United States Patent 11,931,406 (FLAVIVIRUS VACCINE) - sequence listing, part 59

SEQ ID NO: 21017 - RNA, 9867 nt, Artificial Sequence
  derived and/or modified CDS sequence (opt5) from DENV-4__JN638572__SS-prME
agcaccaucacccugcugugccugauucccacggugauggccuuccaccuuuccaccagagacggagagccucugaugaucgucgcuaagcaugaacgggggagaccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucugccugggugauguaugggaccugcacacagagcggagagagacggagagaaaagagauccgucgcucucacaccccacucuggcauggggcuggagacacgggccgaaaccuggaugagcuccgagggagccuggaaacaugcucaacgcguggagucuuggauccuuagaaauccuggcuucgcccugcucgcuggcuuuauggccuacaugaucgggcagacgggcauucagcggacaguuuucuuuauccugaugaugcuuguggcccccagcuauggcaugcgcugugucggggugggaaacagagauuucguugaaggcguguccgggggagccugggucgaccuggugcucgagcacggcggcugcgugaccacaauggcucaggggaagccuacccuggauuuugaacugauuaagaccacagccaaagaggucgcucuccugcggacguacuguaucgaagccagcauuucuaauaucaccacagcgacccgcugcccgacacaaggagagcccuaucuuaaggaggaacaggaccagcaguacauuuguagacgggauaugguugaccgcggcugggggaacggaugcggccuguucgggaaaggaggcguggugaccugcgccaaguuuuccugucucggcaaaaucacggggaaucugguccaaaucgagaaccuugaauauacagugguugugaccguccauaauggagauacccacgcugugggcaacgacacaagcaaucacgggguuaccgccacaauuacgccuagaucucccuccguggaggucaagcugccugaauacggagagcucacccuggauugcgagccccggagcggcaucgacuucaacgaaaugauucugaugaagaugaaaacaaagaccuggcucgugcauaaacagugguuucuggaccuuccgcugccuuggacaaccggggcugauacgcucgagguccacuggaaucauaaggaaagaauggugaccuucaaaguuccccacgccaagcgccaggacgugacaguccugggcucucaggagggagccaugcacuccgcucuugcgggcgccaccgaaguggauagcggggacggaaaccauauguuugcuggccaccugaaauguaagguucggauggagaagcucagaaucaaagggauguccuacacaaugugcucuggaaaguucagcauugauaaagagauggccgaaacccaacauggcacgacaguggucaaggugaaauaugaggggaccggcgccccuuguaaggugcccaucgaaauccgcgacguuaauaaggagaaagucgugggacggauuaucuccagcacacccuucgcugagaacaccaacucugugaccaauauugaacuggagccuccguuuggcgauuccuacaucgucauuggggugggagacggcgcccugacacuccacugguucagaaaggggagcucuaucggaaaaauguuugaaagcacguaucgcggcgcgaagcggauggcuauccugggggagaccgccugggauuucggcuccguuggaggccuucugacaucucucgggaaagccgugcaucaggucuuuggaagcguguacaccacaauguucggcgggguuuccuggauggugcgcauucugaucggacugcuuguccucuggauuggcaccaacagccgcaauacgucuauggcuauguccugcaucgccguugggggaauuacacuguuucugggauucaccgugcacgcugacaugggcuguguggucagcuggucugggaaggaacucaagugcggauccggcguguuugugaucgauaacguccacaccuggacagagcaguauaaauuccaacccgagagcccugcccggcuggcguccgccauucuuaaugcucauaaggaagggguuuguggaaucagaucuaccacacgccuggagaacgugauguggaaacagaucacgaaugaacucaacuacgugcugugggagggcggccacgaccugaccgucguggccggggacguuaagggagugcuuagcaaaggcaagcgggcucucgcgcccccugucaaugaucugaaguauuccuggaaaacaugggggaaggcgaaaauuuuuacccccgaaacaagaaacucuaccuuccugguggacggaccggauacgagcgagugcccuaaugagcggcgcgccuggaacuuucucgaaguugaggacuacggcuucgggauguucaccacaaauaucuggaugaaguuuagagaaggauccagcgaggugugugaucaucggcugaugucugcugccauuaaagaccagaaggcuguccacgccgauaugggcuacuggaucgaauccagcaaaaaccagaccuggcaaauugagaaggccucucuuaucgaggugaagacaugccuguggcccaaaacccacacacucugguccaauggcguucuggaaagccagaugcugaucccuaaggcuuaugcggggcccauuucucagcauaacuacagacagggauaugccacccaaacggcuggcccuuggcaccuugggaaacucgagaucgacuucggagaaugccccggcacaaccgugaccguccaggaggauugugaccaucgcgggccgagccugcggacaaccacggccuccggaaagcuggugacacaguggugcuguagaagcugcaccaugccuccccuccgcuuucugggcgaggauggcuguugguacgggauggaaauuagaccccuuaacgagaaagaagagaauauggugaagucucaggucuccgccggacaaggcacaagcgaaaccuucuccauggggcugcucugccugacacuguuuguugaggagugucuucggcgcagagugacccggaagcacaugauccucguggucgugacgacccugugcgcuauuauccugggaggccucacauggauggaccugcuucgcgcccugaucaugcucggggauaccaugucuggaagaaugggcggccagauucaucuggcgaucauggcuguuuucaaaaugagcccuggguaugugcugggaauuuuucuucggaagcugacaucccgcgaaaccgcccucauggucaucggcauggccaugacgacagugcuggcuauuccgcacgaccucauggaguucaucgacgggaucucucugggacuuauucugcucaaaaugguuacccacuuugauaacacacaggugggcacccuggcccuggcgcuuaccuucaucaagagcacaaugccccuggucauggcuuggagaacgauuauggccgugcucuuugucgugacccugaucccucucugucggacauccugccugcagaaacaaucucauuggguugaaauuaccgcccuuauccugggggcucaggcccuccccguguaccugaugacacugaugaagggagcuagcaagcgcuccuggccucuuaaugagggcauuauggccgucggccuggugagccuccuggggucugcgcuccugaaaaacgacguuccccuugccggaccuaugguggcuggcgggcugcugcucgccgcuuaugucauguccggaagcucugccgaucugucccuugaaaaggccgcuaaugugagaugggacgagauggcggauaucaccggcagcucucccaucauugaggugaaacaggacgaagauggguccuucagcauccgggacguugaggaaacgaacaugauuacacugcucgucaagcuggcccucaucaccguguccggacuguacccgcuugcuauuccugugaccaugacacugugguacauguggcaagucaaaacccagagaagcggcgcccugugggaugugcccucuccugccgcugcccagaaggcgacacucacggagggcguuuaucgcaucaugcagcgggggcuguuuggaaagacccaagugggcgucgggauccacacagaaggaguguuccauaccauguggcacguuacaagaggcagcgugauuugucaugaguccgggcgccuugagcccucuugggcugacguccggaaugauaugaucagcuacggaggcggcuggagacugggggacaaaugggauaaggaagaggacgugcagguucucgccauugaaccgggcaaaaacccuaagcacgugcagaccaaacccggccuguucaagacgcucaccggggagaucggagccgucacacuggacuuuaaaccuggcaccuccgggucucccauuaucaaucgcaagggcaaggugaucggacuuuauggcaacgggguggucacaaaaagcggagauuacguuuccgcuauuacccaggccgagcggaucggcgaacccgacuaugagguggaugaagacauuuucagaaagaaacgccugacaaucauggaucugcacccuggggcgggaaagacgaaacggauucucccgucuaucgugagagaggcucugaagcggcgccuuagaacccugauucucgcccccacacgggucguggccgcugaaauggaggaggcccugcgcggccucccuaucagauaccaaacccccgcuguuaagagcgaacauaccgggcgggagaucguggaccugaugugccacgccacauuuacgaccagacuucuguccagcacacgcgucccuaauuauaaccugauugugauggaugaagcgcauuucaccgaccccucuuccguugccgcucggggcuacaucagcacaagaguggagaugggagaagccgcugccauuuuuaugaccgccacgccuccgggcacaaccgaucccuucccucagucuaauucccccaucgaggacauugagcgcgaaaucccugagcggagcuggaacaccggguuugauuggaucacagacuaccagggaaaaaccgucugguucgugcccuccauuaaggcuggcaaugacaucgcgaacugccucagaaaaucugggaagaaagucauucagcugagccgcaagacauuugauaccgaauauccgaagacgaaacuuacagacugggauuucgugguuaccacagacaucuccgagaugggagccaacuuucgggcuggcagagugauugauccucgcagaugucugaagcccgugauccucaccgacgggcccgaacgggucauccuggccggcccuauucccguuacgccugccagcgcugcccaacgcagaggacggaucggccgcaauccggcgcaggaggaugaccaguacguguucucuggggauccccugagaaacgacgaggaucacgcucacuggaccgaagccaaaaugcuccuugacaauauuuauacaccugagggaaucauucccacccuguucggcccugaacgggagaagacacaagccaucgauggggaguuuagacugcgcggagaacagcggaaaaccuucguggagcucaugagacgcggcgaccugcccgucuggcuuuccuacaagguggcuagcgccggcauuucuuauaaggaccgggaauggugcuuuacaggggagagaaacaaucagauccuggaagagaacauggagguugaaaucuggacccgggagggagagaaaaagaaacuccgcccgaaguggcuggaugcgagaguguacgccgacccuauggcucugaaagauuucaaggaguuugccagcggccggaaguccauuacgcucgacauccuuacagaaauugcuucucugcccaccuaucugagcucccgcgccaaacucgcucuggauaauaucgucaugcuucauaccacagagagagggggaaaggccuaccagcacgcgcugaacgagcucccugaaucucuggagacccugaugcucguggcccuucugggcgcuaugacagccgggauuuuccuguuuuucaugcaaggaaaaggcaucggcaagcucagcauggggcugaucgcuauugccgucgccuccggacuucuguggguggcugaaauccagccccaguggauugcggccagcaucauucucgaguuuuuccugaugguucugcucgugccugaacccgagaaacagcggacgccgcaagacaaucagcuuaucuacgucauccugaccauucugacaaucauugcucucguggccgccaacgagaugggccugaucgaaaagaccaaaacagauuuuggguucuaucagguuaaggcugagaccacgauucuugacguggaucugcgcccugccucugcguggacccucuacgccgucgcuacaaccauccugacacccaugcugagacauaccauugaaaauacguccgccaaccucagccuugcugccaucgcgaaucaggccgcugugcugaugggacugggcaagggguggccccuccaccggauggaccugggagugccucuucuggccaugggcuguuauucccaaguuaacccgacaacccucacagcuucucuggucaugcugcucgugcauuacgccaucauuggccccgggcuucaggcuaaagccacccgcgaggcgcagaagagaaccgccgcuggaaucaugaaaaauccuacaguggauggcauuacggucaucgaccuggagcccauuagcuaugauccuaaguuugaaaaacagcuggggcaaguuaugcuccuggugcuuugcgugggacagcugcuccugaugcggaccacaugggcccugugugagguccucacccuugcuacaggccccaucaugacccugugggaagggaacccuggaagauucuggaacacgacaaucgccguguccaccgccaauauuuuccgcggcucuuaccuggcgggcgcugggcucgccuuuagccugaucaagaacgcucagaccccgcggagaggaacaggcaccacaggggagacgcuuggagaaaaguggaaacgccaacucaauucccucgaccggaaggaguucgaggaauauaaaagaagcggcauucuggagguugaccgcaccgaagccaagucugcccugcgggauggguccaaaacaaagcacgcugugagcagaggaucuuccaagauccgcuggauugucgagcggggcaugaucaaacccaagggcaaagugguugaccucgggugcggaagaggcggguggagcuacuacauggccacccuucagaacgugacagaagucaagggauauaccaaaggcgggccuggacacgaggagcccaucccuauggcgacguacggcuggaaucuggugaagcugcauucuggcguggaugucuuuuauaagcccaccgaacagguugacacacuccugugugauauuggggagagcuccucuaacccgaccaucgaagagggacgcacacuucgggugcugaaaaugguggaaccuuggcucagcuccaagcccgaguucugcauuaaaguccugaaucccuacaugccuaccgugaucgaggaacuggagaagcuccagagacgcuauggcgggagccuuguuagauguccccugucccggaacucuacacacgaaauguacugggugagcggagucuccggcaauauugugucuagcguuaacaccacguccaaaaugcugcucaaucgcuuuacaaccagacaucggaagccuaccuaugagagagacgccgaucugggggcuggaacacggucugugagcacggagaccgaaaaaccggacaugacaaucauuggccgcagacuucaacggcugcaggaggaacacaaggagaccuggcacuacgaucaugaaaaccccuaccgcacaugggccuaucacggcuccuacgaggcuccuagcaccgggucugccuccagcauggucaauggagugguuaagcuccugacaaaacccugggacguggucccuauggugacccagcuggcgaugacggauaccacacccuucggccagcaaagagucuuuaaggagaaaguggacacccggacaccgcagccuaagcccgggacccgcguugugaugacgacaaccgccaacuggcucuggacacugcuuggacgcaaaaagaauccucggcugugcacccgcgaagaguucaucucuaaggucagauccaacgcugccaucggcgcuguguuucaggaggaacagggguggacgagcgccucugaagcugugaaugacucccgguucugggagcucguugauaaagagcgcgcccugcaucaagaaggcaagugugagagcugcguguauaacaugaugggaaaaagagaaaagaaacuuggcgaguuugggcgggcgaagggaucccgcgccauuugguacauguggcugggcgcuagauuccucgaauuugaggcccugggguuccugaacgaggaccacugguucggacgggaaaauagcuggucuggcgucgagggggaaggccuccauagacugggauauauccuugaggauauugacaagaaagauggcgaccugaucuacgcugaugacaccgccgggugggauacacgcauuaccgaggacgaucuccugaacgaagaacuuaucacagaacagauggcgccccaccacaaggugcuggcgaaagcuaucuuuaagcucaccuaucagaauaaaguugugaagguccugcggccuacacccaagggagccgugauggacauuaucagcagaaaagaucaacgcggcuccgggcaggucggaaccuacggccugaacacguucacaaauauggaggugcagcucauucggcagauggaagccgaggggguuaucaccagagacgacaugcauaacccgaagggccugaaagagcgcguggaaaaguggcuuaaagagugcggagucgaucggcugaagagaauggcuauuucuggcgacgauugugugguuaaaccucucgacgaacgcuuuagcaccucccugcuuuuccugaaugauauggggaaggugcggaaggacaucccccaaugggagcccucuaaaggauggaagaacuggcaggaagucccuuuuugcagccaccauuuccacaaaaucuuuaugaaggauggcagaucccucguggugccgugucgcaaucaggacgagcugauugggcgggccagaaucucucagggagcuggcuggagccugcgggagacagccugccucgggaaagcguacgcccaaauguggucccugauguauuuccacagacgcgaucuucggcuggcuagcauggccauuuguucugcuguucccaccgaaugguuuccuacauccagaacgaccuggagcauccaugcccaccaucaguggaugacaaccgaggacaugcucaaggucuggaaccgcguguggauugaagauaaucccaacaugacagacaagaccccugugcacucuugggaggacauccccuaccugggcaaaagagaagaucuuuggugcggaucccugaucggccucagcucccgggcgacgugggccaagaauauucauaccgcuaucacacagguccgcaaccugauugggaaagaggaguauauggacuacaugccugugaugaagagauauucugcccccagcgaauccgagggaguucuguga

SEQ ID NO: 21018 - RNA, 9867 nt, Artificial Sequence
  derived and/or modified CDS sequence (opt5) from DENV-4__JX024757__SS-prME
agcacaaugacacugcugugccugauccccacggugauggccuuccaucuuuccaccagagacggcgaaccucugaugauuguggcuaagcaugaacgggggcgcccgcuccuguuuaagacaaccgaaggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguauugaagcuagcaucucuaauauuaccacagccacccgcugcccgacgcaaggagagcccuaucuuaaggaggaacaggaccagcaguacaucuguagacgggaugugguggaccgcggcugggggaacggaugcggccuguucgggaaaggaggcgucgugacaugcgcgaaguuucucuguuccggcaaaauuaccgggaaucugguucaaaucgagaaccuugaauauaccguggucgugacaguucauaauggagauacccacgccgugggcaacgacacaagcaaucacggggucacggcuaccauuacaccuagaucucccuccguggaggucaagcugccugauuacggagaacucacccuggacugcgagccccggagcggcaucgacuucaacgagaugauccugaugaagaugaaaaagaaaacauggcucgugcauaagcagugguuucuggaucuuccgcugccuuggucugccggggcugacaccuccgaaguucacuggaauuacaaagagagaauggugacguucaaggucccccaugccaaacgccaggaugugaccguucucggcagccaggaaggagccaugcacuccgcucuggcgggcgccacagagguggacucuggggauggaaaccacauguuugcuggccaucuuaaguguaagguccggauggaaaaacugagaauuaaggggaugagcuauaccaugugcuccggaaaauucagcaucgacaaggagauggccgagacacaacacggcaccacgguggugaaaguuaaguacgaaggggccggcgcuccuuguaagguccccauugagauccgcgaugugaauaaagaaaagguggucggacggauuaucucuuccacacccuucgccgagaacaccaacagcgugacaaauaucgagcucgaaccuccguuuggcgacucuuauauuguuaucggggugggagauagcgcgcugacccugcauugguucagaaaaggcuccucuauugggaagauguuugagagcaccuaccgcggagcuaaacggauggccauccucggcgaaacagccugggacuucggguccgucggcggacuguuuacgagccuuggcaaggcugugcaccagguuuucgggucuguguauaccacaauguuuggaggcgucuccuggaugauuagaauccugaucggguuccucgugcuguggauuggaaccaacagccgcaauacaucuauggccaugaccugcaucgcuguuggcgggauuacgcuguuucuuggcuucacagugcaggccgauaugggaugugucguguccuggaacggcaaggagcucaaaugcgggagcggaaucuuuguggucgacaauguucauaccuggaccgaacaauacaaguuccagcccgaguccccugcgcggcuggccucugcuauucugaacgcccacaaagacggcgugugugggaucagaagcacaacccgccucgagaaugugauguggaagcagauuacaaacgaacugaauuauguccuuugggagggaggccacgaucugacggugguugcuggcgacgugaaagggguccucaccaagggaaagcgggcccugacacccccugugaacgaucugaaauacuccuggaagaccuggggcaaagcgaagaucuuuacacccgaagccagaaauucuaccuuccuuaucgacgggccggauacgagcgagugcccuaacggacggcgcgcuuggaauuuccucgaaguugaggacuacggcuuugggauguucaccacaaacauuuggaugaaauuuagagagggauccagcgaagugugugaucaucggcugaugucugccgcuaucaaggaccagaaagccguccacgccgauaugggcuauuggauugaguccagcaagaaucaaaccuggcagaucgaaaaggcuucucugauugaggugaaaacaugccucuggcccaagacccauacacugugguccaacggcguucuugaaagccagaugcugaucccuagaucuuacgcggggcccuucagccagcacaacuaucgccaaggauacgccacccagacggcuggcccuuggcaccucgggaaacuggagaucgacuuuggagagugccccggcacaaccgugaccauucaggaagauugugaccaucgggggccgucccugagaacaaccacggccagcggaaaacuugucacacaguggugcugucgcucuugcaccaugccuccccucagauuccugggcgaggauggcuguugguaugggauggaaauccggccccuguccgagaaagaggaaaauauggucaagagccaagugacagccggacagggcaccuccgagacauuuucuauggggcuccugugccuuacccuguucgucgaagagugucuccgcagacggguuacgcgcaaguacaugaugcuggugguggucauuaccuuuugcgcuaucauucugggaggccuuacauggauggaccuccugagagcccugaucaugcucggggacaccaugagcggacggaucggcggccagauucaccuggcgaucauggcuguguucaaaauguccccuggguauguucuuggaguguuucugcgcaagcucacaucuagagaaaccgcccugauggucauuggcauggccaugacgacaguguucagcaucccgcaugaucugauggagcuuauugacgggaucucccugggacucauccugcuccggauuguuacccacuuugauaacacacaggugggcacccuggcucuuucucugaccuucauccgcagcacaacgccccucgucauggccuggagaaccauuauggcgguguucuuugucgugacacugaucccucugugucggaccuccugccuucaaaaacagagccauuggguugagauuacagcucugauccucggggcccaggcccugcccguguaccucaugacccugaugaagggagcuucuagacgcuccuggccucuuaaugaaggcauuauggccgucggccuggugagccuccuggggucugcucugcuuaaaaacgacguuccccuggccggaccuaugguggcgggcgggcuccugcucgccgcuuacgucauguccggaagcucugccgaucugucccuugagaaggcugccaaugugcaaugggacgaaauggccgauaucacgggcagcucccccaucauugaggugaagcaggacgaagaugggagcuucucuauccgggacguugaggagacaaacaugauuacccugcuggucaaacucgcucugaucaccgugagcggacuuuauccgcuggcgauuccugugacaauggcccucugguacaucuggcaggucaagacccagagauccggcgcucugugggaugugcccucuccugccgccacacaaaaagcuacgcucagcgaaggcguuuaucgcaucaugcagcgggggcuguuuggaaagacccaggugggcgucgggauucacauggagggaguguuccacacaauguggcauguuaccagaggcuccgugaucugucacgaaacagggcgccuugagcccucuugggccgacguccggaaugauaugauuagcuacggaggcggcuggagacugggggacaaaugggacaaggaagaggaugugcagguucuggcgaucgagccgggaaagaacccuaaacaugugcaaaccaagcccggccucuuuaaaacgcugaccggggaaauuggagcugucacacuugacuucaagccuggcaccuccgggucucccaucaucaauaaaaagggcaaagugauuggacuguauggcaacgggguggucacaaagagcggagauuacguuuccgccaucacccaggccgagcgcauuggcgaacccgacuaugagguggaugaggacaucuuucggaagaaaagacucacaauuauggaucugcacccuggggcuggaaagacgaaacggauccucccgagcauugugcgcgaagcccugaagagacggcuucgcacccugauccuggcgcccacaagagucguggcugccgagauggaagaggcccuccggggccugccuaucagauaccagacccccgcuguuaaaucugaacauaccgggcgcgagauuguggaccuuaugugccacgccacauucacgacccggcugcucuccagcacaagagucccuaauuacaaccugaucgugauggaugaggcucacuuuaccgaccccugcucuguugccgcgcgcggcuauauuuccacacggguggaaaugggagaggccgcugccaucuucaugaccgcuacgccuccgggcagcauugaucccuuuccucaguccaauucucccaucgaagacaucgagagagaaauuccugagcgcagcuggaacacaggguucgacuggaucaccgauuaccaaggaaagaccgucugguucgugcccuccauuaaggccggcaaugacaucgccaacugucuccggaaaagcgggaagagagucauucagcugucucgcaaaacauuugauaccgaguauccgaagacaaaacuuaccgacugggauuucgugguuacgacagacaucuccgaaaugggagcuaacuuuagagcgggccgggugaucgauccucgcagaugccugaagcccgugauucugaccgacgggcccgagcgggucauccucgccggcccuauucccguuaccccugcuagcgccgcccagcgcagaggacggaucggcagaaauccggcucaagaagaugaccaguacguguucucuggggauccccugaagaacgacgaggaucaugcccacuggaccgaagcgaaaaugcuucuggacaauauuuauacgccugagggaaucauucccacccucuuuggcccugagcgcgaaaagacacaggcuaucgacggggaguuccggcugagaggagaacagcgcaaaaccuuuguggagcugaugcggagaggcgaucuccccgucuggcuuagcuacaagguggccuccgccggcaucucuuauaaagaccgggagugguguuucacaggggaacgcaacaaucaaauucuggaggaaaacauggagguugaaaucuggaccagagagggagagaagaagaaacugcggccgaaguggcucgaugcucgcguguacgccgacccuauggcgcugaaagauuuuaaggaguucgccagcggcagaaaauccauuacacuugacauccugaccgagauugcuacgcuccccacauaccugucuagcaaggccaagcuggcucucgauaauaucgucaugcuucauaccaccgaaaaagggggacgggccuaucagcacgcucugaacgagcugccugaaucccucgagacacugaugcuuguggcccugcucggcgcgcugaccgccgggaucuuucuguucuuuaugcagggaaagggcauuggcaaacucagcauggggcuuaucgcuauugccgucgcuucuggacugcuguggguggccgagauccagccccaauggauugccgcuuccaucauccucgaguucuuccugaugguucuucugauuccugagcccgaaaagcagcgcacaccgcaggacaaucagcucaucuacgugauucugacgauccugaccauuaucggccucauugcggccaacgagauggggcuuaucgagaagacaaagaccgauuuuggauucuaucaagucaaaacagagaccacgauccuggacguggaucugagaccugcuagcgccuggacccucuacgccguugcuacaaccauucugacacccaugcuucggcacaccaucgagaauacguccgccaaccugucucucgcggccauugcuaaucaggccgcugugcugaugggccuggggaagggauggccccuccaucgcauggaccuuggcgucccucugcuggccaugggcugcuauagccaggugaacccgacaacccucacagcgucccuggugaugcuucugguucacuacgccaucauugggcccggacuccaggcuaaggccaccagagaagcucaaaaacggaccgccgcuggcaucaugaagaauccuacagucgaugggaucacggugauugaccuggagcccaucucuuaugacccuaaauuugaaaagcagcugggacaggugaugcuccuuguccuguguguuggccaacugcuccugaugagaaccacaugggcccuuugcgaggugcugacccucgcgacagggcccauuaugacccugugggagggaaacccuggccgcuucuggaacacgacaaucgccgugagcaccgcuaauauuuuucggggcuccuaccuggccggggcuggacucgccuucagccuuaucaaaaacgcccagaccccgagacgcggcacagggaccacaggagaaacgcugggcgagaaguggaagcggcagcucaauucucucgauagaaaagaauuugaggaauacaagcgcuccgggauccuggaggucgaccggaccgaggcgaaaagcgcucuuagagauggaucuaagauuaaacaugccgugucccgcggcagcucuaagauccgguggauuguugaaagaggcaugaucaagcccaaagggaagguggucgaccugggauguggccgcgggggauggagcuauuacauggcuacacucaaaaacgugaccgagguuaagggcuauacaaaagggggaccuggccacgaagaacccauuccuauggccaccuacggcuggaaucuggugaagcugcauuccggggucgauguguucuauaagcccacggaacagguggacacccuccuuugcgauaucggagagucuagcuccaacccgacaauugaggaaggccggacccugagaguccugaaaaugguugagccuuggcucagcuccaagcccgaauuuuguaucaaagugcugaaucccuacaugccuacagugaucgaggaacuugagaagcugcaacgcagacacgggggaucucucguccggugcccccugagccgcaacuccacccacgagauguauugggugucuggcgccagcgggaauauuguuuccucugugaacacaaucagcaaaaugcugcucaauagauucaccacgcggcauagaaagccuacauacgaaaaagacgucgaucuuggagcuggcacccgguccgugagcaccgagacagaaaagccggacaugacgauuaucggccgcagacugcagcggcugcgcgaggagcacaaggaaaccuggcauuacgaucaggagaaccccuauagaacaugggccuaccacgggucuuaugaagcgccuuccaccggaagcgccucuuccaugguuaauggcguggucaaacuccugacaaagcccugggacgugauuccuaugguuacccagcuugcuaugacagacaccacgcccuuugggcaacagcggguguucaaagagaaggucgauacccgcacaccgcagccuaaacccggaaccagaaugaucaugacaaugaccgccaacuggcugugggcucuccugggcaagaagaaaagcccucggcuguguacgcgcgaagaguuuaucucuaaggugagauccaaugccgcgauuggggccgucuuccaggaggaacaaggcuggacaagcgcuuccgaggccgugaacgacagccgguucugggaacucguugauaaagagcgcgcucugcaccaggaaggaaagugcgagucuugcguguacaauaugaugggcaaaagagagaagaaacuuggggaauuuggacgggccaaaggcagccgcgcuaucugguauauguggcugggggccagauuccucgaguuugaagcgcugggauuccuuaacgaggaccauugguuuucccgggaaaacucuuggagcggcgucgagggggagggccugcacagacucggauacauucuggaagauaucgacaagaaagauggcgaccugauuuaugccgaugacaccgcugggugggauacacgcaucaccgaggacgaucuccugaaugaggaacuuaucacggagcagauggcuccccaccacaagacccuggccaaagccauuuucaagcucacauaccaaaacaagguggugaaaguucugcggccuacccccaagggagccgugauggacaucauuuccagaaaagaccagcgcggcucugggcaggucggaacauacggccuuaauaccuuuacaaacauggaagugcagcugauccggcaaauggaggcggaagggguuauuacccaggaugacaugcagaauccgagaggccucaaggagcgcguggaaaaauggcugaaggaguguggagucgaucggcugaaaagaauggcuaucagcggcgacgauugcguggucaagccuaucgacgagcgcuucuccacgucucuccuguuucuuaacgauauggggaaggugcggaaagacauuccccagugggaacccagcaagggauggaaaaauuggcaagagguuccuuucuguucccaucacuuucacaagaucuucaugaaagauggcagaagccugguggucccgugccgcaaccaggacgaacucauugggcgggccagaaucucucagggagccggcuggucccugcgggagacagcuugucuugggaaggccuaugcucagauguggagccugauguacuuucauagacgcgaucuccggcuggccucuauggcgauuugcuccgccgugcccaccgaaugguucccuaccagcagaacaaccugguccauccacgcucaucaccaauggaugacaacggaggacaugcugaagguuuggaaucgcguguggauugaggacaaccccaauaugaccgauaaaacaccuguccacucuugggaagacauccccuaucucggcaagagagaggaucugugguguggaagccuuaucggccuguccagccgggccaccugggcuaaaaacauucauacagccaucacccaggugcgcaaucucauugggaaggaagaguacguggacuauaugccugcgaugaaaagauacucugcccccuucgaauccgagggaguucuguga

SEQ ID NO: 21019 - RNA, 9867 nt, Artificial Sequence
  derived and/or modified CDS sequence (opt5) from DENV-4__JF741967__SS-prME
agcaccaugacacugcucugccugauccccacggugauggccuuccaccuuuccaccagagacggcgagccucugaugauugucgcuaagcaugaacgggggcgcccgcuccuguuuaaaacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguauugaagcuagcaucucuaauauuaccacagccacccgcugcccgacgcaaggagagcccuaucuuaaggaggaacaggaccagcaguacaucuguagacgggaugugguggaccgcggcugggggaacggaugcggccuguucgggaaaggaggcgucgugacaugcgcgaaguuucucuguuccggcaaaauuaccgggaaucugguucaaaucgagaaccuugaauauaccguggucgugacaguucauaauggaaacacccacgccgugggcaaugauacaagcaaccacggggucacggcuaccauuacaccuagaucucccuccguggaggucaagcugccugacuacggagaacucacccuggauugcgagccccggagcggcaucgacuucaaugagaugauccugaugaagaugaaaaagaaaacauggcucgugcauaagcagugguuucuggaccuuccgcugccuuggaccgccggggcugauacgucugaaguucacuggaacuacaaagagagaauggugaccuucaaggucccccaugccaaacgccaggacgugacaguucucggcucccaggaaggagccaugcacagcgcucuggcgggcgccaccgagguggauuccggggacggaaaucacauguuugcuggccaucuuaaguguaagguccggauggaaaaacugagaauuaaggggaugucuuauacaaugugcagcggaaaauucuccaucgauaaggagauggccgagacccaacacggcacgacaguggugaaaguuaaguacgaaggggccggcgcuccuuguaagguccccauugagauccgcgacgugaacaaagaaaagguggucggacggauuaucagcucuacccccuucgccgagaacacaaauuccgugaccaacaucgagcucgaaccuccguuuggcgauagcuauauuguuaucggggugggagacucugcgcugacccugcauugguucagaaaaggcagcuccauugggaagauguuugagucuacauaccgcggagcuaaacggauggccauccucggcgaaacggccugggauuucgggagcgucggcggacuguuuaccucccuuggcaaggcugugcaccagguuuucgggagcguguauacaaccauguuuggaggcgucucuuggaugauuagaauccugaucggguuccucgugcuguggauuggaacaaauucccgcaacaccagcauggccaugacgugcaucgcuguuggcgggauuacacuguuucuuggcuucaccgugcaggccgacaugggaugugucgugucuuggaauggcaaggagcucaaaugcggguccggaaucuuuguggucgauaacguucauaccuggacagaacaauacaaguuccagcccgagagcccugcgcggcuggccuccgcuauucugaaugcccacaaagacggcgugugugggaucagaucuaccacacgccucgagaacgugauguggaagcagauuacgaaugaacugaacuauguccuuugggagggaggccacgaccugaccgugguugcuggcgaugugaaagggguccucacaaagggaaagcgggcccugacccccccugugaaugaccugaaauacagcuggaagacauggggcaaagcgaagaucuuuacccccgaagccagaaacuccacguuccuuaucgaugggccggacaccucugagugcccuaaugaacggcgcgcuuggaacuucuuugagguugaggauuacggauucggcauguuuacaaccaauauuuggaugaaauucagagaagggagcuccgaggugugugaccaucggcucaugagcgccgcuaucaaggaucagaaagccguccacgccgacaugggauauuggauugaaucuuccaagaaccaaacauggcagaucgagaaggcuagccugauugaagugaaaaccugccuguggcccaagacacauacccucuggucuaacggcguucuggagucccagaugcuuaucccuagaagcuacgcgggccccuuuucucagcacaauuaucgccaaggguacgccacgcagacagcuggaccuuggcaccugggcaaacucgagaucgauuucggggaaugccccggaaccaccgugacaauucaggaggacugugaucaucggggcccgagccugagaaccacgacagccuccgggaagcuggucacccaguggugcugucgcagcugcacaaugccuccccuuagauuucucggagaagacggcuguugguauggcauggagauccggccccugucugagaaagaagagaacauggugaagucccaagugaccgccgggcagggaacaagcgaaaccuucuccaugggccugcucugccugacgcuuuuugucgaggaaugucugcgcagacggguuacccgcaagcacaugauucucgcuguggugaucacauucugcgccauuauccuggggggacugaccuggauggaucuucucagaguccugaucaugcugggcgacacaaugucugggcggauuggaggccagauccaucucgcgauuauggcuguguuuaaaaugagcccuggcuacguucuggggguguuccuucgcaagcugaccuccagagagacggcccucauggucaucggaauggccaugacaaccguguuuucuauuccgcacgaccugauggagcugaucgauggcaucagccuugggcugauucuccugaaaaucguuacacauuucgacaauacccaggugggaacccucgcucugucccuuacauucauucggucuacgaccccccuggucauggccuggcgcacaaucauggcgguguuuuucgucgugacccucauuccucuguguagaacaagcugccugcaaaagcagucccacuggguugaaaucaccgcucuuauucugggcgcccaggcccuccccguguaucugaugacgcucaugaaaggggcuagccggagaucuuggccucugaacgagggaaucauggccgucggccuugugucccugcucggcagcgcucugcugaagaaugauguuccccuugccgggccuaugguggcgggaggccugcuccuggccgcuuacgucaugucuggguccagcgccgaccucucucuggaaaaggcugccaacgugcaaugggaugagauggccgacaucacaggauccagccccauuaucgaagugaaacaggaugaggacggcuccuuuagcauucgcgagguugaagagaccaauaugaucacccuucuggucaagcuggcucucauuacagugucugggcuguacccgcuugcgaucccugugaccauggcccugugguaugucuggcaggugaaaacacagcggagcggagcucucugggauguucccuccccugccgccacgcacaaggcuacccugucugaaggcguguacagaaucaugcaacgcggccucuucgggaaaacacaggucggagugggcauucauauggaggggguuuuucacaccgugggacaugucacacggggcagcgugaucugucacgaaaccgggagacuggagcccuccuggggagacguucgcaacgauaugauuucuuauggcggcggguggcggcuuggagacaagugggauaaggaggaagacgugcagguccuggccaucgagccgggcaaaaauccuaagcaugugcagacgaaacccgggcuguucaagacccucacaggagaaauuggcgcggugacccuggacuuuaaaccugggacaagcggcucccccaucaucaacaagaaaggaaaggucauuggccuuuacgggaauggaguugugaccaagucuggcgauuaugugagcgcuaucacacaagccgagagaauuggggagcccgacuacgaagucgaugaggacaucuuccgcaaaaagcggcugacgauuauggaucuccacccuggagccggcaaaaccaagagaauccugccguccauugugcgggaagcucucaaacgcagacugcggacacuuauccuggcccccacccgcguuguggcggcugagauggaagaggcccugagagggcucccuauccgguaucagacccccgccgucaagagcgagcacacaggcagagaaauuguggaccugaugugccaugcuacguuuaccacacgccuucugucuuccacccggguuccuaacuacaaucucaucgugauggaugaggcccacuucacagaccccugcagcgucgcugccagaggauacauuucuacccgcguggaaaugggcgaggcggccgcuaucuuuaugacggccacaccuccgggguccauugaucccuucccucagagcaacucccccaucgaagacaucgagcgggagauuccugaaagaucuuggaauaccggauucgauuggaucaccgacuaucagggcaagacagucugguuugugcccagcauuaaagcugggaacgacaucgccaacugucugcgcaaguccggaaaacggguuauucaacucagcagaaagaccuucgauacagaguacccgaaaaccaagcugacggacugggauuuuguggugacaaccgacaucucugaaaugggcgccaauuuccgcgcugggagagucaucgauccucggcgcugccuuaagcccguuauucugacagacggccccgagagagugauccuggcgggaccuauucccgugaccccugccuccgcugcccagcggcgcggcagaaucgggcggaacccggcccaggaagaugaccaauaugucuuuagcggagauccccucaaaaaugacgaggaucaugcucacuggacggaggccaagaugcugcuugacaacauuuacaccccugaaggcaucauucccacacuguucgggccugagagagaaaaaacccaggcgaucgauggagaguuucgccuccggggcgagcagagaaagacauucguggaacugaugcgccggggcgaccugcccguuuggcucucuuauaaaguggcuagcgccgggaucuccuacaaggacagagagugguguuuuaccggagaacggaauaaccagauucuugaggaaaauauggaggucgagaucuggacacgcgaaggcgagaagaaaaagcugagaccgaaauggcuggaugcccggguguaugcugacccuauggcccucaaggauuucaaagaauuugcgucugggcgcaagagcauuacccuggacauccuuacggagauugccacacugcccaccuaccucuccucuaaggcuaaacuggcccuggauaacaucgucaugcuccacaccacagaaaagggaggcagagcuuaccaacaugcccuuaaugagcugccugagagccuggaaacccucaugcugguggcucuucugggggccaugacagcgggaaucuuccucuuuuucaugcagggcaaaggcauugggaagcuguccaugggacugaucgccauugcuguugccagcggccuccuuuggguggcugagauccagccccaguggauugccgccucuaucauccuggaauucuuucugaugguccuccugauuccugagcccgaaaaacaacggacgccgcaggacaaccagcuuaucuaugugauucugaccauccucacaauuaucgggcugauugcugcgaaugagaugggacugaucgagaagaccaaaacagauuucggcuuuuaccagguuaagccugaaaccacgauccucgacguggaucuucgccccgccuccgcuuggacccuguaugccgucgccacaaccauucugacacccaugcucagacacaccaucgagaacacgagcgcuaaucugucccuugccgcgauugccaaccaagcugccgugcugauggggcucggaaagggcuggccucugcaucggauggaccugggcgugccgcuccuugcuauggggugcuacucucagguuaaucccacaacccugacagccagccuggucaugcuccuggugcacuaugcgaucauuggaccuggccuucaggccaaagcuacccgcgaagcccagaagagaaccgcugccgggaucaugaaaaaccccacaguggauggaaucacggucauugaccuggagccuaucuccuacgaucccaaguucgagaaacaacucggccagguuaugcugcuggugcucuguguggggcagcuucugcugaugcggaccacaugggcucucugcgaaguccugacccuugccacaggaccugugaugacccugugggagggcaacccgggcagauuuuggaauacgacaauugcgguuucuaccgccaacaucuuccgcgggagcuaucucgcuggagccggccuggcuuuuucccugauuaagaaugcccaaaccccccggagagggacaggaaccacaggcgaaacgcucggggagaaguggaaacgccagcuuaacagccuggaccggaaggaauucgaggaguacaaaagaucuggaauccuggaaguggaccgcaccgaggccaaguccgcgcuccgggauggcacaaaaaucaaguacgcugucagcagaggcucuuccaagauucgcuggaucguggaacgggggaugauuaaaccuaagggaaaaguuguggaccugggcugugggagaggaggcuggagcuauuacauggccacccuuaagaaugucacagaggugaaaggguauaccaagggaggccccggccaugaagagccuauccccauggcuacguacggguggaaccuggugaagcuccacucuggagucgauguuuuuuauaaaccgaccgagcagguggacacacugcugugcgauauuggcgaaagcuccucuaauccuaccaucgaggaagggcgcacacuccgggugcuuaagauggucgagcccuggcugagcuccaaacccgaauucuguauuaaggugcugaacccuuacaugcccaccguuaucgaggagcucgaaaaacugcagagacgccacggaggcagccuugugagaugcccucugucccggaauucuacacaugagauguauugggucagcggggccuccggaaacaucgugucuagcguuaauaccauuuccaagaugcuccugaaccgcuuuacgacaagacaccggaaaccgaccuacgaaaaggacguggaucugggcgccggcaccagaucugucagcacagagacggagaagcccgacaugaccgugaucgggcggcgccuccaaagacuucgggaagagcauaaagaaacauggcacuacgaucaggagaauccuuaucgcaccugggcuuaccacggauccuaugaagcccccagcacaggcucugcguccagcaugguuaacgggguggucaagcugcugaccaaaccuugggacgugauucccauggucacacagcucgccaugaccgauacgaccccguucggacagcaaagaguguuuaaggagaaaguugacacacggaccccucagcccaagccuggcacacgcaugaucaugaccacgacagcuaauuggcugugggcccuucuggggaagaaaaagucucccagacucuguacccgggaggaauucauuuccaaagugcgcagcaacgcugccaucggcgcggucuuccaggaggaacagggauggacaucugccuccgaggcugugaaugacagcagauuuugggaacugguggauaaggagcgggcccugcaucaagagggcaaaugcgaauccugcguuuacaacaugauggggaagcgcgagaagaaacucggagaauucggcagagcuaaggggagccgggccaucugguauauguggcugggagcucgcuuucuugaguucgaagcccugggcuuucucaacgaggaccacugguucucuagagagaauagcugguccgggguggaaggcgagggacugcaucggcuuggcuacauucuggaagauaucgacaaaaaggauggggaccucauuuaugcggaugacaccgccggaugggauacgagaaucaccgaggacgaucugcugaacgaggaacucauuacagagcagauggcuccucaccauaaaacccuggccaaggcuaucuuuaagcuuacauaccagaauaaagucgugaagguucugcgccccaccccgaaaggcgccgugauggacaucauuucucggaaggaucaaagagggagcggacaggucggcacauacgggcucaacaccuucacgaauauggaagugcagcugauccgccagauggaggccgaaggcgucauuacacaagacgacaugcagaacccuaaaggacuuaaggagcggguggagaaauggcugaaggaauguggcguugauagacucaagcgcauggcgaucuccggggacgauugcguggucaaaccccuggacgagcgguuuucuaccagccugcucuuccugaaugauaugggaaaggugagaaaagacauuccccagugggaaccuuccaagggcuggaaaaacuggcaggagguuccguuuuguucucaccacuuccauaagaucuuuaugaaggaugggcgcagccuugugguccccugccggaaucaagacgaacugaucggaagagcucgcauuucccagggcgccggguggagccuccgggagaccgccugucugggcaaagcuuaugcccagauguggucucuuauguacuuccacagacgggaucugagacucgcuuccauggccaucugcagcgcggugccuacagagugguuccccaccucucgcacaacgugguccauucaugcccaccaccaguggaugaccacagaagacaugcugaagguguggaaccggguuuggaucgaggauaauccuaacaugaccgacaaaacacccguccauagcugggaagacauuccuuaucugggaaagagagaggaucucugguguggcucccugaucgggcuuucuagccgcgcuaccugggccaaaaauauucacacggcuaucacccaagugagaaaccugaucggaaaggaagaguacguggacuauaugcccgccaugaagcgguacuccgcgccguuugagagcgaaggcguccucuga

SEQ ID NO: 21020 - RNA, 9867 nt, Artificial Sequence
  derived and/or modified CDS sequence (opt5) from DENV-4__JQ822247__SS-prME
agcaccaugacacugcucugccugauccccacggugauggccuuccaccuuuccaccagagacggcgagccucugaugauugucgcuaagcaugaacgggggcgcccgcuccuguuuaaaacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguauugaagcuagcaucucuaauauuaccacagccacccgcugcccgacgcaaggagagcccuaucuuaaggaggaacaggaccagcaguacaucuguagacgggaugugguggaccgcggcugggggaacggaugcggccuguucgggaaaggaggcgucgugacaugcgcgaaguuucucuguuccggcaaaauuaccgggaaucugguucaaaucgagaaccuugaauauaccguggucgugacaguucauaauggaaacacccacgccgugggcaaugauacaagcaaccacggggucacggcuaccauuacaccuagaucucccuccguggaggucaagcugccugacuacggagaacucacccuggauugcgagccccggagcggcaucgacuucaaugagaugauccugaugaagaugaaaaagaaaacauggcucgugcauaagcagugguuucuggaccuuccgcugccuuggaccgccggggcugauacgucugaaguucacuggaacuacaaagagagaauggugaccuucaaggucccccaugccaaacgccaggacgugacaguucucggcucccaggaaggagccaugcacagcgcucuggcgggcgccaccgagguggauuccggggacggaaaucacauguuugcuggccaucuuaaguguaagguccggauggaaaaacugagaauuaaggggaugucuuauacaaugugcagcggaaaauucuccaucgauaaggagauggccgagacccaacacggcacgacaguggugaaaguuaaguacgaaggggccggcgcuccuuguaagguccccauugagauccgcgacgugaacaaagaaaagguggucggacggauuaucagcucuacccccuucgccgagaacacaaauuccgugaccaacaucgagcucgaaccuccguuuggcgauagcuauauuguuaucggggugggagacucugcgcugacccugcauugguucagaaaaggcagcuccauugggaagauguuugagucuacauaccgcggagcuaaacggauggccauccucggcgaaacggccugggauuucgggagcgucggcggacuguuuaccucccuuggcaaggcugugcaccagguuuucgggagcguguauacaaccauguuuggaggcgucucuuggaugauuagaauccugaucggguuccucgugcuguggauuggaacaaauucccgcaacaccagcauggccaugacgugcaucgcuguuggcgggauuacacuguuucuuggcuucaccgugcaggccgacaugggaugugucgugucuuggaauggcaaggagcucaaaugcggguccggaaucuuuguggucgauaacguucauaccuggacagaacaauacaaguuccagcccgagagcccugcgcggcuggccuccgcuauucugaaugcccacaaagacggcgugugugggaucagaucuaccacacgccucgagaacgugauguggaagcagauuacgaaugaacugaacuauguccuuugggagggaggccacgaccugaccgugguugcuggcgaugugaaagggguccucacaaagggaaagcgggcccugacccccccugugaaugaccugaaauacagcuggaagacauggggcaaagcgaagaucuuuacccccgaagccagaaacuccacguuccuuaucgaugggccggacaccucugagugcccuaaugaacggcgcgcuuggaacuucuuugagguugaggauuacggauucggcauguuuacaaccaauauuuggaugaaauucagagaagggagcuccgaggugugugaccaucggcucaugagcgccgcuaucaaggaucagaaagccguccacgccgacaugggauauuggauugaaucuuccaagaaccaaacauggcagaucgagaaggcuagccugauugaagugaaaaccugccuguggcccaagacacauacccucuggucuaacggcguucuggagucccagaugcuuaucccuagaagcuacgcgggccccuuuucucagcacaauuaucgccaaggguacgccacgcagacagcuggaccuuggcaccugggcaaacucgagaucgauuucggggaaugccccggaaccaccgugacaauucaggaggacugugaucaucggggcccgagccugagaaccacgacagccuccgggaagcuggucacccaguggugcugucgcagcugcacaaugccuccccuuagauuucucggagaagacggcuguugguauggcauggagauccggccccugucugagaaagaagagaacauggugaagucccaagugaccgccgggcagggaacaagcgaaaccuucuccaugggccugcucugccugacgcuuuuugucgaggaaugucugcgcagacggguuacccgcaagcacaugauucucgcuguggugaucacauucugcgccauuauccuggggggacugaccuggauggaucuucucagaguccugaucaugcugggcgacacaaugucugggcggauuggaggccagauccaucucgcgauuauggcuguguuuaaaaugagcccuggcuacguucuggggguguuccuucgcaagcugaccuccagagagacggcccucauggucaucggaauggccaugacaaccguguuuucuauuccgcacgaccugauggagcugaucgauggcaucagccuugggcugauucuccugaaaaucguuacacauuucgacaauacccaggugggaacccucgcucugucccuuacauucauucggucuacgaccccccuggucauggccuggcgcacaaucauggcgguguuuuucgucgugacccucauuccucuguguagaacaagcugccugcaaaagcagucccacuggguugaaaucaccgcucuuauucugggcgcccaggcccuccccguguaucugaugacgcucaugaaaggggcuagccggagaucuuggccucugaacgagggaaucauggccgucggccuugugucccugcucggcagcgcucugcugaagaaugauguuccccuugccgggccuaugguggcgggaggccugcuccuggccgcuuacgucaugucuggguccagcgccgaccucucucuggaaaaggcugccaacgugcaaugggaugagauggccgacaucacaggauccagccccauuaucgaagugaaacaggaugaggacggcuccuuuagcauucgcgauguugaggaaaccaauaugaucacccuucuggucaagcuggcucucauuacagugucugggcuguacccgcuugcgaucccugugaccauggcccugugguaugucuggcaggugaaaacacagcggagcggagcucucugggacguucccuccccugccgccacgcaaaaggcuacccugucugagggcguguacagaaucaugcagcgcggccucuucgggaaaacacaggucggagugggcauucacauggaagggguuuuucauaccauguggcacgugacacggggaagcgucaucugucaugagaccggcagacuggaacccuccugggccgaugugcgcaacgacaugauuucuuaugggggaggcuggcggcuuggcgauaagugggacaaggaggaggacguucaggugcuggcgaucgaaccggggaaaaauccuaagcacguccaaacgaaacccggacuguucaagacccucacaggcgagauuggggcugugacccuggauuuuaaaccuggaacaagcggcucccccaucaucaacaagaaagggaaggugauuggccuuuacggaaauggcgucguuaccaagucuggggacuaugugagcgccaucacacaggccgaaagaauuggagagcccgauuacgagguggacgaagauaucuuccgcaaaaagcggcugacgauuauggaccuccauccuggcgcugggaaaaccaagagaauccugccguccauuguccgggaggcccucaaacgcagacugcggacacuuauccuggcgcccacccgcgugguugcugccgaaauggaggaagcccugagaggacucccuauccgguaucagacccccgcugugaagagcgagcacacaggcagagagauugucgaucugaugugccacgccacguuuaccacacgccuucugucuuccacccgggugccuaacuacaaucucaucguuauggacgaagcucauuucacagaucccugcagcguggccgcgagaggguacauuucuacccgcgucgagaugggcgaagccgcugccaucuuuaugacggcuacaccuccgggauccauugaccccuucccucagagcaacucccccaucgaggauaucgaacgggagauuccugagagaucuuggaauaccggcuucgacuggaucaccgacuaucaagggaagacagugugguuuguccccagcauuaaagccggaaacgauaucgccaacugucugcgcaaguccggcaaacgggugauucagcucagcagaaagaccuucgacacagaauacccgaaaaccaagcugacggauugggacuuuguugugacaaccgauaucucugagaugggggcuaauuuccgcgcgggaagagugaucgacccucggcgcugccuuaagcccgucauucugacagauggccccgaaagaguuauccuggccgggccuauucccgugaccccugcuuccgccgcccagcggcgcggcagaaucggacggaacccggcucaagaggacgaucaguauguguuuagcggcgacccccucaaaaaugaugaagaccacgcccauuggacggaggcgaagaugcugcuugauaacauuuacaccccugaggggaucauucccacacuguucggaccugaaagagagaaaacccaggcuaucgacggcgaauuucgccuccggggggagcagagaaagacauucgucgagcugaugcgccggggagaccugcccguguggcucucuuauaaaguugccagcgccggcaucuccuacaaggauagagaaugguguuuuaccggcgagcggaauaaccaaauucuugaagagaauauggaaguggagaucuggacacgcgagggggaaaagaaaaagcugagaccgaaauggcuggacgcucgggucuaugccgauccuauggcgcucaaggacuucaaagaguuugccucuggacgcaagagcauuacccuggauauccuuacggaaauugcuacacugcccaccuaccucuccucuaaggccaaacuggcucuggacaacaucgugaugcuccacaccacagagaagggcgggagagccuaccagcacgcucuuaaugaacugccugagagccuggagacccucaugcuggucgcccuucugggagcgaugacagccggcaucuuccucuuuuucaugcaggggaaaggaauuggcaagcuguccaugggccugaucgcuauugccguggcuagcgggcuccuuuggguugccgaaauccagccccaauggauugccgcuucuaucauccuggaguucuuucugauggugcuccugauuccugaacccgagaaacagcggacgccgcaggauaaccagcuuaucuaugucauucugaccauccucacaauuaucggacugauugcggccaaugaaaugggccugaucgagaagaccaaaacagacuucggguuuuaccaagugaagccugagaccacgauccucgauguugaccuucgccccgcuuccgccuggacccuguaugccguggcuacaaccauucugacacccaugcucagacauaccaucgaaaacacgagcgccaaucugucccuugcggccauugcuaaccaggccgcuguccugaugggacucggcaagggguggccucugcaccggauggaucugggagugccgcuccuugccaugggcugcuacucucaggugaaucccacaacccugacagcgagccugguuaugcuccugguccauuaugccaucauuggcccugggcuucaggcuaaagccacccgcgaggcucaaaagagaaccgccgcuggaaucaugaaaaaccccacaguggacggcaucacggugauugaucuggaaccuaucuccuacgaccccaaguucgagaaacagcucgggcaggucaugcugcugguucucugugugggacaacuucugcugaugcggaccacaugggcccucugcgaggugcugacccuugcgacaggcccugucaugacccugugggaagggaacccgggaagauuuuggaauacgacaauugccgugucuaccgcuaacaucuuccgcggcagcuaucucgccggcgcugggcuggccuuuucccugauuaagaaugcccagaccccccggagaggaacaggcaccacaggggagacgcucggagaaaaguggaaacgccagcuuaacagccuggaccggaaggaguucgaagaguacaaaagaucuggcauccuggagguugaucgcaccgaagcgaaguccgcucuccgggacgggacaaaaaucaaguacgccgugagcagaggaucuuccaagauucgcuggaucgucgagcggggcaugauuaaaccuaagggcaaagugguugaucugggguguggaagaggcggguggagcuauuacauggcuacccuuaagaaugugacagaagucaaaggauauaccaagggcgggcccggacacgaggaaccuauccccauggccacguacggcuggaaccuggugaagcuccauucuggcguggacgucuuuuauaaaccgaccgagcagguugauacacugcugugcgacauuggggagagcuccucuaauccuaccaucgaagagggacgcacacuccgggugcuuaagaugguggaacccuggcugagcuccaaacccgaguucuguauuaagguccugaacccuuacaugcccaccgugaucgaagagcucgagaaacugcaaagacgccacggcgggagccuuguuagaugcccucugucccggaauucuacacacgaaauguauugggugagcggagccuccggcaacaucgucucuagcgugaauaccauuuccaagaugcuccugaaccgcuuuacgacaagacaucggaaaccgaccuacgagaaggauguugaccugggggcuggaaccagaucugugagcacagaaacggagaagcccgauaugaccgucaucggccggcgccuccagagacuucgggaggaacacaaagagacauggcauuacgaccaggaaaauccuuaucgcaccugggccuaccacggcuccuaugaggcgcccagcacagggucugccuccagcauggugaacggaguugugaagcugcugaccaaaccuugggaugucauucccauggugacacagcucgcuaugaccgacacgaccccguucggccaacagagagucuuuaaggaaaaaguggacacacggaccccucagcccaagccugggacacgcaugaucaugaccacgacagccaauuggcugugggcucuucugggaaagaaaaagucucccagacucuguacccgggaggaguucauuuccaaaguucgcagcaacgccgcgaucggcgccguguuccaggaagagcaaggguggacaucugcuuccgaagccgucaaugauagcagauuuugggagcugguggacaaggaacgggcucugcaccaggagggcaaaugcgaguccugcguguacaacaugaugggaaagcgcgaaaagaaacucggcgaguucgggagagccaagggaagccgggcuaucugguauauguggcugggcgcccgcuuucuugaauucgaggcgcugggguuucucaacgaagaucauugguucucuagagagaauagcugguccggaguugagggcgaagggcugcaccggcuuggcuacauucuggaggacaucgauaaaaaggacggagaucucauuuaugccgacgauaccgcuggcugggacacgagaaucaccgaagaugaccugcugaacgaggagcucauuacagaacagauggccccucaucacaaaacccuggcuaaggccaucuuuaagcuuacauaccaaaauaaaguggucaaggugcugcgccccaccccgaaaggggccguuauggauaucauuucucggaaggaccagagaggaagcggccagguggggacauacggacucaacaccuucacgaauauggagguccagcugauccgccaaauggaagcggagggcgugauuacacaggacgauaugcagaacccuaaagggcuuaaggaacgggucgagaaauggcugaaggaguguggcguggacagacucaagcgcauggcuaucuccggagaugacugcguugugaaaccccuggaugaacgguuuucuaccagccugcucuuccugaaugacaugggcaaggucagaaaagauauuccccagugggagccuuccaagggguggaaaaacuggcaagaagugccguuuuguucucaucacuuccacaagaucuuuaugaaggacggacgcagccuuguugugcccugccggaaucaggaugagcugaucggcagagcccgcauuucccagggggccggauggagccuccgggaaaccgcuugucugggcaaagccuaugcucagauguggucucuuauguacuuccauagacgggaccugagacucgccuccauggcgaucugcagcgccgucccuacagagugguuccccaccucucgcacaacgugguccauucacgcucaucaccaauggaugaccacagaggauaugcugaagguguggaaccggguguggaucgaagacaauccuaacaugaccgacaaaacacccguucacagcugggaggauauuccuuaucuggggaagagagaagaccucugguguggcucccugaucggacuuucuagccgcgccaccugggcuaaaaauauucauacggccaucacccaggucagaaaccugaucggcaaggaggaauacguggauuauaugcccgcgaugaagcgguacuccgccccguuugagagcgagggggugcucuga

SEQ ID NO: 21021 - RNA, 9867 nt, Artificial Sequence
  derived and/or modified CDS sequence (opt5) from DENV-4__JF262783__SS-prME
agcaccgugacacugcucugccugauccccacggucauggccuuccaccuuuccaccagagacggcgagccucugaugauuguugcuaagcaugaacgggggcgcccgcuccuguuuaaaacaaccgagggaaucaacaaguguacacuuauugccauggaucugggcgaaaugugcgaggacaccgugauguacaaauguccccuccuggugaauacagaaccugaggauaucgacugcugguguaaccugaccucuacgugggucauguaugggaccugcacacagagcggagagagacggcgcgaaaagagauccguggcgcucaccccccacucuggcauggggcuggagacacgggcugaaaccuggaugagcuccgagggagccuggaaacaugcccaacgcguugagucuuggauucuuagaaauccuggcuucgcucugcucgccggcuuuauggcuuacaugaucgggcagacgggaauccagcggacaguguucuuuguccugaugaugcuuguggcccccagcuauggcaugcgcuguguuggggugggaaacagagauuucgucgaaggcguguccgggggagcguggguggaccugguccucgagcacggcggcugcguuaccacaauggcccaggggaagccuacccuggauuuugaacugauuaagaccacagcuaaagaggugacgcuccugcggaccuacuguaucgaagccagcauuucuaauaucacaaccgcuacacgcugcccgacccaaggagagcccuaucuuaaggaggaacaggaccagcaguacauuuguagacgggauguggucgaccgcggcugggggaacggaugcggccuguucgggaaaggaggcgugguuacgugcgccaaguuucucuguuccggcaaaaucacagggaaucuggugcaaauugagaaccuugaauauaccgucgugguuaccgugcauaauggagauacacacgucgugggcaaggacaccagcaaccacggggucacagcgacgaucaccccuagaucucccuccguggagguuaagcugccugauuacggagaacucacacuggacugcgagccccggagcggcaucgacuucaaugagaugauucugaugaaaaugaagaaaaagaccuggcucgugcauaaacagugguuucuggaucuuccgcugccuuggacagccggggcugacaccucugaaguccaguggaacuacaaggagagaauggugacguucaaaguuccccacgccaagcgccaggaugugaccguccucggcucccaagaaggagcuaugcauagcgcccugacaggcgccaccgagguggacuccggggauggaaaucacauguuugcuggccaccuuaaguguaaagugcggauggaaaagcugagaaucaaagggaugucuuauacaaugugcagcggaaaguucuccauugacaaagagauggcggagacccagcauggcacgacaguugucaaggugaaguacgaaggggccggcgcuccuuguaaagugcccaucgagauucgcgaugucaacaaggaaaaagugguuggacggaucaucagcucuacccccuucgccgagaauacaaacuccgugaccaacauugagcucgaaccuccguuuggcgacagcuauaucgucauuggggugggagauucugcccugacccugcacugguucagaaagggcagcuccaucgggaaaauguuugagucuacauaccgcggagcuaagcggauggccauucucggcgaaacggcgugggacuucgggagcguuggcggacuguuuaccucccuuggcaaggcugugcaucaggucuucgggagcguguauacaaccauguuuggaggcguuucuuggauggugagaauccugaucgggcuccugguccuguggauuggaacaaauucccgcaacaccagcauggccaugacgugcaucgccauuggcgggaucacacuuuuccucggcuuuaccgugcacgcugauaugggaugugccgugucuugguccggcaaagagcugaagugcgggagcggaauuuucgucaucgacaauguucauaccuggacagaacaauacaaauuucagcccgaguccccugcucggcuggccucugcgauucucaacgcccacaaggacggcgugugugggaucagaagcaccacacgccuggagaaugugauguggaaacagaucacgaacgaacuuaauuauguccugugggagggaggccacgaucucaccgugguugcuggcgacgugaaggggguccugacaaagggaaaacgggcccugacccccccugugaacgaucuuaaguacuccuggaaaacauggggcaaggcuaaaauuuucacccccgaagccagaaauucuacguuucucaucgacgggccggauaccagcgagugcccuaacgaacggcgcgcguggaauuuccuggagguugaggacuacggauucggcauguuugccacaaacauuuggaugaaguucagagaaggguccagcgaggugugugaucaucggcugaugucugcugccaucaaagaccagaaggcuguccacgccgauaugggauauuggauugaauccagcaagaaucaaaccuggcagaucgagaaagccucucucaucgaagugaagacaugccuguggcccaaaacccauacacuuugguccaacgagguucuggagagccagaugcucauuccuaaggcuuacgcgggccccuuuucucagcacaauuauagacaaggcuacgccacccagacgaucgggccuuggcaccugggaaaacuggaaauugacuucggcgagugccccgggacaaccgugaccauccaggaagauuguaaccaucgcggaccgagccuucggacaaccacggcuuccggcaagcucgucacacaguggugcuguagaagcugcaccaugccuccccugcgcuuucugggggaggacggauguugguauggcauggagauuagaccccucucugaaaaggaggaaaacauggugaaaucccaagugagcgccggccaggggacauccgagaccuucucuaugggacugcuuugccugacacucuuugucgaagagugucugcggcgcagaguuacccggaagcacaugauccuggugguggucacgacccuuugcgccaucauucucggcgggcugacauggauggaucugcuccgcgcucugaucaugcuuggagacaccaugagcggcagaauggggggacagauucaucugacaaucauggccguguucaaaauguccccuggcuacguucucggcguguuucugcggaagcugaccucucgcgagacggcgcuuauugucaucgggauggcuaugacaaccgugcugagcaucccgcacgaccucauggaauucauugauggaaucucccugggccucauucugcuuaaaaugguugcccauuuugacaauacacagguggggacccuggcccucucucugaccuucaucagaagcacaaugccccuggucauggcuuggcggacgauuauggccgugcuuuuugucgugacccugaucccucucugucgcacauccugccugcaaaagcagagccacuggguugagauuaccgcgcucauccugggagcucaggcccuucccguguaucugaugacacucaugaagggcgccucuaaaagauccuggccucugaacgaagggaucauggcugucggacuggugagccuucugggcucugcccuccugaagaaugauguuccccucgcuggcccuaugguggccgggggacugcuucuggcggccuacgucauguccggcagcucugcugaccugucccucgagaaagccgcuaacgugcaaugggaugaaauggccgacauuaccgggagcucccccaucauugaggugaagcaggaugaggacggaagcuucucuauccgggauguugaagagacgaauaugauuacacugcuugucaaacuggcccucaucaccgugagcggccuguacccgcucgcuaucccugugaccauggcgcugugguauauguggcaggucaagacacagagauccggggcccuuugggacgugcccucuccugcugccgcccaaaaggcuacccugacagaaggaguuuaccgcauuaugcagcggggccuguucggcaaaacgcaggugggggucggaauccacauggagggcguguuucauaccauguggcacguuacaagagggagcgugauuugucaugaaaccggacgccucgagcccuccugggccgauguccggaacgacaugaucucuuauggcgggggauggagacugggcgauaagugggacaaagaggaagacgugcagguucuugcgauugagccgggcaagaauccuaaacacgugcaaacaaagcccgggcuguucaaaacccucacgggagaaaucggcgcugucacccuggauuuuaagccugggacaagcggaucccccaucauuaacaagaaaggccgcgugaucgggcucuacggcaauggaauugugaccaagucuggcgacuaugucagcgccaucacacaggccgagcggauuggggagcccgauuacgaaguugacgaggauaucuucagaaaaaagcgccugaccgugauggaccuucauccuggagcuggcaaaacaaagcggauucugccguccaucgugagagaagcccugaagcggcgccucagaacgcugauccuugcgcccacccgggucguggcugccgagauggaagaggcccugcgcgggcucccuauuagauaucagacacccgcuguuaaaagcgagcacaccggacgggaaaucguggaucugaugugccacgccaccuuuacaacgagacuccugucuuccacccgcgucccuaacuacaaucuuauugugauggacgaggcucauuucacagaucccagcucuguugccgcgcggggcuacaucuccaccagaguggaaaugggggaggccgcugccauuuuuaugacagcuaccccuccgggcgccacggaccccuucccucagagcaacucccccaucgaagauaucgagcgcgagauuccugaacggucuuggaauacaggauuugacuggaucaccgacuaucaaggcaagaccgucugguucgugcccagcauuaaagccgggaacgauaucgcuaauugccugagaaaguccggaaaaaaggucauucagcugagccgcaagacauuugacaccgaguacccgaaaacaaagcucaccgauugggacuucgugguuacgacagauaucucugaaaugggcgcgaacuuccgggccagacgcgugaucgacccuagacggugucugaaacccgugauucuuaccgaugggcccgagcgcgucauccuggcuggaccuauucccguuacaccugccuccgccgcucagagacggggccgcaucgggagaaacccggcccaagaagacgaucaguauguguuuagcggcgacccccucaagaaugaugaggaccacgcgcauuggaccgaggcuaaaaugcugcuggauaacauuuacacgccugaaggaaucauucccacccucuucggcccugagcgggaaaagauccaggccaucgacggggaguuuagacuucgcggagagcagcggaagacauucguggaacugaugagacgcggcgaccugcccgucuggcucucuuauaaaguggccagcgcugggauuuccuacaaggaucgggaguggugcuuuaccggagaaagaaauaaccaaauccuggaggaaaauauggagguugagauuuggacacgggaaggcgagaaaaagaaacuucgcccgaaguggcuggacgccagaguguaugcggauccuauggcccucaaggacuucaaagaauuugcuucuggccggaagagcaucacccuggauauucugacagagaucgccucccuccccaccuaccuuucuagccgcgcuaaacuggcccuggacaacaucgucaugcuccacacgacagaaagagggggacgggcuuaccagcacgcccugaaugagcuuccugagucccuggaaacccucaugcugguggcgcugcucggcgccaugaccgcugggauuuuccuuuuuuucaugcagggaaagggcaucgggaaacugagcaugggacugauggccauugcugucgccucuggccuccuguggguggccgagauccagccccaauggauugcugcguccaucauccuugaauuuuuccugauggcccuccugauuccugagcccgaaaagcagcgcacaccgcaggauaaccagcugaucuauguuauucucaccauccuuacaauuaucggccugauugcugccaaugagauggggcugaucgagaaaacgaagaccgacuuuggauucuaccaagugaagacagaaaccacaauccucgaugucgaccugagaccugccagcgcuuggacccuuuaugccguggcgacgaccauucugacacccaugcuccggcauaccaucgagaacacauccgccaaucugucucuggcugccauugcuaaccaggccgcgguucucaugggccuugggaaaggauggccccugcaccgcauggaucugggcgugccucuccuggccaugggguguuacagccaggucaauccgaccacgcuuacagcuucccuggugaugcucucugugcauuaugccaucauuggacccggccugcaggcuaaggccaccagagaagcucaaaaacggacagccgcgggcaucaugaagaacccuaccguugacgggaucaccgucauugaucuggagcccaucagcuacgacccuaaauucgagaagcagcucggacaggugaugcuucuggcccugugcgcuggccaacuccugcuuaugagaacaacgugggccuuuugugaagugcugacccucgcuacagggcccauucugacccugugggagggaaauccuggccgcuucuggaacacaaccaucgccgucuccacggccaacauuuuucgggggagcuaucucgcgggagcuggccuugccuucucucugaucaagaaugcucagacaccgagacgcggcaccgggaccacaggagaaacccugggcgagaaauggaagcggcagcucaacucccuggacagaaaagaauuugaggaguacaagcgcagcgggauccuugaaguugaucggacagaggccaaaucugcccugaaggacggauccaagauuaaacacgcugugagcagaggcucuagcaagauccgcuggauuguggaacgggggauggucaaacccaagggaaaagugguugaucucggcugcggcagagggggaugguccuacuauauggccacgcugaagaaugugaccgaggucaagggcuacacaaaagggggaccuggccaugaagagcccaucccuauggcgaccuauggguggaaccuggugaagcuccacucuggaguugacguguucuacaaacccacagagcaggucgauacccuucugugugacauuggcgaaagcuccagcaauccgacgaucgaggaaggccgcacccugcgggugcucaagaugguggagccuuggcuguccucuaaacccgaauuuugcauuaagguccuuaaccccuauaugccuacaguuaucgaggagcuggaaaaacuccaaagaaagcacgggggaagccuggugcgcuguccccuguccagaaauucuacccaugagauguacugggugagcggcgccuccgggaacaucgucucuagcgugaauacaaccuccaagaugcuccuuaaccgguucacaacccgccacagaaaaccuacguaugaaaaggauguuaaucugggagcuggcacacggagcgugucuaccgagaccgagaaaccggacaugacaauuaucgggagacggcugcagcgccucagagaagagcauaaggaaacguggcacuacgaucaggagaaccccuaccggaccugggccuaucacggauccuacgaagcuccuagcacaggcucugccuccagcauggucaauggcgugguuaaacugcuuaccaagcccugggacgugauuccuauggucacacagcuggcgaugaccgauacaacccccuuugggcaacagcgcguguucaaggagaaaguugacacgagaaccccgcagccuaagcccggaacacggauggugaugaccacaaccgccaacuggcucugggcucugcugggcaaaaagaaaucuccucgccucugcacgagagaggaauuuaucuccaagguccggagcaaugccgcuauuggggccguguuccaggaggaacaaggauggacauccgcuagcgaggccgucaacgacucucgcuuuugggaacugguggauaaggagagagcgcuucaucaggagggcaaaugugaaagcugcguuuauaauaugauggggaagcgggagaaaaagcugggcgaauucggacgcgccaaaggcuccagagcuaucugguacauguggcucggggcccgguuccuggaguuugaagcucuuggauuccugaacgaggaccacugguuuggccgcgagaacucuuggagcgggguggaaggagagggccuccauagacugggguauauccuggaagauauugacaagaaggauggcgaccucaucuacgccgaugacaccgccggaugggauacacggauuaccgaggacgaucugcuuaaugaggaacugaucacggagcagauggcgccccaccauagaauucucgcuaaagccaucuucaagcugaccuaucaaaacaaagucgugaaggugcuucgcccuacacccaaaggcgccguuauggacaucauuucccggaaggaucagagagggucuggacaggugggcaccuacgggcugaauacauuuaccaacauggaaguccagcucauccgccaaauggaggcugaaggagugauuacacaggacgacaugcagaauccgaaaggccugaaggagcggguugagaaguggcugaaagaaugcgggguggauagacucaagcgcauggccaucagcggcgacgauugugucgugaaaccucuggacgagcgguucuccaccucucuucuguuucucaacgauaugggaaaggucagaaaagacauuccccagugggaacccagcaagggcuggaagaauuggcaagaggugccuuucugcucccaccacuuucauaaaaucuucaugaaggaugggcgcagccugguugugccgugucggaaccaggacgaacuuaucggaagagcucgcauuucucagggcgccggguggucccugcgggagacggcgugccucggaaaagccuacgcucagauguggagccugauguauuuucacagacgggaucugagacucgccucuauggcuaucuguuccgccguccccacagagugguucccuaccagccgcaccacaugguccauucaugcgcaccaccaauggaugaccacagaagacaugcugaagguguggaaucggguuuggaucgaggauaaccccaauaugacggacaaaaccccugugcauucuugggaagacauucccuaccuuggcaagagagaggaucuguggugcgggagccucaucggccuguccagccgcgccacaugggcuaagaacauucacaccgccaucacacaggucagaaaucuuaucggaaaagaagaguauguggacuacaugccugugaugaagcgguauucugcucccuuugaguccgaaggcguucuguga

SEQ ID NO: 21022 - RNA, 9867 nt, Artificial Sequence
  derived and/or modified CDS sequence (opt5) from DENV-4__KU513441__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaacggguggucggaagagugaucagcgcuacaccccucgccgagaacaccaacucuguuaccaauaucgagcuggaaccuccguucggcgacuccuauauugugaucggggucggaaacagcgcgcugacacuccauugguuucgcaagggcucuagcauugggaaaauguucgaguccacguaccggggagcuaagagaauggccauccugggcgaaaccgccugggauuuugggucugugggcggacuuuucacaagccugggcaaagcuguucaccagguguuuggguccgucuauaccacaauguucggaggcgugagcuggaugauucgcauccucaucggguuucugguucuguggauuggaaccaauucucggaacacguccauggccaugacaugcaucgcugugggcgggauuacccuuuuccucggcuuuaccguccaggccgacaugggauguguggugagcuggucuggcagagagcugaagugcggguccggaaucuucgucguugauaaugugcauacauggaccgaacaauacaaguuucagcccgagagcccugcgcgccuggccuccgcuauucucaacgcccacaaagacggcgugugugggauccggucuacaacgagacuggagaaugucauguggaagcagauuaccaacgaacuuaauuaugugcugugggagggaggccacgaccucacaguuguggcuggcgaugucaaaggggugcugaccaagggaaaacgggcccugacacccccugcgagcgaccuuaaguacuccuggaagaccuggggcaaagccaagaucuucacgcccgaagcucgcaacucuaccuuucucaucgaugggccggacacaagcgagugcccuaaugaaagacgggccuggaacuccuucgagguugaggauuacggauucggcauguuuaccacaaauauuuggaugaaauucagagaagggagcucugaggugugugaccaucgccugauguccgcugccaucaaggaucagaaagccguccacgcugacaugggauauuggauugaaagcucuaagaaccaaaccuggcagaucgagcgggcgucccugauugaagugaaaacaugccucuggcccaagacccauacgcuguggagcaauggcguucuugagucucagaugcugaucccuaagagcuacgccggccccuuuucccagcacaacuauagacaaggguacgcuacacagaccgugggaccuuggcaccucggcaaacuggagaucgauuucggggaaugccccggaaccacagucaccauucaggagaacugugaccaucgcggcccgagccugagaacgacaaccgccucugggaagcuugugacacaguggugcugucgguccugcaccaugccuccccuccgcuuucugggagaagauggcuguugguauggcauggagaucagaccccugagcgagaaagaagagaauauggugaagucccaagucacagccgggcagggaaccucugaaacguucagcaugggccuccugugccuuacccuguuuguugaggaaugucuccggcgcagagugacacggaaacacaugauucuggcuguggucaucacccugugcgccauuauccuugggggacucacauggauggaccugcugcgcgcgcucaucaugcugggcgauaccauguccgggagaauuggaggccagacgcaucuugcuaucauugccguguucaagaugucuccuggcuacguucuggggguguuucuccggaagcugacaagccgcgagaccgcccugauggucaucggaauggcuaugacaaccacccuuuccauuccgcacgaccugauggagcucaucgacggcaucucucuggggcucauucugcuuaaaaucgugacacaguucgauaacacgcaaguuggaacccuggcccucagccugacauuuauuagauccaccaugagccuggugauggcguggcggacaaucauggcuguccuuuucguggucacccugauuccccucuguagaacgucuugccugcagaagcagucccauuggguggaaaucacagcccucauucugggcgcccaagcucuuccuguuuaucugaugacccucaugaaaggggccagccgccggucuuggccccugaaugagggaaucauggcugugggccuggucucccuucugggcagcgcccuccugaagaacgacgugccucucgcggggcccaugguugccggaggccugcuucuggcugccuacgugaugucuggguccagcgcugaucugucccucgaaaaagccgccaauguccagugggacgagauggcugauaucaccggaagcucuccuauuaucgaagugaagcaggacgaggauggcagcuuuuccauuagagacguggaggaaacaaacaugaucacccugcuuguuaagcuggcgcucauuacagucucugggcuguacccccucgccaucccgaucacgaugacccugugguauauguggcaggugaaaacacaacgcagcggagcucuuugggaugugccuucccccgccgccacccagaaggcugcccugucugagggcgucuaccggauuaugcagagaggccuguucgggaaaacacaggugggaguuggcauccacauggaagggguguuccacaccauguggcaugucacgcgcggaagcgugauuugucacgagaccggccggcucgaaccuuccugggcggacguuagaaaugauaugaucucuuaugggggaggcuggcgccugggcgacaagugggauaaagaggaggacgugcaaguccuugcuauugaacccgggaagaacccgaagcaugugcagacaaaaccuggacuguuuaagacccucacaggcgagaucggggccguuacccuggacuucaaacccggaacaagcggcuccccuaucauuaaucggaaggggaaagugaucggccucuacggaaacggcgucgugacgaagagcggggauuaugugucugccauuacccaggcugaaagaaucggagagcccgacuacgaggucgaugaagacauuuuucggaaaaagcgccugacaaucauggaucuucaccccggcgccgggaagaccaaaagaauucugccuuccaucguucgggaggcgcugaagcgcagacuccggacccugauccuugcuccgacaagagugguggccgccgaaauggaggaagcucugcgcggacuccccauucgguaucagacgccugccgucaaaagcgagcauaccggcagagagaucguggaccugaugugccacgcuacauucaccacacgccuccugucuuccacccggguucccaauuacaaccuuauugugauggaugaagcccacuuuacggacccuagcuccgucgcggccagaggguacaucucuacacgcguggagaugggcgaagcugccgcuauuuucaugaccgccacccccccuggagccacagauccguuuccccaaagcaauuccccuaucgaggacaucgaacgggagauucccgagagaagcuggaacaccggcuucgauuggaucacagacuaucaggggaagaccguuugguuugugccuucuauuaaagcuggaaaugacaucgcgaacugccugcgcaaguccggcaagaaagucauucagcugagcagaaagacguucgauacagaauaccccaaaaccaagcucacagacugggauuuuguggucaccacggacaucucugagaugggggccaacuuccgggcuggacgcgugaucgauccgagacggugucugaaaccuguuauucuuaccgacggccccgaacgcgugauccuggccgggcccauuccugugacacccgccagcgcugcccaaagacggggcagaaucggacgcaauccugcgcaggaggaugaccaguaugucuucuccggcgauccgcucaagaacgacgaagaucaugcucacuggaccgaggccaagaugcugcuggacaauauuuacacacccgaggggaucauuccuacccucuuuggacccgaacgggagaaaacacaggccaucgauggcgaauucagacuucgcggggagcaacggaagaccuuuguugagcugaugagacggggagaccugccuguguggcucucuuauaaaguggcuagcgccggcaucuccuacaaggaccgcgaauggugcuucacgggcgagagaaacaaucagauucuggaagagaacauggaagucgagaucuggacacgggagggggaaaaaaagaagcuucgccccaaauggcuggaugcgagaguguaugccgacccgauggcucucaaggauuuuaaagaguucgccucuggacggaagagcauuacccuggacauccugaccgaaauugcuucccucccuacauaccuuagcucucgcgccaaacuggcucuggauaauaucguuaugcuccauaccacagagagaggcgggcgggccuaccagcacgcgcugaacgaacuucccgagucccuggagacgcucaugcugguggcccugcucggagcuaugaccgccggcaucuuucuuuucuuuaugcaggggaagggaauuggcaagcugagcaugggccugaucacaauugcugucgccuccgggcuccuguggguggccgaaauccaaccucaguggauugcugcgucuaucauccuugaguucuuucugaugguccuccugauucccgaaccugagaaacagcgcaccccccaggacaaucaacugaucuaugugauucucacaauccuuaccauuaucggacugauugccgcuaacgaaaugggccugaucgagaagacgaaaaccgauuucggguuuuaccagguuaagacagagaccacaauccucgacguggaucugagaccggccagcgccuggacccuuuaugcugucgccacgacaauucugaccccuaugcuccggcacacaaucgaaaauaccuccgcgaaccugucucuggccgcuauugccaaucaggcugccgugcucaugggacuuggcaaaggguggccccugcauagaauggaccugggaguuccccuccuggcgaugggcuguuacagccaggugaacccuaccacacuuacggccucccuggucaugcuccuggugcacuaugcuaucauuggcccggggcugcaagccaaggcuacccgcgaggcccagaaacggacagcugccggaaucaugaagaaucccaccguggauggcaucacaguuauugaccucgaaccuaucagcuacgaucccaaguucgagaaacagcuugggcaagucaugcugcuggugcucugcgcgggacagcugcuucugaugagaaccacgugggccuucugugaggugcucacacuggcuaccggcccuauucugacccucugggaagggaaccccggacgcuuuuggaacacaaccaucgccgucucuacagcuaauauuuuccggggcuccuaucuugccggcgccgggcuggcguuuagccugaucaagaacgcucagacgccuagacgcggaaccggcacagccggggagacccucggagaaaaauggaagcggcagcugaauucucuugacagaaaagaguucgaagaguacaagcgcuccggcauccuggagguugaccggacagaagcuaagagcgcccucaaagaugggucuaagauuaaacaugccgugagcagaggauccucuaagauccgcuggauuguggagcggggcauggucaaaccgaagggcaaggugguugaccuggggugcggaagaggcggguggagcuacuauauggcuacccugaaaaacgugacggaagucaagggauacaccaaaggcgggcccggacacgaggaaccuauccccauggccacauauggcuggaaucucgugaagcuucauuccggcguugauguguuuuacaaaccuaccgagcaagucgacacacugcugugugauauuggggagagcuccucuaaccccaccaucgaagagggacgcacacucagagugcugaagaugguggaaccguggcuuagcuccaagccugaguucugcauuaaaguccugaaucccuauaugcccaccguuaucgaagagcucgagaagcugcagcggaaacacggcgggaaccuggugcgcuguccucucucuagaaauagcacgcacgaaauguacuggguguccggagcgucuggcaacaucgucagcuccgugaauacaaccagcaagaugcuucugaaccgguuuaccacaagacaucggaaacccacguaugagaaggacguugaucugggggccggaacccgcucuguguccacagaaauugagaaaccugacaugaccaucauuggcagacggcuccagcgccugcaggaggaacacaaggagacauggcauuacgaucaagaaaauccguacagaaccugggcuuaucacggcagcuacgaggcccccucuacaggguccgcuagcucuauggucaacggagugguuaagcuucugaccaaaccuugggacgugauccccauggucacgcagcucgccaugaccgauacaaccccuuucggccagcagcggguguuuaaggaaaaaguugacacacgcaccccccaaccgaagccugggacgagaauggugaugacaaccacagcgaauuggcugugggcccugcucggaaaaaagaagaacccccggcugugcacccgcgaggaguucauuuccaaagucagaagcaaugcugccaucggcgcuguguuucaggaagagcagggguggacguccgccagcgaagcugucaacgacucucgguucugggagcuuguggauaaggaacgcgcccugcaccaagagggcaaaugugagagcugcguuuauaacaugaugggaaagagagaaaaaaagcucggcgaguuugggcgggcgaagggaucccgcgccaucugguacauguggcugggcgcuagauuccuugaauucgaggcccugggguuucucaaugaagaccauugguucggacgggagaacucuuggagcggcguggagggggaaggccugcacagacugggauauauucucgaggaaaucgauaaaaaggacggcgaucugauguacgcugacgauaccgccgggugggacacacgcauuaccgaggaugaccuucagaaugaggaacugaucacagagcagauggccccucaucacaaaauucucgcgaaggcuaucuuuaaacugaccuaucagaacaaggucgugaaggugcuucggcccacaccuagaggagccguuauggauaucauuucccgcaaagaccaacggggcucugggcaggugggaaccuacggccugaauacguucacaaacauggaaguccagcucaucagacagauggaggccgaaggggugauuacccaagaugacaugcagaaucccaagggccugaaagagcgcguugagaaguggcugcgggaaugcggaguggacagacucaaacgcauggcuaucagcggcgaugacugugucgugaagccgcuggaugagcgguuugggaccucccuucuguuccucaacgacaugggaaaagucagaaaggauauuccucagugggaacccucuaagggcuggaaaaauuggcaggaggugcccuuuugcagccaucacuuccacaagaucuuuaugaaagacgggcgcucccugguugugccuugucggaaccaagaugaacuuaucggaagagcccggauuagccagggcgcuggguggucucugagagagacagccugccucggcaaggcguacgcccagauguggucccugauguauuuccaucgccgggaccugagacucgcuagcauggccaucuguucugcugucccgaccgagugguuucccacaucccgcacgaccuggagcauucacgcccaucaccaguggaugacaaccgaagauaugcugaaaguguggaauagaguuuggaucgaggacaacccuaauaugauugauaagacacccgugcacuccugggaagacaucccuuaccuuggaaagcgggaggaccuguggugcggcucucucauugggcugagcucccgcgcgaccugggccaaaaacauccauacggcuaucacccaagucagaaaucuuauuggaaaggaagaguauguggauuacaugagcgugaugaaacgguauucugcccccuccgagagcgaaggcguucuguga

SEQ ID NO: 21023 - RNA, 9867 nt, Artificial Sequence
  derived and/or modified CDS sequence (opt5) from DENV-4__KC762694__SS-prME
agcacaaugacacugcucugccugauccccacggugauggcuuuccaccuuuccacccgggacggcgagccucugaugauuguggcuaagcaugaacgggggcgcccgcuccuguuuaagacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguauugaagcuagcaucucuaauauuaccacagccacccgcugcccgacgcaaggagagcccuaucuuaaggaggaacaggaccagcaguacaucuguagacgggaugugguggaccgcggcugggggaacggaugcggccuguucgggaaaggaggcgucgugacaugcgcgaaguuucucuguuccggcaaaauuaccgggaaucugguucaaaucgagaaccuugaauauaccguggucgugacaguucauaauggagauacccacgccgugggcaacgacacaagcaaucacggggucacggcuaccauuacaccuagaucucccuccguggaggucaagcugccugauuacggagaacucacccuggacugcgagccccggagcggcaucgacuucaacgagaugauccugaugaagaugaaaaagaaaacauggcucgugcauaagcagugguuucuggaucuuccgcugccuuggaccgccggggcugacacgucugaaguucacuggaauuacaaagagagaauggugaccuucaaggucccccaugccaaacgccaggaugugacaguucucggcucccaggaaggagccaugcacagcgcucuggcgggcgccaccgagguggacuccggggauggaaaccacauguuugcuggccaucuuaaguguaagguccggauggaaaaacugagaauuaaggggaugucuuauacaaugugcagcggaaaauucuccaucgacaaggagauggccgagacccaacacggcacgacaguggugaaaguuaaguacgaaggggccggcgcuccuuguaagguccccauugagauccgcgaugugaauaaagaaaagguggucggacggauuaucagcucuacccccuucgccgagaacacaaacuccgugaccaauaucgagcucgaaccuccguuuggcgacagcuauauuguuaucggggugggagauucugcgcugacccugcauugguucagaaaaggcagcuccauugggaagauguuugagucuacauaccgcggagcuaaacggauggccauccucggcgaaacggccugggacuucgggagcgucggcggacuguuuaccucccuuggcaaggcugugcaccagguuuucgggagcguguauacaaccauguuuggaggcgucucuuggaugauuagaauccugaucggguuccucgugcuguggauuggaacaaacucccgcaauaccagcauggccaugacgugcaucgcuguuggcgggauuacacuguuucuuggcuucaccgugcaggccgauaugggaugugucgugucuuggaacggcaaggagcucaaaugcggguccggaaucuuuguggucgacaauguucauaccuggacagaacaauacaaguuccagcccgagagcccugcgcggcuggccuccgcuauucugaacgcccacaaagacggcgugugugggaucagaucuaccagccgccucgagaaugugauguggaagcagauuacaaacgaacugaauuauguccuuugggagggaggccacgaucugacggugguugcuggcgacgugaaagggguccucaccaagggaaagcgggcccugacacccccugugaacgaucugaaauacuccuggaagaccuggggcaaagcgaagaucuuuacacccgaagccagaaauucuaccuuccuuaucgacgggccggauacgagcgagugcccuaacgaacggcgcgcuuggaauuucuuugagguugaggacuacggauucggcauguuuaccacaaacauuuggaugaaauucagagaaggguccagcgaggugugugaucaucggcucaugucugccgcuaucaaggaccagaaagccguccacgccgauaugggauauuggauugaauccagcaagaaucaaaccuggcagaucgagaaggcuucucugauugaagugaaaacaugccuguggcccaagacccauacacucugguccaacggcguucuggagagccagaugcuuaucccuagaucuuacgcgggccccuuuagccagcacaacuaucgccaaggguacgccacccagacggcuggaccuuggcaccugggcaaacucgagaucgacuucggggaaugccccggaacaaccgugaccauucaggaggauugugaccaucggggcccgucccugagaacaaccacggccagcgggaagcuggucacacaguggugcugucgcucuugcaccaugccuccccuuagauuucucggagaagauggcuguugguauggcauggagauccggccccuguccgagaaagaagagaauauggucaagagccaagugacagccgggcagggaaccuccgaaacauucucuaugggccugcucugccugacccuuuuugucgaggaaugucugcgcagacggguuacgcgcaagcacaugauucucgugguggucaucaccuucugcgcuauuauccucgggggacugacauggauggaccuucucagagcccugaucaugcugggcgacaccaugagcgggcggauuggaggccagauccaucucgcgauuauggcuguguuuaaaauguccccuggcuacguucuggggguguuccuucgcaagcugacaucuagagagaccgcccucauggucaucggaauggccaugacgacaguguuuagcauuccgcacgaucugauggagcugaucgacggcaucucccuugggcugauucuccugaaaaucguuacccauuucgauaacacacaggugggaacccucgcucugucucuuaccuucauucggagcacaacgccccuggucauggccuggcgcaccaucauggcgguguuuuucgucgugacacucauuccucuguguagaaccuccugccugcaaaagcagagccacuggguugaaaucacagcucuuauucugggcgcccaggcccuccccguguaucugaugacccucaugaaaggggcuucucggagauccuggccucugaaugagggaaucauggccgucggccuugugagccugcucggcucugcucugcugaagaacgacguuccccuugccgggccuaugguggcgggaggccugcuccuggccgcuuacgucauguccgggagcucugccgaucucucccuggaaaaggcugccaaugugcaaugggacgagauggccgauaucacgggaagcucccccauuaucgaagugaaacaggacgaggauggcagcuuuucuauucgcgacguugaggaaacaaacaugaucacccuucuggucaagcuggcucucauuaccgugagcgggcuguacccgcuugcgaucccugugacaauggcccugugguaugucuggcaagugaaaacccagcgguccggagcucucugggauguucccucuccugccgccacacaaaaggcuacgcugagcgagggcguguacagaaucaugcagcgcggccucuucgggaaaacccaggucggagugggcauucacauggaagggguuuuucauacaauguggcacgugacccggggauccgucaucugucaugagacaggcagacuggaacccucuugggccgacgugcgcaaugauaugauuagcuaugggggaggcuggcggcuuggcgacaagugggacaaggaggaggauguucaggugcuggcgaucgaaccggggaaaaacccuaagcacguccaaaccaaacccggacuguucaagacgcucaccggcgagauuggggcugugacacuggacuuuaaaccuggaaccuccggcucucccaucaucaauaagaaagggaaggugauuggccuuuacggaaacggcgucguuacaaagagcggggauuauguguccgccaucacccaggccgaaagaauuggagagcccgacuacgagguggaugaagacaucuuccgcaaaaagcggcugacaauuauggaucuccauccuggcgcugggaaaacgaagagaauccugccgagcauuguccgggaggcccucaaacgcagacugcggacccuuauccuggcgcccacacgcgugguugcugccgaaauggaggaagcccugagaggacucccuauccgguaucagacccccgcugugaagucugagcacaccggcagagagauugucgaccugaugugccacgccacauuuacgacccgccuucuguccagcacacgggugccuaauuacaaccucaucguuauggaugaagcucauuucaccgaccccugcucuguggccgcgagaggguacauuuccacacgcgucgagaugggcgaagccgcugccaucuuuaugaccgcuacgccuccgggaagcauugaucccuucccucaguccaauucucccaucgaggacaucgaacgggagauuccugagagaagcuggaacacaggcuucgacuggaucaccgauuaucaagggaagaccgugugguuuguccccuccauuaaagccggaaaugacaucgccaacugucugcgcaagagcggcaaacgggugauucagcucucuagaaagacauucgauaccgaauacccgaaaacaaagcugaccgacugggauuuuguugugacgacagacaucuccgagaugggggcuaacuuccgcgcgggaagagugaucgauccucggcgcugccuuaagcccgucauucugaccgacggccccgaaagaguuauccuggccgggccuauucccgugaccccugcuagcgccgcccagcggcgcggcagaaucggacggaauccggcucaagaggaugaccaguauguguuuucuggcgauccccucaaaaacgacgaagaucacgcccauuggaccgaggcgaagaugcugcuugacaauauuuacacgccugaggggaucauucccacccuguucggaccugaaagagagaaaacacaggcuaucgacggcgaauuucgccucagaggggaacagagaaagaccuucgucgagcugaugcgccggggagaucugcccguguggcucagcuauaaaguugccuccgccggcaucucuuacaaggacagagaaugguguuuuacaggcgagcggaacaaucaaauucuugaagagaacauggaaguggagaucuggacccgcgagggggaaaagaaaaagcugagaccgaaauggcuggaugcucgggucuaugccgacccuauggcgcucaaggauuucaaagaguuugccagcggacgcaaguccauuacacuggacauccuuaccgaaauugcuacgcugcccacauaccucucuagcaaggccaaacuggcucuggauaauaucgugaugcuccacaccaccgagaagggcgggagagccuaccagcacgcucuuaacgaacugccugagucccuggagacacucaugcuggucgcccuucugggagcgaugaccgccggcaucuuccucuuuuucaugcaggggaaaggaauuggcaagcugagcaugggccugaucgcuauugccguggcuucugggcuccuuuggguugccgaaauccagccccaauggauugccgcuuccaucauccuggaguucuuucugauggugcuccugauuccugaacccgagaaacagcggacaccgcaggacaaucagcuuaucuaugucauucugacgauccucaccauuaucggacugauugcggccaacgaaaugggccugaucgagaagacaaaaaccgauuucggguuuuaccaagugaagacagagaccacgauccucgacguugaucuucgcccugcuagcgccuggacccuguaugccguggcuacaaccauucugacacccaugcucagacauaccaucgaaaauacguccgccaaccugucucuugcggccauugcuaaucaggccgcuguccugaugggacucggcaagggguggccccugcaccggauggaccugggagugccucuccuugccaugggcugcuacagccaggugaacccgacaacccugacagcgucccugguuaugcuccugguccauuaugccaucauuggccccgggcuucaggcuaaagccacccgcgaggcucaaaagagaaccgccgcuggaaucaugaaaaauccuacaguggauggcaucacggugauugaccuggaacccaucucuuacgacccuaaguucgagaaacagcucgggcaggucaugcugcugguucucugugugggacaacuucugcugaugcggaccacaugggcccucugcgaggugcugacccuugcgacaggccccgucaugacccugugggaagggaacccuggaagauuuuggaacacgacaauugccgugagcaccgcuaauaucuuccgcggcuccuaucucgccggcgcugggcuggccuuuagccugauuaagaacgcccagaccccgcggagaggaacaggcaccacaggggagacgcucggagaaaaguggaaacgccagcuuaauucucuggaucggaaggaguucgaagaguacaaaagauccggcauccuggagguugaccgcaccgaagccaagagcgcucuccgggaugggucuaaaaucaaguacgccguguccagaggaagcucuaagauucgcuggaucgucgagcggggcaugauuaaacccaagggcaaagugguugaccugggguguggaagaggcggguggagcuauuacauggcuacacuuaagaacgugaccgaagucaaaggauauacaaagggcgggccuggacacgaggaacccaucccuauggccaccuacggcuggaaucuggugaagcuccauuccggcguggaugucuuuuauaaacccacggagcagguugacacccugcugugcgauauuggggagucuagcuccaacccgacaaucgaagagggacgcacccuccgggugcuuaagaugguggaaccuuggcugagcuccaaacccgaguucuguauuaagguccugaaucccuacaugccuacagugaucgaagaacuggagaaacugcaaagacgccacggcgggucucuuguuagaugcccccugagccggaacuccacccacgaaauguauugggugucuggagccagcggcaauaucgucuccucugugaacacaauuagcaagaugcuccugaaucgcuuuaccacgagacaucggaaaccuacauacgagaaggacguugaucugggggcuggaaccagauccgugagcaccgaaacagagaagccggacaugacgaucauuggccggcgccuccagagacuucgggaggaacacaaagagaccuggcauuacgaucaggaaaaccccuaucgcacaugggccuaccacggcucuuaugaggcgccuuccaccgggagcgccucuuccauggucaauggagugguuaagcugcugacaaaacccugggacgugaucccuauggucacccagcucgcuaugacagacaccacgcccuucggccaacagagaguguuuaaggaaaaagucgauacccggacaccgcagccuaagcccgggacccgcaugauuaugacaaccacggccaacuggcugugggcccuucugggaaagaaaaagagcccuagacucuguacacgggaggaguucaucucuaaagugcgcuccaaugccgcgaucggcgccguuuuccaggaggagcagggguggaccagcgcuuccgaagccgugaacgacagcagauuuugggagcuggucgauaaggaacgggcucugcaccaggagggcaaaugcgagucuugcguguacaauaugaugggaaagcgcgaaaagaaacucggcgaguucgggagagccaagggaagccgggcuauuugguauauguggcugggcgcccgcuuucuugaguucgaggcgcugggguuucucaacgaagaccauugguucuccagagagaacucuuggagcggaguggagggcgaagggcugcaccggcuuggcuacauccuggaggauauugacaaaaaggauggagaccucaucuaugccgaugacacagcuggcugggauaccagaauuacggaagacgaucugcugaaugaggagcucaucaccgaacagauggcgccccaucacaaaacacuggcuaaggccaucuuuaaacuuaccuaccaaaacaaaguugugaagguccugcgcccuacacccaaaggggccgugauggacauuaucucccggaaggaccagagaggaucuggccagguugggaccuacggacucaauacauucaccaacauggaggugcagcugauucgccaaauggaagcggagggcgucaucacgcaggaugacaugcagaauccgaaagggcuuaaggaacggguggagaaauggcugaaggaguguggcgucgauagacucaagcgcauggcuauuagcggagacgauugcgugguuaaaccucuggacgaacgguuuuccacaucucuccuguuccugaacgauaugggcaaggugagaaaagacaucccccagugggagcccagcaagggguggaaaaauuggcaagaagucccuuuuuguucccaucacuuccacaagaucuuuaugaaggauggacgcagccuugugguuccgugccggaaccaggacgagcugauuggcagagcccgcaucucucagggggccggauggucccuccgggaaaccgcuugucugggcaaagccuaugcucagauguggagccuuauguacuuccauagacgggaucugagacucgccucuauggcgauuugcuccgccgugcccaccgagugguucccuacaagccgcaccacaugguccauccacgcucaucaccaauggaugacgaccgaggacaugcugaaggucuggaaucggguguggauugaagacaaccccaauaugacagauaaaaccccugugcacucuugggaggacauccccuaucuggggaagagagaagaucucugguguggcagccugauuggacuuuccagccgcgccacaugggcuaaaaacauccauaccgccaucacgcagguuagaaaucugauuggcaaggaggaauacgucgacuauaugccugcgaugaagcgguacucugcccccuuugaguccgagggggugcucuga

SEQ ID NO: 21024 - RNA, 9867 nt, Artificial Sequence
  derived and/or modified CDS sequence (opt5) from DENV-4__KC762695__SS-prME
agcaccaugacacugcucugccugauccccacggccauggcuuuccaccuuuccaccagagacggcgagccucugaugauuguggccaagcaugaacgggggcgcccgcuccuguuuaaaacaaccgagggaaucaacaaguguacacuuauugcgauggaucugggcgaaaugugcgaggacaccgucacauacaaauguccccuccugguuaauaccgaaccugaggauaucgacucuuggugcaaccugacgagcaccugggugauguaugggacauguacccaguccggagagagacggcgcgaaaagagaucuguggcucucacaccccacagcggcauggggcuggagacccgggccgaaacguggauguccucugagggagccuggaaacaugcucaacgcgucgagagcuggauucuuagaaauccuggcuucgcccugcucgcuggcuuuauggccuacaugaucgggcagacaggaauccagcggaccguguucuuuguucugaugaugcuuguggcgcccuccuauggcaugcgcugcgucggggugggaaacagagauuucguugaaggcgugagcgggggagccugggucgaccuggugcucgagcacggcggcugugugacaaccauggcucaggggaagccuacccuggauuuugaacugacaaagacgaccgccaaagaggucgcucuccugcggacauacugcauugaagccucuaucuccaauauuaccacagcgacccgcuguccgacgcaaggagagcccuaucuuaaggaggaacaggaccagcaguacaucugcagacgggauguuguggaccgcggcugggggaacggauguggccuguucgggaaaggaggcguggucacaugcgccaaguuucucugcagcggcaaaauuaccgggaaucuggugcaaaucgagaaccuugaauauaccguuguggucacagugcauaauggagauacccacgcuguuggcaacgacacaucuaaucacggggugacggccaccauuacaccuagaucccccagcgucgaggugaagcugccugauuacggagaacucacccuggacugugagccccggucuggcaucgacuucaacgagaugauccugaugaagaugaaaaagaaaacauggcucguccauaagcagugguuucuggaucuuccgcugccuuggaccgcuggggccgacacguccgaagugcacuggaauuacaaagagagaaugguuaccuucaaggugccccaugccaaacgccaggaugucacagugcucggcagccaggaaggagcuaugcacuccgcgcuggccggcgcuaccgagguugacucugggaacggaaaucacauguuugccggccaucuuaagugcaaggugcggauggaaaaacugagaauuaaggggaugagcuauacaauguguuccggaaaauucagcaucgauaaggagauggccgagacccaacacggcacgacagucgugaaagugaaguacgaaggggcuggcgccccuugcaagguucccauugagauccgcgacgucaacaaagaaaagguggugggacggauuaucucuuccacccccuucgcggagaacacaaauagcgucaccaacaucgagcucgaaccuccguuuggcgauucuuauauugugaucgggguuggagacagcgcucugacccugcauugguucagaaaaggcuccucuauugggaagauguuugagagcacauaccgcggagccaaacggauggccauccucggcgaaacggcuugggauuucggguccgugggcggacuguuuaccagccuuggcaaggccauucaccaggucuucgggucuguguauacaaccauguuuggaggcguuuccuggaugaucagaauccugauugggcuccuggugcuguggaucggaacaaauagccgcaacaccucuauggcuaugacguguauugccgucggcgggaucacacuuuuccucggcuuuaccgugcaggcggacaugggaugcguuguguccuggaauggcaaggagcugaaaugugggagcggaauuuucgucguggauaacgugcauaccuggacagaacaauacaaguuucagcccgaguccccugcccggcuggcuucugccauccucaaugcucacaaagacggcgucugcgggauuagaagcaccacacgccuggagaacguuauguggaagcagaucacgaaugaacuuaacuaugugcugugggagggaggccacgaccucaccguggucgccggcgaugugaaagggguucugacaaagggaaagcgggcgcugacccccccugugaaugaccuuaaauacuccuggaagacauggggcaaagccaagaucuucacccccgaagcuagaaacucuacguuucucauugaugggccggacaccagcgaguguccuaaugaacggcgcgccuggaacuuccuggaggucgaggauuacggauucggcauguuuuccacaaauaucuggaugaaauucagagaagggagcucugaggugugcgaccaucggcugauguccgcugccauuaaggaucagaaagccguucacgcugacaugggauauuggaucgaaagcucuaagaaccaaaccuggcagauugagaaggcgucccucaucgaagugaaaacaugucuguggcccaagacccauacacuuuggagcaacggcguccuggagucucagaugcucaucccuagaagcuacgccggccccuuuucccagcacaauuaucgccaaggguacgcuacccagauugccggaccuuggcaccugggcaaacuggagaucgauuucggggaaugccccggaacgacagugaccauucaggaggacugcgaucaucggggcccgagccuuagaaccacaaccgccucugggaagcucguuacgcagugguguugccgcuccuguacaaugccuccccugagauuucugggagaagacggcugcugguauggcauggagauccggccccucagcgagaaagaagagaacauggugaagucccaagucaccgcugggcagggaacaucugaaaccuucagcaugggccugcuuugucugacacucuuuguggaggaaugccugcgcagacgggugacccgcaagcacaugauucuggucguuacgaucaccuucugugccaucauucuugggggacucacauggauggaucugcugagagcgcucaucaugcugggcgacaccauguccgggcggauuggaggccagauccaucuugcuauuauggccguguuuaaaaugucuccuggcuacgugcugggggucuuccuccgcaagcugacaagcagagagaccgcccugauggugaucggaauggcuaugacgacaguuuuuuccaucccgcacgaccuuauggagcugauugauggcaucucucucgggcugauucuccugaaaaucgugacccauuucgacgauacacaggucggaacccuugcccugagccucaccuuuauucgguccacaacgccccuggugauggcguggcgcaccaucauggcuguuuucuucguggucacacugauuccucuuugcagaaccagcugucugcaaaagcagucucacuggguggaaaucacagcccucauccugggcgcccaggcucuccccgucuaucugaugacccuuaugaaaggggccucccggagaagcuggccucugaaugagggaauuauggcugugggccucguuucucugcugggcuccgcccuucugaagaacgacgugccccucgcggggccuauggucgccggaggccugcuccuggcugccuacgugaugagcgggucuuccgcugaucuuagccuggaaaaggccgccaauguucaaugggacgagauggcugauaucacgggauccagccccauuaucgaagugaaacaggacgaggauggcucuuuuagcauucgcgacgucgaggaaacaaacaugaucacccugcucgugaagcuggcgcuuaucaccguguccgggcuguacccgcucgccauuccuguuacaauggcucugugguauaucuggcaggucaaaacccagcggucuggagcccucugggaugugcccagcccuguggccacacaaaaggcuacgcuguccgagggcgucuacagaauuaugcagcgcggccuuuucgggaaaacccaggugggaguuggcauccacauggaagggguguuucauacaauguggcacgucacccggggaucugugauuugccaugagacaggcagacuggaacccagcugggccgacguucgcaaugauaugaucuccuaugggggaggcuggcggcugggcgacaagugggacaaggaggaggaugugcagguccucgcgaucgaaccggggaaaaacccuaagcacgugcaaaccaaacccggacuguucaagacgcuuaccggcgagauuggggcuguuacacuggacuuuaaaccuggaaccucuggcagccccaucauuaauaagaaagggaaggugaucggccucuacggaaacggcgucgugacaaaguccggggauuaugugagcgccauuacccaggccgaaagaaucggagagcccgacuacgaggucgaugaagacauuuuccgcaaaaagcggcugacaaucauggaucuccauccuggcgcugggaaaacgaagagaauccugccgucuauuguucgggaggcccuuaaacgcagacugcggacccugauccucgcgcccacacgcgugguggcugccgaaauggaggaagcccugagaggacuuccuauucgguaucagacccccgcugucaaguccgagcacaccggcagagagaucguggaccugaugugucacgccacauuuacgacccgccuccugagcucuacacggguuccuaauuacaaccucauugugauggaugaagcucauuucaccgaccccugcuccgucgccgcgagaggguacaucagcacacgcguggagaugggcgaagccgcugccaucuuuaugaccgcuacgccuccgggauccacagaucccuucccucagucuaauagccccauugaggacaucgaacgggagauuccugagagauccuggaacaccggcuuugacuggaucaccgauuaucaagggaagacaguuugguucgugcccagcauuaaagccggaaaugacaucgccaacugccugcgcaagucuggcaaacgggucauccagcuuuccagaaagaccuucgauacagaauacccgaaaaccaagcugacggacugggauuuuguggucacaaccgacauuagcgagaugggggcuaacuuccgcgcgggaagagugaucgauccucggcgcugucugaagcccguuauucucacagacggccccgaaagagugauccuggccgggccuauucccgugaccccugcuucugccgcccagcggcgcggcagaaucggacggaauccggcucaagaggaugaccaguaugucuuuagcggcgauccccuuaaaaacgacgaagaucacgcccauuggacggaggcgaagaugcugcucgacaauauuuacaccccugaggggaucauccccacacuguucggaccugaaagagagaaaacccaggcuauugacggcgaauuucgccugcggggggagcagagaaagacauucguugagcucaugcgccggggagaucuucccguguggcuguccuauaaaguggccucugccggcaucagcuacaaggacagagaauggugcuuuaccggcgagcggaacaaucaaauucuggaagagaacauggaagucgagaucuggacacgcgagggggaaaagaaaaagcucagaccgaaauggcuggaugcucggguguaugccgacccuauggcgcuuaaggauuucaaagaguuugccuccggacgcaagucuauuacccuggacauccucacggaaaucgcuacacugcccaccuaccugagcuccaaggccaaacucgcucuugauaauauuguuaugcugcacaccacagagaagggcgggagagccuaccagcacgcucugaacgaacucccugagagccuggagacccuuaugcugguggcccuccugggagcgaugacagccggcaucuuccuguuuuucaugcaggggaaaggaauuggcaagcucucuaucggccuuauugcuaucgccgucgcuuccgggcugcuguggguggccgaaauccagccccaauggauugccgcuagcaucauucucgaguuuuuccugaugguccuucugaucccugaacccgagaaacagcggacgccgcaggacaaucagcucauuuaugugauccugaccauucugacaaucaucggacucauugcggccaacgaaaugggccuuaucgagaagaccaaaacagauuucggguuuuaccaaguuaagaccgagacgaccauucuggacguggaucugcgcccugcuuccgccuggacacucuaugccgucgcuaccacaauccugacccccaugcuuagacauacgauugaaaauacaucugccaaccugagccucgcggccaucgcuaaucaggccgcugugcugaugggacugggcaagggguggccccuccaccggauggaccuuggaguuccucugcuggccaugggcuguuacucccaggugaacccgaccacacucaccgcgucucuggucaugcuucuggugcauuaugccaucauuggccccgggcuccaggcuaaagccacccgcgaggcucaaaagagaacagccgcuggaaucaugaaaaauccuacgguggauggcauuaccguuaucgaccuggaacccauuagcuacgacccuaaguucgagaaacagcuggggcaggucaugcuccuugugcugugcgugggacaacugcuccugaugcggacaaccugggcccuuugugagguccugacacucgcgaccggccccaucaugacgcugugggaagggaacccuggaagauuuuggaacacaaccaucgccguuuccaccgcuaauauuuuccgcggcagcuaucuggccggcgcugggcucgccuuuucucuuaucaagaacgcccagacaccgcggagaggaaccggcacaacgggggagacccugggagaaaaguggaaacgccagcugaauucccucgaucggaaggaguucgaagaguacaaaagaagcggcauucuggagguggaccgcacagaagcgaagucugcucuucgggauggguccaaaaucaagcacgccgugagcagaggaucuagcaagauucgcuggaucgucgagcggggcaugauuaaacccaagggcaaagugguugaccuggggugcggaagaggcgggugguccuacuauauggcuacccucaagaacgugacagaagucaaaggauacaccaagggcgggccuggacaugaggaacccaucccuauggccacguauggcuggaaucuggugaagcugcacucuggcguugauguguuuuacaaacccaccgagcaggucgacacacuccuuugugauaucggggagagcuccagcaacccgaccauugaagagggacgcacacugcgggugcugaagaugguggaaccuuggcucuccucuaaacccgaguucugcaucaagguccugaaucccuauaugccuaccguuauugaagagcuugagaaacugcaaagacgccacggcgggagccucgugagauguccccugucccggaacucuacacaugaaauguacugggugagcggagccuccggcaauaucgucucuagcgugaacaccauuuccaagaugcugcucaaucgcuuuacgacaagacaccggaaaccuaccuaugagaaggacguugaucuuggggcuggaaccagaagcgugucuacagaaacggagaagccggacaugaccaucaucggccggcgccugcagagacugcgggaggaacauaaagagacauggcacuacgaucaggaaaaccccuaccgcaccugggccuaucacggcuccuacgaggcgccuagcacagggucugccuccagcauggucaauggagugguuaagcuccugaccaaacccugggacgugauuccuauggucacacagcuugcuaugaccgacacgacccccuucggccaacagagaguguuuaaggaaaaaguugauacacggaccccgcagccuaagcccgggacacgcaugaucaugaccacgacagccaacuggcugugggcucuccugggaaagaaaaagucuccuagacugugcacccgggaggaguucauuuccaaagugcgcagcaaugccgcgaucggcgccgucuuucaggaagagcaaggguggacauccgcuagcgaagccgugaacgacucuagauucugggagcucgucgauaaggaacgggcucugcaucaggagggcaaaugugagagcugcguguauaauaugaugggaaagcgcgaaaagaaacuuggcgaguucgggagagccaagggaucccgggcuauuugguacauguggcugggcgcccgcuuucucgaauucgaggcgcugggguuucuuaacgaagaccacugguucucuagagagaacagcugguccggaguugagggcgaagggcugcaucggcucggcuauauccuggaggauaucgacaaaaaggauggagaccugauuuacgccgaugacaccgcuggcugggauacgagaaucaccgaagacgaucuccugaaugaggagcuuauuacagaacagauggccccccaccauaaaacccuggcuaaggccaucuuuaagcucacauaucaaaacaaaguggucaaggugcugcgcccuacccccaaaggggccgugauggacauuaucucucggaaggaccagagaggaagcggccagguugggacauacggacuuaauaccuucacgaacauggaggugcagcugauccgccaaauggaagcggagggcgucauuacacaggaugacaugcagaauccgaaagggcucgaagagcggguggagaaguggcugaaagaaugcggcguugauagacugaagcgcauggcuaucuccggagacgauuguguggucaagccucucgacgagcgguuuucuaccagccugcuuuuccugaacgauaugggcaaagugagaaaggacauuccccagugggaacccuccaaaggguggaagaauuggcaagaggucccuuuuugcagccaccacuuccauaaaaucuuuaugaaggauggacgcucucucgugguuccgugucggaaccaggacgaacugauuggcagagcccgcaucucccagggggccggauggagccuucgggagaccgcuugccugggcaaggccuacgcucagauguggucucucauguauuuccacagacgggaucugagacuggccuccauggcgauuuguagcgccgugcccacagagugguuuccuaucucccgcaccacauggucuauccaugcucaccaccaauggaugacgaccgaagacaugcucaaagucuggaaucggguguggauugaggacaaccccaauaugacagauaagaccccuauccauagcugggaagacauucccuaccuggggaaaagagaggaucuuuggugcggcucccugaucggacucagcucucgcgccacaugggcuaagaacauucacaccgccaucucccagguuagaaaucugaucggcaaagaagaguauguggacuacaugccugucaugaagcgguauagcgcgcccucugagagcgaaggggugcuuuga

SEQ ID NO: 21025 - RNA, 9867 nt, Artificial Sequence
  derived and/or modified CDS sequence (opt5) from DENV-4__KC762696__SS-prME
agcaccaugacccugcucugccugauccccacggugauggccuuccaccuuuccaccagagacggcgagccucugaugauuguggcuaagcaugaacgggggcgcccgcuccuguuuaagaccaccgagggaaucaacaaguguacacuuauugccauggaucugggcgaaaugugcgaggacaccguuacauacaaguguccccuccuggugaauaccgaaccugaggauaucgacugcugguguaaccugacgucuaccugggugauguaugggacaugcacccagagcggagagagacggcgcgaaaagagauccgucgcccucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguauugaagcuagcaucucuaauauuaccacagccacccgcugcccgacgcaaggagagcccuaucuuaaggaggaacaggaccagcaguacaucuguagacgggaugugguggaccgcggcugggggaacggaugcggccuguucgggaaaggaggcgucgugacaugcgcgaaguuucucuguuccggcaaaauuaccgggaaucugguucaaaucgagaaccuugaauauaccguggucgugacaguucauaauggagauacccacgccgugggcaacgacacaagcaaucacggggucacggcuaccauuacaccuagaucucccuccguggaggucaagcugccugauuacggagaacucacccuggacugcgagccccggagcggcaucgacuucaacgagaugauccugaugaagaugaaaaagaaaacauggcucgugcauaagcagugguuucuggaucuuccgcugccuuggaccgccggggcugacacgucugaaguucacuggaauuacaaagagagaauggugaccuucaaggucccccaugccaaacgccaggaugugacaguucucggcucccaggaaggagccaugcacagcgcucuggcgggcgccaccgagguggacuccggggauggaaaccacauguuugcuggccaucuuaaguguaagguccggauggaaaaacugagaauuaaggggaugucuuauacaaugugcagcggaaaauucuccaucgacaaggagauggccgagacccaacacggcacgacaguggugaaaguuaaguacgaaggggccggcgcuccuuguaagguccccauugagauccgcgaugugaauaaagaaaagguggucggacggauuaucagcucuacccccuucgccgagaacacaaacuccgugaccaauaucgagcucgaaccuccguuuggcgacagcuauauuguuaucggggugggagauucugcgcugacccugcauugguucagaaaaggcagcuccauugggaagauguuugagucuacauaccgcggagcuaaacggauggccauccucggcgaaacggccugggacuucgggagcgucggcggacuguuuaccucccuuggcaaggcugugcaccagguuuucgggagcguguauacaaccauguuuggaggcgucucuuggaugauuagaauccugaucggguuccucgugcuguggauuggaacaaacucccgcaauaccagcauggccaugacgugcaucgcuguuggcgggauuacacuguuucuuggcuucaccgugcaggccgauaugggaugugucgugucuuggaacggcaaggagcucaaaugcggguccggaaucuuuguggucgacaauguucauaccuggacagaacaauacaaguuccagcccgagagcccugcgcggcuggccuccgcuauucugaacgcccacaaagacggcgugugugggaucagaucuaccacacgccucgagaaugugauguggaagcagauuacgaacgaacugaauuauguccuuugggagggaggccacgaucugaccgugguugcuggcgacgugaaagggguccucacaaagggaaagcgggcccugacacccccugugaacgaucugaaauacagcuggaagacauggggcaaagcgaagaucuuuacccccgaagccagaaauuccacguuccuuaucgacgggccggauaccucugagugcccuaacgaacggcgcgcuuggaauuucuuugagguugaggacuacggauucggcauguuuacaaccaacauuuggaugaaauucagagaagggagcuccgaggugugugaucaucggcucaugagcgccgcuaucaaggaccagaaagccguccacgccgauaugggauauuggauugaaucuuccaagaaucaaacauggcagaucgagaaggcuagccugauugaagugaaaaccugccuguggcccaagacacauacccucuggucuaacggcguucuggagucccagaugcuuaucccuagaagcuacgcgggccccuuuucucagcacaacuaucgccaaggguacgccacgcagacagcuggaccuuggcaccugggcaaacucgagaucgacuucggggaaugccccggaaccaccgugacaauucaggaggauugugaccaucggggcccgagccugagaaccacgacagccuccgggaagcuggucacccaguggugcugucgcagcugcacaaugccuccccuuagauuucucggagaagauggcuguugguauggcauggagauccggccccugucugagaaagaagagaauauggugaagucccaagugaccgccgggcagggaacaagcgaaaccuucuccaugggccugcucugccugacgcuuuuugucgaggaaugucugcgcagacggguuacccgcaagcacaugauucucgugguggucaucacauucugcgcuauuauccucgggggacugaccuggauggaccuucucagagcccugaucaugcugggcgacacaaugucugggcggauuggaggccagauccaucucgcgauuauggcuguguuuaaaaugagcccuggcuacguucuggggguguuccuucgcaagcugaccuccagagagacggcccucauggucaucggaauggccaugacaaccguguuuucuauuccgcacgaucugauggagcugaucgacggcaucagccuugggcugauuauccucaaaauuguuacacauuucgauaacacccaggugggaacccuggcucucucccugacauucauccggucuacgacaccccuugucauggccuggcgcacaauuauggcgguguuuuucgucgugacccugaucccucucuguagaacaagcugccugcaaaagcagucccacuggguugaaauuaccgcucugauccuuggcgcccaggcccugcccguguaucucaugacgcugaugaaaggggcuagccggagaucuuggccucucaaugagggaaucauggccgucggccuggugucccuucugggcagcgcucuccugaagaacgacguuccccuggccgggccuaugguggcgggaggccuucugcucgccgcuuacgucaugucuggguccagcgccgaucugucucucgaaaaggcugccaaugugcaaugggacgagauggccgauauuacaggauccagccccaucauugaagugaaacaggacgaggauggcuccuuuagcauccgcgacguugaggaaaccaacaugauuacccugcuugucaagcuggcucugaucacagugucugggcucuacccgcuggcgaucccugugaccauggcccuuugguaugucuggcaagugaaaacacagcggagcggagcucugugggauguucccuccccugccgccacgcaaaaggcuacccucucugagggcguguacagaauuaugcagcgcggccuguucgggaaaacacaggucggagugggcauccacauggaagggguuuuucauaccauguggcacgugacacggggaagcgucauuugucaugagaccggcagacucgaacccuccugggccgacgugcgcaaugauaugaucucuuaugggggaggcuggcggcugggcgacaagugggacaaggaggaggauguucaggugcuugcgauugaaccggggaaaaacccuaagcacguccaaacgaaacccggacuguucaagacccugacaggcgagaucggggcugugacccucgacuuuaaaccuggaacaagcggcucccccaucauuaauaagaaagggaaggugaucggccuguacggaaacggcgucguuaccaagucuggggauuaugugagcgccauuacacaggccgaaagaaucggagagcccgacuacgagguggaugaagacauuuuccgcaaaaagcggcuuacgaucauggaucugcauccuggcgcugggaaaaccaagcggauucugccguccaucguccgggaggcccugaaacgcagacuccggacacugauccuugcgcccacccgcgugguugcugccgaaauggaggaagcccugagaggacugccuauucgguaucagacccccgcugucaagagcgagcacacaggcagagagaucgucgaccucaugugccacgccacguuuaccacacgccugcuuucuuccacccgggugccuaauuacaaccugauuguuauggaugaagcucauuucacagaccccugcagcguggccgcgagaggguacaucucuacccgcgucgagaugggcgaagccgcugccauuuuuaugacggcuacaccuccgggauccaucgaucccuucccucagagcaauucccccaucgaggacauugaacgggagaucccugagagaucuuggaacaccggcuucgacuggauuaccgauuaucaagggaagacagugugguuuguccccagcaucaaagccggaaaugacauugccaacugucuccgcaaguccggcaaacgggugauccagcugagcagaaagaccuucgauacagaauacccgaaaaccaagcucacggacugggauuuuguugugacaaccgacaucucugagaugggggcuaacuuccgcgcgggaagagugauugauccucggcgcugccugaagcccgucauccuuacagacggccccgaaagaguuauucuggccgggccuauccccgugaccccugcuuccgccgcccagcggcgcggcagaauuggacggaauccggcucaagaggaugaccaguauguguuuagcggcgauccccugaaaaacgacgaagaucacgcccauuggacggaggcgaagaugcuccuggacaauaucuacaccccugaggggauuauccccacacuuuucggaccugaaagagagaaaacccaggcuaucgacggcgaauuucgccugagaggggaacagagaaagacauucgucgagcucaugcgccggggagaucugcccguguggcugucuuauaaaguugccagcgccggcauuuccuacaaggacagagaaugguguuuuaccggcgagcggaacaaucaaauccucgaagagaacauggaaguggagauuuggacacgcgagggggaaaagaagaaacuuagaccgaaauggcuggaugcucgggucuaugccgacccuauggcgcugaaagauuucaaagaguuugccucuggacgcaagagcaucacccucgacauucugacggaaaucgcuacacuucccaccuaccuguccucuaaggccaaacucgcucuggauaauaucgugaugcugcacaccacagagaagggcgggagagccuaccagcacgcucucaacgaacuuccugagagccuggagacccugaugcucgucgcccugcuuggagcgaugacagccggcauuuuccuguuuuucaugcaggggaaaggaaucggcaagcucuccaugggccugauugcuaucgccguggcuagcgggcugcucuggguugccgaaauucagccccaauggaucgccgcuucuaucauucuugaguucuuucugauggugcugcucaucccugaacccgagaaacagcggacgccgcaggacaaucagcugauuuaugucauccuuaccauucugacaaucauuggacucaucgcggccaacgaaaugggccugaucgagaagaccaaaacagauuucggguuuuaccaagugaagaccgagacgaccauucuggacguugaucuccgcccugcuuccgccuggacacuuuaugccguggcuaccacaauccugacccccaugcugagacauacgauugaaaauacaagcgccaaccucucccuggcggccaucgcuaaucaggccgcuguccuuaugggacugggcaagggguggccccuccaccggauggaccugggagugccucugcucgccaugggcugcuacucucaggugaacccgaccacacuuaccgcgagccugguuaugcugcucguccauuaugccauuaucggccccgggcugcaggcuaaagccacccgcgaggcucaaaagagaacagccgcuggaaucaugaaaaauccuacgguggauggcauuaccgugaucgaccuugaacccauuuccuacgacccuaaguucgagaaacagcuggggcaggucaugcuccugguucugugugugggacaacuccuucugaugcggacaaccugggcccugugcgaggugcucacacuggcgaccggccccgucaugacgcuuugggaagggaacccuggaagauuuuggaacacaaccaucgccgugucuaccgcuaauauuuuccgcggcagcuaucuggccggcgcugggcucgccuuuucccugaucaagaacgcccagacaccgcggagaggaaccggcacaacgggggagacccugggagaaaaguggaaacgccagcucaauagccuugaucggaaggaguucgaagaguacaaaagaucuggcauccuggagguugaccgcacagaagcgaaguccgcucugcgggaugggagcaaaauuaaguacgccgugucuagaggauccagcaagauccgcuggauugucgagcggggcaugaucaaacccaagggcaaagugguugaccucggguguggaagaggcggguggucuuauuacauggcuacccugaagaacgugacagaagucaaaggauauaccaagggcgggccuggacacgaggaacccauuccuauggccacguacggcuggaaucuugugaagcugcauagcggcguggaugucuuuuauaaacccaccgagcagguugacacacuccugugcgauaucggggaguccucuagcaacccgaccauugaagagggacgcacacugcgggugcucaagaugguggaaccuuggcuuuccagcaaacccgaguucuguaucaagguccugaaucccuacaugccuaccgugaucgaggaacuggagaaacuccaaagacgccacggcgggucccugguuagaugcccccuuucucggaacagcacacacgaaauguauuggguguccggagccucuggcaauauugucagcuccgugaacaccaucucuaagaugcugcucaaucgcuuuacgacaagacaucggaaaccuaccuacgagaaggacguugaucugggggcuggaaccagaagcguguccacagaaacggagaagccggacaugaccauuaucggccggcgccugcagagacuccgggaggaacacaaagagacauggcauuacgaucaggaaaaccccuaucgcaccugggccuaccacggcagcuaugaggcgccuucuacaggguccgccagcucuauggucaauggagugguuaaacuucugaccaaacccugggacgugauuccuauggucacacagcuggcuaugaccgacacgacccccuucggccaacagagaguguuuaaggaaaaagucgauacacggaccccgcagccuaagcccgggacacgcaugaucaugaccacgacagccaacuggcucugggcucugcuuggaaagaaaaaguccccuagacuguguacccgggaggaguucaucagcaaagugcgcucuaaugccgcgauuggcgccguuuuccaggaggaacagggguggacauccgcuagcgaagccgugaacgacuccagauuuugggagcucgucgauaaggaacgggcucugcaccaggagggcaaaugcgagagcugcguguacaauaugaugggaaagcgcgaaaagaaacugggcgaguucgggagagccaagggaucucgggcuaucugguauauguggcucggcgcccgcuuucuggaguucgaggcgcuuggguuucugaacgaagaccauugguucagcagagagaacuccuggucuggaguggagggcgaagggcuccaccggcugggcuacauucuugaggauaucgacaaaaaggauggagaccugauuuaugccgaugacaccgcuggcugggauacgagaaucaccgaagacgaucuccugaaugaggagcugaucacagaacagauggcgccccaucacaaaacccucgcuaaggccauuuuuaagcugacauaccaaaacaaaguugugaagguccuucgcccuacccccaaaggggccgugauggacaucauuagccggaaggaccagagaggauccggccagguugggacauacggacugaauaccuucacgaacauggaggugcagcucauccgccaaauggaagcggagggcgucauuacacaggaugacaugcagaauccgaaagggcugaaggaacggguggagaaauggcuuaaggaguguggcgucgauagacugaagcgcauggcuaucucuggagacgauugcgugguuaaaccucucgacgaacgguuuagcaccucccugcuguuccucaacgauaugggcaaggugagaaaagacaucccccagugggagcccucuaagggguggaaaaauuggcaagaagucccuuuuuguagccaucacuuccacaagauuuuuaugaaggauggacgcucccuggugguuccgugccggaaccccgacgagcuuaucggcagagcccgcauuagccagggggccggauggucucugcgggaaaccgcuugucucggcaaagccuaugcucagauguggucccugauguacuuccauagacgggaucuuagacuggccagcauggcgaucugcucugccgugccuacagagugguuccccaccucccgcacaacguggagcauucacgcucaucaccaguggaugaccacagaggacaugcucaaggucuggaaucggguguggaucgaagacaacccuaauaugaccgauaaaacacccgugcacuccugggaggacauuccuuaucuggggaagagagaagaucugugguguggcucucucaucggacugagcucccgcgccaccugggcuaaaaacauccauacggccauuacccaaguuagaaaucuuaucggcaaggaggaauacgucgacuauaugcccgcgaugaagcgguacagcgccccguuugagucugagggggugcuguga

SEQ ID NO: 21026 - RNA, 9867 nt, Artificial Sequence
  derived and/or modified CDS sequence (opt5) from DENV-4__KC762697__SS-prME
agcaccaugacccugcugugccugauccccacggccauggcuuuccaucuuuccacccgggacggcgagccucugaugauuguggccaagcaugaacgggggcgcccgcuccuguuuaagacaaccgagggaaucaacaaguguacacuuauugcgauggaucugggcgaaaugugcgaggacaccgugacauacaaguguccccuccugguuaauaccgaaccugaggauaucgacugcugguguaaccugacgucuaccugggugauguaugggacaugcacccagagcggagagagacggcgcgaaaagagauccguggcucucacaccccacucuggcauggggcuggagacccgggccgaaacguggaugagcuccgagggagccuggaaacaugcucaacgcgucgagucuuggauucuuagaaauccuggcuucgcccugcucgcuggcuuuauggccuacaugaucgggcagacaggaauccagcggaccguguucuuuguucugaugaugcuuguggcgcccagcuauggcaugcgcugugucggggugggaaacagagauuucguugaaggcguguccgggggagccugggucgaccuggugcucgagcacggcggcugcgugacaaccauggcucaggggaagccuacccuggauuuugaacugacaaagacgaccgccaaagaggucgcucuccugcggacauacuguauugaagccagcaucucuaauauuaccacagcgacccgcugcccgacgcaaggagagcccuaucuuaaggaggaacaggaccagcaguacaucuguagacgggauguuguggaccgcggcugggggaacggaugcggccuguucgggaaaggaggcguggucacaugcgccaaguuucucuguuccggcaaaauuaccgggaaucuggugcaaaucgagaaccuugaauauaccguuguggucacagugcauaauggagauacccacgcuguuggcaacgacacaagcaaucacggggugacggccaccauuacaccuagaucucccuccgucgaggugaagcugccugauuacggagaacucacccuggacugcgagccccggagcggcaucgacuucaacgagaugauccugaugaagaugaaaaagaaaacauggcucguccauaagcagugguuucuggaucuuccgcugccuuggaccgcuggggccgacacgucugaagugcacuggaauuacaaagagagaaugguuaccuucaaggugccccaugccaaacgccaggaugucacagugcucggcucccaggaaggagcuaugcacagcgcgcuggccggcgcuaccgagguugacuccggggauggaaaccacauguuugccggccaucuuaaguguaaggugcggauggaaaaacugagaauuaaggggaugucuuauacaaugugcagcggaaaauucuccaucgacaaggagauggccgagacccaacacggcacgacagucgugaaagugaaguacgaaggggcuggcgccccuuguaagguucccauugagauccgcgaugucaauaaagaaaagguggugggacggauuaucagcucuacccccuucgcggagaacacaaacuccgucaccaauaucgagcucgaaccuccguuuggcgacagcuauauugugaucgggguuggagauucugcucugacccugcauugguucagaaaaggcagcuccauugggaagauguuugagucuacauaccgcggagccaaacggauggccauccucggcgaaacggcuugggacuucgggagcgugggcggacuguuuaccucccuuggcaaggccguccaccagguguucgggagcguuuauacaaccauguuuggaggcgugucuuggaugauuagaauccugaucgggcuccugguccuguggauuggaacaaacucccgcaauaccagcauggcuaugacgugcaucgccgugggcgggauuacacuuuuccucggcuuuaccguucaggcggauaugggauguguggucucuuggaacggcaaggagcugaaaugcggguccggaaucuucgugguggacaauguccauaccuggacagaacaauacaaguuucagcccgagagcccugcccggcuggcuuccgccauucucaacgcucacaaagacggcguuugugggaucagaucuaccacacgccuggagaaugugauguggaagcagauuacgaacgaacuuaauuaugugcugugggagggaggccacgaucucaccgucguggccggcgacguuaaaggggugcugacaaagggaaagcggguccugacacccccugugaacgaucuuaaauacagcuggaagacauggggcaaagcgaagaucuucacccccgaagccagaaauuccacguuucucaucgacgggccggauaccucugagugcccuaacgaacggcgcgcuuggaauuucuucgagguugaggacuacggauuuggcauguucagcacaaacauuuggaugaaauuuagagaaggguccagcgaggugugugaucaucggcugaugucugccgcuaucaaggaccagaaagccguccacgccgauaugggauauuggauugaauccagcaagaaucaaaccuggcagaucgagaaggcuucucugauugaagugaaaacaugccucuggcccaagacccauacacugugguccaacggcguucuugagagccagaugcugaucccuagaucuuacgcgggccccuucagccagcacaacuaucgccaaggguacgccacccagaucgcuggaccuuggcaccucggcaaacuggagauugacuuuggggaaugccccggaacgacagugaccauccaggaggauugugaccaucggggcccgucccugagaaccacaaccgccagcgggaaacuugucacgcaguggugcugucgcucuugcacaaugccuccccucagauuccugggagaagauggcuguugguauggcauggagauucggccccuguccgagaaagaagagaauauggucaagagccaagugaccgccgggcagggaacauccgaaaccuuuucuaugggccuccugugccuuacacuguucgucgaggaaugucuccgcagacggguuacccgcaagcacaugauccuggugguggcuauuacguuuugcgccaucauccucgggggacuuaccuggauggaccuccugagagcgcugauuaugcucggcgacacaaugagcgggcggaucggaggccagauucaucuggcuaucauggccgucuucaaaauguccccuggcuacgugcuugggguuuuucugcgcaagcucaccucuagagagacagcccugauggugauuggaauggcuaugaccacggucuucagcaucccgcacgaucugauggagcuuaucgacggcauuucccuggggcucauccugcucaaaauugugacacauuuugaugacacccagguuggaacacuggcccuuucucugaccuucauccggagcaccacaccccucgugauggcguggcgcacgauuauggcugucuucuuuauggugacccugaucccucuguguagaacauccugccuucaaaagcagagccacugggucgaaauuaccgcccugauccucggcgcccaggcucugcccguguaucucaugacacugaugaaaggggccucucggagauccuggccucuuaacgagggaaucauggcuguuggccuggugagccuccugggcucugcccugcuuaagaaugaugucccccuggcggggccuaugguggccggaggccuccugcucgcugccuacguuauguccgggagcucugcugaccugucccuugaaaaggccgccaacgugcaaugggaugagauggcugacauuaccggaagcucccccaucauugaagucaaacaggaugaggacggcagcuucucuauccgcgauguggaggaaacgaauaugauuacacugcuggugaagcucgcgcugaucaccguuagcgggcuuuacccgcuggccaucccugucaccauggcucucugguauauuuggcaagugaaaacacagcgguccggagcccugugggacgugcccucuccugccgcuacccaaaaggccacacucagcgagggcgucuacagaaucaugcagcgcggccuguuugggaaaacacaggugggaguuggcauucacauggaagggguguuccauaccauguggcacgucacacggggauccgugaucugucaugagaccggcagacuugaacccucuugggcggauguucgcaacgacaugauuagcuaugggggaggcuggcggcugggcgacaagugggauaaggaggaggacgugcagguccuggcuaucgaaccggggaaaaauccuaagcacgugcaaacaaaacccggacucuuuaagacccugacgggcgagaucggggccguuacccuugauuucaaaccuggaacauccggcucucccauuaucaacaagaaagggaaggugauuggccuguacggaaauggcgucgugaccaagagcggggacuauguguccgccaucacacaggcugaaagaauuggagagcccgauuacgaggucgacgaagauaucuuucgcaaaaagcggcucaccauuauggaccugcauccuggcgccgggaaaacaaagagaauccucccgagcaucguucgggaggcgcugaaacgcagacuucggacgcugauucuggcucccacccgcgugguggccgccgaaauggaggaagcucucagaggacugccuauccgguaucagacacccgccgucaaggcugagcacaccggcagagagauuguggaucuuaugugccacgccaccuucacaacgcgccugcucucuuccacccggguuccuaacuacaaucugaucgugauggacgaagcgcauuuuacagaucccugcagcgucgccgcuagaggguacauuucuacccgcguggagaugggcgaagccgcugccaucuucaugacagccaccccuccgggauccacggaccccuuuccucagagcaacucccccaucgaggacauugaacgggagaucccugagagaucuuggaauacaggcuucgauuggauuaccgacuaucaagggaagaccguuugguucgugcccagcaucaaagcuggaaacgauauugcgaauugucuccgcaaguccggcaaacgggucauccagcugagcagaaagacauuugacaccgaauacccgaaaacaaaacuuaccgauugggacuucguggucacgacagauaucucugagaugggggccaacuuucgcgcuggaagagugauugacccucggcgcugccugaagcccguuauccugaccgauggccccgaaagagugauucucgccgggccuauccccgugacgccugccuccgcugcccagcggcgcggcagaauuggacggaacccggcgcaagaggacgaucaguaugucuucagcggcgacccccugaaaaaugaugaagaccacgcucauuggaccgaggccaagaugcuucuggacaacaucuacacgccugaggggauuauccccacccucuuuggaccugaaagagagaaaacacaggccaucgauggcgaguuccgccugagaggggaacagagaaagaccuuuguugagcugaugcgccggggagaccuccccguguggcuuucuuauaaaguggcuagcgccggcauuuccuacaaggauagagaaugguguuucacaggcgagcggaauaaccaaauccuggaagagaauauggaagucgagauuuggacccgcgagggggaaaagaaaaagcugagaccgaaauggcucgacgcgcggguguaugccgauccuauggcucugaaggacuuuaaagaguucgccucuggacgcaagagcaucacacuugauauucugaccgaaaucgcuacgcuccccacauaccuguccucuaaggccaaacuggcucucgacaacaucguuaugcuucacaccaccgagaagggcgggagagccuaccagcacgcgcugaaugaacugccugagagccucgagacacugaugcuuguggcccugcucggagcuaugaccgccggcauuuuucuguucuuuaugcaggggaaaggaaucggcaagcuguccaugggccucauugcuaucgccgucgccagcgggcuucuguggguggcugaaauucagccccaauggaucgcggccucuaucauucuggaguucuuccucaugguccugcuuaucccugaacccgagaaacagcggacaccgcaggauaaccagcugauuuaugugauccucacgauucugaccaucauuggacugaucgcugccaaugaaaugggccucaucgagaagacaaaaaccgacuuuggguucuaccaagccaagacagagaccacgauucuugauguugaccugcgcccugcuuccgccuggacccuguaugcgguggccacaaccauccucacacccaugcugagacauaccauugaaaacacgagcgcuaaucuuucccuggccgcuaucgccaaccaggcggccguccucaugggacugggcaagggguggccccugcaccggauggaucucggagugccucuucuggcuaugggcugcuacucucagguuaauccgacaacccugacagccagccucgugaugcugcuuguccauuaugcuauuaucggccccgggcugcaggccaaagcuacccgcgaggcccaaaagagaaccgcggccggaaucaugaaaaacccuacaguggacggcauuacggugaucgaccucgaacccauuuccuacgauccuaaguuugagaaacagcuggggcagguuaugcugcucguccuuugugugggacaacugcugcucaugcggaccacaugggcucugugcgaggugcuuacccuggccacaggccccaucaugacccucugggaagggaauccuggaagauucuggaacacgacaauugcugucucuaccgccaacaucuuucgcggcagcuaucuggccggcgcggggcuggcuuucucccucaucaagaaugcccagaccccgcggagaggaacaggcaccacaggggagacgcuuggagaaaaguggaaacgccagcugaacagccuggaccggaaggaguuugaagaguacaaaagaucuggcauucucgagguugaucgcaccgaagcuaaguccgcccugcgggacgggagcaaaaucaaguacgccgugucuagaggauccagcaagauucgcuggaucguggagcggggcauggucaaacccaagggcaaagugguugaucuuggguguggaagaggcggguggucuuauuacauggcuacacugaagaaugugaccgaagucaaaggauauacaaagggcgggccuggacacgaggaacccauuccuauggccaccuacggcuggaaccucgugaagcugcauagcggcguugacguguucuauaaacccacggagcaggucgauacccugcucugcgacaucggggaguccucuagcaauccgacaauugaagagggacgcacccuucgggugcugaagaugguggaaccuuggcuguccagcaaacccgaguuuuguaucaagguccucaaccccuacaugccuacaguuaucgaggaacuggagaaacuucaaagacgccacggcgggucccuggugagaugcccccucucucggaauagcacccacgaaauguauuggguguccggagcgucuggcaacauugucagcuccgugaauacaaucucuaagaugcugcugaaccgcuucaccacgagacaucggaaaccuacauacgagaaggauguugaccucggggccggaaccagaagcguguccaccgaaacagagaagccggauaugacgauuaucggccggcgccuucagagacugcgggaggaacacaaagagaccuggcauuacgaccaggaaaaucccuaucgcacaugggcuuaccacggcagcuaugaggccccuucuaccggguccgcuagcucuauggucaacggagugguuaagcugcucacaaaacccugggacgugauuccuauggucacccagcuggccaugacagauaccacgcccuuuggccaacagagaguguucaaggaaaaaguugacacccggacaccgcagccuaagcccgggacccgcaugaucaugacaaccacggcgaauuggcuuugggcccugcucggaaagaaaaaguccccuagacuguguacacgggaggaguuuaucagcaaagugcgcucuaacgcugccauuggcgcugucuuccaggaggaacagggguggaccuccgccagcgaagcugugaaugauuccagauucugggagcuggucgacaaggaacgggcccuccaccaggagggcaaaugcgagagcugcguguacaacaugaugggaaagcgcgaaaagaaacugggcgaguuugggagagcgaagggaucucgggccaucugguauauguggcuuggcgcucgcuuccuggaauuugaggcccucggguuccugaaugaagaucauugguuuagcagagagaacuccuggucuggaguugagggcgaagggcuucaccggcugggcuacauucucgaggacaucgauaaaaaggacggagaucugauuuaugcugacgauacagccggcugggacaccagaaucacggaagaugaccugcucaacgaggagcugaucaccgaacagauggcgccccaccacaaaacacuugccaaggcuauuuucaagcugaccuaccaaaauaaaguggucaaggugcuccgcccuacacccaaaggggccgugauggacaucauuagccggaaggaucagagaggauccggccagguugggaccuacggacugaacacauuuaccaauauggaggugcagcuuauccgccaaauggaagccgagggcgucauuacgcaggacgauaugcagaacccgaaagggcuggaggaacggguggagaaguggcucaaagaauguggcguugacagacugaagcgcauggcuaucucuggagaugacugcguggucaagccucuggaugagcgguucagcacaucccuccuguuucuuaaugacaugggcaaagugagaaaggauaucccccagugggaacccucuaaaggguggaagaacuggcaagaggucccuuucuguagccaucacuuucacaaaauuuucaugaaggacggacgcucccuggugguuccgugccggaaucaggaugaacucaucggcagagcccgcauuagccagggggcuggauggucucugcgggagaccgccugucuuggcaaggcguaugcccagauguggucccugauguacuuucauagacgggaccucagacuggcuagcauggccaucugcucugcugugcccaccgagugguucccuacaucccgcaccacauggagcauucacgcccaucaccaauggaugacgaccgaagacaugcugaaagucuggaaccggguguggaucgaggauaaucccaacaugacagacaagaccccuauucacuccugggaagauauccccuaucucgggaaaagagaggaccugugguguggcucucuuaucggacugagcucccgcgcgacaugggccaagaauauucauaccgcuaucacgcagguuagaaaccucauuggcaaagaagaguacguggauuauaugccugucaugaagcgguacagcgcccccucugaguccgaaggggugcuguga

SEQ ID NO: 21027 - RNA, 9867 nt, Artificial Sequence
  derived and/or modified CDS sequence (opt5) from DENV-4__KC762698__SS-prME
agcaccaugacacugcucugccugauccccacggugauggccuuccaccuuuccaccagagacggcgagccucugaugauugucgcuaagcaugaacgggggcgcccgcuccuguuuaaaacaaccgagggaaucaacaaguguacacuuauugccauggaucugggcgaaaugugcgaggacaccguuacauacaaauguccccuccuggugaauaccgaaccugaggauaucgugugcugguguaaccugacgucuaccugggucauguaugggacaugcacccagagcggagagagacggcgcgaaaagagauccguggcgcucacaccccacucuggcauggggcuggagacccgggcugaaacguggaugagcuccgagggagccuggaaacaugcccaacgcguugagucuuggauucuuagaaauccuggcuucgcucugcucgccggcuuuauggcuuacaugaucgggcagacaggaauccagcggaccguguucuuuguccugaugaugcuuguggcccccagcuauggcaugcgcuguguuggggugggaaacagagacuucgucgaaggcguguccgggggagcguggguggaucugguccucgagcacggcggcugcguuacaaccauggcccaggggaagccuacccuggacuuugaacugacaaagacgaccgcuaaagagguggcccuccugcggacauacuguauugaagcuagcaucucuaauauuaccacagccacccgcugcccgacgcaaggagagcccuaucuuaaggaggaacaggaucagcaguacaucuguagacgggacguggucgaucgcggcugggggaacggaugcggccuguucgggaaaggaggcgugguuacaugcgcgaaguuucucuguuccggcaaaauuaccgggaaucuggugcaaaucgagaaccuugaauauaccgucgugguuacagugcauaauggagacacccacgccgucggcaacgauacaagcaaucacggggugacggcuaccauuacaccuagaucucccuccgucgaggugaagcugccugacuacggagaacucacccuggauugcgagccccggagcggcaucgacuucaacgagaugauccugaugaagaugaaaaagaaaacauggcucguucauaagcagugguuucuggaccuuccgcugccuuggaccgccggggcugauacgucugaagugcacuggaauuacaaagagagaauggucaccuucaaggugccccaugccaaacgccaggacguuacagugcucggcucccaggaaggagccaugcacagcgcucuggcgggcgccaccgaggucgauuccggggacggaaaccacauguuugcuggccaucuuaaguguaaggugcggauggaaaaacugagaauuaaggggaugucuuauacaaugugcagcggaaaauucuccaucgauaaggagauggccgagacccaacacggcacgacagugguuaaagucaaguacgaaggggccggcgcuccuuguaaggugcccauugagauccgcgacgugaauaaagaaaaggucgugggacggauuaucagcucuacccccuucgccgagaacacaaacuccguuaccaauaucgagcucgaaccuccguuuggcgauagcuauauugugaucggggcgggagacucugcucugacccugcauugguucagaaaaggcagcuccauugggaagauguuugagucuacauaccgcggagccaaacggauggccauccucggcgaaacggcuugggauuucgggagcgucggcggacuguuuaccucccuuggcaaggccgugcaccagguuuucgggagcguguauacaaccauguuuggaggcgucucuuggaugauuagaauccugaucggguuccucgugcuguggauuggaacaaacucccgcaauaccagcauggcuaugacgugcaucgccguuggcgggauuacacuguuucuuggcuucaccgugcaggcggacaugggaugugucgugucuuggaacggcaaggagcucaaaugcggguccggaaucuuuguggucgauaauguucauaccuggacagaacaauacaaguuccagcccgagagcccugcccggcuggcuuccgccauucugaacgcucacaaagacggcgugugugggaucagaucuaccacacgccucgagaaugugauguggaagcagauuacgaacgaacugaauuauguccuuugggagggaggccacgaccugaccgugguugccggcgaugugaaagggguccucacaaagggaaagcgggcgcugacccccccugugaacgaccugaaauacagcuggaagacauggggcaaagccaagaucuuuacccccgaagcuagaaauuccacguuccuuaucgaugggccggacaccucugagugcccuaacgaacggcgcgccuggaauuucuuugagguugaggauuacggauucggcauguuuacaaccaacauuuggaugaaauucagagaagggagcuccgaggugugugaccaucggcucaugagcgcugccaucaaggaucagaaagccguccacgcugacaugggauauuggauugaaucuuccaagaaucaaacauggcagaucgagaaggcgagccugauugaagugaaaaccugccuguggcccaagacacauacccucuggucuaacggcguucuggagucccagaugcuuaucccuagaagcuacgccggccccuuuucucagcacaacuaucgccaaggguacgcuacgcagacagccggaccuuggcaccugggcaaacucgagaucgauuucggggaaugccccggaaccaccgugacaauucaggaggacugugaucaucggggcccgagccugagaaccacgacagccuccgggaagcuggucacccaguggugcugucgcagcugcacaaugccuccccuuagauuucucggagaagacggcuguugguauggcauggagauccggccccugucugagaaagaagagaauauggugaagucccaagugaccgcugggcagggaacaagcgaaaccuucuccaugggccugcucugccugacgcuuuuugucgaggaaugucugcgcagacggguuacccgcaagcacaugauucucgugguggucaucacauucugcgccauuauccuggggggacugaccuggauggaucuucucagagcgcugaucaugcugggcgacacaaugucugggcggauuggaggccagauccaucucgcuauuauggccguguuuaaaaugagcccuggcuacguucuggggguguuccuucgcaagcugaccuccagagagacggcccucauggucaucggaauggcuaugacaaccguguuuucuauuccgcacgaccugauggagcugaucgauggcaucagccuugggcugauucuccugaaaaucguuacacauuucgacaacacccaggugggaacccucgcccugucccuuacauucauucggucuacgaccccccuggucauggcguggcgcacaaucauggcuguguuuuucgucgugacccucauuccucuguguagaacaagcugccugcaaaagcagucccacuggguugaaaucaccgcccuuauucugggcgcccaggcucuccccguguaucugaugacgcucaugaaaggggccagccggagaucuuggccucugaaugagggaaucauggcugucggccuugugucccugcucggcagcgcccugcugaagaacgauguuccccuugcggggccuaugguggccggaggccugcuccuggcugccuacgucaugucuggguccagcgcugaccucucucuggaaaaggccgccaaugugcaaugggaugagauggcugacaucacaggauccagccccauuaucgaagugaaacaggaugaggacggcuccuuuagcauucgcgauguugaggaaaccaacaugaucacccuucuggucaagcuggcgcucauuacagugucugggcuguacccgcuugccaucccugugaccauggcucugugguaugucuggcaggugaaaacacagcggagcggagcccucugggacguucccuccccugccgcuacgcaaaaggccacccugucugagggcguguacagaaucaugcagcgcggccucuucgggaaaacacaggucggagugggcauucacauggaagggguuuuucauaccauguggcacgugacacggggaagcgucaucugucaugagaccggcagacuggaacccuccugggcggaugugcgcaaugacaugauuucuuaugggggaggcuggcggcuuggcgauaagugggacaaggaggaggacguucaggugcuggcuaucgaaccggggaaaaacccuaagcacguccaaacgaaacccggacuguucaagacccucacaggcgagauuggggccgugacccuggauuuuaaaccuggaacaagcggcucccccaucaucaauaagaaagggaaggugauuggccuuuacggaaacggcgucguuaccaagucuggggacuaugugagcgccaucacacaggcugaaagaauuggagagcccgauuacgagguggacgaagauaucuuccgcaaaaagcggcugacgauuauggaccuccauccuggcgccgggaaaaccaagagaauccugccguccauuguccgggaggcgcucaaacgcagacugcggacacuuauccuggcucccacccgcgugguugccgccgaaauggaggaagcucugagaggacucccuauccgguaucagacccccgccgugaagagcgagcacacaggcagagagauugucgaucugaugugccacgcuacguuuaccacacgccuucugucuuccacccgggugccuaauuacaaccucaucguuauggacgaagcccauuucacagaucccugcagcguggcggccagaggguacauuucuacccgcgucgagaugggcgaagcugccgcuaucuuuaugacggccacaccuccgggauccauugaccccuucccucagagcaauucccccaucgaggauaucgaacgggagauuccugagagaucuuggaacaccggcuucgacuggaucaccgacuaucaagggaagacagugugguuuguccccagcauuaaagccggaaaugauaucgcuaacugucugcgcaaguccggcaaaaaggugauucagcucagccggaaaaccuucgacacagaauacccgaagaccaagcugacggauugggacuuuguugugacaaccgauaucucugagaugggggcgaacuucagagccggacgcgugaucgacccuagacggugccuuaaacccgucauucugacagauggccccgaacgcguuauccuggcugggccuauucccgugaccccugccuccgccgcucagagacggggccgcaucggaagaaauccggcccaagaggacgaucaguauguguuuagcggcgacccccucaagaacgaugaagaccacgcgcauuggacggaggcuaaaaugcugcuugauaauauuuacaccccugaggggaucauucccacacuguucggaccugaacgggagaagacccaggccaucgacggcgaauuuagacuccgcggggagcagcggaaaacauucgucgagcugaugagacgcggagaccugcccguguggcucucuuauaagguugccagcgcuggcaucuccuacaaggaucgggaaugguguuuuaccggcgagagaaacaaucaaauucuugaagagaacauggaaguggagaucuggacacgggagggggaaaaaaagaaacugcgcccgaaguggcuggacgccagagucuaugcggauccuauggcccucaaagacuucaaggaguuugcuucuggacggaagagcauuacccuggauauccuuacggaaauugccacacugcccaccuaccucuccucuaaagcuaagcuggcccuggacaauaucgugaugcuccacaccacagagaaaggcgggcgcgcuuaccagcacgcccuuaacgaacugccugagagccuggagacccucaugcuggucgcgcuucugggagccaugacagcuggcaucuuccucuuuuucaugcaggggaagggaauuggcaaacuguccaugggccugaucgccauugcuguggccagcgggcuccuuuggguugccgaaauccagccccaauggauugcugcgucuaucauccuggaguucuuucugauggugcuccugauuccugaacccgagaagcagagaacgccgcaggauaaucagcuuaucuaugucauucugaccauccucacaauuaucggacugauugccgcuaacgaaaugggccugaucgagaaaaccaagacagacuucggguuuuaccaagugaagaccgagaauacgauccucgauguugaccuucggccugccuccgccuggacccuguaugcuguggccacaaccauucugacacccaugcuccgccauaccaucgaaaacacgagcgcgaaucugucccuugccgcuauugccaaccaggcugccguccugaugggacucggcaaaggguggccccugcacagaauggaucugggagugccucuccuugcgaugggcugcuacucucaggugaauccgacaacccugacagccagccugguuaugcuccugguccauuaugcuaucauuggccccgggcuucaggccaaggcuacccgggaggcccaaaaacgcaccgcugccggaaucaugaagaacccuacaguggacggcaucacggugauugaucuggaacccaucuccuacgacccuaaauucgagaagcagcucgggcaggucaugcugcugguucucugugugggacaacuucugcugaugagaaccacaugggcgcucugcgaggugcugacccuugccacaggccccgucaugacccugugggaagggaacccuggacgguuuuggaauacgacaauugcugugucuaccgccaacaucuucagaggcagcuaucucgcuggcgccgggcuggccuuuucccugauuaagaaugcgcagaccccgcgccggggaacaggcaccacaggggagacgcucggagaaaaauggaagagacagcuuaacagccuggaccgcaaagaguucgaagaguacaagcggucuggcauccuggagguugauagaaccgaagcuaaauccgcccuccgcgacgggagcaagaucaaguacgcugugucucggggauccagcaaaauuagauggaucgucgagcgcggcaugauuaagcccaaaggcaaggugguugaucugggguguggacggggcggguggucuuauuacauggccacacuuaaaaaugugaccgaagucaagggauauacaaagggcgggccuggacacgaggaacccaucccuauggccaccuacggcuggaaccuggugaaacuccauagcggcguggacgucuuuuauaagcccacggagcagguugauacccugcugugcgacauuggggaguccucuagcaauccgacaaucgaagagggaagaacccuccgcgugcuuaaaaugguggaaccuuggcuguccagcaagcccgaguucuguauuaaaguccugaaccccuacaugccuacagugaucgaagagcucgagaagcugcaacggagacacggcgggucccuuguucgcugcccccugucuagaaauagcacccacgaaauguauuggguguccggagcuucuggcaacaucgucagcuccgugaauacaauuucuaaaaugcuccugaaccgguuuaccacgcgccauagaaagccuacauacgagaaggauguugaccugggggccggaacccggagcguguccaccgaaaucgagaaaccggauaugacaauuaucggcagacggcuccagcgccuuagagaggaacacaaggagacguggcauuacgaccacgaaaaucccuaucggaccugggcguaccacggcagcuaugaggccccuucuacaggguccgcuagcucuauggucaacggaauugugaaacugcugaccaagcccugggauguuaucccuauggugacacagcucgccaugaccgacacaacccccuucggccagcaacgcgucuuuaaagaaaagguggacacgagaaccccgcagccuaagcccgggacacggaugaucaugaccacaaccgcuaauuggcugugggcccuucugggaaaaaagaaauccccucgccucuguacgagagaggaguucauuagcaagguccggucuaacgcggccaucggcgcuguguuccaggaagagcagggguggacauccgccagcgaagcuguuaaugauucccgcuuuugggagcugguggacaaagaaagagcccugcaucaagagggcaagugcgagagcugcgucuacaacaugaugggaaagcgggaaaaaaagcucggcgaguucgggcgcgcuaaaggaucuagagccauuugguauauguggcugggcgcgcgguuucuugaauucgaggcccugggguuucucaacgaagaucacugguucagccgcgagaauuccuggucuggaguggagggcgaagggcugcauagacuuggcuacauccuggaggacauugauaagaaagacggagaucucaucuaugcugacgauaccgccggcugggacacacggaucaccgaagaugaccugcugaacgaggagcucauuacggaacagauggcuccccaccauaagacccuggccaaggccaucuuuaaacuuacauaccagaauaaggugguuaaagugcugagaccuacccccaagggggcggucauggauauuaucagccgcaaagaccaacggggauccggccagguggggacauacggacucaacaccuucacaaauauggagguucagcugauuagacagauggaagcugagggcgugaucacccaagacgauaugcagaacccgaaggggcuuaaagaacgcgucgagaaguggcugaaggaguguggcguggaccggcucgaaagaauggccaucucuggagaugacugcgucgugaaaccucuggaugagcgcuuuagcacgucccugcucuuccugaaugacaugggcaagguucggaaagauauuccccagugggaacccucuaagggguggaaaaacuggcaggaggugccuuuuuguagccaccacuuccauaagaucuuuaugaaggacggaagaucccuugucgugccgugccgcaaucaagaugaacugauuggccgggccagaaucagccagggggcuggauggucucuccgcgagacagccugucugggcaaagcuuaugcccagauguggcuucugauguacuuccaccggagagaccuccggcuggcguccauggccauuugcagcgcuguucccaccgagugguucccuaccucuagaacaaccugguccauccaugcccaccaccaguggaugacaacggaagauaugcugaagguguggaaccgcgucuggauugaggacaaucccaacaugaccgacaaaacaccugugcauagcugggaagauauccccuaucucgggaagcgggaggaccugugguguggcucccuuaucggacugucuagcagagcuaccugggccaaaaauauucacacagcgaucacccaagugcgcaaccucauuggcaaggaagaguacguugauuauaugccugccaugaagagauacuccgcucccuuugagagcgaagggguccuguga

SEQ ID NO: 21028 - RNA, 9867 nt, Artificial Sequence
  derived and/or modified CDS sequence (opt5) from DENV-4__KC762699__SS-prME
agcaccaugacccugcucugccugauccccacggugauggcuuuccaccuuuccaccagagacggcgaaccucugaugauuguggcuaagcaugaacgggggcgcccgcuccuguuuaaaaccaccgaaggaaucaacaaguguacacuuauugccauggaucugggcgaaaugugcgaagacaccguuacauacaaauguccccuccuggugaauaccgaaccugaggauaucgacugcugguguaaccugacgucuaccugggugauguaugggacaugcacccagagcggagagagacggcgcgaaaagagauccgucgcccucacaccccacucuggcauggggcuggagacccgggcugaaacguggaugagcuccgagggagccuggaaacaugcccagcgcguggagucuuggauucuuagaaauccuggcuucgcucugcucgccggcuuuauggcuuacaugaucgggcagacaggaauccagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguauugaagcuagcaucucuaauauuaccacagccacccgcugcccgacgcaaggagagcccuaucuuaaggaggaacaggaccagcaguacaucuguagacgggaugugguggaccgcggcugggggaacggaugcggccuguucgggaaaggaggcgucgugacaugcgcgaaguuucucuguuccggcaaaauuaccgggaaucugguucaaaucgagaaccuugaauauaccguggucgugacaguucauaauggagauacccacgccgugggcaacgacacaagcaaucacggggucacggcuaccauuacaccuagaucucccuccguggaggucaagcugccugauuacggagaacucacccuggacugcgagccccggagcggcaucgacuucaacgagaugauccugaugaagaugaaaaagaaaacauggcucgugcauaagcagugguuucuggaucuuccgcugccuuggaccgccggggcugacacgucugaaguucacuggaauuacaaagagagaauggugaccuucaaggucccccaugccaaacgccaggaugugacaguucucggcucccaggaaggagccaugcacagcgcucuggcgggcgccaccgagguggacuccggggauggaaaccacauguuugcuggccaucuuaaguguaagguccggauggaaaaacugagaauuaaggggaugucuuauacaaugugcagcggaaaauucuccaucgacaaggagauggccgagacccaacacggcacgacaguggugaaaguuaaguacgaaggggccggcgcuccuuguaagguccccauugagauccgcgaugugaauaaagaaaagguggucggacggauuaucagcucuacccccuucgccgagaacacaaacuccgugaccaauaucgagcucgaaccuccguuuggcgacagcuauauuguuaucggggugggagauucugcgcugacccugcauugguucagaaaaggcagcuccauugggaagauguuugagucuacauaccgcggagcuaaacggauggccauccucggcgaaacggccugggacuucgggagcgucggcggacuguuuaccucccuuggcaaggcugugcaccagguuuucgggagcguguauacaaccauguuuggaggcgucucuuggaugauuagaauccugaucggguuccucgugcuguggauuggaacaaacucccgcaauaccagcauggccaugacgugcaucgcuguuggcgggauuacacuguuucuuggcuucaccgugcaggccgauaugggaugugucgugucuuggaacggcaaggagcucaaaugcggguccggaaucuuuguggucgacaauguucauaccuggacagaacaauacaaguuccagcccgagagcccugcgcggcuggccuccgcuauucugaacgcccacaaagacggcgugugugggaucagaucuaccacacgccucgagaaugugauguggaagcagauuacgaacgaacugaauuauguccuuugggagggaggccacgaucugaccgugguugcuggcgacgugaaagggguccucacaaagggaaagcgggcccugacacccccugugaacgaucugaaauacagcuggaagacauggggcaaagcgaagaucuuuacccccgaagccagaaauuccacguuccuuaucgacgggccggauaccucugagugcccuaacgaacggcgcgcuuggaauuucuuugagguugaggacuacggauucggcauguuuacaaccaacauuuggaugaaauucagagaagggagcuccgaggugugugaucaucggcucaugagcgccgcuaucaaggaccagaaagccguccacgccgauaugggauauuggauugaaucuuccaagaaucaaacauggcagaucgagaaggcuagccugauugaagugaaaaccugccuguggcccaagacacauacccucuggucuaacggcguucuggagucccagaugcuuaucccuagaagcuacgcgggccccuuuucucagcacaacuaucgccaaggguacgccacgcagacagcuggaccuuggcaccugggcaaacucgagaucgacuucggggaaugccccggaaccaccgugacaauucaggaggauugugaccaucggggcccgagccugagaaccacgacagccuccgggaagcuggucacccaguggugcugucgcagcugcacaaugccuccccuuagauuucucggagaagauggcuguugguauggcauggagauccggccccugucugagaaagaagagaauauggugaagucccaagugaccgccgggcagggaacaagcgaaaccuucuccaugggccugcucugccugacgcuuuuugucgaggaaugucugcgcagacggguuacccgcaagcacaugauucucgugguggucaucacauucugcgcuauuauccucgggggacugaccuggauggaccuucucagagcccugaucaugcugggcgacacaaugucugggcggauuggaggccagauccaucucgcgauuauggcuguguuuaaaaugagcccuggcuacguucuggggguguuccuucgcaagcugaccuccagagagacggcccucauggucaucggaauggccaugacaaccguguuuucuauuccgcacgagcugauggaacugaucgauggcaucagccuugggcugauucuccugaaaaucguuacacauuucgacaacacccaggugggaacccucgcucugucccuuacauucauucggucuacgacaccccuggucauggccuggcgcacaaucauggcgguguuuuucgucgugacccucauuccucuguguagaacaagcugccugcaaaagcagucccacuggguugagaucaccgcucuuauucugggcgcccaggcccuccccguguaucugaugacgcucaugaaaggggcuagccggagaucuuggccucugaaugaaggaaucauggccgucggccuugugucccugcucggcagcgcucugcugaagaacgauguuccccuugccgggccuaugguggcgggaggccugcuccuggccgcuuacgucaugucuggguccagcgccgaccucucucuggagaaggcugccaaugugcaaugggaugaaauggccgacaucacaggauccagccccauuaucgaggugaaacaggaugaggacggcuccuuuagcauucgcgauguugaagagaccaacaugaucacccuucuggucaagcuggcucucauuacagugucugggcuguacccgcuugcgaucccugugaccauggcccugugguaugucuggcaagugaaaacacagcggagcggagcucucugggacguucccuccccugccgccacgcaaaaggcuacccugucugaaggcguguacagaaucaugcagcgcggccucuucgggaaaacacaggucggagugggcauucacauggaggggguuuuucauaccauguggcacgugacacggggaagcgucaucugucaugaaaccggcagacuggagcccuccugggccgaugugcgcaaugacaugauuucuuaugggggaggcuggcggcuuggcgauaagugggacaaggaggaagacguucaggugcuggcgaucgagccggggaaaaacccuaagcacguccaaacgaaacccggacuguucaagacccucacaggcgaaauuggggcugugacccuggauuuuaaaccuggaacaagcggcucccccaucaucaauaagaaagggaaggugauuggccuuuacggaaacggcgucguuaccaagucuggggacuaugugagcgccaucacacaggccgagagaauuggagagcccgauuacgaaguggacgaggauaucuuccgcaaaaagcggcugacgauuauggaccuccauccuggcgcugggaaaaccaagagaauccugccguccauuguccgggaagcccucaaacgcagacugcggacacuuauccuggcgcccacccgcgugguugcugccgagauggaagaggcccugagaggacucccuauccgguaucagacccccgcugucaagagcgagcacacaggcagagaaauugucgaucugaugugccacgccacguuuaccacacgccuucugucuuccacccgggugccuaauuacaaccucaucguuauggacgaggcucauuucacagaucccugcagcguggccgcgagaggguacauuucuacccgcgucgaaaugggcgaggccgcugccaucuuuaugacggcuacaccuccgggauccauugaccccuucccucagagcaauucccccaucgaagauaucgagcgggagauuccugaaagaucuuggaacaccggcuucgacuggaucaccgacuaucaagggaagacagugugguuuguccccagcauuaaagccggaaaugauaucgccaacugucugcgcaaguccggcaaacgggugauucagcucagcagaaagaccuucgacacagaguacccgaaaaccaagcugacggauugggacuuuguugugacaaccgauaucucugaaaugggggcuaacuuccgcgcgggaagagugaucgacccucggcgcugccuuaagcccgucauucugacagauggccccgagagaguuauccuggccgggccuauucccgugaccccugcuuccgccgcccagcggcgcggcagaaucggacggaauccggcucaagaagacgaucaguauguguuuagcggcgacccccucaaaaacgaugaggaccacgcccauuggacggaggcgaagaugcugcuugauaauauuuacaccccugaagggaucauucccacacuguucggaccugagagagagaagacccaggcuaucgacggcgaguuucgccucagaggggaacagcggaagacauucgucgaacugaugcgccggggagaccugcccguguggcucucuuauaaaguugccagcgccggcaucuccuacaaggauagagagugguguuuuaccggcgaacggaacaaucaaauucuugaggaaaacauggagguggagaucuggacacgcgaaggggagaagaaaaagcugagaccgaaauggcuggacgcucgggucuaugccgauccuauggcgcucaaggacuucaaagaauuugccucuggacgcaagagcauuacccuggauauccuuacggagauugcuacacugcccaccuaccucuccucuaaggccaaacuggcucuggacaauaucgugaugcuccacaccacagaaaagggcgggagagccuaccagcacgcucuuaacgagcugccugagagccuggaaacccucaugcuggucgcccuucugggagcgaugacagccggcaucuuccucuuuuucaugcaggggaaaggaauuggcaagcuguccaugggccugaucgcuauugccguggcuagcgggcuccuuuggguugccgagauccagccccaauggauugccgcuucuaucauccuggaguucuuucugauggugcuccugauuccugagcccgaaaaacagcggacgccgcaggauaaucagcuuaucuaugucauucugaccauccucacaauuaucggacugauugcggccaacgagaugggccugaucgagaagaccaaaacagacuucggguuuuaccaagugaagaccgaaacgaccauccucgauguugaccuucgcccugcuuccgccuggacacuguaugccguggcuaccacaauucugacccccaugcucagacauacgaucgagaauacaagcgccaaccugucccuugcggccauugcuaaucaggccgcuguccugaugggacucggcaagggguggccccugcaccggauggaucugggagugccucuccuugccaugggcugcuacucucaggugaacccgaccacacugaccgcgagccugguuaugcuccugguccauuaugccaucauuggccccgggcuucaggcuaaagccacccgcgaagcucaaaagagaacagccgcuggaaucaugaaaaauccuacgguggacggcaucaccgugauugaucuggagcccaucuccuacgacccuaaguucgagaaacagcucgggcaggucaugcugcugguucucugugugggacaacuucugcugaugcggacaaccugggcccucugcgaagugcugacacuugcgaccggccccgucaugacgcugugggaggggaacccuggaagauuuuggaacacaaccauugccgugucuaccgcuaauaucuuccgcggcagcuaucucgccggcgcugggcuggccuuuucccugauuaagaacgcccagacaccgcggagaggaaccggcacaacgggggaaacccucggagagaaguggaaacgccagcuuaauagccuggaccggaaggaguucgaggaguacaaaagaucuggcauccuggaaguugaucgcacagaggcgaaguccgcucuccgggacgggagcaaaaucaaguacgccgugucuagaggauccagcaagauucgcuggaucgucgaacggggcaugauuaaacccaagggcaaagugguugaucugggguguggaagaggcggguggucuuauuacauggcuacccuuaagaacgugacagaggucaaaggauauaccaagggcgggccuggacacgaagaacccaucccuauggccacguacggcuggaaucuggugaagcuccauagcggcguggacgucuuuuauaaacccaccgagcagguugauacacugcugugcgacauuggggaauccucuagcaacccgaccaucgaggaaggacgcacacuccgggugcuuaagaugguggagccuuggcuguccagcaaacccgaguucuguauuaagguccugaaucccuacaugccuaccgugaucgaggagcucgaaaaacugcaaagacgccacggcgggucccuuguuagaugcccccugucucggaacagcacacacgagauguauuggguguccggagccucuggcaauaucgucagcuccgugaacaccauuucuaagaugcuccugaaucgcuuuacgacaagacaucggaaaccuaccuacgaaaaggauguugaccugggggcuggaaccagaagcguguccacagagacggagaagccggauaugaccaucauuggccggcgccuccagagacuucgggaagaacacaaagaaacauggcauuacgaccaggagaaccccuaucgcaccugggccuaccacggcagcuaugaagcgccuucuacaggguccgccagcucuauggucaauggagugguuaagcugcugaccaaacccugggaugugaucccuauggucacacagcucgcuaugaccgacacgacccccuucggccaacagagaguguuuaaggagaaagucgacacacggaccccgcagccuaagcccgggacacgcaugauuaugaccacgacagccaacuggcugugggcccuucugggaaagaaaaaguccccuagacucuguacccgggaggaguucaucagcaaagugcgcucuaaugccgcgaucggcgccguuuuccaggaggaacaaggguggacauccgcuagcgaggccgugaacgauuccagauuuugggaacuggucgacaaggagcgggcucugcaccaggagggcaaaugcgaaagcugcguguacaauaugaugggaaagcgcgagaagaaacucggcgaguucgggagagccaagggaucucgggcuauuugguauauguggcugggcgcccgcuuucuugaguucgaagcgcugggguuucucaacgaggaucauugguucagcagagagaacuccuggucuggaguggaaggcgaggggcugcaccggcuuggcuacauccuggaagacauugauaaaaaggacggagaucucaucuaugccgacgauaccgcuggcugggacacgagaauuaccgaggaugaccugcugaaugaggaacucaucacagagcagauggcgccccaucacaaaacccuggcuaaggccaucuuuaaacuuacauaccaaaacaaaguugugaagguccugcgcccuacccccaaaggggccgugauggauauuaucagccggaaggaccagagaggauccggccagguugggacauacggacucaauaccuucacgaacauggaagugcagcugauucgccaaauggaggcggaaggcgucaucacacaggacgauaugcagaauccgaaagggcuuaaggagcggguggagaaauggcugaaggaauguggcgucgacagacucaagcgcauggcuauuucuggagaugacugcgugguuaaaccucuggaugagcgguuuagcaccucccugcuguuccugaacgacaugggcaaggugagaaaagauaucccccagugggaacccucuaagggguggaaaaauuggcaagaggucccuuuuuguagccaucacuuccacaagaucuuuaugaaggacggacgcucccuugugguuccgugccggaaccaggaugaacugauuggcagagcccgcaucagccagggggccggauggucucuccgggagaccgcuugucugggcaaagccuaugcucagauguggucccuuauguacuuccauagacgggaccugagacucgccagcauggcgauuugcucugccgugcccacagagugguucccuaccucccgcacaacguggagcauccacgcucaucaccaauggaugaccacagaagauaugcugaaggucuggaaucggguguggauugaggacaaccccaauaugaccgacaaaacaccugugcacuccugggaagauauccccuaucuggggaagagagaggaccucugguguggcucucugauuggacuuagcucccgcgccaccugggcuaaaaacauccauacggccaucacccagguuagaaaucugauuggcaaggaagaguacgucgauuauaugccugcgaugaagcgguacagcgcccccuuugagucugaaggggugcucuga

SEQ ID NO: 21029 - RNA, 9867 nt, Artificial Sequence
  derived and/or modified CDS sequence (opt5) from DENV-4__JQ915085__SS-prME
agcaccaugacccugcucugccugauccccacggugauggccuuccaccuuuccaccagagacggagagccucugaugauuguugcuaagcaugaacgggggcgcccgcuccuguuuaaaacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccaaagcggagagagacggcgcgaaaagagauccgucgcccucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguauugaagcuagcaucucuaauauuaccacagccacccgcugcccgacgcaaggagagcccuaucuuaaggaggaacaggaccagcaguacaucuguagacgggaugugguggaccgcggcugggggaacggaugcggccuguucgggaaaggaggcgucgugacaugcgcgaaguuucucuguuccggcaaaauuaccgggaaucugguucaaaucgagaaccuugaauauaccguggucgugacaguucauaauggagauacccacgccgugggcaacgacacaagcaaucacggggucacggcuaccauuacaccuagaucucccuccguggaggucaagcugccugauuacggagaacucacccuggacugcgagccccggagcggcaucgacuucaacgagaugauccugaugaagaugaaaaagaaaacauggcucgugcauaagcagugguuucuggaucuuccgcugccuuggaccgccggggcugacacgucugaaguucacuggaauuacaaagagagaauggugaccuucaaggucccccaugccaaacgccaggaugugacaguucucggcucccaggaaggagccaugcacagcgcucuggcgggcgccaccgagguggacuccggggauggaaaccacauguuugcuggccaucuuaaguguaagguccggauggaaaaacugagaauuaaggggaugucuuauacaaugugcagcggaaaauucuccaucgacaaggagauggccgagacccaacacggcacgacaguggugaaaguuaaguacgaaggggccggcgcuccuuguaagguccccauugagauccgcgaugugaauaaagaaaagguggucggacggauuaucagcucuacccccuucgccgagaacacaaacuccgugaccaauaucgagcucgaaccuccguuuggcgacagcuauauuguuaucggggugggagauucugcgcugacccugcauugguucagaaaaggcagcuccauugggaagauguuugagucuacauaccgcggagcuaaacggauggccauccucggcgaaacggccugggacuucgggagcgucggcggacuguuuaccucccuuggcaaggcugugcaccagguuuucgggagcguguauacaaccauguuuggaggcgucucuuggauuaucagaauccugauuggguuccucgugcuguggaucggaacaaacucccgcaauaccagcauggccaugacgugcauugcuguuggcgggaucacacuguuucuuggcuucaccgugcaggccgauaugggaugugucgugucuuggaacggcaaggagcucaaaugcggguccggaauuuuuguggucgacaauguucauaccuggacagaacaauacaaguuccagcccgagagcccugcgcggcuggccuccgcuauccugaacgcccacaaagacggcgugugugggauuagaucuaccacacgccucgagaaugugauguggaagcagaucacgaacgaacugaauuauguccuuugggagggaggccacgaucugaccgugguugcuggcgacgugaaagggguccucacaaagggaaagcgggcccugacacccccugugaacgaucugaaauacagcuggaagacauggggcaaagcgaagaucuuuacccccgaagccagaaauuccacguuccuuauugacgggccggauaccucugagugcccuaacgaacggcgcgcuuggaauuucuuugagguugaggacuacggauucggcauguuuacaaccaacaucuggaugaaauucagagaagggagcuccgaggugugugaucaucggcucaugagcgccgcuauuaaggaccagaaagccguccacgccgauaugggauauuggaucgaaucuuccaagaaucaaacauggcagauugagaaggcuagccugaucgaagugaaaaccugccuguggcccaagacacauacccucuggucuaacggcguucuggagucccagaugcuuaucccuagaagcuacgcgggccccuuuucucagcacaacuaucgccaaggguacgccacgcagacagcuggaccuuggcaccugggcaaacucgagauugacuucggggaaugccccggaaccaccgugacaauccaggaggauugugaccaucggggcccgagccugagaaccacgacagccuccgggaagcuggucacccaguggugcugucgcagcugcacaaugccuccccuuagauuucucggagaagauggcuguugguauggcauggagauucggccccugucugagaaagaagagaauauggugaagucccaagugaccgccgggcagggaacaagcgaaaccuucuccaugggccugcucugccugacgcuuuuugucgaggaaugucugcgcagacggguuacccgcaagcacaugauccucgugguggucauuacauucugcgcuaucauccucgggggacugaccuggguggaccuucucagagcccugauuaugcugggcgacacaaugucugggcggaucggaggccagauucaucucgcgaucauggcuguuuuuaaaaugagcccuggcuacgugcugggggucuuccuucgcaagcugaccuccagagagacggcccucauggugauuggaauggccaugacaaccgucuuuucuaucccgcgggaucugauggagcugaucgacggcauuagccuugggcugauccuccugaaaauugugacacacuucgauaacacccaggucggaacccucgcucugucccuuacauucauccgcucuacgacaccccuggugauggccuggagaacaauuauggucguguuuuucguugugacccucaucccucugugucggacaagcugccugcaaaagcagucccauugggucgaaauuaccgcgcuuauccugggcgcucaggcccuccccguguaucugaugacgcucaugaaaggggccagcagacgcucuuggccucugaaugagggaaucauggcuguuggccuugugucccugcucggcagcgcccugcugaagaacgacgucccccuugcugggccuaugguggccggaggccugcuccuggcggccuacgugaugucuggguccagcgcugaucucucucuggaaaaggccgcuaauguucaaugggacgagauggccgauauuacaggauccagccccaucauugaagucaaacaggacgaggauggcuccuuuagcauccgggacguggaggaaaccaacaugauuacccuucuggugaagcuggcccucaucacagucucugggcuguacccgcuugcuaucccugugaccauggcgcugugguauauuuggcagguuaaaacacagagaagcggagcccucugggaugugcccuccccugcugccauccaaaaggccacgcugucugagggcgucuaccgcauuaugcagcggggccucuucgggaaaacccaggugggaguuggcauccacauggaagggguguuucacacaauguggcaugucaccagaggaagcgugauuugucacgagacaggccgccuggaacccuccugggcugacguucggaaugauaugaucucuuaugggggaggcuggagacuuggcgacaagugggacaaggaggaggaugugcagguccuggccaucgaaccggggaaaaacccuaagcaugugcaaaccaaacccggacuguucaagacgcucaccggcgagauuggggcggugacacuggacuuuaaaccuggaaccagcggcucccccaucauuaauaagaaagggaaggucaucggccuuuacggaaacggcguugugacaaagucuggggauuaugugagcgcuauuacccaggccgaacgcaucggagagcccgacuacgaggucgaugaagacauuuuccggaaaaagagacugacaaucauggaucuccacccuggcgccgggaaaacgaagcggauccugccguccauugugcgcgaggcucucaaaagacggcugcgcacccuuauccuggcccccacaagaguuguggcggcugaaauggaggaagcccugcggggacucccuauuagauaucagacccccgccgucaagagcgagcauaccggccgcgagaucguggaccugaugugccacgcuacauuuacgacccggcuucugucuuccacaagaguuccuaauuacaaccucauugugauggaugaagcccacuucaccgaccccugcagcgucgcugcccgcggguacaucucuacacggguggagaugggcgaagcggccgcuaucuuuaugaccgccacgccuccgggauccauugaucccuucccucagagcaauucccccaucgaggacauugaaagagagaucccugagcgcucuuggaacacaggcuucgacuggauuaccgauuaucaagggaagaccgucugguuugugcccagcaucaaagcuggaaaugacaucgccaacugucugcggaaguccggcaaaaagguuauucagcucagcagaaaaacauucgauaccgaauacccgaagacaaagcugaccgacugggauuuuguggugacgacagacaucucugagaugggggccaacuuccgcgcuggaagagucauugauccucggcgcugccuuaaacccguuauccugaccgacggccccgaaagagugauucuggcggggccuauccccgugaccccugcuuccgcugcccagcggcgcggcagaauuggacggaauccggcccaagaggaugaccaguaugucuuuagcggcgauccccucaagaacgacgaagaucaugcucacuggaccgaggccaaaaugcugcuugacaauaucuacacgccugaggggaucauucccacccuguucggaccugaaagagagaagacacaggcgaucgacggcgaauuucgccucagaggggaacagcggaaaaccuucguggagcugaugcgccggggagaucugcccguuuggcucucuuauaagguggcuagcgccggcauuuccuacaaggacagagaaugguguuuuacaggcgagcggaacaaucaaauccuugaagagaacauggaagucgagauuuggacccgcgagggggagaaaaagaaacugagaccgaaguggcuggaugcccggguguaugcugacccuauggcccucaaagauuucaaggaguuugcgucuggacgcaagagcaucacacuggacauccuuaccgaaauugccacgcugcccacauaccucuccucuaaagcuaagcuggcccuggauaauaucgucaugcuccauaccgcugagaaaggcgggagagccuaccagcacgcucuuaacgaacugccugagagccuggagacccucaugcugguggcccuucugggagcgaugacagccggcauuuuccucuuuuucaugcaggggaagggaaucggcaaacuguccaugggccugauugcuaucgccguugcuagcgggcuccuuuggguggccgaaauccagccccaauggauugccgcuucuaucauucuggaguucuuucugaugguccuccugaucccugaacccgagaagcagcggaccccgcaggacaaucagcuuauuuaugugauccugacaauucucacgaucaucggacugauugcggccaacgaaaugggccugaucgagaaaaccaagacagauuucggguuuuaccaaguuaagaccgagacaaccauucucgacguggaucuucgcccugcuuccgccuggacgcuguaugccgucgcuaccacaauccugacccccaugcucagacacacaauugaaaauaccagcgccaaccugucccuugcggccaucgcuaaucaggccgcugugcugaugggacucggcaaaggguggccccugcaucggauggaccugggagugccucuccuugccaugggcugcuacucucagguuaacccgacgacacugaccgcgagccuggucaugcuccuggugcacuaugccaucauuggccccgggcuucaggcuaaggccacacgcgaggcucagaaaagaaccgccgcuggaaucaugaagaauccuaccguggauggcauuacagucaucgaccuggaacccauuuccuacgacccuaaauucgagaagcagcucgggcagguuaugcugcuggugcucugugugggacaacuucugcugaugcggacgaccugggcccucugcgagguccugacacuugcgaccggccccaucaugacacugugggaagggaacccuggaagauuuuggaacaccacgaucgccgugucuacagcuaauauuuuccgcggcagcuaucucgccggcgcugggcuggccuuuucccugaucaagaacgcccagaccccgcggagaggaaccggcacaaccggggagacacucggagaaaaauggaagcgccagcuuaauagccuggaucggaaagaguucgaagaguacaagagaucuggcauucuggagguugaccgcacggaagcgaaauccgcucuccgggaugggagcaagaucaagcaugccgugucuagaggauccagcaaaauucgcuggaucgucgagcggggcaugauuaagcccaaaggcaaggugguugaccugggguguggaagaggcggguggucuuacuauauggcuacccuuaaaaacgugacagaagucaagggauacaccaagggcgggccuggacacgaggaacccaucccuauggccacauauggcuggaaucuggugaaacuccauagcggcguggaugucuuuuacaagcccaccgagcagguugacacgcugcugugcgauaucggggaguccucuagcaacccgaccauugaagagggacgcacacuccgggugcuuaaaaugguggaaccuuggcuguccagcaagcccgaguucuguaucaaaguccugaaucccuauaugccuaccgugauugaagaacuggagaagcugcaaagacgccacggcgggucccuuguuagaugcccccugucucggaacagcacacacgaaauguacuggguguccggagccucuggcaauaucgucagcuccgugaacaccauuucuaaaaugcuccugaaucgcuuuacaaccagacaucggaagccuacguaugagaaggacguugaucugggggcuggaacaagaagcguguccaccgaaaccgagaaaccggacaugacaaucaucggccggcgccuccagagacuucgggaggaacacaaggagacguggcauuacgaucaggaaaaccccuaccgcaccugggccuaucacggcagcuacgaggcgccuucuacaggguccgccagcucuauggucaauggagugguuaaacugcugaccaagcccugggacgugauuccuauggucacacagcucgcuaugaccgacacaacccccuucggccaacagagaguguuuaaagaaaaggucgauacgcggaccccgcagccuaagcccgggacacgcaugaucaugaccacaaccgccaacuggcugugggcccuucugggcaaaaagaaauccccuagacucuguacgcgggaggaguucauuagcaaggugcgcucuaaugccgcgaucggcgccguuuuccaggaagaacaaggguggacauccgcuagcgaagccgugaacgacuccagauuuugggagcuggucgauaaagaacgggcucugcaccaggagggcaagugcgagagcugcguguauaauaugaugggaaagcgcgagaaaaagcucggcgaguucgggagagccaaaggaucucgggcuauuugguacauguggcugggcgcccgcuuucuugaguucgaggcgcugggguuucucaacgaagaccauugguucagcagagagaacuccuggucuggaguggagggcgaagggcugcaccggcuuggcuauauccuggaggauaucgacaagaaagauggagaccucauuuacgccgaugacaccgcuggcugggauacaagaaucaccgaagacgaucugcugaaugaggagcucauuacggaacagauggcgccccaucacaagacccuggcuaaggccaucuuuaaacuuacauaucaaaacaagguugugaaaguccugcgcccuacccccaagggggccgugauggacauuaucagccggaaagaccagagaggauccggccagguugggacauacggacucaauaccuucacaaacauggaggugcagcugauccgccaaauggaagcggagggcgucauuacccaggaugacaugcagaauccgaaggggcuuaaagaacggguggagaaguggcugaaggaguguggcgucgauagacucaaacgcauggcuaucucuggagacgauugcgugguuaagccucuggacgaacgguuuagcacgucccuccuguuccugaacgauaugggcaaagugagaaaggacauuccccagugggagcccucuaaaggguggaagaauuggcaagaagucccuuuuuguagccaucacuuccacaagaucuuuaugaaagauggacgcucccuugugguuccgugccggaaccaggacgagcugauuggcagagcccgcaucagccagggggccggauggucucuccgggaaacagcuugucugggcaaggccuacgcucagauguggucccuuauguauuuccauagacgggaucugagacucgccagcauggcgauuugcucugccgugcccaccgagugguucccuaccucccgcacaaccuggagcauccacgcucaucaccaauggaugacaacggaggacaugcugaaagucuggaaucggguguggaucgaagacaaccccaauaugaccgauaagacaccugugcacuccugggaggacauucccuaccuggggaaaagagaagaucucugguguggcucucugaucggacuuagcucccgcgccaccugggcuaagaacauucauacagccaucacccagguuagaaaucugauuggcaaggaggaauaugucgacuacaugccugcgaugaaacgguauagcgcccccuuugagucugagggggugcucuga

SEQ ID NO: 21030 - RNA, 9867 nt, Artificial Sequence
  derived and/or modified CDS sequence (opt5) from DENV-4__JQ915088__SS-prME
agcaccaugacacugcucugccugauccccacggugauggccuuccaccuuuccaccagagacggcgagccucugaugauugucgcuaagcaugaacgggggcgcccgcuccuguuuaaaacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggauuguuuucuuugugcugaugaugcuugucgcccccagcuauggcaugcgcuguguggggguuggaaacagagauuucguggaaggcgucuccgggggagcguggguggaccuggugcucgagcacggcggcugcgucaccacaauggcccaggggaagccuacccuggauuuugaacugaccaagacaacggcuaaagagguugcccuccugcggaccuacuguaucgaagcuagcauuucuaauaucacaaccgccacacgcugcccgacccaaggagagcccuaucuuaaggaggaacaggaccagcaguacauuuguagacgggaugugguggaccgcggcugggggaacggaugcggccuguucgggaaaggaggcgucgugacgugcgcgaaguuucucuguuccggcaaaaucacagggaaucugguucaaauugagaaccuugaauauaccguggucgugaccguucauaauggagauacacacgccgugggcaacgacaccagcaaucacggggucacagcuacgaucaccccuagaucucccuccguggaggucaagcugccugauuacggagaacucacacuggacugcgagccccggagcggcaucgacuucaacgagaugauucugaugaagaugaaaaagaaaaccuggcucgugcauaagcagugguuucuggaucuuccgcugccuuggacagccggggcugacaccucugaaguucacuggaauuacaaagagagaauggugacguucaaggucccccaugccaaacgccaggaugugaccguucucggcucccaggaaggagccaugcacagcgcucuggcgggcgccacagagguggacuccggggauggaaaccacauguuugcuggccaucuuaaguguaagguccggauggaaaaacugagaaucaaggggaugucuuauaccaugugcagcggaaaauucuccauugacaaggagauggccgagacacaacacggcaccacgguggugaaaguuaaguacgaaggggccggcgcuccuuguaagauccccauugagauccgcgaugucaauaaagaaaagguggugggacggaucauuagcucuacacccuucgccgagaacaccaacuccgucaucaauauugagcucgaaccuccguuuggcgacagcuauaucgugauugggguuggagauucugcgcugacacugcauugguucagaaaaggcagcuccaucgggaagauguuugagucuaccuaccgcggagcuaaacggauggccauccucggcgaaaccgccugggacuucgggagcgugggcggacuguuuacaucccuuggcaaggcuguccaccagguguucgggagcguuuauacgaccauguuuggaggcgugucuuggaugauuagaauccugauuggguuccucguccuguggaucggaacaaacucccgcaauaccagcauggccaugacaugcauugcugugggcgggaucacccuguuucuuggcuucacgguucaggccgauaugggauguguggucucuuggaacggcaaggagcucaaaugcggguccggaauuuuugugguggacaauguccauacauggaccgaacaauacaaguuccagcccgagagcccugcgcggcuggccuccgcuauccugaacgcccacaaagacggcguuugugggaucagaucuaccacacgccucgagaaugugauguggaagcagauuaccaacgaacugaauuaugugcuuugggagggaggccacgaucugacagucguggcuggcgacguuaaaggggugcucacgaagggaaagcgggcccugacccccccugucaacgaucugaaauacagcuggaagacauggggcaaagcgaagaucuccacccccgaagccagaaauucuacauuucuuauugacgggccggauaccagcgagugcccuaacgaacggcgcgcuuggaauuucuucgagguggaggacuacggauuuggcauguucacgaccaacaucuggaugaaauuuagagaaggguccagcgagguuugugaucaucggcucaugucugccgcuauuaaggaccagaaagccgugcacgccgauaugggauauuggaucgaauccagcaagaaucaaacauggcagaucgagaaggcuucucugauugaagucaaaaccugccuguggcccaagacacauacccucugguccaacggcgugcuggagagccagaugcuuaucccuagaucuuacgcgggccccuucagccagcacaacuaucgccaaggguacgccacacagaccgcuggaccuuggcaccugggcaaacucgagauugacuuuggggaaugccccggaacgacaguuaagauccaggaggauugugaccaucggggcccgucccugagaaccaccacagccagcgggaaacuggugacccaguggugcugucgcucuugcacgaugccuccccuuagauuccucggagaagauggcuguugguauggcauggagauucggccccuguccgagaaggaagagaauauggucaagagccaagugacagccgggcagggaaccuccgaaacauuuucuaugggccugcucugccugacccuuuucguggaggaaugucugcgcagacgggucacacgcaaacacaugauccucguuguggugaucaccuuuugcgcuauuauccuggggggacugacguggauggaccuucucagagcccugauuaugcugggcgacaccaugagcgggcggaucggaggccagauucaucucgcgaucaugacagucuucaagauguccccuggcuacgugcuggggguuuuucuucgcaaacugaccucuagagagacagcucucauggugaucggaauggccaugaccacggucuucagcauuccgcacgaucugauggagcugaucgacggcauuucccuugggcugauccuccugaagauugugacacauuuugauaacacccagguuggaacacucgcccugucucuuaccuucaugcggagcaccacaccccuggugauggcuuggcgcacgaucauggccgucuucuuugugauuacccucaucccucuguguagaacauccugccugcaaaaacagagccacugggucgaaaucaccgcgcuuauucugggcgcucaggcccuccccguguaucugaugacacucaugaagggggccucucggagauccuggccucugaaugagggaaucauggcuguuggccuugugagccugcucggcucugcccugcugaagaacgacgucccccuugcugggccuaugguggccggaggccugcuccuggcggccuacguuauguccgggagcucugcugaucucucccuggaaaaagccgcuaaugugcaaugggacgagauggccgauauuaccggaagcucccccaucauugaagucaagcaggacgaggauggcagcuucucuauccgcgacguggaggaaacgaacaugaucacacuucuggugaaacuggcccucauuaccguuagcgggcuguacccgcuugcuaucccugucaccauggcgcugugguauauuuggcaggugaagacacagcgguccggagcccucugggaugugcccucuccugcugccacccaaaaagccacacugagcgagggcgucuacagaaucaugcagcgcggccucuuugggaagacgcaggugggaguuggcauucacauggaagggguguuccauaccauguggcacgucacacggggauccgugaucugucaugagaccggcagacuggaacccucuugggcugacguucgcaaugauaugaucagcuaugggggaggcuggcggcuuggcgacaagugggacaaagaggaggaugugcagguccuggccauugaaccggggaagaacccuagacacgugcaaacaaaacccggacuguuuaagacccucacgggcgagaucggggcgguuacccuggacuucaaaccuggaacauccggcucucccauuaucaauaagaaagggaaggugauuggccuuuacggaaacggcgucgugaccaagagcggggauuauguguccgcuaucacacaggccgaacgcauuggagagcccgacuacgaggucgaugaagacaucuuucggaaaaagagacugaccaucauggaucuccauccuggcgccgggaaaacaaagcggauucugccgagcaucguucgcgaggcucucaaaagacggcugcgcacgcuuauucuggcccccaccagagugguggcggcugaaauggaggaagcccugcggggacucccuaucagauaucagacacccgccgucaagucugagcacaccggccgcgagauuguggaccugaugugccacgcuaccuucacaacgcggcuucuguccagcaccagaguuccuaauuacaaccucaucgugauggaugaagcccauuuuacagaccccugcucugucgcugcccgcggguacaucuccacccggguggagaugggcgaagcggccgcuauuuucaugacagccaccccuccgggaagcaucgaucccuuuccucaguccaauucucccauugaggacaucgaaagagagauuccugagcgcagcuggaacacgggcuucgacuggaucacagauuaucaagggaagaccguuugguucgugcccuccaucaaagcuggaaaugacauugccaacugucugcggaagagcggcaaaagagucauccagcucucucgcaagaccuuugauacagaauacccgaaaaccaagcugacagacugggauuucguggucaccacggacauuuccgagaugggggccaacuuuagagcuggacgggugaucgauccucgcagaugccuuaagcccguuauucugacagacggccccgaacgggugauccuggcggggccuauucccgugaccccugccagcgcugcccagcgcagaggccggaucggaagaaauccggcccaagaggaugaccaguaugucuucucuggcgauccccucaaaaacgacgaagaucacgcucauuggacagaggccaagaugcugcuugacaauaucuacaccccugaggggauuauccccacgcuguuuggaccugaacgcgagaaaacccaggcgauugacggcgaauuccggcucagaggggagcagcgcaagacauuuguugagcugaugcggagaggagaucugcccguguggcucagcuauaaaguggcuuccgccggcaucucuuacaaggaccgggaaugguguuucaccggcgagcgcaacaaucaaauucuugaagagaacauggaagucgagaucuggacaagagagggggaaaagaaaaagcugcggccgaaauggcuggaugcccgcguguaugcugacccuauggcccucaaggauuuuaaagaguucgcgagcggaagaaaguccaccacacuggacauccuuaccgaaauugccacgcugcccacauaccucucuagcaaggcuaaacuggcccuggauaauaucguuaugcuccacaccaccgagaagggcgggcgggcuuaccagcacgcccuuaacgaacugccugagucccuggagacacucaugcugguggcucuucugggagccaugaccgcgggcauuuuucucuucuuuaugcaggggaaaggaaucggcaagcugagcaugggccugauugccauggcugucgccucugggcuccuuuggguggcugaaauccagccccaauggaucgccgccuccauuauccuggaguucuuccugaugguccuccugauuccugaacccgagaaacagcgcacaccgcaggacaaucagcuuaucuaugugauucugacgauccucaccauuaucggacugaucgcugcgaacgaaaugggccugauugagaagacaaaaaccgauuuuggguucuaccaaguuaagacagagaccacgauccucgacguggaucuuagaccugccagcgcuuggacccuguaugccgucgccacaaccauucugacacccaugcuccggcauaccaucgaaaauacguccgcuaaccugucucuugccgcgauugccaaucaggcugccgugcugaugggacucggcaagggguggccccugcaccgcauggaccugggaguuccucuccuugcuaugggcugcuacagccaggugaacccgacaacccugacagccucccuggucaugcuccugauccauuaugcgaucauuggccccgggcuucaggccaaagcuaccagagaggcccaaaagcggaccgcugccggaaucaugaaaaauccuacaguggauggcauuacggugaucgaccuggaacccauuucuuacgacccuaaguuugagaaacagcucgggcagguuaugcugcugguccucugugugggacaacuucugcugaugagaaccacaugggcucucugcgaggugcugacccuugccacaggccccaucaugacccugugggaagggaacccuggacgcuucuggaacacgacaaucgcggucagcaccgccaauauuuuucggggcuccuaucucgcuggcgccgggcuggcuuucagccugaucaagaacgcccagaccccgagacgcggaacaggcaccacaggggagacgcucggagaaaaguggaaacggcagcuuaauucucuggauagaaaggaguuugaagaguacaaacgcuccggcauucuggagguugaccggaccgaagccaagagcgcgcucagagaugggucuaaaaucaagcacgcugugucccgcggaagcucuaagauucgguggaucguggagagaggcaugauuaaacccaagggcaaagucguggaccugggguguggacgcggcggguggagcuacuauauggccacacuuaagaacguuaccgaagugaaaggauacacaaagggcgggccuggacaugaggaacccaucccuauggcuaccuauggcuggaaucuggucaagcuccacuccggcguggauguuuucuacaaacccacggagcagguggacacccugcugugcgauaucggggagucuagcuccaacccgacaauugaagagggacggacccucagaauccuuaagauggucgaaccuuggcugagcuccaaacccgaguuuuguauuaaggugcugaaucccuauaugccuacagugaucgaagagcucgagaaacugcaacgcagacacggcgggucucuuguccggugcccccugagccgcaacuccacccaugaaauguacuggguuucuggagccagcggcaauauuguguccucugugaacacaaucagcaagaugcuccugaauagauucaccacgcggcacagaaaaccuacauaugagaaggacgucgaucugggggccggaacccgguccgugagcaccgaaacagagaagccggacaugacgaucauuggccgcagacuccagcggcuucaggaggaacauaaagagaccuggcacuacgaucaggaaaaccccuaccgcacaugggcuuaucacggcucuuacgaggccccuuccaccgggagcgcgucuuccaugguuaauggaguggucaagcugcugacaaaacccugggacgugaucccuaugguuacccaacucgccaugacagacaccacgcccuuuggccagcagagaguguucaaggaaaaagucgauacccggacaccgcagccuaagcuggggacccgcaugauuaugacaaccacggcuaacuggcuuugggcccugcucggaaagaaaaagagccccagacuguguacacgggaggaguuuaucucuaaagugcgcuccaaugcugccauuggcgcgguuuuccaagaagagcagggguggaccagcgccuccgaagcugugaacgacagcagauucugggagcuggucgauaaggaacgggcccuccaucaggagggcaaaugcgagucuugcguguauaauaugaugggaaagcgcgaaaagaaacugggcgaguuugggagagcuaagggaagccgggccaucugguacauguggcuuggcgcucgcuuccuggaauuugaggcccucggguuccugaacgaagaccacugguuuuccagagagaacucuuggagcggagucgagggcgaagggcuucaucggcugggcuauauccucgaggauauugacaaaaaggauggagaccugaucuacgcggaugacacagccggcugggauaccagaauuacggaagacgaucugcucaaugaggagcugaucaccgaacaaauggcuccucaccauaaaacacuugccaaggcuauuuucaagcugaccuaucagaacaaagugguuaaggugcuccgccccacaccuaaaggggccgucauggacaucaucucccggaaggaccagagaggaucuggccagguggggaccuacggacugaauacauuuaccaacauggaggugcaacuuauucgccagauggaagccgagggcguuaucacgcaggaugacaugcagaaucccaaagggcugaaggaacggguggagaaauggcucaaggaguguggcgucgauagacugaagcgcauggcgauuagcggagacgauugcgugguuaaaccgcuggacgaacgguucuccacaucucuccuguuucuuaacgauaugggcaaggugagaaaagacgucccucaaugggagcccagcaagggguggaaaaauuggcaggaagugcccuucuguucccaccacuuucauaagaucuucaugaaggauggacgcagccuggucgugccuugccggaaccaggacgagcucauuggcagagcucgcaucucucagggggccggauggucccugcgggaaaccgccugucuuggcaaagcuuacgcccaaauguggagccugauguauuuucacagacgggaucucagacuggcuucuauggccauuugcuccgcgguuccgaccgagugguuccccacaagccgcaccacaugguccauccaugcccagcaccaguggaugacgaccgaggacaugcugaagguguggaaucgggucuggaucgaagacaacccuaauaugacagauaaaacccccgugcacucuugggaggacauuccuuaccucgggaagagagaagaucugugguguggcagccuuaucggacuguccagccgcgcuacaugggccaaaaacauucauaccgcuaucacgcagguuagaaaucucauuggcaaggaggaauauguggacuacaugcccgucaugaagcgguauucuuccccuagcgagucugagggggugcuguga

SEQ ID NO: 21031 - RNA, 9867 nt, Artificial Sequence
  derived and/or modified CDS sequence (opt5) from DENV-4__JQ915086__SS-prME
agcaccaugacacugcucugccugauccccacggugauggccuuccaccuuuccaccagagacggcgagccucugaugauugucgcuaagcaugaacgggggcgcccgcuccuguuuaaaacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguauugaagcuagcaucucuaauauuaccacagccacccgcugcccgacgcaaggagagcccuaucuuaaggaggaacaggaccagcaguacaucuguagacgggaugugguggaccgcggcugggggaacggaugcggccuguucgggaaaggaggcgucgugacaugcgcgaaguuucucuguuccggcaaaauuaccgggaaucugguucaaaucgagaaccuugaauauaccguggucgugacaguucauaauggagauacccacgccgugggcaacgacacaagcaaucacggggucacggcuaccauuacaccuagaucucccuccguggaggucaagcugccugauuacggagaacucacccuggacugcgagccccggagcggcaucgacuucaacgagaugauccugaugaagaugaaaaagaaaacauggcucgugcauaagcagugguuucuggaucuuccgcugccuuggaccgccggggcugacacgucugaaguucacuggaauuacaaagagagaauggugaccuucaaggucccccaugccaaacgccaggaugugacaguucucggcucccaggaaggagccaugcacagcgcucuggcgggcgccaccgagguggacuccggggauggaaaccacauguuugcuggccaucuuaaguguaagguccggauggaaaaacugagaauuaaggggaugucuuauacaaugugcagcggaaaauucuccaucgacaaggagauggccgagacccaacacggcacgacaguggugaaaguuaaguacgaaggggccggcgcuccuuguaagauucccaucgagauucgcgaugucaauaaagaaaagguggugggacggaucaucagcucuacccccuucgccgagaacacaaacuccgucauuaauaucgagcucgaaccuccguuuggcgacagcuauauugugaucgggguuggagauucugcgcugacccugcauugguucagaaaaggcagcuccauugggaagauguuugagucuaccuaccgcggagcuaaacggauggccauccucggcgaaacagccugggacuucgggagcgugggcggacuguuuacgucccuuggcaaggcuguccaccagguguucgggagcguuuauaccacaauguuuggaggcgugucuuggaugaucagaauucugaucggguuccucguccuguggauuggaaccaacucccgcaauacaagcauggccaugaccugcaucgcugugggcgggauuacgcuguuucuuggcuucacaguucaggccgauaugggauguguggucucuuggaacggcaaggagcucaaaugcggguccggaaucuuugugguggacaauguccauaccuggaccgaacaauacaaguuccagcccgagagcccugcgcggcuggccuccgcuauucugaacgcccacaaagacggcguuugugggaucagaucuacaacccgccucgagaaugugauguggaagcagaucacaaacgaacugaauuaugugcuuugggagggaggccacgaucugacggucguggcuggcgacguuaaaggggugcucaccaagggaaagcggguccugacacccccugugaacgaucugaaauacagcuggaagaccuggggcaaagccaagauuuuuacacccgaagcgagaaauuccaccuuccuuaucgacgggccggauacgucugagugcccuaacgaacggcgcgccuggaauuucuuugagguugaggacuacggauucggcauguuuaccacaaacauuuggaugaaauucagagaagggagcuccgaggugugugaucaucggcucaugagcgcugccaucaaggaccagaaagcuguccacgccgauaugggauauuggauugaaucuuccaagaaucaaaccuggcagaucgagaaggccagccugaucgaagugaaaacaugccuguggcccaagacccauacacucuggucuaacggcguucuggagucccagaugcuuauuccuagaagcuacgcuggccccuuuucucagcacaacuaucgccaaggguacgcgacccagacggccggaccuuggcaccugggcaaacucgagaucgacuucggggaaugccccggaacaaccgugaagauucaggaggauugugaccaucggggcccgagccugagaaccacaaccgcuuccgggaaacuggucacgcaguggugcugucgcagcugcacaaugccuccccuuagauuucucggagaagauggcuguugguauggcauggagauccggccccugucugagaaggaagagaauauggugaagucccaagugaccgccgggcagggaacaagcgaaaccuucuccaugggccugcucugccugacacuuuuugucgaggaaugucugcgcagacggguuacccgcaaacacaugauucucgugguggucaucacguucugcgccaucauucuggggggacugaccuggauggaccuucucagagcucugaucaugcugggcgacacaaugucugggcggauuggaggccagauccaucucgccauuaugaccguguuuaagaugagcccuggcuacguucuggggguguuccuucgcaaacugacauccagagagaccgcgcucauggucaucggaauggcuaugacgacaguguuuucuaucccgcacgaucugauggagcugauugacggcaucagccuugggcugauucuccugaagaucguuacccauuucgauaacacacaggugggaacccucgcccugucccuuaccuucauucggucuacaacgccccuggucauggccuggcgcaccaucauggcuguguuuuucgucauuacacucaucccucuguguagaaccagcugccugcaaaaacagucccacuggguggaaaucacagcccuuauucugggcgcgcaggcucuccccguuuaucugaugacccucaugaagggggccagccggagaucuuggccucugaaugagggaaucauggccgugggccuugucucccugcucggcagcgcucugcugaagaacgacgugccccuugccgggccuaugguugcuggaggccugcuccuggccgcguacgugaugucuggguccagcgccgaucucucucuggaaaaagcugccaauguccaaugggacgagauggcugauauuacgggauccagccccaucauugaagugaagcaggacgaggauggcuccuuuagcauccgcgacguggaggaaacaaacaugaucacccuucugguuaaacuggcccucauuaccgucucugggcuguacccgcuugccaucccugugacaauggcucugugguauauuuggcaggugaagacccagcggagcggagcgcucugggauguccccuccccugccgcuacacaaaaagccacgcugucugagggcguguacagaaucaugcagcgcggccucuucgggaagacccagguuggagugggcauucacauggaaggggucuuucauacaauguggcacgugacccggggaagcguuaucugucaugagacaggcagacuggaacccuccugggccgacgugcgcaaugauaugaucucuuaugggggaggcuggcggcuuggcgacaagugggacaaagaggaggauguccaggugcuggcuauugaaccggggaagaacccuagacacguucaaaccaaacccggacuguucaagacgcucaccggcgagaucggggccgugacacuggacuuuaaaccuggaaccagcggcucccccauuaucaauaagaaagggaaggucauuggccuuuacggaaacggcguggugacaaagucuggggauuaugucagcgcgaucacccaggcugaacgcauuggagagcccgacuacgagguugaugaagacaucuuccggaaaaagagacugacaaucauggaucuccauccuggcgccgggaaaacgaagcggauucugccguccaucgugcgcgaggcccucaaaagacggcugcgcacccuuauucuggcucccacaagaguggucgccgcggaaauggaggaagcucugcggggacucccuaucagauaucagacccccgccgugaagagcgagcacaccggccgcgagauuguugaccugaugugccacgccacauuuacgacccggcuucugucuuccacaagagugccuaauuacaaccucaucgucauggaugaagcucauuucaccgaccccugcagcguggccgcucgcggguacaucucuacacggguugagaugggcgaagccgcggccauuuuuaugaccgcuacgccuccgggauccaucgaucccuucccucagagcaauucccccauugaggacaucgaaagagagauuccugagcgcucuuggaacacaggcuucgacuggaucaccgauuaucaagggaagaccgugugguuuguccccagcaucaaagccggaaaugacauugcuaacugucugcggaaguccggcaaaagagugauccagcucagccgcaagacauucgauaccgaauacccgaaaacaaagcugaccgacugggauuuugucgugacgacagacauuucugagaugggggccaacuucagagccggacggguuaucgauccucgcagaugccuuaagcccgugauucugaccgacggccccgaacgggugauccuggcugggccuauucccgucacaccugcguccgccgcucagcgcagaggccggaucggaagaaauccggcccaagaggaugaccaguauguuuuuagcggcgauccccucaaaaacgacgaagaucacgcccauuggaccgaggcuaagaugcugcuugacaauaucuacacgccugaggggauuauccccacccuguucggaccugaacgcgagaaaacacaggccauugacggcgaauuucggcucagaggggagcagcgcaagaccuucguggagcugaugcggagaggagaucugcccguguggcucucuuauaaagucgcgagcgcuggcaucuccuacaaggaccgggaaugguguuuuacaggcgagcgcaacaaucaaauucuugaagagaacauggaaguggagaucuggaccagagagggggaaaagaaaaagcugcggccgaaauggcuggaugcccgcguuuaugccgacccuauggcucucaaggauuucaaagaguuugccucuggaagaaagagcacaacccuggacauccuuacggaaauugcgacacugcccaccuaccucuccucuaaggccaaacuggcucuggauaauaucgugaugcuccacaccacagagaagggcgggcgggccuaccagcacgcucuuaacgaacugccugagagccuggagacccucaugcuggucgcccuucugggagcuaugacagccggcauuuuccucuuuuucaugcaggggaaaggaaucggcaagcuguccaugggccugauugcgaucgccguggcuagcgggcuccuuugggucgccgaaauccagccccaauggauugcugccucuaucauucuggaguucuuucugauggugcuccugaucccugaacccgagaaacagcgcacgccgcaggacaaucagcuuauuuauguuauccugaccauucucacaaucaucggacugauugccgcuaacgaaaugggccugaucgagaagaccaaaacagauuucggguuuuaccaagugaagaccgagacgaccauucucgacgucgaucuuagaccugcguccgccuggacacuguaugcuguggccaccacaauccugacccccaugcuccggcauacgauugaaaauacaagcgccaaccugucccuugcugccaucgcgaaucaggccgcuguucugaugggacucggcaagggguggccccugcaccgcauggaccugggagugccucuccuugccaugggcugcuacucucaggucaacccgaccacacugaccgcuagccuggugaugcuccugauccauuaugccauuaucggccccgggcuucaggcgaaagccaccagagaggcucaaaagcggacagccgcuggaauuaugaaaaauccuacgguggauggcaucaccguuauugaccuggaacccaucuccuacgacccuaaguucgagaaacagcucgggcaggucaugcugcuggugcucugugugggacaacuucugcugaugagaacaaccugggcccucugcgagguccugacacuugcuaccggccccaucaugacgcugugggaagggaacccuggacgcuuuuggaacacaaccauugccguuucuaccgcgaauaucuuccggggcagcuaucucgccggcgcugggcuggccuuuucccugauuaagaacgcucagacaccgagacgcggaaccggcacaacgggggagacccucggagaaaaguggaaacggcagcuuaauagccuggauagaaaggaguucgaagaguacaaacgcucuggcauccuggagguggaccggacagaagccaaguccgcccucagagaugggagcaaaauuaagcacgcggugucucgcggauccagcaagauccgguggauugucgagagaggcaugaucaaacccaagggcaaagugguugaccugggguguggacgcggcggguggucuuacuauauggcuacccuuaagaacgugacagaagucaaaggauacaccaagggcgggccuggacaugaggaacccaucccuauggccacguauggcuggaaucuggugaagcuccacagcggcguugauguguuuuacaaacccaccgagcaggucgacacacugcugugcgauauuggggaguccucuagcaacccgaccaucgaagagggacggacacucagaauucuuaagaugguggaaccuuggcuguccagcaaacccgaguucuguaucaaggugcugaaucccuauaugccuaccgucauugaagagcucgagaaacugcaacgcagacacggcgggucccuuguucggugcccccugucucgcaacagcacacaugaaauguacuggguguccggagcuucuggcaauaucgugagcuccgucaacaccaucucuaagaugcuccugaauagauuuacgacacggcacagaaaaccuaccuaugagaaggacguggaucugggggccggaacccggagcguuuccacagaaacggagaagccggacaugaccauuaucggccgcagacuccagcggcuucaggaggaacauaaagagacauggcacuacgaucaggaaaaccccuaccgcaccugggccuaucacggcagcuacgaggcuccuucuacaggguccgccagcucuauggugaauggagucgugaagcugcugaccaaacccugggacguuauuccuauggugacacaacucgcgaugaccgacacgacccccuucggccagcagagagucuuuaaggaaaaaguggauacacggaccccgcagccuaagcuggggacacgcaugaucaugaccacgacagccaacuggcuuugggcucugcucggaaagaaaaagucccccagacuguguacccgggaggaguucauuagcaaaguucgcucuaaugccgcuaucggcgccguguuccaagaagagcagggguggacauccgcgagcgaagccgucaacgacuccagauuuugggagcugguggauaaggaacgggcucuccaucaggagggcaaaugcgagagcugcgucuauaauaugaugggaaagcgcgaaaagaaacugggcgaguucgggagagccaagggaucucgggcuaucugguacauguggcuuggcgcccgcuuucuggaauucgaggcucucggguuucugaacgaagaccacugguucagcagagagaacuccuggucuggaguggagggcgaagggcuucaucggcugggcuauauucucgaggauaucgacaaaaaggauggagaccugauuuacgccgaugacaccgcgggcugggauacgagaaucaccgaagacgaucugcucaaugaggagcugauuacagaacaaauggccccucaccauaaaacccuugcuaaggccaucuuuaagcugacauaucagaacaaaguugugaagguccuccgccccaccccuaaaggggcugugauggacaucauuagccggaaggaccagagaggauccggccagguggggacauacggacugaauaccuucacgaacauggagguucaacuuauccgccagauggaagccgagggcgugauuacacaggaugacaugcagaaucccaaagggcugaaggaacgggucgagaaauggcucaaggaguguggcguggauagacugaagcgcauggccaucucuggagacgauugcguugugaaaccgcuggacgaacgguuuagcaccucccuccuguuccuuaacgauaugggcaaggucagaaaagacgugccucaaugggagcccucuaagggguggaaaaauuggcaggaaguccccuuuuguagccaccacuuccauaagauuuuuaugaaggauggacgcucccuggugguuccuugccggaaccaggacgagcucaucggcagagcgcgcauuagccagggggcuggauggucucugcgggaaaccgccugucuuggcaaagccuacgcucaaauguggucccugauguauuuccacagacgggaucucagacuggccagcauggcuaucugcucugccgugccgacagagugguuccccaccucccgcacaacguggagcauccaugcgcagcaccaguggaugaccacagaggacaugcugaaggucuggaaucggguguggauugaagacaacccuaauaugaccgauaaaacacccguucacuccugggaggacaucccuuaccucgggaagagagaagaucugugguguggcucucuuauuggacugagcucccgcgccaccugggcuaaaaacauccauacggccauuacccaggugagaaaucucaucggcaaggaggaauaugucgacuacaugcccgugaugaagcgguauagcgcuccuucugaguccgagggggugcuguga

SEQ ID NO: 21032 - RNA, 9867 nt, Artificial Sequence
  derived and/or modified CDS sequence (opt5) from DENV-4__JQ915087__SS-prME
agcaccaugacacugcucugccugauccccacggugauggccuuccaccuuuccaccagagacggcgagccucugaugauugucgcuaagcaugaacgggggcgcccgcuccuguuuaaaacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggauuguuuucuuugugcugaugaugcuugucgcccccagcuauggcaugcgcuguguggggguuggaaacagagauuucguggaaggcgucuccgggggagcguggguggaccuggugcucgagcacggcggcugcgucaccacaauggcccaggggaagccuacccuggauuuugaacugaccaagacaacggcuaaagagguugcccuccugcggaccuacuguaucgaagcuagcauuucuaauaucacaaccgccacacgcugcccgacccaaggagagcccuaucuuaaggaggaacaggaccagcaguacauuuguagacgggaugugguggaccgcggcugggggaacggaugcggccuguucgggaaaggaggcgucgugacgugcgcgaaguuucucuguuccggcaaaaucacagggaaucugguucaaauugagaaccuugaauauaccguggucgugaccguucauaauggagauacacacgccgugggcaacgacaccagcaaucacggggucacagcuacgaucaccccuagaucucccuccguggaggucaagcugccugauuacggagaacucacacuggacugcgagccccggagcggcaucgacuucaacgagaugauucugaugaagaugaaaaagaaaaccuggcucgugcauaagcagugguuucuggaucuuccgcugccuuggacagccggggcugacaccucugaaguucacuggaauuacaaagagagaauggugacguucaaggucccccaugccaaacgccaggaugugaccguucucggcucccaggaaggagccaugcacagcgcucuggcgggcgccacagagguggacuccggggauggaaaccacauguuugcuggccaucuuaaguguaagguccggauggaaaaacugagaaucaaggggaugucuuauaccaugugcagcggaaaauucuccauugacaaggagauggccgagacacaacacggcaccacgguggugaaaguuaaguacgaaggggccggcgcuccuuguaagauccccauugagauccgcgaugucaauaaagaaaagguggugggacggaucauuagcucuacacccuucgccgagaacaccaacuccgucaucaauauugagcucgaaccuccguuuggcgacagcuauaucgugauugggguuggagauucugcgcugacacugcauugguucagaaaaggcagcuccaucgggaagauguuugagucuaccuaccgcggagcuaaacggauggccauccucggcgaaaccgccugggacuucgggagcgugggcggacuguuuacaucccuuggcaaggcuguccaccagguguucgggagcguuuauacgaccauguuuggaggcgugucuuggaugauuagaauccugauuggguuccucguccuguggaucggaacaaacucccgcaauaccagcauggccaugacaugcauugcugugggcgggaucacccuguuucuuggcuucacgguucaggccgauaugggauguguggucucuuggaacggcaaggagcucaaaugcggguccggaauuuuugugguggacaauguccauacauggaccgaacaauacaaguuccagcccgagagcccugcgcggcuggccuccgcuauccugaacgcccacaaagacggcguuugugggaucagaucuaccacacgccucgagaaugugauguggaagcagauuaccaacgaacugaauuaugugcuuugggagggaggccacgaucugacagucguggcuggcgacguuaaaggggugcucacgaagggaaagcgggcccugacccccccugucaacgaucugaaauacagcuggaagacauggggcaaagcgaagaucuuuacccccgaagccagaaauuccacauuccuuauugacgggccggauaccucugagugcccuaacgaacggcgcgcuuggaauuucuuugagguggaggacuacggauucggcauguuuacgaccaacaucuggaugaaauucagagaagggagcuccgagguuugugaucaucggcucaugagcgccgcuauuaaggaccagaaagccgugcacgccgauaugggauauuggaucgaaucuuccaagaaucaaacauggcagaucgagaaggcuagccugauugaagucaaaaccugccuguggcccaagacacauacccucuggucuaacggcgugcuggagucccagaugcuuaucccuagaagcuacgcgggccccuuuucucagcacaacuaucgccaaggguacgccacacagaccgcuggaccuuggcaccugggcaaacucgagauugacuucggggaaugccccggaacgacaguuaagauccaggaggauugugaccaucggggcccgagccugagaaccaccacagccuccgggaaacuggugacccaguggugcugucgcagcugcacgaugccuccccuuagauuucucggagaagauggcuguugguauggcauggagauucggccccugucugagaaggaagagaauauggucaagucccaagugacagccgggcagggaaccagcgaaacauucuccaugggccugcucugccugacccuuuuuguggaggaaugucugcgcagacgggucacacgcaaacacaugauccucguuguggugaucaccuucugcgcuauuauccuggggggacugacguggauggaccuucucagagcccugauuaugcugggcgacaccaugucugggcggaucggaggccagauucaucucgcgaucaugacagucuuuaagaugagcccuggcuacgugcuggggguuuuccuucgcaaacugaccuccagagagacagcucucauggugaucggaauggccaugaccacggucuuuucuauuccgcacgaucugauggagcugaucgacggcauuagccuugggcugauccuccugaagauugugacacauuucgauaacacccagguuggaacacucgcccugucccuuaccuucauccggucuaccacaccccuggugauggcuuggcgcacgauuauggccgucuuuuucgugaucacccucaucccucuguguagaacaagcugccugcaaaaacagucccacugggucgaaauuaccgcgcuuauccugggcgcucaggcccuccccguguaucugaugacacucaugaagggggccagccggagaucuuggccucugaaugagggaauuauggcuguuggccuugugucccugcucggcagcgcccugcugaagaacgacgucccccuugcugggccuaugguggccggaggccugcuccuggcggccuacguuaugucuggguccagcgcugaucucucucuggaaaaagccgcuaaugugcaaugggacgagauggccgauaucaccggauccagccccauuaucgaagucaagcaggacgaggauggcuccuuuagcauccgcgacguggaggaaacgaacaugauuacacuucuggugaaacuggcccucaucaccguuucugggcuguacccgcuugcuauuccugucaccauggcgcugugguauaucuggcaggugaagacacagcggagcggagcccucugggaugugcccuccccugcugccacccaaaaagccacacugucugagggcgucuacagaauuaugcagcgcggccucuucgggaagacgcaggugggaguuggcauccacauggaagggguguuucauaccauguggcacgucacacggggaagcgugaucugucaugagaccggcagacuggaacccuccugggcugacguucgcaaugauaugauuucuuaugggggaggcuggcggcuuggcgacaagugggacaaagaggaggaugugcagguccuggccaucgaaccggggaagaacccuagacacgugcaaacaaaacccggacuguucaagacccucacgggcgagauuggggcgguuacccuggacuuuaaaccuggaacaagcggcucccccaucauuaauaagaaagggaaggugaucggccuuuacggaaacggcgucgugaccaagucuggggauuaugugagcgcuauuacacaggccgaacgcaucggagagcccgacuacgaggucgaugaagacaucuuccggaaaaagagacugaccauuauggaucuccauccuggcgccgggaaaacaaagcggauccugccguccauuguucgcgaggcucucaaaagacggcugcgcacgcuuauccuggcccccaccagagugguggcggcugaaauggaggaagcccugcggggacucccuauuagauaucagacacccgccgucaagagcgagcacaccggccgcgagaucguggaccugaugugccacgcuaccuuuacaacgcggcuucugucuuccaccagaguuccuaauuacaaccucaucgugauggaugaagcccauuucacagaccccugcagcgucgcugcccgcggguacauuucuacccggguggagaugggcgaagcggccgcuaucuuuaugacagccaccccuccgggauccauugaucccuucccucagagcaauucccccaucgaggacauugaaagagagaucccugagcgcucuuggaacacgggcuucgacuggaucacagauuaucaagggaagaccguuugguuugugcccagcauuaaagcuggaaaugacaucgccaacugucugcggaaguccggcaaaagagucauucagcucagccgcaagaccuucgauacagaauacccgaaaaccaagcugacagacugggauuuuguggucaccacggacaucucugagaugggggccaacuucagagcuggacgggugauugauccucgcagaugccuuaagcccguuauccugacagacggccccgaacgggugauucuggcggggccuauccccgugaccccugccuccgcugcccagcgcagaggccggaucggaagaaauccggcccaagaggaugaccaguaugucuuuagcggcgauccccucaaaaacgacgaagaucacgcucauuggacagaggccaagaugcugcuugacaauauuuacaccccugaggggaucauucccacgcuguucggaccugaacgcgagaaaacccaggcgaucgacggcgaauuucggcucagaggggagcagcgcaagacauucguugagcugaugcggagaggagaucugcccguguggcucucuuauaaaguggcuagcgccggcauuuccuacaaggaccgggaaugguguuuuaccggcgagcgcaacaaucaaauccuugaagagaacauggaagucgagaucuggacaagagagggggaaaagaaaaagcugcggccgaaauggcuggaugcccgcguguaugcugacccuauggcccucaaggauuucaaagaguuugcgucuggaagaaagagcaccacacuggacauucuuaccgaaaucgccacgcugcccacauaccucuccucuaaggcuaaacuggcccuggauaauauuguuaugcuccacaccaccgagaagggcgggcgggcuuaccagcacgcccuuaacgaacugccugagagccuggagacacucaugcugguggcucuucugggagccaugaccgcgggcaucuuccucuuuuucaugcaggggaaaggaauuggcaagcuguccaugggccugaucgccaucgcugucgccagcgggcuccuuuggguggcugaaauucagccccaauggaucgccgccucuauuauccuggaguucuuucugaugguccuccugauuccugaacccgagaaacagcgcacaccgcaggacaaucagcuuaucuaugugauucugacgauccucaccaucauuggacugaucgcugcgaacgaaaugggccugauugagaagacaaaaaccgauuucggguuuuaccaaguuaagacagagaccacgauccucgacguggaucuuagaccugccuccgcuuggacccuguaugccgucgccacaaccauucugacacccaugcuccggcauaccaucgaaaauacgagcgcuaaccugucccuugccgcgaucgccaaucaggcugccgugcugaugggacucggcaagggguggccccugcaccgcauggaccugggaguuccucuccuugcuaugggcugcuacucucaggugaacccgacaacccugacagccagccuggucaugcuccugauucauuaugcgaucauuggccccgggcuucaggccaaagcuaccagagaggcccaaaagcggaccgcugccggaaucaugaaaaauccuacaguggauggcauuacggugaucgaccuggaacccaucuccuacgacccuaaguucgagaaacagcucgggcagguuaugcugcugguccucugugugggacaacuucugcugaugagaaccacaugggcucucugcgaggugcugacccuugccacaggccccauuaugacccugugggaagggaacccuggacgcuuuuggaacacgacaaucgcggucucuaccgccaauauuuuccggggcagcuaucucgcuggcgccgggcuggcuuuuucccugaucaagaacgcccagaccccgagacgcggaacaggcaccacaggggagacgcucggagaaaaguggaaacggcagcuuaauagccuggauagaaaggaguucgaagaguacaaacgcucuggcauucuggagguugaccggaccgaagccaaguccgcgcucagagaugggagcaaaaucaagcacgcugugucucgcggauccagcaagauucgguggaucguggagagaggcaugaucaaacccaagggcaaagucguggaccugggguguggacgcggcggguggucuuacuauauggccacacuuaagaacguuaccgaagugaaaggauacacaaagggcgggccuggacaugaggaacccauuccuauggcuaccuauggcuggaaucuggucaagcuccacagcggcguggauguuuuuuacaaacccacggagcagguggacacccugcugugcgauaucggggaguccucuagcaacccgacaauugaagagggacggacccucagaauccuuaagauggucgaaccuuggcuguccagcaaacccgaguucuguauuaaggugcugaaucccuauaugccuacagugaucgaagagcucgagaaacugcaacgcagacacggcgggucccuuguccggugcccccugucucgcaacagcacccaugaaauguacuggguuuccggagccucuggcaauaucgugagcuccgugaacacaauuucuaagaugcuccugaauagauuuaccacgcggcacagaaaaccuacauaugagaaggacgucgaucugggggccggaacccggagcguguccaccgaaacagagaagccggacaugacgaucauuggccgcagacuccagcggcuucaggaggaacauaaagagaccuggcacuacgaucaggaaaaccccuaccgcacaugggcuuaucacggcagcuacgaggccccuucuaccggguccgcgagcucuaugguuaauggaguggucaagcugcugacaaaacccugggacgugaucccuaugguuacccaacucgccaugacagacaccacgcccuucggccagcagagaguguuuaaggaaaaagucgauacccggacaccgcagccuaagcuggggacccgcaugauuaugacaaccacggcuaacuggcuuugggcccugcucggaaagaaaaagucccccagacuguguacacgggaggaguucaucagcaaagugcgcucuaaugcugccaucggcgcgguuuuccaagaagagcagggguggaccuccgccagcgaagcugugaacgacuccagauuuugggagcuggucgauaaggaacgggcccuccaucaggagggcaaaugcgagagcugcguguauaauaugaugggaaagcgcgaaaagaaacugggcgaguucgggagagcuaagggaucucgggccauuugguacauguggcuuggcgcucgcuuucuggaauucgaggcccucggguuucugaacgaagaccacugguucagcagagagaacuccuggucuggagucgagggcgaagggcuucauagccugggcuauauccucgaggauauugacaaaaaggauggagaccugaucuacgcggaugacacagccggcugggauacccggauuacggaagacgaucugcucaaugaggagcugaucaccgaacaaauggcuccucaccauaaaacacuugccaaggcuaucuuuaagcugaccuaucagaacaaagugguuaaggugcucagacccacaccuaaaggggccgucauggacauuaucucccgcaaggaccagcggggaucuggccagguggggaccuacggacugaauacauucaccaacauggaggugcaacuuauuagacagauggaagccgagggcguuaucacgcaggaugacaugcagaaucccaaagggcugaaggaacgcguggagaaauggcucaaggaguguggcgucgaucggcugaagagaauggcgauuagcggagacgauugcgugguuaaaccgcuggacgaacgcuuuuccacaucucuccuguuccuuaacgauaugggcaaggugcggaaagacgucccucaaugggagcccagcaagggguggaaaaauuggcaggaagugcccuuuuguucccaccacuuccauaagaucuuuaugaaggauggaagaagccuggucgugccuugccgcaaccaggacgagcucauuggccgggcuagaaucucucagggggccggauggucccugcgcgaaaccgccugucuuggcaaagcuuacgcccaaauguggagccugauguauuuccaccggagagaucuccggcuggcuucuauggccaucugcuccgcgguuccgaccgagugguuccccacaagcagaaccacaugguccauucaugcccagcaccaguggaugacgaccgaggacaugcugaagguguggaaucgcgucuggaucgaagacaacccuaauaugacagauaaaacccccgugcacucuugggaggacauuccuuaccucgggaagcgggaagaucugugguguggcagccuuaucggacuguccagcagagcuacaugggccaaaaacauucauaccgcuaucacgcagguucgcaaucucaucggcaaggaggaauauguggacuacaugcccgucaugaagagauauucugccccuuccgagagcgagggggugcuguga

SEQ ID NO: 21033 - RNA, 9867 nt, Artificial Sequence
  derived and/or modified CDS sequence (opt5) from DENV-4__JQ915089__SS-prME
agcacaaugacacugcucugccugauccccacggugauggccuuccaccuuuccaccagagacggcgagccucugaugauuguugcuaagcaugaacgggggagaccgcuccuguuuaaaacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccagcgcguggagucuuggauucuuagaaauccuggcuucgcucugcucgccggcuuuauggcuuacaugaucgggcagacaggaauccagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguauugaagcuagcaucucuaauauuaccacagccacccgcugcccgacgcaaggagagcccuaucuuaaggaggaacaggaccagcaguacaucuguagacgggaugugguggaccgcggcugggggaacggaugcggccuguucgggaaaggaggcgucgugacaugcgcgaaguuucucuguuccggcaaaauuaccgggaaucugguucaaaucgagaaccuugaauauaccguggucgugacaguucauaauggagauacccacgccgugggcaacgacacaagcaaucacggggucacggcuaccauuacaccuagaucucccuccguggaggucaagcugccugauuacggagaacucacccuggacugcgagccccggagcggcaucgacuucaacgagaugauccugaugaagaugaaaaagaaaacauggcucgugcauaagcagugguuucuggaucuuccgcugccuuggaccgccggggcugacacgucugaaguucacuggaauuacaaagagagaauggugaccuucaaggucccccaugccaaacgccaggaugugacaguucucggcucccaggaaggagccaugcacagcgcucuggcgggcgccaccgagguggacuccggggauggaaaccacauguuugcuggccaucuuaaguguaagguccggauggaaaaacugagaauuaaggggaugucuuauacaaugugcagcggaaaauucuccaucgacaaggagauggccgagacccaacacggcacgacaguggugaaaguuaaguacgaaggggccggcgcuccuuguaagauucccaucgagauucgcgaugucaauaaagaaaagguggugggacggaucaucagcucuacccccuucgccgagaacacaaacuccgucauuaauaucgagcucgaaccuccguuuggcgacagcuauauugugaucgggguuggagauucugcgcugacccugcauugguucagaaaaggcagcuccauugggaagauguuugagucuaccuaccgcggagcuaaacggauggccauccucggcgaaacagccugggacuucgggagcgugggcggacuguuuacgucccuuggcaaggcuguccaccagguguucgggagcguuuauaccacaauguuuggaggcgugucuuggaugauccgcauucugaucggguuccucguccuguggauuggaaccaacucccgcaauacaagcauggccaugaccugcaucgcugugggcgggauuacgcuguuucuuggcuucacaguucaggccgauaugggauguguggucucuuggaacggcaaggagcucaaaugcggguccggaaucuuugugguggacaauguccauaccuggaccgaacaauacaaguuccagcccgagagcccugcgcggcuggccuccgcuauucugaacgcccacaaagacggcguuugugggaucagaucuacaacccgccucgagaaugugauguggaagcagaucacaaacgaacugaauuaugugcuuugggagggaggccacgaucugacggucguggcuggcgacguuaaaggggugcucaccaagggaaagcggguccugacacccccugugaacgaucugaaauacagcuggaagaccuggggcaaagccaagauuuuuacacccgaagcgagaaauuccaccuuccuuaucgacgggccggauacgucugagugcccuaacgaacggcgcgccuggaauuucuuugagguugaggacuacggauucggcauguuuaccacaaacauuuggaugaaauucagagaagggagcuccgaggugugugaucaucggcucaugagcgcugccaucaaggaccagaaagcuguccacgccgauaugggauauuggauugaaucuuccaagaaucaaaccuggcagaucgagaaggccagccugaucgaagugaaaacaugccuguggcccaagacccauacacucuggucuaacggcguucuggagucccagaugcuuauuccuagaagcuacgcuggccccuuuucucagcacaacuaucgccaaggguacgcgacccagacggccggaccuuggcaccugggcaaacucgagaucgacuucggggaaugccccggaacaaccgugaagauucaggaggauugugaccaucggggcccgagccugagaaccacaaccgcuuccgggaaacuggucacgcaguggugcugucgcagcugcacaaugccuccccuuagauuucucggagaagauggcuguugguauggcauggagauccggccccugucugagaaggaagagaauauggugaagucccaagugaccgccgggcagggaacaagcgaaaccuucuccaugggccugcucugccugacacuuuuugucgaggaaugucugcgcagacggguuacccgcaaacacaugauucucgugguggucaucacguucugcgccaucauucucgggggacugaccuggauggaccuucucagagcucugaucaugcugggcgacacaaugucugggcggauuggaggccagauccaucucgccauuaugaccguguuuaagaugagcccuggcuacguucuggggguguuccuucgcaaacugacauccagagagaccgcgcucauggucaucggaauggcuaugacgacaguguuuucuaucccgcacgaucugauggagcugauugacggcaucagccuugggcugauucuccugaagaucguuacccauuucgauaacacacaggugggaacccucgcccugucccuuaccuucauucggucuacaacgccccuggucauggccuggcgcaccaucauggcuguguuuuucgucauuacacucaucccucuguguagaaccagcugccugcaaaaacagucccacuggguggaaaucacagcccuuauucugggcgcgcaggcucuccccguuuaucugaugacccucaugaagggggccagcucucgguccuggccucugaaugagggaaucauggccgugggccuugucagccugcucggcucugcucugcugaagaacgacgugccccuugccgggccuaugguugcuggaggccugcuccuggccgcguacgugauguccgggagcucugccgaucucucccuggaaaaagcugccaauguccaaugggacgagauggcugauauuacgggaagcucccccaucauugaagugaagcaggacgaggauggcagcuuuucuaucagagacguggaggaaacaaacaugaucacccuucugguuaaacuggcccucauuaccgucagcgggcuguacccgcuugccaucccugugacaauggcucugugguauauuuggcaagugaagacccagcgcuccggagcgcucugggauguccccucuccugccgcuacacaaaaagccacgcugagcgagggcguguaccggaucaugcagagaggccucuucgggaagacccagguuggagugggcauucacauggaaggggucuuucauacaauguggcacgugacccgcggauccguuaucugucaugagacaggccggcuggaacccucuugggccgacgugagaaaugauaugaucagcuaugggggaggcuggcgccuuggcgacaagugggacaaagaggaggauguccaggugcuggcuauugaaccggggaagaacccucggcacguucaaaccaaacccggacuguucaagacgcucaccggcgagaucggggccgugacacuggacuuuaaaccuggaaccuccggcucucccauuaucaauaagaaagggaaggucauuggccuuuacggaaacggcguggugacaaagagcggggauuaugucuccgcgaucacccaggcugaaagaauuggagagcccgacuacgagaucgaugaagacaucuuccgcaaaaagcggcugacaauuauggaucuccauccuggcgccgggaaaacgaagagaauccugccgagcauuguucgggaggcccucaaacgcagacugcggacccuuauccuggcucccacacgcgugguggccgcggaaauggaggaagcucugagaggacucccuauucgguaucagacccccgccgucaagucugagcacaccggcagagagaucguggaccugaugugccacgccacauuuacgacccgccuucuguccagcacacggguuccuaauuacaaccucaucgugauggaugaagcucauuucaccgaccccugcucugucgccgcuagaggguacauuuccacacgcguggagaugggcgaagccgcggccaucuuuaugaccgcuacgccuccgggaagcauugaucccuucccucaguccaauucucccaucgaggacauugaacgggagaucccugagagaagcuggaacacaggcuucgacuggaucaccgauuaucaagggaagaccguuugguuugugcccuccauuaaagccggaaaugacaucgcuaacugucugcgcaagagcggcaaacgggucauucagcucucuagaaagacauucgauaccgaauacccgaaaacaaagcugaccgacugggauuuuguggucacgacagacaucuccgagaugggggccaacuuccgcgccggaagagugauugauccucggcgcugccuuaagcccguuauccugaccgacggccccgaaagagugauucuggcugggccuauccccgugaccccugcgagcgccgcucagcggcgcggcagaaucggacggaauccggcccaagaggaugaccaguaugucuuuucuggcgauccccucaaaaacgacgaagaucacgcccauuggaccgaggcuaagaugcugcuugacaauauuuacacgccugaggggaucauucccacccuguucggaccugaaagagagaaaacacaggccaucgacggcgaauuucgccucagaggggagcagcggaagaccuucguugagcugaugcgccggggagaucugcccguguggcucagcuauaaaguggcguccgcuggcauuucuuacaaggacagagaaugguguuuuacaggcgagcggaacaaucaaauccuugaagagaacauggaagucgagaucuggacccgcgagggggaaaagaaaaagcugagaccgaaauggcuggaugcccggguguaugccgacccuauggcucucaaggauuucaaagaguuugccagcggacgcaaguccacaacccuggacauucuuacggaaaucgcgacacugcccaccuaccucucuagcaaggccaaacuggcucuggauaauauuguuaugcuccacaccacagagaagggcgggagagccuaccagcacgcucuuaacgaacugccugagucccuggagacccucaugcugguggcccuucugggagcuaugacagccggcaucuuccucuuuuucaugcaggggaaaggaauuggcaagcugagcaugggccugaucgcgaucgccgucgcuucugggcuccuuuggguggccgaaauucagccccaauggaucgcugccuccauuauccuggaguucuuucugaugguccuccugauuccugaacccgagaaacagcggacgccgcaggacaaucagcuuaucuaugugauucugaccauccucacaaucauuggacugaucgccgcuaacgaaaugggccugauugagaagaccaaaacagauuucggguuuuaccaaguuaagaccgagacgaccauccucgacguggaucuucgcccugcgagcgccuggacacuguaugcugucgccaccacaauucugacccccaugcucagacauacgaucgaaaauacauccgccaaccugucucuugcugccaucgcgaaucaggccgcugugcugaugggacucggcaagggguggccccugcaccggauggaccugggaguuccucuccuugccaugggcugcuacagccaggugaacccgaccacacugaccgcuucccuggucaugcuccugauucauuaugccaucauuggccccgggcuucaggcgaaagccacccgcgaggcucaaaagagaacagccgcuggaaucaugaaaaauccuacgguggauggcauuaccgugaucgaccuggaacccaucucuuacgacccuaaguucgagaaacagcucgggcagguuaugcugcugguccucugugugggacaacuucugcugaugcggacaaccugggcccucugcgaggugcugacacuugcuaccggccccauuaugacgcugugggaagggaacccuggaagauuuuggaacacaaccaucgccgucagcaccgcgaauauuuuccgcggcuccuaucucgccggcgcugggcuggccuuuagccugaucaagaacgcucagacaccgcggagaggaaccggcacaacgggggagacccucggagaaaaguggaaacgccagcuuaauucucuggaucggaaggaguucgaagaguacaaaagauccggcauucuggagguugaccgcacagaagccaagagcgcccuccgggaugggucuaaaaucaagcacgcgguguccagaggaagcucuaagauucgcuggaucguggagcggggcaugaucaaacccaagggcaaagucguggaccugggguguggaagaggcggguggagcuacuauauggcuacccuuaagaacguuacagaagugaaaggauacaccaagggcgggccuggacaugaggaacccauuccuauggccacguauggcuggaaucuggucaagcuccacuccggcguggaugucuuuuacaaacccaccgaacagguggacacacugcugugcgauaucggggagucuagcuccaacccgaccauugaagagggacgcacacuccggauccuuaagauggucgaaccuuggcugagcuccaaacccgaguucuguauuaaggugcugaaucccuauaugccuaccgugaucgaagaacuggagaaacugcaaagacgccacggcgggucucuugucagaugcccccugagccggaacuccacacaugaaauguacuggguuucuggagcuagcggcaauaucguguccucugugaacaccauuagcaagaugcuccugaaucgcuuuacgacaagacaccggaaaccuaccuaugagaaggacgucgaucugggggccggaaccagauccgugagcacagaaacggagaagccggacaugaccaucauuggccggcgccuccagagacuucaggaggaacauaaagagacauggcacuacgaucaggaaaaccccuaccggaccugggccuaucacggcucuuacgaggcuccuuccacagggagcgccucuuccaugguuaauggaguggucaagcugcugaccaaacccugggacgugaucccuaugguuacacaacucgcgaugaccgacacgacccccuucggccagcagcgcguguuuaaggaaaaagucgauacaagaaccccgcagccuaagcuggggacacggaugauuaugaccacgacagccaacuggcuuugggcucugcucggaaagaaaaagagcccccgccuguguaccagagaggaguucaucucuaaagugcgguccaaugccgcuaucggcgccguuuuccaagaggagcagggguggacaagcgcguccgaagccgugaacgacagccgcuuuugggagcuggucgauaaggaaagagcucuccaucaggagggcaaaugcgagucuugcguguauaauaugaugggaaagcgggaaaagaaacugggcgaguucgggcgcgccaagggaagcagagcuauuugguacauguggcuuggcgcccgguuucuggaguucgaggcucucggguuucugaacgaagaccacugguucucccgcgagaacucuuggagcggagucgagggcgaagggcuucauagacugggcuauauccucgaggauauugacaaaaaggauggagaccugaucuacgccgaugacaccgcgggcugggauacgcggauuaccgaagacgaucugcucaaugaggagcugaucacagaacaaauggccccucaccauaaaacccuugcuaaggccaucuuuaagcugacauaucagaacaaagugguuaaggugcucagacccaccccuaaaggggcugucauggacauuaucucccgcaaggaccagcggggaucuggccagguggggacauacggacugaauaccuucacgaacauggaggugcaacuuauuagacagauggaagccgagggcguuaucacacaggaugacaugcagaaucccaaagggcugaaggaacgcguggagaaauggcucaaggaguguggcgucgaucggcugaagagaauggccauuagcggagacgauugcgugguuaaaccgcuggacgaacgcuuuuccaccucucuccuguuccuuaacgauaugggcaaggugcggaaagacgucccucaaugggagcccagcaagggguggaaaaauuggcaggaagugcccuuuuguucccaccacuuccauaagaucuuuaugaaggauggaagaagccuggucgugccuugccgcaaccaggacgagcucauuggccgggcgagaaucucucagggggcuggauggucccugcgcgaaaccgccugucuuggcaaagccuacgcucaaauguggagccugauguauuuccaccggagagaucuccggcuggccucuauggcuaucugcuccgccguuccgacagagugguuccccaccagcagaacaacgugguccauucaugcgcagcaccaguggaugaccacagaggacaugcugaagguguggaaucgcgucuggaucgaagacaacccuaauaugaccgauaaaacacccgugcacucuugggaggacauuccuuaccucgggaagcgggaagaucugugguguggcagccuuaucggacuguccagcagagccaccugggcuaaaaacauucauacggccaucacccagguucgcaaucucaucggcaaggaggaauauguggacuacaugcccgucaugaagagauauucugcuccuuccgagagcgagggggugcuguga

SEQ ID NO: 21034 - RNA, 9867 nt, Artificial Sequence
  derived and/or modified CDS sequence (opt5) from DENV-4__JQ915082__SS-prME
agcaccaugacacugcucugccugauccccacggugauggccuuccaccuuuccaccagagacggcgagccucugaugauugucgcuaagcaugaacgggggcgcccgcuccuguuuaaaacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggauuguuuucuuugugcugaugaugcuugucgcccccagcuauggcaugcgcuguguggggguuggaaacagagauuucguggaaggcgucuccgggggagcguggguggaccuggugcucgagcacggcggcugcgucaccacaauggcccaggggaagccuacccuggauuuugaacugaccaagacaacggcuaaagagguugcccuccugcggaccuacuguaucgaagcuagcauuucuaauaucacaaccgccacacgcugcccgacccaaggagagcccuaucuuaaggaggaacaggaccagcaguacauuuguagacgggaugugguggaccgcggcugggggaacggaugcggccuguucgggaaaggaggcgucgugacgugcgcgaaguuucucuguuccggcaaaaucacagggaaucugguucaaauugagaaccuugaauauaccguggucgugaccguucauaauggagauacacacgccgugggcaacgacaccagcaaucacggggucacagcuacgaucaccccuagaucucccuccguggaggucaagcugccugauuacggagaacucacacuggacugcgagccccggagcggcaucgacuucaacgagaugauucugaugaagaugaaaaagaaaaccuggcucgugcauaagcagugguuucuggaucuuccgcugccuuggacagccggggcugacaccucugaaguucacuggaauuacaaagagagaauggugacguucaaggucccccaugccaaacgccaggaugugaccguucucggcucccaggaaggagccaugcacagcgcucuggcgggcgccacagagguggacuccggggauggaaaccacauguuugcuggccaucuuaaguguaagguccggauggaaaaacugagaaucaaggggaugucuuauaccaugugcagcggaaaauucuccauugacaaggagauggccgagacacaacacggcaccacgguggugaaaguuaaguacgaaggggccggcgcuccuuguaagauccccauugagauccgcgaugucaauaaagaaaagguggugggacggaucauuagcucuacacccuucgccgagaacaccaacuccgucaucaauauugagcucgaaccuccguuuggcgacagcuauaucgugauugggguuggagauucugcgcugacacugcauugguucagaaaaggcagcuccaucgggaagauguuugagucuaccuaccgcggagcuaaacggauggccauccucggcgaaaccgccugggacuucgggagcgugggcggacuguuuacaucccuuggcaaggcuguccaccagguguucgggagcguuuauacgaccauguuuggaggcgugucuuggaugauuagaauccugauuggguuccucguccuguggaucggaacaaacucccgcaauaccagcauggccaugacaugcauugcugugggcgggaucacccuguuucuuggcuucacgguucaggccgauaugggauguguggucucuuggaacggcaaggagcucaaaugcggguccggaauuuuugugguggacaauguccauacauggaccgaacaauacaaguuccagcccgagagcccugcgcggcuggccuccgcuauccugaacgcccacaaagacggcguuugugggaucagaucuaccacacgccucgagaaugugauguggaagcagauuaccaacgaacugaauuaugugcuuugggagggaggccacgaucugacagucguggcuggcgacguuaaaggggugcucacgaagggaaagcgggcccugacccccccugucaacgaucugaaauacagcuggaagacauggggcaaagcgaagaucuuuacccccgaagccagaaauuccacauuccuuauugacgggccggauaccucugagugcccuaacgaacggcgcgcuuggaauuucuuugagguggaggacuacggauucggcauguuuacgaccaacaucuggaugaaauucagagaagggagcuccgagguuugugaucaucggcucaugagcgccgcuauuaaggaccagaaagccgugcacgccgauaugggauauuggaucgaaucuuccaagaaucaaacauggcagaucgagaaggcuagccugauugaagucaaaaccugccuguggcccaagacacauacccucuggucuaacggcgugcuggagucccagaugcuuaucccuagaagcuacgcgggccccuuuucucagcacaacuaucgccaaggguacgccacacagaccgcuggaccuuggcaccugggcaaacucgagauugacuucggggaaugccccggaacgacaguuaagauccaggaggauugugaccaucggggcccgagccugagaaccaccacagccuccgggaaacuggugacccaguggugcugucgcagcugcacgaugccuccccuuagauuucucggagaagauggcuguugguauggcauggagauucggccccugucugagaaggaagagaauauggucaagucccaagugacagccgggcagggaaccagcgaaacauucuccaugggccugcucugccugacccuuuuuguggaggaaugucugcgcagacgggucacacgcaaacacaugauccucguuguggugaucaccuucugcgcuauuauccuggggggacugacguggauggaccuucucagagcccugauuaugcugggcgacaccaugucugggcggaucggaggccagauucaucucgcgaucaugacagucuuuaagaugagcccuggcuacgugcuggggguuuuccuucgcaaacugaccuccagagagacagcucucauggugaucggaauggccaugaccacggucuuuucuauuccgcacgaucugauggagcugaucgacggcauuagccuugggcugauccuccugaagauugugacacauuucgauaacacccagguuggaacacucgcccugucccuuaccuucauccggucuaccacaccccuggugauggcuuggcgcacgauuauggccgucuuuuucgugaucacccucaucccucuguguagaacaagcugccugcaaaaacagucccacugggucgaaauuaccgcgcuuauccugggcgcucaggcccuccccguguaucugaugacacucaugaagggggccagccggagaucuuggccucugaaugagggaauuauggcuguuggccuugugucccugcucggcagcgcccugcugaagaacgacgucccccuugcugggccuaugguggccggaggccugcuccuggcggccuacguuaugucuggguccagcgcugaucucucucuggaaaaagccgcuaaugugcaaugggacgagauggccgauaucaccggauccagccccauuaucgaagucaagcaggacgaggauggcuccuuuagcauccgcgacguggaggaaacgaacaugauuacacuucuggugaaacuggcccucaucaccguuucugggcuguacccgcuugcuauuccugucaccauggcgcugugguauaucuggcaggugaagacacagcggagcggagcccucugggaugugcccuccccugcugccacccaaaaagccacacugucugagggcgucuacagaauuaugcagcgcggccucuucgggaagacgcaggugggaguuggcauccacauggaagggguguuucauaccauguggcacgucacacggggaagcgugaucugucaugagaccggcagacuggaacccuccugggcugacguucgcaaugauaugauuucuuaugggggaggcuggcggcuuggcgacaagugggacaaagaggaggaugugcagguccuggccaucgaaccggggaagaacccuagacacgugcaaacaaaacccggacuguucaagacccucacgggcgagauuggggcgguuacccuggacuuuaaaccuggaacaagcggcucccccaucauuaauaagaaagggaaggugaucggccuuuacggaaacggcgucgugaccaagucuggggauuaugugagcgcuauuacacaggccgaacgcaucggagagcccgacuacgaggucgaugaagacaucuuccggaaaaagagacugaccauuauggaucuccauccuggcgccgggaaaacaaagcggauccugccguccauuguucgcgaggcucucaaaagacggcugcgcacgcuuauccuggcccccaccagagugguggcggcugaaauggaggaagcccugcggggacucccuauuagauaucagacacccgccgucaagagcgagcacaccggccgcgagaucguggaccugaugugccacgcuaccuuuacaacgcggcuucugucuuccaccagaguuccuaauuacaaccucaucgugauggaugaagcccauuucacagaccccugcagcgucgcugcccgcggguacauuucuacccggguggagaugggcgaagcggccgcuaucuuuaugacagccaccccuccgggauccauugaucccuucccucagagcaauucccccaucgaggacauugaaagagagaucccugagcgcucuuggaacacgggcuucgacuggaucacagauuaucaagggaagaccguuugguuugugcccagcauuaaagcuggaaaugacaucgccaacugucugcggaaguccggcaaaagagucauucagcucagccgcaagaccuucgauacagaauacccgaaaaccaagcugacagacugggauuuuguggucaccacggacaucucugagaugggggccaacuucagagcuggacgggugauugauccucgcagaugccuuaagcccguuauccugacagacggccccgaacgggugauucuggcggggccuauccccgugaccccugccuccgcugcccagcgcagaggccggaucggaagaaauccggcccaagaggaugaccaguaugucuuuagcggcgauccccucaaaaacgacgaagaucacgcucauuggacagaggccaagaugcugcuugacaauauuuacaccccugaggggaucauucccacgcuguucggaccugaacgcgagaaaacccaggcgaucgacggcgaauuucggcucagaggggagcagcgcaagacauucguugagcugaugcggagaggagaucugcccguguggcucucuuauaaaguggcuagcgccggcauuuccuacaaggaccgggaaugguguuuuaccggcgagcgcaacaaucaaauccuugaagagaacauggaagucgagaucuggacaagagagggggaaaagaaaaagcugcggccgaaauggcuggaugcccgcguguaugcugacccuauggcccucaaggauuucaaagaguuugcgucuggaagaaagagcaccacacuggacauucuuaccgaaaucgccacgcugcccacauaccucuccucuaaggcuaaacuggcccuggauaauauuguuaugcuccacaccaccgagaagggcgggcgggcuuaccagcacgcccuuaacgaacugccugagagccuggagacacucaugcugguggcucuucugggagccaugaccgcgggcaucuuccucuuuuucaugcaggggaaaggaauuggcaagcuguccaugggccugaucgccaucgcugucgccagcgggcuccuuuggguggcugaaauucagccccaauggaucgccgccucuauuauccuggaguucuuucugaugguccuccugauuccugaacccgagaaacagcgcacaccgcaggacaaucagcuuaucuaugugauucugacgauccucaccaucauuggacugaucgcugcgaacgaaaugggccugauugagaagacaaaaaccgauuucggguuuuaccaaguuaagacagagaccacgauccucgacguggaucuuagaccugccuccgcuuggacccuguaugccgucgccacaaccauucugacacccaugcuccggcauaccaucgaaaauaugagcgcuaaccugucccuugccgcgaucgccaaucaggcugccgugcugaugggacucggcaagggguggccccugcaccgcauggaccugggaguuccucuccuugcuaugggcugcuacucucaggugaacccgacgacacugaccgccagccuggucaugcuccugauucauuaugcgaucauuggccccgggcuucaggccaaagcuacaagagaggcccaaaagcggaccgcugccggaaucaugaaaaauccuaccguggauggcauuacagugaucgaccuggaacccaucuccuacgacccuaaguucgagaaacagcucgggcagguuaugcugcugguccucugugugggacaacuucugcugaugagaacgaccugggcucucugcgaggugcugacacuugccaccggccccauuaucacacugugggaagggaacccuggacgcuuuuggaacaccacgauugcggucucuacagccaauaucuuccggggcagcuaucucgcuggcgccgggcuggcuuuuucccugauuaagaacgcccagaccccgagacgcggaaccggcacaaccggggagacacucggagaaaaguggaaacggcagcuuaauagccuggauagaaaggaguucgaagaguacaaacgcucuggcauccuggagguugaccggacggaagccaaguccgcgcucagagaugggagcaaaauuaagcacgcugugucucgcggauccagcaagauccgguggaucguggagagaggcaugauuaaacccaagggcaaagucguggaccugggguguggacgcggcggguggucuuacuauauggccacccuuaagaacguuacagaagugaaaggauacaccaagggcgggccuggacaugaggaacccaucccuauggcuacauauggcuggaaucuggucaagcuccacagcggcguggauguuuuuuacaaacccaccgagcagguggacacgcugcugugcgauauuggggaguccucuagcaacccgaccaucgaagagggacggacacucagaauucuuaagauggucgaaccuuggcuguccagcaaacccgaguucuguaucaaggugcugaaucccuauaugccuaccgugaucgaagagcucgagaaacugcaacgcagacacggcgggucccuuguccggugcccccugucucgcaacagcacacaugaaauguacuggguuuccggagccucuggcaauauugugagcuccgugaacaccaucucuaagaugcuccugaauagauuuacaacccggcacagaaaaccuacguaugagaaggacgucgaucugggggccggaacacggagcguguccaccgaaaccgagaagccggacaugacaauuaucggccgcagacuccagcggcuucaggaggaacauaaagagacguggcacuacgaucaggaaaaccccuaccgcaccugggcuuaucacggcagcuacgaggccccuucuacaggguccgcgagcucuaugguuaauggaguggucaagcugcugaccaaacccugggacgugauuccuaugguuacacaacucgccaugaccgacacaacccccuucggccagcagagaguguuuaaggaaaaagucgauacgcggaccccgcagccuaagcuggggacacgcaugaucaugaccacaaccgcuaacuggcuuugggcccugcucggaaagaaaaagucccccagacuguguacgcgggaggaguucaucagcaaagugcgcucuaaugcugccauuggcgcgguuuuccaagaagagcagggguggacauccgccagcgaagcugugaacgacuccagauuuugggagcuggucgauaaggaacgggcccuccaucaggagggcaaaugcgagagcugcguguauaauaugaugggaaagcgcgaaaagaaacugggcgaguucgggagagcuaagggaucucgggccaucugguacauguggcuuggcgcucgcuuucuggaauucgaggcccucggguuucugaacgaagaccacugguucagcagagagaacuccuggucuggagucgagggcgaagggcuucaucggcugggcuauauucucgaggauaucgacaaaaaggauggagaccugauuuacgcggaugacaccgccggcugggauacaagaaucaccgaagacgaucugcucaaugaggagcugaucacggaacaaauggcuccucaccauaaaacccuugccaaggcuauuuuuaagcugacauaucagaacaaagugguuaaggugcuccgccccaccccuaaaggggccgucauggacaucauuagccggaaggaccagagaggauccggccagguggggacauacggacugaauaccuucacaaacauggaggugcaacuuauccgccagauggaagccgagggcguuauuacccaggaugacaugcagaaucccaaagggcugaaggaacggguggagaaauggcucaaggaguguggcgucgauagacugaagcgcauggcgaucucuggagacgauugcgugguuaaaccgcuggacgaacgguuuagcacgucccuccuguuccuuaacgauaugggcaaggugagaaaagacgucccucaaugggaucccucuaagggguggaaaaauuggcaggaggugcccuuuuguagccaccacuuccauaagauuuuuaugaaggacggacgcucccuggucgugccuugccggaaccaggaugaacucaucggcagagcucgcaucagccagggggccggauggucucugcgggagacagccugucuuggcaaagcuuacgcccaaauguggucccugauguauuuccacagacgggaccucagacuggcuagcauggccauuugcucugcgguuccgaccgaaugguuccccaccucccgcacaaccuggagcauccaugcccagcaccaguggaugacaacggaggacaugcugaagguguggaaucgggucuggauugaggauaacccuaauaugaccgacaaaacacccgugcacuccugggaagauaucccuuaccucgggaagagagaggaccugugguguggcucucuuauuggacugagcucccgcgcuaccugggccaaaaacauccauacagcuaucacccagguuagaaaucucauuggcaaggaagaguauguggauuacaugcccgucaugaagcgguauagcgccccuucugaauccgagggggugcuguga

SEQ ID NO: 21035 - RNA, 9867 nt, Artificial Sequence
  derived and/or modified CDS sequence (opt5) from DENV-4__JQ915081__SS-prME
agcaccaugacacugcucugccugauccccacggugauggccuuccaccuuuccaccagagacggcgagccucugaugauugucgcuaagcaugaacgggggcgcccgcuccuguuuaaaacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggauuguuuucuuugugcugaugaugcuugucgcccccagcuauggcaugcgcuguguggggguuggaaacagagauuucguggaaggcgucuccgggggagcguggguggaccuggugcucgagcacggcggcugcgucaccacaauggcccaggggaagccuacccuggauuuugaacugaccaagacaacggcuaaagagguugcccuccugcggaccuacuguaucgaagcuagcauuucuaauaucacaaccgccacacgcugcccgacccaaggagagcccuaucuuaaggaggaacaggaccagcaguacauuuguagacgggaugugguggaccgcggcugggggaacggaugcggccuguucgggaaaggaggcgucgugacgugcgcgaaguuucucuguuccggcaaaaucacagggaaucugguucaaauugagaaccuugaauauaccguggucgugaccguucauaauggagauacacacgccgugggcaacgacaccagcaaucacggggucacagcuacgaucaccccuagaucucccuccguggaggucaagcugccugauuacggagaacucacacuggacugcgagccccggagcggcaucgacuucaacgagaugauucugaugaagaugaaaaagaaaaccuggcucgugcauaagcagugguuucuggaucuuccgcugccuuggacagccggggcugacaccucugaaguucacuggaauuacaaagagagaauggugacguucaaggucccccaugccaaacgccaggaugugaccguucucggcucccaggaaggagccaugcacagcgcucuggcgggcgccacagagguggacuccggggauggaaaccacauguuugcuggccaucuuaaguguaagguccggauggaaaaacugagaaucaaggggaugucuuauaccaugugcagcggaaaauucuccauugacaaggagauggccgagacacaacacggcaccacgguggugaaaguuaaguacgaaggggccggcgcuccuuguaagauccccauugagauccgcgaugucaauaaagaaaagguggugggacggaucauuagcucuacacccuucgccgagaacaccaacuccgucaucaauauugagcucgaaccuccguuuggcgacagcuauaucgugauugggguuggagauucugcgcugacacugcauugguucagaaaaggcagcuccaucgggaagauguuugagucuaccuaccgcggagcuaaacggauggccauccucggcgaaaccgccugggacuucgggagcgugggcggacuguuuacaucccuuggcaaggcuguccaccagguguucgggagcguuuauacgaccauguuuggaggcgugucuuggaugauuagaauccugauuggguuccucguccuguggaucggaacaaacucccgcaauaccagcauggccaugacaugcauugcugugggcgggaucacccuguuucuuggcuucacgguucaggccgauaugggauguguggucucuuggaacggcaaggagcucaaaugcggguccggaauuuuugugguggacaauguccauacauggaccgaacaauacaaguuccagcccgagagcccugcgcggcuggccuccgcuauccugaacgcccacaaagacggcguuugugggaucagaucuaccacacgccucgagaaugugauguggaagcagauuaccaacgaacugaauuaugugcuuugggagggaggccacgaucugacagucguggcuggcgacguuaaaggggugcucacgaagggaaagcgggcccugacccccccugucaacgaucugaaauacagcuggaagacauggggcaaagcgaagaucuuuacccccgaagccagaaauuccacauuccuuauugacgggccggauaccucugagugcccuaacgaacggcgcgcuuggaauuucuuugagguggaggacuacggauucggcauguuuacgaccaacaucuggaugaaauucagagaagggagcuccgagguuugugaucaucggcucaugagcgccgcuauuaaggaccagaaagccgugcacgccgauaugggauauuggaucgaaucuuccaagaaucaaacauggcagaucgagaaggcuagccugauugaagucaaaaccugccuguggcccaagacacauacccucuggucuaacggcgugcuggagucccagaugcuuaucccuagaagcuacgcgggccccuuuucucagcacaacuaucgccaaggguacgccacacagaccgcuggaccuuggcaccugggcaaacucgagauugacuucggggaaugccccggaacgacaguuaagauccaggaggauugugaccaucggggcccgagccugagaaccaccacagccuccgggaaacuggugacccaguggugcugucgcagcugcacgaugccuccccuuagauuucucggagaagauggcuguugguauggcauggagauucggccccugucugagaaggaagagaauauggucaagucccaagugacagccgggcagggaaccagcgaaacauucuccaugggccugcucugccugacccuuuuuguggaggaaugucugcgcagacgggucacacgcaaacacaugauccucguuguggugaucaccuucugcgcuauuauccuggggggacugacguggauggaccuucucagagcccugauuaugcugggcgacaccaugucugggcggaucggaggccagauucaucucgcgaucaugacagucuuuaagaugagcccuggcuacgugcuggggguuuuccuucgcaaacugaccuccagagagacagcucucauggugaucggaauggccaugaccacggucuuuucuauuccgcacgaucugauggagcugaucgacggcauuagccuugggcugauccuccugaagauugugacacauuucgauaacacccagguuggaacacucgcccugucccuuaccuucauccggucuaccacaccccuggugauggcuuggcgcacgauuauggccgucuuuuucgugaucacccucaucccucuguguagaacaagcugccugcaaaaacagucccacugggucgaaauuaccgcgcuuauccugggcgcucaggcccuccccguguaucugaugacacucaugaagggggccagccggagaucuuggccucugaaugagggaauuauggcuguuggccuugugucccugcucggcagcgcccugcugaagaacgacgucccccuugcugggccuaugguggccggaggccugcuccuggcggccuacguuaugucuggguccagcgcugaucucucucuggaaaaagccgcuaaugugcaaugggacgagauggccgauaucaccggauccagccccauuaucgaagucaagcaggacgaggauggcuccuuuagcauccgcgacguggaggaaacgaacaugauuacacuucuggugaaacuggcccucaucaccguuucugggcuguacccgcuugcuauuccugucaccauggcgcugugguauaucuggcaggugaagacacagcggagcggagcccucugggaugugcccuccccugcugccacccaaaaagccacacugucugagggcgucuacagaauuaugcagcgcggccucuucgggaagacgcaggugggaguuggcauccacauggaagggguguuucauaccauguggcacgucacacggggaagcgugaucugucaugagaccggcagacuggaacccuccugggcugacguucgcaaugauaugauuucuuaugggggaggcuggcggcuuggcgacaagugggacaaagaggaggaugugcagguccuggccaucgaaccggggaagaacccuagacacgugcaaacaaaacccggacuguucaagacccucacgggcgagauuggggcgguuacccuggacuuuaaaccuggaacaagcggcucccccaucauuaauaagaaagggaaggugaucggccuuuacggaaacggcgucgugaccaagucuggggauuaugugagcgcuauuacacaggccgaacgcaucggagagcccgacuacgaggucgaugaagacaucuuccggaaaaagagacugaccauuauggaucuccauccuggcgccgggaaaacaaagcggauccugccguccauuguucgcgaggcucucaaaagacggcugcgcacgcuuauccuggcccccaccagagugguggcggcugaaauggaggaagcccugcggggacucccuauuagauaucagacacccgccgucaagagcgagcacaccggccgcgagaucguggaccugaugugccacgcuaccuuuacaacgcggcuucugucuuccaccagaguuccuaauuacaaccucaucgugauggaugaagcccauuucacagaccccugcagcgucgcugcccgcggguacauuucuacccggguggagaugggcgaagcggccgcuaucuuuaugacagccaccccuccgggauccauugaucccuucccucagagcaauucccccaucgaggacauugaaagagagaucccugagcgcucuuggaacacgggcuucgacuggaucacagauuaucaagggaagaccguuugguuugugcccagcauuaaagcuggaaaugacaucgccaacugucugcggaaguccggcaaaagagucauucagcucagccgcaagaccuucgauacagaauacccgaaaaccaagcugacagacugggauuuuguggucaccacggacaucucugagaugggggccaacuucagagcuggacgggugauugauccucgcagaugccuuaagcccguuauccugacagacggccccgaacgggugauucuggcggggccuauccccgugaccccugccuccgcugcccagcgcagaggccggaucggaagaaauccggcccaagaggaugaccaguaugucuuuagcggcgauccccucaaaaacgacgaagaucacgcucauuggacagaggccaagaugcugcuugacaauauuuacaccccugaggggaucauucccacgcuguucggaccugaacgcgagaaaacccaggcgaucgacggcgaauuucggcucagaggggagcagcgcaagacauucguugagcugaugcggagaggagaucugcccguguggcucucuuauaaaguggcuagcgccggcauuuccuacaaggaccgggaaugguguuuuaccggcgagcgcaacaaucaaauccuugaagagaacauggaagucgagaucuggacaagagagggggaaaagaaaaagcugcggccgaaauggcuggaugcccgcguguaugcugacccuauggcccucaaggauuucaaagaguuugcgucuggaagaaagagcaccacacuggacauucuuaccgaaaucgccacgcugcccacauaccucuccucuaaggcuaaacuggcccuggauaauauuguuaugcuccacaccaccgagaagggcgggcgggcuuaccagcacgcccuuaacgaacugccugagagccuggagacacucaugcugguggcucuucugggagccaugaccgcgggcaucuuccucuuuuucaugcaggggaaaggaauuggcaagcuguccaugggccugaucgccaucgcugucgccagcgggcuccuuuggguggcugaaauucagccccaauggaucgccgccucuauuauccuggaguucuuucugaugguccuccugauuccugaacccgagaaacagcgcacaccgcaggacaaucagcuuaucuaugugauucugacgauccucaccaucauuggacugaucgcugcgaacgaaaugggccugauugagaagacaaaaaccgauuucggguuuuaccaaguuaagacagagaccacgauccucgacguggaucuuagaccugccuccgcuuggacccuguaugccgucgccacaaccauucugacacccaugcuccggcauaccaucgaaaauaugagcgcuaaccugucccuugccgcgaucgccaaucaggcugccgugcugaugggacucggcaagggguggccccugcaccgcauggaccugggaguuccucuccuugcuaugggcugcuacucucaggugaacccgacgacacugaccgccagccuggucaugcuccugauucauuaugcgaucauuggccccgggcuucaggccaaagcuacaagagaggcccaaaagcggaccgcugccggaaucaugaaaaauccuaccguggauggcauuacagugaucgaccuggaacccaucuccuacgacccuaaguucgagaaacagcucgggcagguuaugcugcugguccucugugugggacaacuucugcugaugagaacgaccugggcucucugcgaggugcugacacuugccaccggccccauuaucacacugugggaagggaacccuggacgcuuuuggaacaccacgauugcggucucuacagccaauaucuuccggggcagcuaucucgcuggcgccgggcuggcuuuuucccugauuaagaacgcccagaccccgagacgcggaaccggcacaaccggggagacacucggagaaaaguggaaacggcagcuuaauagccuggauagaaaggaguucgaagaguacaaacgcucuggcauccuggagguugaccggacggaagccaaguccgcgcucagagaugggagcaaaauuaagcacgcugugucucgcggauccagcaagauccgguggaucguggagagaggcaugauuaaacccaagggcaaagucguggaccugggguguggacgcggcggguggucuuacuauauggccacccuuaagaacguuacagaagugaaaggauacaccaagggcgggccuggacaugaggaacccaucccuauggcuacauauggcuggaaucuggucaagcuccacagcggcguggauguuuuuuacaaacccaccgagcagguggacacgcugcugugcgauauuggggaguccucuagcaacccgaccaucgaagagggacggacacucagaauucuuaagauggucgaaccuuggcuguccagcaaacccgaguucuguaucaaggugcugaaucccuauaugccuaccgugaucgaagagcucgagaaacugcaacgcagacacggcgggucccuuguccggugcccccugucucgcaacagcacacaugaaauguacuggguuuccggagccucuggcaauauugugagcuccgugaacaccaucucuaagaugcuccugaauagauuuacaacccggcacagaaaaccuacguaugagaaggacgucgaucugggggccggaacacggagcguguccauugaaaccgagaagccggacaugaccaucauuggccgcagacuccagcggcuucaggaggaacauaaagagacauggcacuacgaucaggaaaaccccuaccgcacgugggcuuaucacggcagcuacgaggccccuucuaccggguccgcgagcucuaugguuaauggaguggucaagcugcugacaaaacccugggacgugaucccuaugguuacccaacucgccaugacagacaccacacccuucggccagcagagaguguuuaaggaaaaagucgauacccggacgccgcagccuaagcuggggacccgcaugaucaugacaaccacagcuaacuggcuuugggcccugcucggaaagaaaaagucccccagacuguguacccgggaggaguucauuagcaaagugcgcucuaaugcugccaucggcgcgguuuuccaagaagagcagggguggacguccgccagcgaagcugugaacgacuccagauuuugggagcuggucgauaaggaacgggcccuccaucaggagggcaaaugcgagagcugcguguauaauaugaugggaaagcgcgaaaagaaacugggcgaguucgggagagcuaagggaucucgggccauuugguacauguggcuuggcgcucgcuuucuggaauucgaggcccucggguuucugaacgaagaccacugguucagcagagagaacuccuggucuggagucgagggcgaagggcuucaucggcugggcuauauccucgaggauauugacaaaaaggauggagaccugaucuacgcggaugacacagccggcugggauaccagaaucacagaagacgaucugcucaaugaggagcugauuaccgaacaaauggcuccucaccauaaaacgcuugccaaggcuaucuuuaagcugaccuaucagaacaaagugguuaaggugcuccgccccacaccuaaaggggccgucauggacauuaucagccggaaggaccagagaggauccggccagguggggaccuacggacugaauacauucaccaacauggaggugcaacuuauucgccagauggaagccgagggcguuaucacacaggaugacaugcagaaucccaaagggcugaaggaacggguggagaaauggcucaaggaguguggcgucgauagacugaagcgcauggcgauuucuggagacgauugcgugguuaaaccgcuggacgaacgguuuagcaccucccuccuguuccuuaacgauaugggcaaggugagaaaagacgucccucaaugggaucccucuaagggguggaaaaauuggcaggaggugcccuuuuguagccaccacuuccauaagaucuuuaugaaggacggacgcucccuggucgugccuugccggaaccaggaugaacucaucggcagagcucgcauuagccagggggccggauggucucugcgggagacggccugucuuggcaaagcuuacgcccaaauguggucccugauguauuuccacagacgggaccucagacuggcuagcauggccaucugcucugcgguuccgacagaaugguuccccaccucccgcaccacauggagcauucaugcccagcaccaguggaugaccacagaggacaugcugaagguguggaaucgggucuggaucgaggauaacccuaauaugacggacaaaacccccgugcacuccugggaagauauuccuuaccucgggaagagagaggaccugugguguggcucucuuaucggacugagcucccgcgcuacaugggccaaaaacauccauaccgcuauuacacagguuagaaaucucaucggcaaggaagaguauguggauuacaugcccgucaugaagcgguauagcgccccuucugaauccgagggggugcuguga

SEQ ID NO: 21036 - RNA, 9867 nt, Artificial Sequence
  derived and/or modified CDS sequence (opt5) from DENV-4__JQ915084__SS-prME
agcaccaugacacugcucugccugauccccacggugauggccuuccaccuuuccaccagagacggcgagccucugaugauugucgcuaagcaugaacgggggcgcccgcuccuguuuaaaacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggauuguuuucuuugugcugaugaugcuugucgcccccagcuauggcaugcgcuguguggggguuggaaacagagauuucguggaaggcgucuccgggggagcguggguggaccuggugcucgagcacggcggcugcgucaccacaauggcccaggggaagccuacccuggauuuugaacugaccaagacaacggcuaaagagguugcccuccugcggaccuacuguaucgaagcuagcauuucuaauaucacaaccgccacacgcugcccgacccaaggagagcccuaucuuaaggaggaacaggaccagcaguacauuuguagacgggaugugguggaccgcggcugggggaacggaugcggccuguucgggaaaggaggcgucgugacgugcgcgaaguuucucuguuccggcaaaaucacagggaaucugguucaaauugagaaccuugaauauaccguggucgugaccguucauaauggagauacacacgccgugggcaacgacaccagcaaucacggggucacagcuacgaucaccccuagaucucccuccguggaggucaagcugccugauuacggagaacucacacuggacugcgagccccggagcggcaucgacuucaacgagaugauucugaugaagaugaaaaagaaaaccuggcucgugcauaagcagugguuucuggaucuuccgcugccuuggacagccggggcugacaccucugaaguucacuggaauuacaaagagagaauggugacguucaaggucccccaugccaaacgccaggaugugaccguucucggcucccaggaaggagccaugcacagcgcucuggcgggcgccacagagguggacuccggggauggaaaccacauguuugcuggccaucuuaaguguaagguccggauggaaaaacugagaaucaaggggaugucuuauaccaugugcagcggaaaauucuccauugacaaggagauggccgagacacaacacggcaccacgguggugaaaguuaaguacgaaggggccggcgcuccuuguaagauccccauugagauccgcgaugucaauaaagaaaagguggugggacggaucauuagcucuacacccuucgccgagaacaccaacuccgucaucaauauugagcucgaaccuccguuuggcgacagcuauaucgugauugggguuggagauucugcgcugacacugcauugguucagaaaaggcagcuccaucgggaagauguuugagucuaccuaccgcggagcuaaacggauggccauccucggcgaaaccgccugggacuucgggagcgugggcggacuguuuacaucccuuggcaaggcuguccaccagguguucgggagcguuuauacgaccauguuuggaggcgugucuuggaugauuagaauccugauuggguuccucguccuguggaucggaacaaacucccgcaauaccagcauggccaugacaugcauugcugugggcgggaucacccuguuucuuggcuucacgguucaggccgauaugggauguguggucucuuggaacggcaaggagcucaaaugcggguccggaauuuuugugguggacaauguccauacauggaccgaacaauacaaguuccagcccgagagcccugcgcggcuggccuccgcuauccugaacgcccacaaagacggcguuugugggaucagaucuaccacacgccucgagaaugugauguggaagcagauuaccaacgaacugaauuaugugcuuugggagggaggccacgaucugacagucguggcuggcgacguuaaaggggugcucacgaagggaaagcgggcccugacccccccugucaacgaucugaaauacagcuggaagacauggggcaaagcgaagaucuuuacccccgaagccagaaauuccacauuccuuauugacgggccggauaccucugagugcccuaacgaacggcgcgcuuggaauuucuuugagguggaggacuacggauucggcauguuuacgaccaacaucuggaugaaauucagagaagggagcuccgagguuugugaucaucggcucaugagcgccgcuauuaaggaccagaaagccgugcacgccgauaugggauauuggaucgaaucuuccaagaaucaaacauggcagaucgagaaggcuagccugauugaagucaaaaccugccuguggcccaagacacauacccucuggucuaacggcgugcuggagucccagaugcuuaucccuagaagcuacgcgggccccuuuucucagcacaacuaucgccaaggguacgccacacagaccgcuggaccuuggcaccugggcaaacucgagauugacuucggggaaugccccggaacgacaguuaagauccaggaggauugugaccaucggggcccgagccugagaaccaccacagccuccgggaaacuggugacccaguggugcugucgcagcugcacgaugccuccccuuagauuucucggagaagauggcuguugguauggcauggagauucggccccugucugagaaggaagagaauauggucaagucccaagugacagccgggcagggaaccagcgaaacauucuccaugggccugcucugccugacccuuuuuguggaggaaugucugcgcagacgggucacacgcaaacacaugauccucguuguggugaucaccuucugcgcuauuauccuggggggacugacguggauggaccuucucagagcccugauuaugcugggcgacaccaugucugggcggaucggaggccagauucaucucgcgaucaugacagucuuuaagaugagcccuggcuacgugcuggggguuuuccuucgcaaacugaccuccagagagacagcucucauggugaucggaauggccaugaccacggucuuuucuauuccgcacgaucugauggagcugaucgacggcauuagccuugggcugauccuccugaagauugugacacauuucgauaacacccagguuggaacacucgcccugucccuuaccuucaugcggucuaccacaccccuggugauggcuuggcgcacgaucauggccgucuuuuucgugauuacccucaucccucuguguagaacaagcugccugcaaaaacagucccacugggucgaaaucaccgcgcuuauucugggcgcucaggcccuccccguguaucugaugacacucaugaagggggccagccggagaucuuggccucugaaugagggaaucauggcuguuggccuugugucccugcucggcagcgcccugcugaagaacgacgucccccuugcugggccuaugguggccggaggccugcuccuggcggccuacguuaugucuggguccagcgcugaucucucucuggaaaaagccgcuaaugugcaaugggacgagauggccgauauuaccggauccagccccaucauugaagucaagcaggacgaggauggcuccuuuagcauccgcgacguggaggaaacgaacaugaucacacuucuggugaaacuggcccucauuaccguuucugggcuguacccgcuugcuaucccugucaccauggcgcugugguauauuuggcaggugaagacacagcggagcggagcccucugggaugugcccuccccugcugccacccaaaaagccacacugucugagggcgucuacagaaucaugcagcgcggccucuucgggaagacgcaggugggaguuggcauucacauggaagggguguuucauaccauguggcacgucacacggggaagcgugaucugucaugagaccggcagacuggaacccuccugggcugacguucgcaaugauaugaucucuuaugggggaggcuggcggcuuggcgacaagugggacaaagaggaggaugugcagguccuggccauugaaccggggaagaacccuagacacgugcaaacaaaacccggacuguucaagacccucacgggcgagaucggggcgguuacccuggacuuuaaaccuggaacaagcggcucccccauuaucaauaagaaagggaaggugauuggccuuuacggaaacggcgucgugaccaagucuggggauuaugugagcgcuaucacacaggccgaacgcauuggagagcccgacuacgaggucgaugaagacaucuuccggaaaaagagacugaccaucauggaucuccauccuggcgccgggaaaacaaagcggauucugccguccaucguucgcgaggcucucaaaagacggcugcgcacgcuuauucuggcccccaccagagugguggcggcugaaauggaggaagcccugcggggacucccuaucagauaucagacacccgccgucaagagcgagcacaccggccgcgagauuguggaccugaugugccacgcuaccuuuacaacgcggcuucugucuuccaccagaguuccuaauuacaaccucaucgugauggaugaagcccauuucacagaccccugcagcgucgcugcccgcggguacaucucuacccggguggagaugggcgaagcggccgcuauuuuuaugacagccaccccuccgggauccaucgaucccuucccucagagcaauucccccauugaggacaucgaaagagagauuccugagcgcucuuggaacacgggcuucgacuggaucacagauuaucaagggaagaccguuugguuugugcccagcaucaaagcuggaaaugacauugccaacugucugcggaaguccggcaaaagagucauccagcucagccgcaagaccuucgauacagaauacccgaaaaccaagcugacagacugggauuuuguggucaccacggacauuucugagaugggggccaacuucagagcuggacgggugaucgauccucgcagaugccuuaagcccguuauucugacagacggccccgaacgggugauccuggcggggccuauucccgugaccccugccuccgcugcccagcgcagaggccggaucggaagaaauccggcccaagaggaugaccaguaugucuuuagcggcgauccccucaaaaacgacgaagaucacgcucauuggacagaggccaagaugcugcuugacaauaucuacaccccugaggggauuauccccacgcuguucggaccugaacgcgagaaaacccaggcgauugacggcgaauuucggcucagaggggagcagcgcaagacauucguugagcugaugcggagaggagaucugcccguguggcucucuuauaaaguggcuagcgccggcaucuccuacaaggaccgggaaugguguuuuaccggcgagcgcaacaaucaaauucuugaagagaacauggaagucgagaucuggacaagagagggggaaaagaaaaagcugcggccgaaauggcuggaugcccgcguguaugcugacccuauggcccucaaggauuucaaagaguuugcgucuggaagaaagagcaccacacuggacauccuuaccgaaauugccacgcugcccacauaccucuccucuaaggcuaaacuggcccuggauaauaucguuaugcuccacaccaccgagaagggcgggcgggcuuaccagcacgcccuuaacgaacugccugagagccuggagacacucaugcugguggcucuucugggagccaugaccgcgggcauuuuccucuuuuucaugcaggggaaaggaaucggcaagcuguccaugggccugauugccaucgcugucgccagcgggcuccuuuggguggcugaaauccagccccaauggauugccgccucuaucauucuggaguucuuucugaugguccuccugaucccugaacccgagaaacagcgcacaccgcaggacaaucagcuuauuuaugugauccugacgauucucgcuaucaucggacugauugcggccaacgaaaugggccugaucgagaagaccaaaacagauuucggguuuuaccaaguuaagaccgagacaaccauucucgacguggaucuuagaccugcuuccgccuggacgcuguaugccgucgcuaccacaauccugacccccaugcuccggcauacaauugaaaauaccagcgccaaccugucccuugcggccaucgcuaaucaggccgcugugcugaugggacucggcaagggguggccccugcaccgcauggaccugggaguuccucuccuugccaugggcugcuacucucaggugaacccgacgacacugaccgcgagccuggucaugcuccugauccauuaugccauuaucggccccgggcuucaggcuaaagccacaagagaggcucaaaagcggaccgccgcuggaauuaugaaaaauccuaccguggauggcaucacagugauugaccuggaacccaucuccuacgacccuaaguucgagaaacagcucgggcagguuaugcugcugguccucugugugggacaacuucugcugaugagaacgaccugggcccucugcgaggugcugacacuugcgaccggccccaucaugacacugugggaagggaacccuggacgcuuuuggaacaccacgauugccgucucuacagcuaauaucuuccggggcagcuaucucgccggcgcugggcuggccuuuucccugauuaagaacgcccagaccccgagacgcggaaccggcacaaccggggagacacucggagaaaaguggaaacggcagcuuaauagccuggauagaaaggaguucgaagaguacaaacgcucuggcauccuggagguugaccggacggaagcgaaguccgcucucagagaugggagcaaaauuaagcacgccgugucucgcggauccagcaagauccgguggauuguggagagaggcaugaucaaacccaagggcaaagucguggaccugggguguggacgcggcggguggucuuacuauauggcuacccuuaagaacguuacagaagugaaaggauacaccaagggcgggccuggacaugaggaacccaucccuauggccacauauggcuggaaucuggucaagcuccacagcggcguggauguuuuuuacaaacccaccgagcagguggacacgcugcugugcgauauuggggaguccucuagcaacccgaccaucgaagagggacggacacucagaauucuuaagauggucgaaccuuggcuguccagcaaacccgaguucuguaucaaggugcugaaucccuauaugccuaccgugauugaagagcucgagaaacugcaacgcagacacggcgggucccuuguccggugcccccugucucgcaacagcacacaugaaauguacuggguuuccggagccucuggcaauaucgugagcuccgugaacaccaucucuaagaugcuccugaauagauuuacaacccggcacagaaaaccuacguaugagaaggacgucgaucugggggcuggaacacggagcguguccaccgaaaccgagaagccggacaugacaauuaucggccgcagacuccagcggcuucaggaggaacauaaagagacguggcacuacgaucaggaaaaccccuaccgcaccugggccuaucacggcagcuacgaggcgccuucuacaggguccgccagcucuaugguuaauggaguggucaagcugcugaccaaacccugggacgugauuccuaugguuacacaacucgcuaugaccgacacaacccccuucggccagcagagaguguuuaaggaaaaagucgauacgcggaccccgcagccuaagaucgggacacgcaugauuaugaccacaaccgccaacuggcugugggcucuucugggaaagaaaaagucccccagacucuguacgcgggaggaguucaucagcaaagugcgcucuaaugccgcgaucggcgccguuuuccaagaagagcagggguggacauccgcuagcgaagccgugaacgacuccagauuuugggagcuggucgauaaggaacgggcucugcaucaggagggcaaaugcgagagcugcguguauaauaugaugggaaagcgcgaaaagaaacucggcgaguucgggagagccaagggaucucgggcuauuugguacauguggcugggcgcccgcuuucuugaauucgaggcgcugggguuucucaacgaagaccacugguucagcagagagaacuccuggucuggagucgagggcgaagggcugcaucggcuuggcuauauccuggaggauauugacaaaaaggauggagaccucaucuacgccgaugacaccgcuggcugggauacaagaauuaccgaagacgaucugcugaaugaggagcucaucacggaacaaauggccccucaccauaaaacccuggcuaaggccaucuuuaagcuuacauaucagaacaaagugguuaaggugcugcgccccaccccuaaaggggccgucauggacauuaucagccggaaggaccagagaggauccggccagguggggacauacggacucaauaccuucacaaacauggaggugcaacugauucgccagauggaagcggagggcguuaucacccaggaugacaugcagaaucccaaagggcuuaaggaacggguggagaaauggcugaaggaguguggcgucgauagacucaagcgcauggcuauuucuggagacgauugcgugguuaaaccgcuggacgaacgguuuagcacgucccugcucuuccugaacgauaugggcaaggugagaaaagacgucccucaaugggagcccucuaagggguggaaaaauuggcaggaagugcccuuuuguagccaccacuuccauaagaucuuuaugaaggauggacgcucccuugucgugccuugccggaaccaggacgagcugauuggcagagcccgcaucagccagggggccggauggucucuccgggaaacagcuugucugggcaaagccuacgcucaaauguggucccuuauguauuuccacagacgggaucugagacucgccagcauggcgaucugcucugccguuccgaccgagugguuccccaccucccgcacaaccuggagcauucaugcucagcaccaguggaugacaacggaggacaugcugaagguguggaaucgggucuggaucgaagacaacccuaauaugaccgauaaaacacccgugcacuccugggaggacauuccuuaccuggggaagagagaagaucucugguguggcucucugaucggacuuagcucccgcgccaccugggcuaaaaacauucauacagccaucacccagguuagaaaucugaucggcaaggaggaauauguggacuacaugcccgucaugaagcgguauagcucuccuuccgagagcgagggggugcucuga

SEQ ID NO: 21037 - RNA, 9867 nt, Artificial Sequence
  derived and/or modified CDS sequence (opt5) from DENV-4__KM190936__SS-prME
agcaccaucacacugcucugccugauucccacggugauggccuucucccuuucuaccagagacggcgagccucugaugaucgucgcuaagcacgaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgagcaccugggugauguaugggacaugcacccaguccggagagagacggcgcgaaaagagaucugucgcgcucacaccccauagcggcauggggcuggagacccgggcugaaacguggauguccucugagggagccuggaaacacgcccaacgcguggagagcuggauccuuagaaauccuggcuucgcucugcucgccggcuuuauggcuuacaugaucgggcagacaggaauucagcggaccguuuucuuugugcugaugaugcuugucgcccccuccuauggcaugcgcuguguggggguuggaaacagagauuucguggaaggcgucagcgggggagcguggguggaccuggugcucgagcauggcggcugcgucacaaccauggcccaggggaagccuacccuggauuuugaacugacaaagacgaccgcuaaagagguugcccuccugcggacauacuguaucgaagcuucuauuuccaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuagcuguucuggcaaaaucaccgggaaucucguucaaauugagaaccuggaauauaccguggucgugacaguucacaauggagauacccaugccgugggcaacgacacauccaaucacggggucacggcuaugaucaccccuagaagccccucuguggaggucaagcuuccugauuacggagaacugacacucgacugcgagccccgguccggcaucgacuucaacgagaugauucugaugaagaugaaaaagaaaaccuggcuggugcacaagcagugguuucucgaucugccgcuuccuuggacagccggggcugacaccagcgaaguucauuggaauuacaaagagagaauggugacguucaaggucccccacgccaaacgccaggaugugaccguucugggcucccaggaaggagccaugcauucugcucucgcgggcgccacagagguggacagcggggauggaaaccacauguuugcuggccaccugaaguguaagguccggauggaaaaacuuagaaucaaggggauguccuauaccaugugcagcggaaaauucucuauugacaaggagauggccgagacacaacauggcaccacgguggugaaaguuaaguacgaaggggccggcgcuccuuguaagguccccaucgagauucgcgaugugaauaaagaaaagguggucggacggaucaucuccagcacaccccuggccgagaacaccaacucugugacaaauauugagcucgaaccuccguucggcgacagcuauaucguuauuggggugggaaacuccgcgcugacccugcacugguuuagaaaaggcucuagcaucgggaagauguucgaguccaccuaccgcggagcuaaacggauggccauucucggcgaaacagccugggauuuugggagcgucggcggacuguucacgucucuuggcaaggcugugcaucagguuuuuggguccguguauaccacaauguucggaggcgucagcuggaugaucagaauccugauuggguuucucgugcuguggaucggaaccaauucucgcaacacauccauggccaugaccugcauugcuguuggcgggaucacgcuguuccuuggcuuuacagugcaggccgacaugggaugugucgugagcugguccggcaaggagcucaaaugcgggucuggaauuuucguggucgauaauguucacaccuggaccgaacaauacaaguuucagcccgagagcccugcgcggcuggccuccgcuauccugaacgcccauaaagacggcgugugugggauuagaucuacaacccgccucgagaaugugauguggaagcagaucacaaacgaacugaauuauguccuuugggagggaggccacgaccugacggugguugcuggcgaugugaaagggguccucaccaagggaaagcgggcccugacacccccugugagcgaccugaaauacuccuggaagaccuggggcaaagcgaagaucuucacacccgaagccagaaacagcaccuuucuuauugaugggccggacacgucugagugcccuaaugaacggcgcgcuuggaacucccucgagguugaggauuacggauucggcauguucaccacaaauaucuggaugaaauuuagagaagggagcucugaggugugugaccaccggcugauguccgccgcuauuaaggaucagaaagccguccaugccgacaugggauauuggaucgaaagcucuaagaaccaaaccuggcagauugagaaggcuagccugaucgaagugaaaacaugccucuggcccaagacccacacacugugguccaauggcguucuugagagccagaugcugaucccuaaaucuuacgcgggccccuucucccagcauaacuauagacaaggguacgccacccagacggugggaccuuggcaccucggcaagcuggagauugauuuuggggaaugccccggaacaaccgucaccauccaggaggacugugaucaccgcggcccgagccugcggacaaccacggcuuccgggaaacuugugacacaguggugcuguagaucuugcaccaugccuccccuccgcuuccugggagaagacggcuguugguauggcauggagauuagaccccugagcgagaaggaagagaacauggugaagucccaagucacagccgggcagggaaccucugaaacauuuagcaugggccuccugugccuuacccuguucguugaggaaugucuccggcgcagagugacgcggaaacauaugauccugguggucgugauuacccugugcgccaucauccuugggggacucacauggauggaucugcugcgcgcucucauuaugcugggcgacaccauguccgggagaaucggaggccagauucaccuugccaucauggcgguuuuuaagaugucuccuggcuacgugcugggggucuuccuccggaaacugacaagccgcgagaccgcucugauggugauuggaauggccaugacgacaguucuuuccaucccgcaugaccugauggagcucaucgauggcauuagccuggggcucauccugcuuaagauugugacccaguuugacaauacacaagucggaacccuggcccucucucugaccuucaucagauccacaaugccccuggugauggcuuggcggacgauuauggccguccuuuuugugguuacccugaucccucucugucgcacaagcugccugcagaaacagucucacuggguggaaauuaccgcgcucauccugggcgcucaagcccuucccgucuaucugaugacacucaugaagggggccuccagacggagcuggccucugaacgagggaaucauggcugugggccugguuucucuucugggcuccgcccuccugaagaaugaugugccccucgcugggccuauggucgccggaggccugcuucuggcggccuacgugaugagcggguccagcgcugaccugucucucgaaaaagccgcuaacgugcagugggaugagauggccgacauuaccggaagcucccccaucauugaaguuaagcaggaugaggacggcucuuucagcaucagagaugucgaggaaacgaauaugauuacacugcuugugaaacuggcccucaucaccguguccgggcuguacccgcucgcuaucccugucaccaugacacugugguauauguggcaggugaagacccaacgcucuggagcgcuuugggacguucccagcccugccgcuacacagaaagccgcccuguccgagggcguguaccggauuaugcagagaggccuguuugggaagacgcaggucggagugggcauccauauggaagggguuuuccacaccauguggcacgugacacgcggaucugucauuugucaugagaccggccggcucgaacccagcugggcugaugugagaaacgacaugaucuccuaugggggaggcuggcgccugggcgauaagugggacaaagaggaggacguucaagugcuugccauugaaccggggaagaauccuaaacacguccagacaaagcccggacuguucaaaacccucacgggcgagaucggggcggugacccuggauuuuaagccuggaacaagcggcucucccaucauuaaccggaaagggaaggugaucggccucuacggaaauggcgucguuaccaaguccggggacuaugugagcgcuauuacacaggccgaaagaaucggagagcccgauuacgagguggacgaagauauuuuccgcaaaaagcggcugaccaucauggaccuucauccuggcgccgggaaaacaaagagaauucugccgucuaucguccgggaggcucugaaacgcagacuccggacgcugauccuugcccccacccgcgugguugcggcugaaauggaggaagcccugagaggacucccuauucgguaucagacacccgccgugaaguccgagcacaccggcagagagaucgucgaucugaugugccaugcuaccuuuacaacgcgccuccugagcuccacccgggugccuaacuacaaucuuauuguuauggacgaagcccacuucacagaucccucuagcguggcugccagaggguacaucuccacccgcgucgagaugggcgaagcggccgcuauuuuuaugacagccaccccuccgggagcuacggaccccuucccucaaagcaacucucccaucgaggauaucgaacgggagauuccugagagauccuggaauacaggcuuugacuggaucaccgacuaucaggggaagaccgugugguucguccccagcauuaaagccggaaacgauaucgccaauugccugcgcaagucuggcaaaaaggugauucagcugagccggaaaacauuugacaccgaauacccgaagacaaagcucaccgauugggacuucguugugacgacagauaucuccgagaugggggcuaacuuuagagcgggacgcgugaucgacccuagacggugucugaaacccgucauucuuaccgauggccccgaacgcguuauccuggccgggccuauucccgugacaccugcuucugccgcccaaagacggggccgcaucggaagaaacccggcucaggaggacgaucaguauguguucagcggcgacccccucaagaaugaugaagaccacgcccauuggaccgaggcgaaaaugcugcuggauaacauuuacacgccugaggggaucauucccacccucuucggaccugaacgggagaagacacaggcuaucgacggcgaauuuagacuucgcggggagcaacggaaaaccuucgucgagcugaugagacgcggagaccugcccguguggcucuccuauaagguugccucugccggcaucagcuacaaggaucgggaauggugcuuuacaggcgagagaaauaaccagauucuggaagagaauauggaaguggagaucuggacccgggagggggaaaaaaagaaacuucgcccgagauggcuggacgcucgggucuaugccgauccuauggcgcucaaggacuucaaagaguuugccuccggacgcaagagcauuacacuggauauccugaccgaaauugcuucucuccccacguaccuuuccagcagagccaagcuggcucuggacaacaucgugaugcuccacacaaccgagcggggcgggcgcgccuaccagcaugcucugaaugaacuuccugagucccuggagacccucaugcuggucgcccugcucggagcgaugacagccggcaucuuccuuuuuuucaugcaggggaaaggaauuggcaagcugucuaugggccugaucaccauugcuguggccagcgggcuccuguggguugcugaaauccaaccccaguggauugccgccuccaucauccuugaguuuuuccugauggugcuccugauuccugaacccgagaaacagagaacaccgcaggauaaccaacugaucuaugucauucucacgauccuuaccauuaucggacugauugcugcgaaugaaaugggccugaucgagaagacaaaaaccgacuuuggguucuaccaggugaagacagagaccacgauccucgauguugaccugcggccugccucugcuuggacccuuuaugccguggccacaaccauucugacacccaugcuccgccacaccaucgaaaacacgagcgcuaaucugucccuggccgcgauugccaaccaggcugccguccucaugggacuuggcaaaggguggccccugcacagaauggaucugggagugccucuccuggcuaugggcuguuacagccaggugaauccgacaacccuuacagccucucugguuaugcuccugguccauuaugcgaucauuggccccgggcugcaagccaaggcuacccgggaggcccagaagagaaccgcugccggaaucaugaaaaacccuacaguggacggcaucacggugauugaucucgaacccaucuccuacgacccuaaguuugagaaacagcuugggcaagucaugcugcugguucucugcgcuggacagcugcuucugaugcgcaccacaugggccuucugugaggugcucacccuggcgacaggccccauucugacccucugggaagggaauccuggacgguucuggaacacgacaaucgccgugagcaccgcuaacauuuuuagaggcucuuaucuugccggcgcugggcuggccuucucccugaucaagaaugcccagaccccgcgccggggaacaggcaccacaggggagacgcucggagaaaaauggaagagacagcugaacagccuugaccgcaaggaguuugaagaguacaaacggucuggcauccuggaggucgauagaaccgaagcgaagagcgcucucaaagacggguccaagauuaaacacgccgugucucgcggaagcuccaagauccgguggauuguugagagaggcauggugaagcccaaaggcaaggucguggaucuggggugcggacgcggcggguggagcuacuauauggcuacacugaaaaauguuaccgaagugaagggauacacaaaaggcgggccuggacaugaggaacccaucccuauggccaccuauggcuggaaccucgucaagcuucacuccggcguggacguguucuacaagcccacggagcaagucgauacccugcugugugacauuggggagucuagcuccaauccgacaaucgaagagggacggacccucagaguucugaaaaugguggaaccuuggcuuucuagcaagcccgaguuuugcauuaaagugcugaaccccuauaugccuacagucaucgaagagcucgagaagcugcagcgcaaacauggcgggaaucuggugagauguccccucucccggaacucuacccacgaaauguacuggguuagcggagccuccggcaauaucgugagcucugucaacacaaccuccaagaugcuucugaaucgcuucacgacaagacaccggaaaccuaccuaugagaaggauguggaccugggggcuggaaccagaagcguuucuacagaaacggagaagccggauaugaccauuaucggccggcgccuccagagacugcaggaggaacauaaagagacauggcacuacgaccaagaaaaccccuaccggaccugggccuaucauggcuccuacgaggcgccuagcacagggucugccuccagcauggugaauggagucgugaagcuucugaccaaacccugggauguuauuccuauggugacacagcucgcuaugaccgacacgacccccuuuggccagcagcgcgucuucaaggaaaaaguggacacaagaaccccgcaaccuaagcccgggacacggauggucaugaccacgacagccaacuggcugugggcucugcucggaaagaaaaagaauccucgccugugcaccagagaggaguuuaucuccaaagugcggagcaacgccgcgauuggcgccguuuuccaggaagagcagggguggacaucugcuagcgaagccgugaaugauucccgcuuuugggagcuugucgacaaggaaagagcucugcaccaagagggcaaaugugagucuugcguguauaacaugaugggaaagcgggaaaagaaacucggcgaguucgggcgcgccaagggaagcagagcuaucugguacauguggcugggcgcccgguuucuugaauucgaggcgcugggguuccucaacgaagaucacugguuuggacgcgagaauuccuggucuggcguggagggggaaggccugcauagacugggauauauccucgaggaaauugacaaaaaggauggcgaccugauguacgccgaugacaccgcugggugggauacgcggaucaccgaggacgaucuucagaacgaggaacugauuacagagcagauggccccccaccauaaaauccucgcuaaggccauuuucaagcugaccuaucagaauaaaguugugaagguccuuagaccuacaccccgcggagccgugauggacaucaucagccggaaagaucaaagaggcuccgggcagguuggaaccuacggccugaacacauuuaccaauauggaagugcagcucauucgccagauggaggcggaaggggucaucacgcaagacgacaugcagaacccgaagggccugaaagagcggguggagaaguggcugaaagaaugcggagucgauagacucaagcgcauggcuauuucuggcgacgauugugugguuaagccucuggacgagcgguucgggacaagccuucuguuucucaaugauaugggaaaagugagaaaggacaucccccagugggaacccuccaaaggcuggaagaacuggcaggaggucccuuucugcagccaccauuuucacaaaauuuucaugaaggaugggcgcucucuggugguuccgugucggaaucaagacgaacuuaucggaagagcccgcaucucccagggcgccggguggagccugcgggagaccgcuugccucggcaaggccuacgcucagauguggucucugauguauuuucacagacgggaucugagacucgccuccauggcgauuuguagcgccgugcccaccgagugguucccuacaucccgcaccacauggucuauccaugcucaccaucaguggaugacgaccgaagacaugcugaaagucuggaaccggguguggauugaggauaaucccaacaugacagacaagaccccugugcacagcugggaagacauccccuaccuuggaaaaagagaggaucuguggugcggcucccucauugggcugagcucucgcgccacaugggcuaagaauauccacaccgccauuacgcaaguuagaaaccuuaucggaaaagaagaguaugucgacuacaugccugugaugaagcgguauuccgcgcccagcgagucugaaggcgugcuguga

SEQ ID NO: 21038 - RNA, 9867 nt, Artificial Sequence
  derived and/or modified CDS sequence (opt5) from DENV-4__JQ915090__SS-prME
agcaccaugacacugcucugccugauccccacggugauggccuuccaccuuuccaccagagacggcgagccucugaugauugucgcuaagcaugaacgggggcgcccgcuccuguuuaaaacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggauuguuuucuuugugcugaugaugcuugucgcccccagcuauggcaugcgcuguguggggguuggaaacagagauuucguggaaggcgucuccgggggagcguggguggaccuggugcucgagcacggcggcugcgucaccacaauggcccaggggaagccuacccuggauuuugaacuggcuaagaccacagccaaagagguugcucuccugcggacguacuguaucgaagccagcauuucuaauaucaccacagcgacccgcugcccgacacaaggagagcccuaucuuaaggaggaacaggaccagcaguacauuuguagacgggaugugguggaccgcggcugggggaacggaugcggccuguucgggaaaggaggcgucgugaccugcgccaaguuucucuguuccggcaaaaucacggggaaucugguucaaauugagaaccuugaauauacaguggucgugaccguucauaauggagauacccacgcugugggcaacgacacaagcaaucacggggucaccgccacaaucacgccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccgcuggggccgacacaucugaaguucacuggaauuacaaagagagaauggugaccuucaaggucccccaugccaaacgccaggaugugacgguucucggcucccaggaaggagcuaugcacagcgcgcuggccggcgcuaccgagguggacuccggggauggaaaccacauguuugccggccaucuuaaguguaagguccggauggaaaaacugagaaucaaggggaugucuuauacaaugugcagcggaaaauucuccauugacaaggagauggccgagacccaacacggcacaaccguggugaaaguuaaguacgaaggggcuggcgccccuuguaagauccccauugagauccgcgaugucaauaaagaaaagguggugggacggaucauuagcucuacgcccuucgcggagaacacaaacuccgucaucaauauugagcucgaaccuccguuuggcgacagcuauaucgugauugggguuggagauucugcucugacccugcauugguucagaaaaggcagcuccaucgggaagauguuugagucuacauaccgcggagccaaacggauggccauccucggcgaaaccgcuugggacuucgggagcgugggcggacuguuuaccucccuuggcaaggccguccaccagguguucgggagcguuuauacaacgauguuuggaggcgugucuuggaugauuagaauccugauuggguuccucguccuguggaucggaaccaacucccgcaauacaagcauggcuaugaccugcauugccgugggcgggaucacacuguuucuuggcuucaccguucaggcggauaugggauguguggucucuuggaacggcaaggagcucaaaugcggguccggaauuuuugugguggacaauguccauacguggacagaacaauacaaguuccagcccgagagcccugcccggcuggcuuccgccauccugaacgcucacaaagacggcguuugugggaucagaucuaccacccgccucgagaaugugauguggaagcagauuacaaacgaacugaauuaugugcuuugggagggaggccacgaucugaccgucguggccggcgacguuaaaggggugcucacaaagggaaagcgggcgcugacgcccccugucaacgaucugaaauacagcuggaagaccuggggcaaagccaagaucuuuacacccgaagcuagaaauuccaccuuccuuauugacgggccggauacaucugagugcccuaacgaacggcgcgccuggaauuucuuugagguggaggacuacggauucggcauguuuaccacgaacaucuggaugaaauucagagaagggagcuccgagguuugugaucaucggcucaugagcgcugccauuaaggaccagaaagccgugcacgcugauaugggauauuggaucgaaucuuccaagaaucaaaccuggcagaucgagaaggcgagccugauugaagucaaaacaugccuguggcccaagacccauacacucuggucuaacggcgugcuggagucccagaugcuuaucccuagaagcuacgccggccccuuuucucagcacaacuaucgccaaggguacgcuacccagacagccggaccuuggcaccugggcaaacucgagauugacuucggggaaugccccggaaccacgguuaagauccaggaggauugugaccaucggggcccgagccugagaacaaccaccgccuccgggaaacuggugacacaguggugcugucgcagcugcaccaugccuccccuuagauuucucggagaagauggcuguugguauggcauggagauucggccccugucugagaaggaagagaauauggucaagucccaagugacggcugggcagggaacaagcgaaaccuucuccaugggccugcucugccugacacuuuuuguggaggaaugucugcgcagacgggucacccgcaaacacaugauccucguuguggugaucacauucugcgccauuauccuggggggacugaccuggauggaccuucucagagcgcugauuaugcugggcgacacgaugucugggcggaucggaggccagauucaucucgcuaucaugaccgucuuuaagaugagcccuggcuacgugcuggggguuuuccuucgcaaacugacauccagagagaccgcccucauggugaucggaauggccaugacaaccgucuuuucuauuccgcacgaucugauggagcugaucgacggcauuagccuugggcugauccuccugaagauugugacgcauuucgauaacacacagguuggaacccucgcucugucccuuacauucaugcggucuaccaccccccuggugauggccuggcgcacaaucauggcggucuuuuucgugauuacgcucaucccucuguguagaaccagcugccugcaaaaacagucccacugggucgaaaugacagcucuuauccugggcgcccaggcccuccccguguaucugaugacccucaugaagggggcuagccggagaucuuggccucugaaugagggaauuauggccguuggccuugugucccugcucggcagcgcucugcugaagaacgacgucccccuugccgggccuaugguggcgggaggccugcuccuggccgcuuacguuaugucuggguccagcgccgaucucucucuggaaaaagcugccaaugugcaaugggacgagauggccgauaucacaggauccagccccauuaucgaagucaagcaggacgaggauggcuccuuuagcauucgcgacguggaggaaaccaacaugaucacgcuucuggugaaacuggcucucaucacaguuucugggcuguacccgcuugcgauuccugucaccauggcccugugguauaucuggcaggugaagacccagcggagcggagcucucugggaugugcccuccccugccgccacacaaaaagcuacccugucugagggcgucuacagaauuaugcagcgcggccucuucgggaagacacaggugggaguuggcauccacauggaagggguguuucauacgauguggcacgucacccggggaagcgugauuugucaugagacaggcagacuggaacccuccugggccgacguucgcucugauaugaucagcuaugggggaggcuggcggcuuggcgacaagugggacaaagaggaggaugugcagguccuggcgaucgaaccggggaagaauccuagacacgugcaaaccaaacccggacuguucaagacacucaccggcgagauuggggcuguuacgcuggacuuuaaaccuggaaccuccggcucucccaucauuaacaagaaagggaaggugaucggccuuuacggaaauggcgucgugacaaagagcggggauuauguguccgccauuacccaggccgaacgcaucggagagcccgacuacgaggucgaugaagacauuuuccggaaaaagagacugacaaucauggaucuccauccuggcgcugggaaaaccaagcggauccugccgagcauuguucgcgaggcccucaaaagacggcugcgcacacuuauccuggcgcccacgagagugguggcugccgaaauggaggaagcccugcggggacucccuauuagauaucagacccccgcugucaagucugagcacacaggccgcgagaucguggaccugaugugccacgccaccuuuaccacacggcuucuguccagcacgagaguuccuaacuacaaucucauugugauggaugaagcucauuucaccgaccccugcucugucgccgcgcgcggguacaucuccacacggguggagaugggcgaagccgcugccaucuuuaugaccgcuacaccuccgggaagcauugaucccuucccucaguccaacucucccaucgaggacauugaaagagagaucccugagcgcagcuggaauaccggcuucgacuggauuacggauuaucaagggaagacaguuugguuugugcccuccaucaaagccggaaacgacaucgccaauugucugcggaagagcggcaaaagagucauucagcucucucgcaagaccuucgauaccgaauacccgaaaacaaagcugaccgacugggauuuuguggucacaaccgacaucuccgagaugggggcuaacuucagagcgggacgggugauugauccucgcagaugccuuaagcccguuauccugacggacggccccgaacgggugauucuggccgggccuauccccgugacaccugcuagcgccgcccagcgcagaggccggauuggaagaaacccggcucaagaggaugaccaguaugucuuuucuggcgauccccucaaaaaugacgaagaucacgcccauuggaccgaggcgaagaugcugcuugacaacaucuacacaccugaggggaucauucccacccuguucggaccugaacgcgagaaaacgcaggcuaucgacggcgaauuucggcucagaggggagcagcgcaagaccuucguugagcugaugcggagaggagaucugcccguguggcucagcuauaaaguggccuccgccggcauuucuuacaaggaccgggaaugguguuuuacaggcgagcgcaauaaccaaauccuugaagagaauauggaagucgagauuuggaccagagagggggaaaagaaaaagcugcggccgaaauggcuggaugcucgcguguaugccgacccuauggcgcucaaggauuucaaagaguuugccagcggaagaaaguccacaacccuggacauccuuacagaaaucgcuacccugcccacguaccucucuagcaaggccaaacuggcucuggauaacauuguuaugcuccacacaaccgagaagggcgggcgggccuaccagcacgcucuuaaugaacugccugagucccuggagacccucaugcugguggcccuucugggagcgaugacagccggcaucuuccucuuuuucaugcaggggaaaggaauuggcaagcugagcaugggccugaucgcuauugccgucgcuucugggcuccuuuggguggccgaaauccagccccaauggaucgccgcuuccauuauccuggaguucuuucugaugguccuccugauuccugaacccgagaaacagcgcaccccgcaggacaaccagcuuaucuaugugauucugacaauccucacgauuaucggacugaucgcggccaaugaaaugggccugauugagaagaccaaaacagauuucggguuuuaccaaguuaagaccgagacaaccauccucgacguggaucuuagaccugcuagcgccuggacgcuguaugccgucgcuaccacaauucugacccccaugcuccggcauacaaucgaaaacauguccgccaaucugucucuugcggccauugcuaaccaggccgcugugcugaugggacucggcaagggguggccccugcaccgcauggaccugggaguuccucuccuugccaugggcugcuacagccaggugaauccgaccacgcugacagcgucccuggucaugcuccugauccauuaugccaucauuggccccgggcuucaggcuaaagccaccagagaggcucaaaagcggacagccgcuggaaucaugaaaaacccuaccguggauggcauuaccgugaucgaccuggaacccauuucuuacgacccuaaguucgagaaacagcucgggcagguuaugcugcugguccucugugugggacaacuucugcugaugagaacaacgugggcccucugcgaggugcugacccuugcgacaggccccaucaugacccugugggaagggaauccuggacgcuuuuggaacacaaccaucgccgucagcacggcuaacauuuuccggggcuccuaucucgccggcgcugggcuggccuuuagccugaucaagaaugcccagacaccgagacgcggaaccggcaccacaggggagacccucggagaaaaguggaaacggcagcuuaacucucuggauagaaaggaguucgaagaguacaaacgcuccggcauucuggagguugaccggacagaagcgaagagcgcucucagagaugggucuaaaaucaagcacgccgugucccgcggaagcucuaagauucgguggaucguggagagaggcaugauuaaacccaagggcaaagucguggaccugggguguggacgcggcggguggagcuacuauauggcuacgcuuaagaauguuaccgaagugaaaggauacacaaagggcgggccuggacaugaggaacccaucccuauggccaccuauggcuggaaccuggucaagcuccacuccggcguggauguuuuuuacaaacccacagagcagguggacacccugcugugcgauaucggggagucuagcuccaauccgacgauugaagagggacggacccucagaauccuuaagauggucgaaccuuggcugagcuccaaacccgaguucuguauuaaggugcugaaccccuauaugccuacagugaucgaagagcucgagaaacugcaacgcagacacggcgggucucuuguccggugcccccugagccgcaauuccacccaugaaauguacuggguuucuggagccagcggcaacauuguguccucugugaauacaaucagcaagaugcuccugaacagauuuaccacacggcacagaaaaccuaccuaugagaaggacgucgaucugggggcuggaacgcgguccgugagcacagaaaccgagaagccggacaugaccaucauuggccgcagacuccagcggcuucaggaggaacauaaagagacauggcacuacgaucaggaaaaucccuaccgcacgugggccuaucacggcucuuacgaggcgccuuccaccgggagcgccucuuccaugguuaacggaguggucaagcugcugacaaaacccugggacgugaucccuaugguuacccaacucgcuaugacagacaccacacccuucggccagcagagaguguuuaaggaaaaagucgauacccggacgccgcagccuaagcuggggacccgcaugauuaugacaaccacagccaauuggcuuugggcucugcucggaaagaaaaagagccccagacuguguacccgggaggaguucaucucuaaagugcgcuccaacgccgcgauuggcgccguuuuccaagaagagcagggguggacgagcgcuaucgaagccgugaaugacuccagauuuugggagcuggucgauaaggaacgggcucuccaucaggagggcaaaugcgagagcugcguguauaacaugaugggaaagcgcgaaaagaaacugggcgaguucgggagagccaagggaucucgggcuaucugguacauguggcuuggcgcccgcuuucuggaauucgaggcgcucggguuucugaaugaagaccacugguucagcagagagaacuccuggucuggagucgagggcgaagggcuucaucggcugggcuauauucucgaggauaucgacaaaaaggauggagaccugauuuacgccgaugacacagcuggcugggauaccagaaucacagaagacgaucugcucaacgaggagcugauuaccgaacaaauggccccucaccauaaaacgcuugcuaaggccaucuuuaagcugaccuaucagaauaaagugguuaaggugcuccgccccacaccuaaaggggccgucauggacaucauuagccggaaggaccagagaggauccggccagguggggaccuacggacugaacacauucaccaauauggaggugcaacuuauccgccagauggaagcggagggcguuauuacacaggaugacaugcagaaccccaaagggcugaaggaacggguggagaaauggcucaaggaguguggcgucgauagacugaagcgcauggcuaucucuggagacgauugcgugguuaaaccgcuggacgaacgguuuagcaccucccuccuguuccuuaaugauaugggcaaggugagaaaagacgucccucaaugggagcccucuaagggguggaaaaacuggcaggaagugcccuuuuguagccaccacuuccauaagauuuuuaugaaggauggacgcucccuggucgugccuugccggaaucaggacgagcucaucggcagagcccgcauuagccagggggccggauggucucugcgggaaacggcuugucuuggcaaagccuacgcucaaauguggucccugauguauuuccacagacgggaucucagacuggccagcauggcgaucugcucugccguuccgacagagugguuccccaccucccgcaccacauggagcauccaugcucagcaccaguggaugaccacagaggacaugcugaagguguggaaccgggucuggauugaagacaauccuaacaugacggauaaaacccccgugcacuccugggaggacaucccuuaccucgggaagagagaagaucugugguguggcucucuuauuggacugagcucccgcgccacaugggcuaaaaauauccauaccgccauuacacagguuagaaaccucaucggcaaggaggaauauguggacuacaugcccgucaugaagcgguauagcucuccuuccgagagcgagggggugcuguga

SEQ ID NO: 21039 - RNA, 9867 nt, Artificial Sequence
  derived and/or modified CDS sequence (opt5) from DENV-4__KJ160504__SS-prME
agcaccaucacccugcucugccugauucccacggugauggccuuccaccuuuccaccagagacggagagccucugaugaucguugcuaagcaugaacgggggcgcccgcuucuguuuaagacaaccgagggaauuaacaaguguacccuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaagcaugcccagcgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccacaccccuggccgagaacacaaacagcguuaccaauaucgagcucgaaccuccguucggcgacucuuauauugugaucggggucggaaacagcgcgcugacccugcauugguuuagaaaaggcuccucuauugggaagauguucgagagcacauaccgcggagcuaaacggauggccauccucggcgaaacggccugggauuuuggguccgugggcggacuguucaccagccuuggcaaggcuguucaccagguguuugggucugucuauacaaccauguucggaggcguguccuggaugauuagaauccugaucggguuucucguucuguggauuggaacaaauagccgcaacaccucuauggccaugacgugcaucgcugugggcgggauuacacuguuccuuggcuuuaccguccaggccgacaugggaugugugguguccuggagcggccgggagcucaagugcggguccggaaucuucgucguugauaaugugcauaccuggacagaacaauacaaauuucagcccgagucuccugcgagacuggccagcgcuauucugaacgcccacaaggacggcgugugugggauccgcuccaccacacggcucgagaaugucauguggaaacagauuacgaacgaacugaauuaugugcuuugggagggaggccacgaccugaccguuguggcuggcgaugucaagggggugcucacaaaaggaaagagagcccugacacccccuguuucugaccugaaguacagcuggaaaacauggggcaaggcgaaaaucuucacccccgaagcccggaacuccacguuucuuaucgaugggccggacaccagcgagugcccuaaugaacgcagagcuuggaacucucucgagguggaggauuacggauucggcauguucacaaccaauauuuggaugaaguuucgggaaggguccagcgaggucugugaccauagacugaugucugccgcuaucaaagaucagaaggccgugcacgccgacaugggauauuggauugaauccagcaaaaaccaaacauggcagaucgagaaggcuucucugauugaaguuaagaccugccucuggcccaaaacacauacccuguggagcaauggcgugcuugagucccagaugcugaucccuaagagcuacgcgggccccuucucucagcacaacuaucgccaaggguacgccacgcagacagucggaccuuggcaccucggcaaacuggagaucgauuuuggggaaugccccggaaccaccgugacaauucaggaggacugugaucaucggggcccgucccugagaaccacgacagcuagcgggaaacuugugacccaguggugcugucgcuccugcacaaugccuccccucagauuccugggagaagacggcuguugguauggcauggagauccggccccugucugagaaagaagagaacauggucaagagccaaguuaccgccgggcagggaacauccgaaaccuuuucuaugggccuccugugccuuacgcuguucguggaggaaugucuccgcagacgggugacccgcaagcacaugauucuggucgugguuaucacacugugcgccauuauccuugggggacucaccuggauggaucugcugagagcucucaucaugcugggcgacacaaugagcgggcggauuggaggccagauccaucuugccauuauggcgguguuuaaaauguccccuggcuacguccuggggguguuccuccgcaagcugaccucuagagagacggcucugaugguuaucggaauggccaugacaaccgugcuuagcauuccgcacgaccugauggagcucaucgauggcaucucccuggggcucauucugcuuaaaaucgucacacaguuugacaauacccaagugggaacccuggcccucagccugacauucauucggucuacgaugccccuggucauggcuuggcgcaccaucauggccgugcuuuuuguugugacacugauuccucucuguagaaccuccugccugcagaagcagagccauugggucgaaaucacagcgcucauucugggcgcucaagcccuucccguguaucugaugacccucaugaaaggggccucucggagauccuggccucugaacgagggaaucauggcuguuggccuggugagccuucugggcucugcccuccugaagaaugaugucccccucgcugggccuaugguggccggaggccugcuucuggcggccuacgugauguccgggagcuccgcugaccugagccucgaaaaggccgcuaacguucagugggaugagauggccgacaucacgggaucuagccccauuaucgaagucaaacaggaugaggacggcuccuucucuauucgcgauguggaggaaacaaauaugaucacccugcuugugaagcuggcccucauuaccgucagcgggcuguacccgcucgcuaucccuaucacaaugacccugugguauauguggcaagugaaaacacaacgguccggagcgcuuugggacguucccucuccugccgcuacgcagaaggccgcccugagcgagggcguguacagaauuaugcagcgcggccuguuugggaaaacccaggucggagugggcauccacauggaagggguuuuccacacaauguggcaugugacccggggauccgucauuugucacgagacaggcagacucgaacccucuugggcugaugugcgcaacgacaugaucagcuaugggggaggcuggcggcugggcgauaagugggacaaggaggaggacguucaagugcuugccauugaaccggggaaaaauccuaagcauguccagaccaaacccggacuguucaagacgcucaccggcgagaucggggcggugacacuggauuuuaaaccuggaaccuccggcagccccaucauuaacagaaaggggaaagugaucggccucuacggaaauggcgucguuacaaagucuggggacuauguguccgcuauuacccaggccgaacgcaucggagagcccgauuacgagguggacgaagauauuuuccggaagaaaagacugacaaucauggaccuucacccuggcgccgggaagacgaaacggauucugccgagcaucguccgcgaggcucugaagagacggcuccgcacccugauccuugcccccacaagagugguugcggcugaaauggaggaagcccugcggggacucccuauuagauaucagacccccgccgugaaaucugagcauaccggccgcgagaucgucgaucugaugugccacgcuacauuuacgacccggcuccuguccagcacaagagugccuaacuacaaucuuauuguuauggacgaagcccacuucaccgaucccuccucuguggcugcccgcggguacaucagcacacgggucgagaugggcgaagcggccgcuauuuuuaugaccgccacgccuccgggagcuacagaccccuucccucaauccaacagccccaucgaggauaucgaaagagagauuccugagcgcucuuggaauaccggcuuugacuggaucaccgacuaucaggggaagacagugugguucguccccuccauuaaggccggaaacgauaucgccaauugccugcggaaaagcggcaagaaagugauucagcugucuagaaagaccuuugggacagaauacccgaaaaccaagcucacggacugggauuucguugugacaaccgacaucagcgagaugggagcuaacuuucgcgcgggcagagugaucgauccucggcgcugucugaagcccgucauucuuacagacgggcccgaaagaguuauccuggccggcccuauucccgugaccccugcuuccgccgcccaacggcgcggaagagugggccggaacccggcucaggaggaugaccaguaugucuucucuggggauccccucaaaaaugacgaagaucaugcccacuggacggaggcgaagaugcugcuggacaacaucuacaccccugagggaauuauccccacacucuucggcccugaaagagagaaaacccaggcuauugauggggaauuucgccuucggggagagcaaagaaagacauucguggagcugaugcgccggggcgaccugcccguuuggcucagcuauaaaguggccuccgccggcaucucuuacaaggacagagaauggugcuuuaccggggagcggaauaaccagauccuggaagagaauauggaagucgagauuuggacacgcgagggagaaaagaagaaacuuagaccgcgguggcuggaugcucgcguguaugccgacccuauggcgcucaaagauuucaaagaguuugccagcggcagaaaauccaucacccuggacauucugacggaaaucgcuagccuccccgccuaccuuucuucccgggcuaagcuggcccuggauaacauugucaugcuccauacaaccgagcgcgggggcagagcuuaccagcacgcccugaaugaacuuccugagagccuggagacccucaugcugguggcgcugcucggagccaugacagcugggaucuuccucuuuuucaugcagggaaagggcaucggcaaacuguccauggggcugauuaccaucgccguugcuucuggacuccuguggauugccgaaauccaaccccaguggauugccgcuagcaucauccuugaguuuuuccugauggugcuccugauuccugaacccgagaagcagcggacaccgcaggacaaccaacugaucuaugucauucucacggugcuuaccaucauuggccugaucgcggccaaugaaauggggcugauugagaaaacaaagaccgauuuuggauucuaccagguuaaaacagagaccacgauccucgacguggaucugcgcccugcuuccgccuggacccuuuaugccgucgcuacaaccgugcugacacccaugcucagacacaccaucgaaaacacgucugccaaucugagccuggcggccauugcuaaccaggccgcugugcucaugggccuugggaagggauggccccugcaucggauggaccugggcguuccucuccuggccaugggcuguuacucccaggucaauccgacaacccuuacagcgagccuggugaugcucuuugugcacuaugccaucauugggcccggacugcaagcuaaagccaccagagaggcucagaagcgcaccgccgcuggcaucaugaagaacccuacagucgaugggauuacgguuaucgaccuggaacccaucucuuacgauccuaaauucgagaagcagcucggacaagugaugcuucuggugcugugcgccggccagcuccugcuuaugcggaccacaugggcguucugugagguccugacccucgccacagggcccauucugacccugugggaaggaaauccuggcagauuuuggaacacgacaaucgcuguguccaccgccaacauuuuccgcggcagcuaucucgcuggggccggacuugccuuuucucugaucaaaaaugcgcagaccccgcggagaggcacagggaccacaggagagacgcugggcgaaaaguggaaacgccagcucaacucccuggaccggaaggaguucgaagaguacaagagaagcgggauucuugagguugaccgcaccgaagcuaaaucugcccugaaggauggaagcaaaaucaagcaugcugugucccggggcucuagcaaaaucagauggauugucgagcgcggcauggugaagcccaaggggaaaguuguggaccucggaugcggcagagggggaugguccuacuauauggccacacugaagaaugucaccgaagugaaaggcuacacaaaagggggaccuggccacgaggaacccaucccuauggccaccuauggcuggaaccuggugaaacuccauagcggggucgaugucuuuuacaagcccacggagcaaguggacacccuucugugugauauuggagaguccucuagcaauccgacaaucgaagagggcagaacccugcgcgugcucaagauggucgaaccuuggcuguccucuaaacccgaguucugcauuaaggugcuuaaccccuauaugccuacaguuaucgaagaacuggagaaacuccagagaaagcacgggggaaaucuggugcgguguccccugagccgcaacuccacccacgaaauguacugggucucuggcgcuagcgggaauauuguguccagcguuaacacaaccucuaaaaugcuccuuaauagauuuacgacacggcauagaaagccuaccuaugagaaagacguggaucugggagccggcacccgguccgucagcacagaaacggagaagccggacaugaccaucaucggccgcagacugcagcggcuccaggaggaacacaaggagacauggcauuacgaucaagaaaaccccuaccgcaccugggcguaucacgggucuuacgaggccccuuccacaggaagcgcuucuuccauggugaauggcguugugaaacugcuuaccaagcccugggacgucauuccuauggugacacagcuggccaugaccgauacgacccccuucgggcagcagagagucuuuaaagaaaagguggacacacggaccccgcaaccuaaacccggaacacgcaugguuaugaccacgacagcuaacuggcucugggcccugcugggcaagaagaaaaauccuagacucugcacccgggaggaguucaucagcaaggugcgcuccaacgcggccauuggggcugucuuucaggaggaacagggcuggacaagcgccucugaagcugugaaugacagcagauucugggagcugguggauaaagaacgggcccuucaccaagagggaaagugugaguccugcguuuauaacaugaugggcaaacgcgaaaagaagcugggggaguuuggacgggcuaaaggcucucgggccaucugguacauguggcucggggcgcgcuuccuggaguucgaggcccuuggauuucugaacgaagaccauugguucggcagagagaauagcugguccgggguggagggcgaaggacuccaccggcugggcuauauucuggaggaaaucgauaagaaagacggggaucucauguacgcugacgauaccgccggaugggacacgagaaucaccgaggaugaccugcagaacgaggaacuuauuacagagcagauggcuccccaucacaagauccuggccaaagccauuuuuaagcucaccuaucagaauaaggucgugaaaguucugcgcccuacaccccggggcgcggugauggauaucauuucuagaaaggaccaacgcgggagcggacaggucggcaccuacgggcuuaacacauucaccaauauggaagugcagcugauccggcagauggaggcugaaggcgucaucacgcaagaugacaugcagaacccgaaaggacucaaggagagaguggagaaauggcugcgcgaaugcggcguugaccggcugaagagaauggccauuuccggggaugacuguguggucaaaccucucgaugagcgcuuuggaacaucucugcuuuuccugaaugacaugggcaaggugcggaaggauaucccccagugggaacccagcaaaggguggaagaacuggcaggagguuccuuuuugcucccaucacuuccacaaaauuuuuaugaaggacggaagaagccucguggucccgugucgcaaucaagaugaacugaucggccgggccagaauuucucagggggcuggcuggucccuucgggagaccgccugccugggaaaggcuuacgcccagauguggagccucauguauuuccauagacgcgaccugcggcuggcgucuauggccaucuguuccgcugugcccaccgagugguuuccuacaagcagaaccacaugguccauccacgcccaucaccaguggaugacgaccgaagauaugcucaagguguggaaccgcguuuggauugaggacaaucccaacaugacagauaagaccccuguccacucuugggaagacauccccuaccugggcaaaagagaggaccuuuggugcgggagccugauuggacucuccagccgggcuacaugggccaagaauauccauaccgcgauuacgcaagugcgcaaccugaucggcaaagaagaguauguggauuacaugccugucaugaagagauauucugcccccuccgagagcgaaggggugcuuuga

SEQ ID NO: 21040 - RNA, 9867 nt, Artificial Sequence
  derived and/or modified CDS sequence (opt5) from DENV-4__GU289913__SS-prME
agcacaaucacacugcucugccugauucccacggugauggccuuccaccuuuccaccagagacggagagccucugaugaucguggcuaagcaugaacgggggagaccgcuucuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaugaucaccccuagaucccccagcguggaggucaaacuuccugauuacggagaacugacacucgacugcgagccccggucuggcaucgacuucaacgagaugauucugaugaagaugaaaaagaaaaccuggcuggugcauaagcagugguuucucgaucugccgcuuccuuggacagccggggcugacaccuccgaaguucacuggaauuacaaagagagaauggugacguucaaggucccccaugccaaacgccaggaugugaccguucugggcagccaggaaggagccaugcacuccgcucucgcgggcgccacagagguggacucuggggauggaaaccacauguuugcuggccaucugaaguguaagguccggauggaaaaacuuagaaucaaggggaugagcuauaccaugugcuccggaaaauucagcauugacaaggagauggccgagacacaacacggcaccacgguggugaaaguuaaguacgaaggggccggcgcuccuuguaagguccccaucgagauucgcgaugugaauaaagaaaagguggucggacggaucaucucuuccacaccccuggccgagaacaccaacagcgugacaaauauugagcucgaaccuccguucggcgacucuuauaucguuauuggggugggaaacagcgcgcugacccugcauugguuuagaaaaggcuccucuaucgggaagauguucgagagcaccuaccgcggagcuaaacggauggccauucucggcgaaacagccugggauuuuggguccgucggcggacuguucacgagccuuggcaaggcugugcaccagguuuuugggucuguguauaccacaauguucggaggcgucuccuggaugaucagaauccugauuggguuucucgugcuguggaucggaaccaauagccgcaacacaucuauggccaugaccugcauugcuguuggcgggaucacgcuguuccuuggcuuuacagugcaggccgacaugggaugugucguguccuggagcggcaaggagcucaaaugcggguccggaauuuucguggucgauaauguucauaccuggaccgaacaauacaaguuucagcccgagucuccugcgcggcuggccagcgcuauccugaacgcccacaaagacggcgugugugggauuagauccacaacccgccucgagaaugugauguggaagcagaucacaaacgaacugaauuauguccuuugggagggaggccacgaccugacggugguugcuggcgaugugaaagggguccucaccaagggaaagcgggcccugacacccccugugucugaccugaaauacagcuggaagaccuggggcaaagcgaagaucuucacacccgaagccagaaacuccaccuuucuuauugaugggccggacacgagcgagugcccuaaugaacggcgcgcuuggaacucucucgagguugaggauuacggauucggcauguucaccacaaauaucuggaugaaauuuagagaaggguccagcgaggugugugaccaucggcugaugucugccgcuauuaaggaucagaaagccguccacgccgacaugggauauuggaucgaauccagcaagaaccaaaccuggcagauugagaaggcuucucugaucgaagugaaaacaugccucuggcccaagacccauacacuguggagcaauggcguucuugagucccagaugcugaucccuaaaagcuacgcgggccccuucucucagcacaacuauagacaaggguacgccacccagacggugggaccuuggcaccucggcaagcuggagauugauuuuggggaaugccccggaacaaccgucaccauccaggaggacugugaucaucgcggcccgucccugcggacaaccacggcuagcgggaaacuugugacacaguggugcuguagauccugcaccaugccuccccuccgcuuccugggagaagacggcuguugguauggcauggagauuagaccccugucugagaaggaagagaacauggucaagagccaagucacagccgggcagggaaccuccgaaacauuuucuaugggccuccugugccuuacccuguucguugaggaaugucuccggcgcagagugacgcggaaacacaugauccugguggucgugauuacccugugcgccaucauccuugggggacucacauggauggaucugcugcgcgcucucauuaugcugggcgacaccaugagcgggagaaucggaggccagauucaucuugccaucauggcgguuuuuaagauguccccuggcuacgugcugggggucuuccuccggaaacugacaucucgcgagaccgcucugauggugauuggaauggccaugacgacaguucuuagcaucccgcacgaccugauggagcucaucgauggcauuucccuggggcucauccugcuuaagauugugacccaguuugacaauacacaagucggaacccuggcccucagccugaccuucaucagaucuacaaugccccuggugauggcuuggcggacgauuauggccguccuuuuugugguuacccugaucccucucugucgcacauccugccugcagaaacagagccauuggguggaaauuaccgcgcucauccugggcgcucaagcccuucccgucuaucugaugacacucaugaagggggccucuagacgguccuggccucugaacgagggaaucauggcugugggccugguuagccuucugggcucugcccuccugaagaaugaugugccccucgcugggccuauggucgccggaggccugcuucuggcggccuacgugauguccgggagcuccgcugaccugagccucgaaaaagccgcuaacgugcagugggaugagauggccgacauuaccggaucuagccccaucauugaaguuaagcaggaugaggacggcuccuucucuaucagagaugucgaggaaacgaauaugauuacacugcuugugaaacuggcccucaucaccgugagcgggcuguacccgcucgcuaucccugucaccaugacacugugguauauguggcaagugaagacccaacgcuccggagcgcuuugggacguucccucuccugccgcuacacagaaagccgcccugagcgagggcguguaccggauuaugcagagaggccuguuugggaagacgcaggucggagugggcauccacauggaagggguuuuccacaccauguggcaugugacacgcggauccgucauuugucacgagaccggccggcucgaacccucuugggcugaugugagaaacgacaugaucagcuaugggggaggcuggcgccugggcgauaagugggacaaagaggaggacguucaagugcuugccauugaaccggggaagaauccuaaacauguccagacaaagcccggacuguucaaaacccucacgggcgagaucggggcggugacccuggauuuuaagccuggaacauccggcagccccaucauuaaccggaaagggaaggugaucggccucuacggaaauggcgucguuaccaagucuggggacuauguguccgcuauuacacaggccgaaagaaucggagagcccgauuacgagguggacgaagauauuuuccgcaaaaagcggcugaccaucauggaccuucacccuggcgccgggaaaacaaagcgcauucugccgagcaucguccgggaggcucugaaacgcagacuccggacgcugauccuugcccccacccgcgugguugcggcugaaauggaggaagcccugagaggacucccuauucgguaucagacacccgccgugaagucugagcauaccggcagagagaucgucgaucugaugugccacgcuaccuuuacaacgcgccuccuguccagcacccgggugccuaacuacaaucuuauuguuauggacgaagcccacuucacagaucccuccucuguggcugccagaggguacaucagcacccgcgucgagaugggcgaagcggccgcuauuuuuaugacagccaccccuccgggagcuacggaccccuucccucaauccaacagccccaucgaggauaucgaacgggagauuccugagagaucuuggaauacaggcuuugacuggaucaccgacuaucaggggaagaccgugugguucguccccuccauuaaagccggaaacgauaucgccaauugccugcgcaagagcggcaaaaaggugauucagcugucucggaaaacauuugacaccgaauacccgaagacaaagcucaccgauugggacuucguugugacgacagauaucagcgagaugggggcuaacuuuagagcgggacgcgugaucgacccuagacggugucugaaacccgucauucuuaccgauggccccgaacgcguuauccuggccgggccuauucccgugaccccugcuuccgccgcccaaagacggggccgcaucggaagaaacccggcucaggaggacgaucaguauguguucucuggcgacccccucaagaaugaugaagaccaugcccacuggaccgaggcgaaaaugcugcuggauaacauuuacacgccugaggggaucauucccacccucuucggaccugaacgggagaagacacaggcuaucgacggcgaauuuagacuucgcggggagcaacggaaaaccuucgucgagcugaugagacgcggagaccugcccguguggcucagcuauaagguugccuccgccggcaucucuuacaaggaucgggaauggugcuuuacaggcgagagaaauaaccagauucuggaagagaauauggaaguggagaucuggacccgggagggggagaagaagaaacuucgcccgagauggcuggacgcucgggucuaugccgauccuauggcgcucaaggacuucaaagaguuugccagcggacgcaaguccauuacacuggauauccugaccgaaauugcuagccuccccacguaccuuucuuccagagccaagcuggcucuggacaacaucgugaugcuccauacaaccgagcggggcgggcgcgccuaccagcacgcucugaaugaacuuccugagagccuggagacccucaugcuggucgcccugcucggagcgaugacagccggcaucuuccucuuuuucaugcaggggaaaggaauuggcaagcuguccaugggccugaucaccauugcuguggccucugggcuccuguggguugcugaaauccaaccccaguggauugccgccagcaucauccuugaguuuuuccugauggugcuccugauuccugaacccgagaaacagagaacaccgcaggauaaccaacugaucuaugucauucucacgauccuuaccauuaucggacugauugcugcgaaugaaaugggccugaucgagaagacaaaaaccgacuuuggguucuaccaggugaagacagagaccacgauccucgauguugaccugcggccugccuccgcuuggacccuuuaugccguggccacaaccauucugacacccaugcuccgccacaccaucgaaaacacgucugcuaaucugagccuggccgcgauugccaaccaggcugccguccucaugggacuuggcaaaggguggccccugcauagaauggaucugggagugccucuccuggcuaugggcuguuacucccaggugaauccgacaacccuuacagccagccugguuaugcucucuguccacuaugcgaucauuggccccgggcugcaagccaaggcuacccgggaggcccagaagagaaccgcugccggaaucaugaaaaacccuacaguggacggcaucacggugauugaucuggaacccaucuccuacgacccuaaguuugagaaacagcucgggcaagucaugcuucugguucugugcgcuggacagcuccugcuuaugcgcaccacaugggccuucugugaggugcugacccucgcgacaggccccauucugacccugugggaagggaauccuggacgguucuggaacacgacaaucgccgugagcaccgcuaacauuuuuagaggcucuuaucucgccggcgcugggcuugccuucucccugaucaagaaugcccagaccccgcgccggggaacaggcaccacaggggagacgcugggagaaaaauggaagagacagcucaacagccuggaccgcaaggaguuugaagaguacaaacggucuggcauccuugaggucgauagaaccgaagccaagagcgcucugaaagacggguccaagauuaaacaugccgugucucgcggaagcuccaagauccgguggauuguugagagaggcauggugaagcccaaaggcaaggucguggaucucgggugcggacgcggcggguggagcuacuauauggcuacacugaaaaauguuaccgaagugaagggauacacaaaaggcgggccuggacacgaggaacccaucccuauggccaccuauggcuggaaccuggucaagcuccauuccggcguggacguguucuacaagcccacggagcaagucgauacccuucugugugacauuggggagucuagcuccaauccgacaaucgaagagggacggacccugagaguucucaaaaugguggaaccuuggcugucuagcaagcccgaguuuugcauuaaagugcuuaaccccuauaugccuacagucaucgaggaacuggagaagcuccagcgcaaacacggcgggaaucuggugagauguccccugucccggaacucuacccacgaaauguacuggguuagcggagccuccggcaauaucgugagcucugucaacacaaccuccaagaugcuccuuaaucgcuucacgacaagacaucggaaaccuaccuaugagaaggauguggaccugggggcuggaaccagaagcguuucuacagaaacggagaagccggauaugaccauuaucggccggcgccugcagagacuccaggaggaacacaaagagacauggcauuacgaccaagaaaaccccuaccggaccugggccuaucacggcuccuacgaggcgccuagcacagggucugccuccagcauggugaauggagucgugaagcugcuuaccaaacccugggauguuauuccuauggugacacagcuggcuaugaccgacacgacccccuuuggccagcagcgcgucuucaaggaaaaaguggacacaagaaccccgcaaccuaagcccgggacacggauggucaugaccacgacagccaacuggcucugggcucugcugggaaagaaaaagaauccucgccucugcaccagagaggaguuuaucuccaaagugcggagcaacgccgcgauuggcgccguuuuccaggaagaacagggguggacaucugcuagcgaagccgugaaugauucccgcuuuugggagcuggucgacaaggaaagagcccuucaccaagagggcaaaugugagucuugcguguauaacaugaugggaaagcgggaaaagaaacugggcgaguucgggcgcgccaagggaagcagagcuaucugguacauguggcucggcgcccgguuucuggaguucgaggcgcuuggguuccugaacgaagaucauugguuuggacgcgaaaauuccuggucuggcguggagggggaaggccuccacagacugggauauauccuggaggaaauugacaaaaaggauggcgaccucauguacgccgaugacaccgcugggugggauacgcggaucaccgaggacgaucugcagaacgaggaacuuauuacagagcagauggcgccccaucacaaaauccuggcuaaggccauuuucaagcucaccuaucagaauaaaguugugaagguccugagaccuacaccccgcggagccgugauggacaucaucagccggaaagaucaaagaggcuccgggcagguuggaaccuacggccuuaacacauuuaccaauauggaagugcagcugauucgccagauggaggcggaaggggucaucacgcaagacgacaugcagaacccgaagggccucaaagagcggguggagaaguggcugaaagaaugcggagucgauagacugaagcgcauggcuauuucuggcgacgauugugugguuaagccucucgacgagcgguucgggacaagccugcuuuuucugaaugauaugggaaaagugagaaaggacaucccccagugggaacccuccaaaggcuggaagaacuggcaggaggucccuuucugcagccaucacuuucacaaaauuuucaugaaggaugggcgcucucucgugguuccgugucggaaucaagacgaacugaucggcagagcucgcaucucccagggagccggguggagccuucgggagaccgcuugccugggcaaggccuacgcucagauguggucucucauguauuuucauagacgggaucugagacuggccuccauggcgauuuguagcgccgugcccaccgagugguucccuacaucccgcaccacauggucuauccacgcucaucaccaguggaugacgaccgaagacaugcucaaagucuggaaccggguguggauugaggauaaucccaacaugacagacaagaccccugugcacagcugggaagacauccccuaccugggaaaaagagaggaucuuuggugcggcucccugauugggcucagcucucgcgccacaugggcuaagaauauccauaccgccauuacgcaaguuagaaaccugaucggaaaagaagaguaugucgacuacaugccugugaugaagcgguauuccgcgcccagcgagucugaaggcgugcuuuga

SEQ ID NO: 21041 - RNA, 9867 nt, Artificial Sequence
  derived and/or modified CDS sequence (opt5) from DENV-4__KJ579243__SS-prME
agcaccaucacccugcuuugccugauucccacggugauggccuuccaccuuuccaccagagacggagagccucugaugaucgucgcuaagcaugaacgggggcgcccgcuccuguuuaagaccaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucgggugccugguucuguggauuggaaccaauucucgcaacacguccauggccaugacauguaucgcugugggcgggauuacccuuuuucucggcuucaccguccaggccgacaugggaugcguggugagcuggucuggccgggagcugaaguguggguccggaaucuuugucguugauaaugugcauacauggaccgaacaauacaaauuccagcccgagagcccugcgagacuggccuccgcuauucucaacgcccacaaggacggcgugugcgggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcggccuuaaguacuccuggaaaaccugggggaaggccaaaaucuuuacgcccgaagcucggaacucuaccuuccucaucgacggaccggauacaagcgaguguccuaaugaacgcagagccuggaacuccuuugagguugaggacuacggcuucgggauguucaccacaaauauuuggaugaaguuucgggaaggaagcucugaggugugcgaucauagacugauguccgcugccaucaaagaccagaaggccguccacgcugauaugggcuauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccgggcccuucucccagcacaacuaucggcaaggauacgcuacacagaccgugggcccuuggcaccucgggaagcuggagaucgacuuuggagaaugucccggcaccacagucaccauucaggagaacugcgaucauagagggccgagccugcgcacgacaaccgccucuggaaaacuugugacacagugguguugcagauccuguaccaugccuccccuccgguuccugggcgaagacggcugcugguaugggauggagauccgcccccugagcgagaaggaagagaauauggugaaaucccaagucacagccggacagggcaccucugaaacguuuagcauggggcuccugugucuuacccuguucguugaggaaugccucagacggcgcgugacaagaaagcacaugauucuggcuguggucaucacccugugugccauuauccuuggaggccucacauggauggaucugcugcgggcgcucaucauucugggggacaccauguccggacgcaucggcggccagacgcaucuugcuauuauggccguguuuaagaugucuccuggguacguucugggaguguuccucagaaaacugacaagccgggagaccgcccugauggucaucggcauggcuaugacaaccacccuuuccauuccgcacgaucugauggagcucaucgacgggaucucucugggacucauucugcuuaagaucgugacacaguuugacaacacgcaaguuggcacccuggcccucagccugacauucauucgcuccaccaugagccuggugauggcguggagaacaaucauggcuguccuuuuuguggucacccugauuccccucugccggacgucuugucugcagaaacagucccauuggguggaaaucacagcccucauucugggggcccaagcccuuccuguuuaucugaugacccucaugaagggagccagcagacgcucuuggccccugaaugagggcaucauggcugugggccuggucucccuucuggggagcgcccuccugaaaaacgaugugccucucgcgggacccaugguugccggcgggcugcuucuggcugccuacgugaugucuggauccagcgcugaccugucccucgaaaaggccgccaauguccagugggaugagauggcugacaucaccggcagcucuccuauuaucgaagugaagcaggaugaggacgggagcuucuccauucgggauguggaggaaacaaacaugaucacccugcuuguuaaacuggcgcucauuacagucucuggacuguacccccucgccaucccgaucacgaugacccugugguauauguggcaagugaagacacaaagaagcggcgcucuuugggacgugccuucccccgccgccacccagaaagcugcccugucugagggcgucuaccgcauuaugcagcgggggcuguuuggaaagacacaggugggcguugggauccacauggaaggaguguuccacaccauguggcaugucacgagaggcagcgugauuugccacgagaccgggcgccucgaaccuuccugggcggauguucggaaugacaugaucucuuauggaggcggcuggagacugggggauaaaugggacaaggaggaggaugugcaaguccuugcuauugaacccggaaagaacccgaaacaugugcagacaaagccuggccuguucaaaacccucacaggggagaucggagccguuacccuggacuuuaagcccggcacaagcggguccccuaucauuaaucgcaaaggcaaggugaucggacucuacggcaacggggucgugacgaaaagcggagacuaugugucugccauuacccaggcugaacggaucggcgagcccgauuacgaggucgacgaagauauuuucagaaagaagcggcugacaaucauggaccuucaccccggggccggaaaaaccaagcgcauucugccuuccaucguuagagaggcgcugaaacggcgccucagaacccugauccuugcuccgacacgggugguggccgccgaaauggaggaagcucugagaggccuccccauucgcuaucagacgccugccgucaagagcgagcauaccgggcgggagaucguggaucugaugugccacgcuacauuuaccacaagacuccugucuuccacccgcguucccaauuacaaccuuauugugauggacgaagcccacuucacggauccuagcuccgucgcggcccggggcuacaucucuacaagaguggagaugggagaagcugccgcuauuuuuaugaccgccacacccccuggcgccacagacccguucccccaaagcaauuccccuaucgaggauaucgaacgcgagauucccgagcggagcuggaacaccggguuugacuggaucacagauuaucagggaaaaaccguuugguucgugccuucuauuaaggcuggcaaugacaucgcgaacugucugagaaaguccgggaaaaaggucauucagcugagccgcaaaacguuugacacagaauaccccaagaccaaacucacagauugggacuucguggucaccacggauaucucugagaugggagccaacuuuagagcuggccgggugaucgacccgcgcagaugccugaagccuguuauucuuaccgaugggcccgaacgggugauccuggccggccccauuccugugacacccgccagcgcugcccaacgcagaggacggaucggcagaaauccugcgcaggaggacgaucaguaugucuucuccggggacccgcucaagaacgaugaagaccaugcucacuggaccgaggccaaaaugcugcuggauaauauuuacacacccgagggaaucauuccuacccucuucggccccgaacgcgagaagacacaggccaucgacggggaauuucggcuuagaggagagcaacgcaaaaccuucguugagcugaugcggagaggcgaucugccuguguggcucucuuauaagguggcuagcgccggcaucuccuacaaagaccgggaaugguguuuuacgggggagcgcaacaaucagauucuggaagagaacauggaagucgagaucuggacaagagagggagaaaagaagaaacuucggcccaaguggcuggacgcgcgcguguaugccgauccgauggcucucaaagacuucaaggaguuugccucuggcagaaaaagcauuacccuggauauccugaccgaaauugcuucccucccuacauaccuuagcucucgggccaagcuggcucuggacaauaucguuaugcuccauaccacagagcgcgggggcagagcuuaccagcacgcgcugaacgaacuucccgagucccuggagacgcucaugcugguggcccugcucggagcuaugaccgccgggaucuuccucuuuuucaugcagggaaagggcauuggcaaacugagcauggggcugaucacaauugcugucgccuccggacuccuguggguggccgaaauccaaccucaguggauugcugcgucuaucauccuugaguuuuuccugaugguccuccugauucccgaaccugagaagcagcggacaccccaggauaaucaacugaucuaugugauucucacaauccuuaccauuaucggccugauugccgcuaacgaaauggggcugaucgagaaaacgaagaccgacuuuggauucuaccagguuaaaacagagaccacaauccucgauguggaccugcgcccggccagcgccuggacccuuuaugcugucgccacgacaauucugaccccuaugcucagacacacaaucgaaaauaccuccgcgaaccugucucuggccgcuauugccaaucaggcugccgugcucaugggccuugggaagggauggccccugcaucggauggaucugggcguuccccuccuggcgaugggcugcuacagccaggugaacccuaccacacuuacggccucccuggucaugcuccuggugcacuaugcuaucauugggccgggacugcaagccaaagcuaccagagaggcccagaagcgcacagcugccggcaucaugaagaaucccaccguggacgggaucacaguuauugaucucgaaccuaucagcuacgaccccaaauuugagaagcagcuuggacaagucaugcugcuggugcucugugcgggccagcugcuucugaugcggaccacgugggccuucugcgaggugcucacacuggcuaccgggccuauucugacccucugggaaggaaaccccggcagauucuggaacacaaccaucgccgucucuacagcuaauauuuuucgcggcuccuaucuugccggggccggacuggcguucagccugaucaaaaacgcucagacgccucggagaggcaccgggacagccggagagacccucggcgaaaaguggaaacgccagcucaauucucuugaucggaaggaguuugaagaguacaagagauccgggauccuggagguugaccgcacagaagcuaaaagcgcccucaaggacggaucuaaaauuaagcaugccgugagccggggcuccucuaaaaucagauggauuguggagcgcggcauggucaagccgaaggggaaagugguugaucugggauguggcagagggggauggagcuacuauauggcuacccugaagaacgugacggaagucaaaggcuacaccaaagggggacccggccacgaggaaccuauccccauggccacauauggcuggaaucucgugaaacuucauuccgggguugacguguucuacaagccuaccgagcaagucgauacacugcugugcgacauuggagagagcuccucuaaccccaccaucgaagagggcagaacacuccgcgugcugaagaugguggaaccguggcuuagcuccaaaccugaguuuuguauuaagguccugaaucccuauaugcccaccguuaucgaagaacuggagaaacugcagagaaagcacgggggaaaccuggugcggugcccucucucucgcaauagcacgcacgaaauguacuggguguccggcgcgucugggaacaucgucagcuccgugaauacaaccagcaaaaugcuucugaacagauucaccacacggcauagaaagcccacguaugagaaagauguugaccugggagccggcacccggucuguguccacagaaaccgagaagccugauaugacaauuaucggccgcagacuccagcggcugcaggaggaacacaaggagaccuggcauuacgaccaagaaaauccguaccgcacaugggcuuaucacgggagcuacgaggcccccucuaccggauccgcuagcucuauggucaacggcgugguuaaacuucugacgaagccuugggaugugauucccauggucacccagcucgccaugacagacaccacaccuuuugggcagcagagaguguucaaagaaaagguugauacccggacgccccaaccgaaaccuggaacacgcauggugaugaccacaaccgcgaauuggcugugggcccugcucggcaagaagaaaaaccccagacuguguacgcgggaggaguuuaucuccaagguccgcagcaaugcugccauuggggcuguguuccaggaggaacagggcuggaccuccgccagcgaagcugucaacgacucuagauuuugggagcuuguggacaaagaacgggcccugcaccaagagggaaagugcgagagcugcguuuauaacaugaugggcaaacgcgaaaagaagcucggggaguucggacgggcgaaaggcucccgggccaucugguacauguggcugggggcucgcuuucuugaguucgaggcccugggauuccucaaugaagaucauugguuuggcagagagaacucuuggagcgggguggagggcgaaggacugcaccggcugggcuauauccucgaggaaauugacaagaaagauggggaccugauguacgcugaugacacagccggaugggauaccagaaucacagaggacgaucuucagaaugaggaacugauuaccgagcagauggccccucaucacaagauccucgcgaaagcuauuuucaagcugacauaucagaacaaggucgugaaagugcuucgccccaccccucggggcgccguuauggacaucaucuccagaaaggaucaacgcgggucuggacaggugggcacguacgggcugaauacauuuaccaacauggaaguccagcucauucggcagauggaggccgaaggcgugaucacccaagacgauaugcagaaucccaaaggacugaaggagagaguugagaaauggcugcgcgaauguggcguggaccggcucaagagaauggcuauuagcggggacgauugcgucgugaaaccgcuggacgagcgcuucggaacaucccuucuguuucucaacgauaugggcaagguccggaaggacaucccucagugggaacccucuaaaggguggaagaauuggcaggaggugcccuucuguagccaucacuuucacaaaauuuucaugaaggauggaagaucccugguugugccuugccgcaaccaagacgaacuuaucggccgggccagaaucagccagggggcuggcuggucucugcgggagaccgccugucucggaaaagcguacgcccagauguggucccugauguauuuucauagacgcgaucugcggcucgcuagcauggccauuugcucugcugucccgacagagugguuccccacguccagaaccacauggagcauccacgcccaucaccaguggaugaccacagaagacaugcugaagguguggaaucgcguuuggauugaggauaacccuaauaugaucgacaagacccccgugcacuccugggaagauauuccuuaccuuggcaaaagagaggaccuguggugugggucucucaucggacugagcucccgggcgacgugggccaagaacauucauaccgcuaucacacaaguccgcaaucuuaucggcaaagaagaguauguggacuacaugcccgugaugaagagauauagcgccccuucugaguccgaagggguucuguga

SEQ ID NO: 21042 - RNA, 9867 nt, Artificial Sequence
  derived and/or modified CDS sequence (opt5) from DENV-4__KJ579246__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucauucugggcgauaccauguccgggcgcaucggaggccagacgcaucuugcuauuauggccguguucaagaugucuccuggcuacguucuggggguguuucucagaaaacugacaagccgggagaccgcccugauggucaucggaauggcuaugacaaccacccuuuccauuccgcacgaccugauggagcucaucgacggcaucucucuggggcucauucugcuuaagaucgugacacaguucgauaacacgcaaguuggaacccuggcccucagccugacauuuauucgcuccaccaugagccuggugauggcguggagaacaaucauggcuguccuuuucguggucacccugauuccccucugucggacgucuugccugcagaaacagucccauuggguggaaaucacagcccucauucugggcgcccaagcucuuccuguuuaucugaugacccucaugaagggggccagcagacgcucuuggccccugaaugagggaaucauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuauuaucgaagugaagcaggacgaggauggcagcuuuuccauucgggacguggaggaaacaaacaugaucacccugcuuguuaaacuggcgcucauuacagucucugggcuguacccccucgccaucccgaucacgaugacccugugguauauguggcaggugaagacacaaagaagcggagcucuuugggaugugccuucccccgccgccacccagaaagcugcccugucugagggcgucuaccgcauuaugcagcggggccuguucgggaagacacaggugggaguuggcauccacauggaagggguguuccacaccauguggcaugucacgagaggaagcgugauuugucacgagaccggccgccucgaaccuuccugggcggacguucggaaugauaugaucucuuaugggggaggcuggagacugggcgacaaaugggauaaggaggaggacgugcaaguccuugcuauugaacccgggaagaacccgaaacaugugcagacaaagccuggacuguuuaaaacccucacaggcgagaucggggccguuacccuggacuucaagcccggaacaagcggcuccccuaucauuaaucgcaaagggaaggugaucggccucuacggaaacggcgucgugacgaaaagcggggauuaugugucugccauuacccaggcugaacggaucggagagcccgacuacgaggucgaugaagacauuuuuagaaagaagcggcugacaaucauggaucuucaccccggcgccgggaaaaccaagcgcauucugccuuccaucguuagagaggcgcugaaacggcgccucagaacccugauccuugcuccgacacgggugguggccgccgaaauggaggaagcucugagaggacuccccauucgcuaucagacgccugccgucaagagcgagcauaccggccgggagaucguggaccugaugugccacgcuacauucaccacaagacuccugucuuccacccgcguucccaauuacaaccuuauugugauggaugaagcccacuuuacggacccuagcuccgucgcggcccggggguacaucucuacaagaguggagaugggcgaagcugccgcuauuuucaugaccgccacccccccuggagccacagauccguuuccccaaagcaauuccccuaucgaggacaucgaacgcgagauucccgagcggagcuggaacaccggcuucgauuggaucacagacuaucaggggaaaaccguuugguuugugccuucuauuaaggcuggaaaugacaucgcgaacugccugagaaaguccggcaaaaaggucauucagcugagccgcaaaacguucgauacagaauaccccaagaccaaacucacagacugggauuuuguggucaccacggacaucucugagaugggggccaacuucagagcuggacgggugaucgauccgcgcagaugucugaagccuguuauucuuaccgacggccccgaacgggugauccuggccgggcccauuccugugacacccgccagcgcugcccaacgcagaggccggaucggaagaaauccugcgcaggaggaugaccaguaugucuucuccggcgauccgcucaagaacgacgaagaucaugcucacuggaccgaggccaaaaugcugcuggacaauauuuacacacccgaggggaucauuccuacccucuuuggacccgaacgcgagaagacacaggccaucgauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauucuggaagagaacauggaagucgagaucuggacaagagagggggaaaagaagaaacuucggcccaaguggcuggaugcgcgcguguaugccgacccgauggcucucaaagauuuuaaggaguucgccucuggaagaaaaagcauuacccuggacauccugaccgaaauugcuucccucccuacauaccuuagcucucgggccaagcuggcucuggauaauaucguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaauuggcaaacugagcaugggccugaucacaauugcugucgccuccgggcuccuguggguggccgaaauccaaccucaguggauugcugcgucuaucauccuugaguucuuucugaugguccuccugauucccgaaccugagaagcagcggaccccccaggacaaucaacugaucuaugugauucucacaauccuuaccauuaucggacugauugccgcuaacgaaaugggccugaucgagaaaacgaagaccgauuucggguuuuaccagguuaaaacagagaccacaauccucgacguggaucugcgcccggccagcgccuggacccuuuaugcugucgccacgacaauucugaccccuaugcucagacacacaaucgaaaauaccuccgcgaaccugucucuggccgcuauugccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuaucauuggcccggggcugcaagccaaagcuaccagagaggcccagaagcgcacagcugccggaaucaugaagaaucccaccguggauggcaucacaguuauugaccucgaaccuaucagcuacgaucccaaauucgagaagcagcuugggcaagucaugcugcuggugcucugcgcgggacagcugcuucugaugcggaccacgugggccuucugugaggugcucacacuggcuaccggcccuauucugacccucugggaagggaaccccggaagauuuuggaacacaaccaucgccgucucuacagcuaauauuuuccgcggcuccuaucuugccggcgccgggcuggcguuuagccugaucaaaaacgcucagacgccucggagaggaaccggcacagccggggagacccucggagaaaaguggaaacgccagcugaauucucuugaccggaaggaguucgaagaguacaagagauccggcauccuggagguugaccgcacagaagcuaaaagcgcccucaaggaugggucuaaaauuaagcaugccgugagccggggauccucuaaaaucagauggauuguggagcgcggcauggucaagccgaagggcaaagugguugaccuggggugcggacggggcggguggagcuacuauauggcuacccugaagaacgugacggaagucaaaggauacaccaagggcgggcccggacacgaggaaccuauccccauggccacauauggcuggaaucucgugaaacuucauuccggcguugauguguuuuacaagccuaccgagcaagucgacacacugcugugugauauuggggagagcuccucuaaccccaccaucgaagagggaagaacacuccgcgugcugaagaugguggaaccguggcuuagcuccaaaccugaguucugcauuaagguccugaaucccuauaugcccaccguuaucgaagagcucgagaaacugcagagaaagcacggcgggaaccuggugcgguguccucucucucgcaauagcacgcacgaaauguacuggguguccggagcgucuggcaacaucgucagcuccgugaauacaaccagcaaaaugcuucugaacagauuuaccacacggcauagaaagcccacguaugagaaagacguugaucugggggccggaacccggucuguguccacagaaaccgagaagccugacaugacaauuaucggccgcagacuccagcggcugcaggaggaacacaaggagaccuggcauuacgaucaagaaaauccguaccgcacaugggcuuaucacggcagcuacgaggcccccucuaccggguccgcuagcucuauggucaacggagugguuaaacuucugacgaagccuugggacgugauucccauggucacccagcucgccaugacagauaccacaccuuucggccagcagagaguguuuaaagaaaagguugacacccggacgccccaaccgaaaccugggacacgcauggugaugaccacaaccgcgaauuggcugugggcccugcucggaaagaagaaaaaccccagacugugcacgcgggaggaguucaucuccaagguccgcagcaaugcugccauuggcgcuguguuucaggaagagcagggguggaccuccgccagcgaagcugucaacgacucuagauucugggagcuuguggauaaagaacgggcccugcaccaagagggcaagugugagagcugcguuuauaacaugaugggaaaacgcgaaaagaagcucggcgaguuugggagagcgaaaggaucccgggccaucugguacauguggcugggcgcucgcuuccuugaauucgaggcccugggguuucucaaugaagaccauugguucggaagagagaacucuuggagcggcguggagggggaaggccugcaccggcugggauauauccucgaggaaauugauaagaaagacggcgaucugauguacgcugacgauacagccgggugggacaccagaaucacagaggaugaccuucagaaugaggaacugauuaccgagcagauggccccucaucacaagauccucgcgaaagcuauuuuuaagcugacauaucagaacaaggucgugaaagugcuucgccccaccccucggggagccguuauggauaucaucuccagaaaggaccaacgcggcucugggcaggugggaacguacggccugaauacauucaccaacauggaaguccagcucauucggcagauggaggccgaaggggugaucacccaagaugacaugcagaaucccaaaggccugaaggagagaguugagaaauggcugcgcgaaugcggaguggaccggcucaagagaauggcuauuagcggcgaugacugugucgugaaaccgcuggaugagcgcuuugggacaucccuucuguuccucaacgacaugggaaagguccggaaggauaucccucagugggaacccucuaaaggcuggaagaauuggcaggaggugcccuuuugcagccaucacuuccacaaaauuuuuaugaaggacgggagaucccugguugugccuugucgcaaccaagaugaacuuaucggacgggccagaaucagccagggcgcuggguggucucugcgggagaccgccugccucggcaaagcguacgcccagauguggucccugauguauuuccauagacgcgaccugcggcucgcuagcauggccauuuguucugcugucccgacagagugguuucccacguccagaaccacauggagcauccacgcccaucaccaguggaugaccacagaagauaugcugaagguguggaaucgcguuuggauugaggacaacccuaauaugaucgauaagacccccauucacuccugggaagacaucccuuaccuuggaaaaagagaggaccuguggugcggcucucucauugggcugagcucccgggcgacgugggccaagaacauccauaccgcuaucacacaagugcgcaaucuuauuggaaaagaagaguaugucgauuacaugcccgugaugaagagauauagcgccccuucugaguccgaaggcgugcuguga

SEQ ID NO: 21043 - RNA, 9867 nt, Artificial Sequence
  derived and/or modified CDS sequence (opt5) from DENV-4__KJ579248__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccauguccgggcgcgugggaggccagacgcaucuugcuauuaucgccguuuucaagaugucuccuggcuacgugcugggggucuuucucagaaaacugacaagccgggagaccgcccugauggugauuggaauggcuaugacaaccacccuuuccaucccgcacgaccugauggagcucauugacggcaucucucuggggcucauccugcuuaagauuguuacacaguucgauaacacgcaagugggaacccuggcccucagccugacauuuauccgcuccaccaugagccuggucauggcguggagaacaauuauggcugugcuuuucgucgugacccugaucccccucugucggacgucuugccugcagaaacagucccauuggguugaaauuacagcccucauccugggcgcccaagcucuuccuguguaucugaugacccucaugaagggggccagcagacgcucuuggccccugaaugagggaauuauggcugucggccuggugucccuucugggcagcgcccuccugaaaaacgacguuccucucgcggggcccaugguggccggaggccugcuucuggcugccuacgucaugucuggguccagcgcugaucugucccucgaaaaggccgccaaugugcagugggacgagauggcugauaucaccggaagcucuccuaucauugaagugaagcaggacgaggauggcagcuuuuccauccgggacguugaggaaacaaacaugauuacccugcuugucaaacuggcgcucaucacagugucugggcuguacccccucgccauuccgaucacgaugacccugugguauauguggcaggugaagacacaaagaagcggagcucuuugggaugucccuucccccgccgccacccagaaagcugcccugucugagggcguguaccgcaucaugcagcggggccuguucgggaagacacagguuggagugggcauucacauggaaggggucuuccacaccauguggcaugugacgagaggaagcguuaucugucacgagaccggccgccucgaaccuuccugggcggacgugcggaaugauaugauuucuuaugggggaggcuggagacugggcgacaaaugggauaaggaggaggacguccaagugcuugcuaucgaacccgggaagaacccgaaacauguucagacaaagccuggacuguuuaaaacccucacaggcgagauuggggccgugacccuggacuucaagcccggaacaagcggcuccccuaucaucaaucgcaaagggaaggucauuggccucuacggaaacggcguggugacgaaaagcggggauuaugucucugccaucacccaggcugaacggauuggagagcccgacuacgagguugaugaagacaucuuuagaaagaagcggcugacaauuauggaucuucaccccggcgccgggaaaaccaagcgcauccugccuuccauugugagagaggcgcugaaacggcgccucagaacccugauccuugcuccgacacggguggucgccgccgaaauggaggaagcucugagaggacuccccauccgcuaucagacgccugccgugaagagcgagcauaccggccgggagauuguugaccugaugugccacgcuacauucaccacaagacuccugucuuccacccgcgugcccaauuacaaccuuaucgucauggaugaagcccacuuuacggacccuagcuccguggcggcccggggguacauuucuacaagaguugagaugggcgaagcugccgcuaucuucaugaccgccacccccccuggagccacagauccguuuccccaaagcaauuccccuauugaggacaucgaacgcgagauccccgagcggagcuggaacaccggcuucgauuggauuacagacuaucaggggaaaaccgugugguuugucccuucuaucaaggcuggaaaugacauugcgaacugccugagaaaguccggcaaaaaggugauccagcugagccgcaaaacguucgauacagaauaccccaagaccaaacucacagacugggauuuugucgugaccacggacauuucugagaugggggccaacuucagagcuggacggguuaucgauccgcgcagaugucugaagccugugauccuuaccgacggccccgaacgggugauucuggccgggcccaucccugucacacccgccagcgcugcccaacgcagaggccggauuggaagaaauccugcgcaggaggaugaccaguauguuuucuccggcgauccgcucaagaacgacgaagaucaugcucacuggaccgaggccaaaaugcugcuggacaauaucuacacacccgaggggauuaucccuacccucuuuggacccgaacgcgagaagacacaggccauugauggcgaauuccggcuuagaggggagcaacgcaaaaccuuuguggagcugaugcggagaggagaccugccuguguggcucucuuauaaggucgcuagcgccggcaucuccuacaaagaccgggaauggugcuucacgggcgagcgcaacaaucagauccuggaagagaacauggaaguggagauuuggacaagagagggggaaaagaagaaacuucggcccaaguggcuggaugcgcgcguuuaugccgacccgauggcucucaaagauuuuaaggaguucgccucuggaagaaaaagcaucacccuggacauucugaccgaaaucgcuucccucccuacauaccuuagcucucgggccaagcuggcucuggauaauauugugaugcuccauaccacagagcgcggcgggagagccuaccagcacgcgcugaacgaacuucccgagucccuggagacgcucaugcuggucgcccugcucggagcuaugaccgccggcaucuuucuuuucuuuaugcaggggaagggaaucggcaaacugagcaugggccugauuacaaucgcuguggccuccgggcuccugugggucgccgaaauucaaccucaguggaucgcugcgucuauuauccuugaguucuuucugauggugcuccugauccccgaaccugagaagcagcggaccccccaggacaaucaacugauuuauguuauccucacaauucuuaccaucauuggacugaucgccgcuaacgaaaugggccugauugagaaaacgaagaccgauuucggguuuuaccaggugaaaacagagaccacaauccucgacgucgaucugcgcccggccagcgccuggacccuuuaugcuguggccacgacaauccugaccccuaugcucagacacacaauugaaaauaccuccgcgaaccugucucuggccgcuaucgccaaucaggcugccguucucaugggacuuggcaagggguggccccugcaucggauggaccugggagugccccuccuggcgaugggcuguuacagccaggucaacccuaccacacuuacggccucccuggugaugcuccuggugcacuaugcuauuaucggcccggggcugcaagccaaagcuaccagagaggcccagaagcgcacagcugccggaauuaugaagaaucccaccguugauggcaucacagucaucgaccucgaaccuauuagcuacgaucccaaauucgagaagcagcuugggcaagugaugcugcuggugcucugcgcgggacagcugcuucugaugcggaccacgugggccuucugugagguccucacacuggcuaccggcccuauccugacccucugggaagggaaccccggaagauuuuggaacacaaccauugccguuucuacagcuaauaucuuccgcggcuccuaucuugccggcgccgggcuggcguuuagccugauuaaaaacgcucagacgccucggagaggaaccggcacagccggggagacccucggagaaaaguggaaacgccagcugaauucucuugaccggaaggaguucgaagaguacaagagauccggcauccuggagguggaccgcacagaagcuaaaagcgcccucaaggaugggucuaaaaucaagcaugccgugagccggggauccucuaaaauuagauggaucgucgagcgcggcauggugaagccgaagggcaaaguuguggaccuggggugcggacggggcggguggagcuacuauauggcuacccugaagaacgucacggaagugaaaggauacaccaagggcgggcccggacacgaggaaccuauucccauggccacauauggcuggaaucucguuaaacuucauuccggcguggaugucuuuuacaagccuaccgagcaaguggacacacugcugugugauaucggggagagcuccucuaaccccaccauugaagagggaagaacacuccgcgugcugaagauggucgaaccguggcuuagcuccaaaccugaguucugcaucaagguucugaaucccuauaugcccaccgugauugaagagcucgagaaacugcagagaaagcacggcgggaaccuggugcgguguccucucucucgcaauagcacgcacgaaauguacugggucuccggagcgucuggcaacaucgugagcuccguuaauacaaccagcaaaaugcuucugaacagauuuaccacacggcauagaaagcccacguaugagaaagacguggaucugggggccggaacccggucugucuccacagaaaucgagaagccugacaugaccauuaucggccgcagacuccagcggcugcaggaggaacacaaggagacauggcauuacgaucaagaaaauccguaccgcaccugggcuuaucacggcagcuacgaggcccccucuacaggguccgcuagcucuauggugaacggaguugugaaacuucugaccaagccuugggacgucauucccauggugacgcagcucgccaugaccgauacaaccccuuucggccagcagagaguuuuuaaagaaaagguggacacacggaccccccaaccgaaaccugggacgcgcauggucaugacaaccacagcgaauuggcugugggcccugcucggaaagaagaaaaaccccagacugugcacccgggaggaguucaucuccaaggugcgcagcaaugcugccauuggcgcugucuuucaggaagagcagggguggacguccgccagcgaagcugugaacgacucuagauucugggagcuuguugauaaagaacgggcccugcaccaagagggcaagugugagagcugcguguauaacaugaugggaaaacgcgaaaagaagcucggcgaguuugggagagcgaaaggaucccgggccaucugguacauguggcugggcgcucgcuuccuugaauucgaggcccugggguuucucaaugaagaccauugguucggaagagagaacucuuggagcggcgucgagggggaaggccugcaccggcugggauauauccucgaggaaauugauaagaaagacggcgaucugauguacgcugacgauaccgccgggugggacacaagaaucaccgaggaugaccuucagaaugaggaacugauuacagagcagauggccccucaucacaagauccucgcgaaagcuauuuuuaagcugaccuaucagaacaagguggugaaaguucuucgccccacaccucggggagccgugauggauaucaucuccagaaaggaccaacgcggcucugggcaggucggaaccuacggccugaauacguucacaaacauggaagugcagcucauucggcagauggaggccgaagggguuaucacccaagaugacaugcagaaucccaaaggccugaaggagagaguggagaaauggcugcgcgaaugcggagucgaccggcucaagagaauggcuauuagcggcgaugacuguguggucaaaccgcuggaugagcgcuuugggaccucccuucuguuccucaacgacaugggaaaggugcggaaggauaucccucagugggaacccucuaaaggcuggaagaauuggcaggagguucccuuuugcagccaucacuuccacaaaauuuuuaugaaggacgggagaucccugguggucccuugucgcaaccaagaugaacuuaucggacgggccagaaucagccagggcgcuggguggucucugcgggagacagccugccucggcaaagcguacgcccagauguggucccugauguauuuccauagacgcgaccugcggcucgcuagcauggccauuuguucugcugugccgaccgagugguuucccacauccagaacgaccuggagcauccacgcccaucaccaguggaugacaaccgaagauaugcugaagguuuggaaucgcguguggauugaggacaacccuaauaugaucgauaagacacccguccacuccugggaagacauuccuuaccuuggaaaaagagaggaccuguggugcggcucucucaucgggcugagcucccgggcgaccugggccaagaacauucauacggcuaucacccaagugcgcaaucuuaucggaaaagaagaguauguggauuacaugagcguuaugaagagauauucugcccccuccgagagcgaaggcguccuguga

SEQ ID NO: 21044 - RNA, 9867 nt, Artificial Sequence
  derived and/or modified CDS sequence (opt5) from DENV-4__KJ579240__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccgugacaugcaucgcugucggcgggauuacccuuuuccucggcuuuaccgugcaggccgacaugggauguguggucagcuggucuggccgggagcugaagugcggguccggaaucuucguuguggauaaugugcauacauggaccgaacaauacaaauuucagcccgagagcccugcgagacuggccuccgcuauucucaacgcccacaaggacggcgucugugggauccgcucuacaacgcggcuggagaaugugauguggaaacagauuaccaacgaacuuaauuauguucugugggagggaggccacgaccucacaguggucgcuggcgaugugaaggggguucugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguggaggauuacggauucggcauguuuaccacaaauauuuggaugaaguuccgggaagggagcucugaggucugugaccauagacugauguccgcugccaucaaagaucagaaggccgugcacgcugacaugggauauuggauugaaagcucuaaaaaccaaaccuggcagaucgagcgcgcgucccugauugaaguuaagacaugccucuggcccaagacccauacgcuguggagcaauggcgugcuugagucucagaugcugaucccuaaaagcuacgccggccccuuuucccagcacaacuaucggcaaggguacgcuacacagaccgucggaccuuggcaccucggcaagcuggagaucgauuucggggaaugccccggaaccacagugaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggucaaaucccaaguuacagccgggcagggaaccucugaaacguucagcaugggccuccugugccuuacccuguuuguggaggaaugucucagacggcgcgugacaagaaagcacaugauucuggcugucgugaucacccugugcgccauuauccuugggggacucacauggauggaccugcugcgggcgcucaucaugcugggcgauaccauguccgggcgcauuggaggccagacgcaucuugcuaucauugccguuuucaagaugucuccuggcuacgugcugggggucuuucucagaaaacugacaagccgggagaccgcccugauggugaucggaauggcuaugacaaccacccuuuccauuccgcacgaccugauggagcucaucgacggcaucucucuggggcucauucugcuuaagaucguuacacaguucgauaacacgcaagugggaacccuggcccucagccugacauuuauucgcuccaccaugagccuggucauggcguggagaacaaucauggcugugcuuuucgucgugacccugauuccccucugucggacgucuugccugcagaaacagucccauuggguugaaaucacagcccucauucugggcgcccaagcucuuccuguguaucugaugacccucaugaagggggccagcagacgcucuuggccccugaaugagggaaucauggcugucggccuggugucccuucugggcagcgcccuccugaaaaacgacguuccucucgcggggcccaugguggccggaggccugcuucuggcugccuacgucaugucuggguccagcgcugaucugucccucgaaaaggccgccaaugugcagugggacgagauggcugauaucaccggaagcucuccuauuaucgaagugaagcaggacgaggauggcagcuuuuccauucgggacguugaggaaacaaacaugaucacccugcuugucaaacuggcgcucauuacagugucugggcuguacccccucgccaucccgaucacgaugacccugugguauauguggcaggugaagacacaaagaagcggagcucuuugggaugucccuucccccgccgccacccagaaagcugcccugucugagggcguguaccgcauuaugcagcggggccuguucgggaagacacagguuggagugggcauccacauggaaggggucuuccacaccauguggcaugugacgagaggaagcguuauuugucacgagaccggccgccucgaaccuuccugggcggacgugcggaaugauaugaucucuuaugggggaggcuggagacugggcgacaaaugggauaaggaggaggacguccaagugcuugcuauugaacccgggaagaacccgaaacauguucagacaaagccuggacuguuuaaaacccucacaggcgagaucggggccgugacccuggacuucaagcccggaacaagcggcuccccuaucauuaaucgcaaagggaaggucaucggccucuacggaaacggcguggugacgaaaagcggggauuaugucucugccauuacccaggcugaacggaucggagagcccgacuacgagguugaugaagacauuuuuagaaagaagcggcugacaaucauggaucuucaccccggcgccgggaaaaccaagcgcauucugccuuccaucgugagagaggcgcugaaacggcgccucagaacccugauccuugcuccgacacggguggucgccgccgaaauggaggaagcucugagaggacuccccauucgcuaucagacgccugccgugaagagcgagcauaccggccgggagaucguugaccugaugugccacgcuacauucaccacaagacuccugucuuccacccgcgugcccaauuacaaccuuauugucauggaugaagcccacuuuacggacccuagcuccguggcggcccggggguacaucucuacaagaguugagaugggcgaagcugccgcuauuuucaugaccgccacccccccuggagccacagauccguuuccccaaagcaauuccccuaucgaggacaucgaacgcgagauucccgagcggagcuggaacaccggcuucgauuggaucacagacuaucaggggaaaaccgugugguuugucccuucuauuaaggcuggaaaugacaucgcgaacugccugagaaaguccggcaaaaaggugauucagcugagccgcaaaacguucgauacagaauaccccaagaccaaacucacagacugggauuuugucgugaccacggacaucucugagaugggggccaacuucagagcuggacggguuaucgauccgcgcagaugucugaagccugugauucuuaccgacggccccgaacgggugauccuggccgggcccauuccugucacacccgccagcgcugcccaacgcagaggccggaucggaagaaauccugcgcaggaggaugaccaguauguuuucuccggcgauccgcucaagaacgacgaagaucaugcucacuggaccgaggccaaaaugcugcuggacaauauuuacacacccgaggggaucauuccuacccucuuuggacccgaacgcgagaagacacaggccaucgauggcgaauuccggcuuagaggggagcaacgcaaaaccuuuguggagcugaugcggagaggagaccugccuguguggcucucuuauaaggucgcuagcgccggcaucuccuacaaagaccgggaauggugcuucacgggcgagcgcaacaaucagauucuggaagagaacauggaaguggagaucuggacaagagagggggaaaagaagaaacuucggcccaaguggcuggaugcgcgcguuuaugccgacccgauggcucucaaagauuuuaaggaguucgccucuggaagaaaaagcauuacccuggacauccugaccgaaauugcuucccucccuacauaccuuagcucucgggccaagcuggcucuggauaauaucgugaugcuccauaccacagagcgcggcgggagagccuaccagcacgcgcugaacgaacuucccgagucccuggagacgcucaugcuggucgcccugcucggagcuaugaccgccggcaucuuucuuuucuuuaugcaggggaagggaauuggcaaacugagcaugggccugaucacaauugcuguggccuccgggcuccugugggucgccgaaauccaaccucaguggauugcugcgucuaucauccuugaguucuuucugauggugcuccugauucccgaaccugagaagcagcggaccccccaggacaaucaacugaucuauguuauucucacaauccuuaccauuaucggacugauugccgcuaacgaaaugggccugaucgagaaaacgaagaccgauuucggguuuuaccaggugaaaacagagaccacaauccucgacgucgaucugcgcccggccagcgccuggacccuuuaugcuguggccacgacaauucugaccccuaugcucagacacacaaucgaaaauaccuccgcgaaccugucucuggccgcuauugccaaucaggcugccguucucaugggacuuggcaagggguggccccugcaucggauggaccugggagugccccuccuggcgaugggcuguuacagccaggucaacccuaccacacuuacggccucccuggugaugcuccuggugcacuaugcuaucauuggcccggggcugcaagccaaagcuaccagagaggcccagaagcgcacagcugccggaaucaugaagaaucccaccguugauggcaucacagucauugaccucgaaccuaucagcuacgaucccaaauucgagaagcagcuugggcaagugaugcugcuggugcucugcgcgggacagcugcuucugaugcggaccacgugggccuucugugagguccucacacuggcuaccggcccuauucugacccucugggaagggaaccccggaagauuuuggaacacaaccaucgccguuucuacagcuaauauuuuccgcggcuccuaucuugccggcgccgggcuggcguuuagccugaucaaaaacgcucagacgccucggagaggaaccggcacagccggggagacccucggagaaaaguggaaacgccagcugaauucucuugaccggaaggaguucgaagaguacaagagauccggcauccuggagguggaccgcacagaagcuaaaagcgcccucaaggaugggucuaaaauuaagcaugccgugagccggggauccucuaaaaucagauggauugucgagcgcggcauggugaagccgaagggcaaaguuguggaccuggggugcggacggggcggguggagcuacuauauggcuacccugaagaacgucacggaagugaaaggauacaccaagggcgggcccggacacgaggaaccuauccccauggccacauauggcuggaaucucguuaaacuucauuccggcguggaugucuuuuacaagccuaccgagcaaguggacacacugcugugugauauuggggagagcuccucuaaccccaccaucgaagagggaagaacacuccgcgugcugaagauggucgaaccguggcuuagcuccaaaccugaguucugcauuaagguucugaaucccuauaugcccaccgugaucgaagagcucgagaaacugcagagaaagcacggcgggaaccuggugcgguguccucucucucgcaauagcacgcacgaaauguacugggucuccggagcgucuggcaacaucgugagcuccguuaauacaaccagcaaaaugcuucugaacagauuuaccacacggcauagaaagcccacguaugagaaagacguggaucugggggccggaacccggucugucuccacagaaauugagaagccugacaugaccaucauuggccgcagacuccagcggcugcaggaggaacacaaggagacauggcauuacgaucaagaaaauccguaccgcaccugggcuuaucacggcagcuacgaggcccccucuacaggguccgcuagcucuauggugaacggaguugugaaacuucugaccaagccuugggacgucauccccauggugacgcagcucgccaugaccgauacaaccccuuucggccagcagagaguuuuuaaagaaaagguggacacacggaccccccaaccgaaaccugggacgcgcauggucaugacaaccacagcgaauuggcugugggcccugcucggaaagaagaaaaaccccagacugugcacccgggaggaguucauuuccaaggugcgcagcaaugcugccaucggcgcugucuuucaggaagagcagggguggacguccgccagcgaagcugugaacgacucuagauucugggagcuuguugauaaagaacgggcccugcaccaagagggcaagugugagagcugcguguauaacaugaugggaaaacgcgaaaagaagcucggcgaguuugggagagcgaaaggaucccgggccaucugguacauguggcugggcgcucgcuuccuugaauucgaggcccugggguuucucaaugaagaccauugguucggaagagagaacucuuggagcggcgucgagggggaaggccugcaccggcugggauauauucucgaggaaaucgauaagaaagacggcgaucugauguacgcugacgauaccgccgggugggacacaagaauuaccgaggaugaccuucagaaugaggaacugaucacagagcagauggccccucaucacaagauucucgcgaaagcuaucuuuaagcugaccuaucagaacaagguggugaaaguucuucgccccacaccucggggagccgugauggauaucauuuccagaaaggaccaacgcggcucugggcaggucggaaccuacggccugaauacguucacaaacauggaagugcagcucauccggcagauggaggccgaagggguuauuacccaagaugacaugcagaaucccaaaggccugaaggagagaguggagaaauggcugcgcgaaugcggagucgaccggcucaagagaauggcuaucagcggcgaugacuguguggucaaaccgcuggaugagcgcuuugggaccucccuucuguuccucaacgacaugggaaaggugcggaaggauauuccucagugggaacccucuaaaggcuggaagaauuggcaggagguucccuuuugcagccaucacuuccacaaaaucuuuaugaaggacgggagaucccugguggucccuugucgcaaccaagaugaacuuaucggacgggccagaauuagccagggcgcuggguggucucugcgggagacagccugccucggcaaagcguacgcccagauguggucccugauguauuuccauagacgcgaccugcggcucgcuagcauggccaucuguucugcugugccgaccgagugguuucccacauccagaacgaccuggagcauucacgcccaucaccaguggaugacaaccgaagauaugcugaagguuuggaaucgcguguggaucgaggacaacccuaauaugauugauaagacacccguccacuccugggaagacaucccuuaccuuggaaaaagagaggaccuguggugcggcucucucauugggcugagcucccgggcgaccugggccaagaacauccauacggcuaucacccaagugcgcaaucuuauuggaaaagaagaguauguggauuacaugagcguuaugaagagauauucugcccccuccgagagcgaaggcguccuguga

SEQ ID NO: 21045 - RNA, 9867 nt, Artificial Sequence
  derived and/or modified CDS sequence (opt5) from DENV-4__KJ596658__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucauucugggcgauaccauguccgggcgcaucggaggccagacgcaucuugcuauuauggccguguucaagaugucuccuggcuacguucuggggguguuucucagaaaacugacaagccgggagaccgcccugauggucaucggaauggcuaugacaaccacccuuuccauuccgcacgaccugauggagcucaucgacggcaucucucuggggcucauucugcuuaagaucgugacacaguucgauaacacgcaaguuggaacccuggcccucagccugacauuuauucgcuccaccaugagccuggugauggcguggagaacaaucauggcuguccuuuucguggucacccugauuccccucugucggacgucuugccugcagaaacagucccauuggguggaaaucacagcccucauucugggcgcccaagcucuuccuguuuaucugaugacccucaugaagggggccagcagacgcucuuggccccugaaugagggaaucauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuauuaucgaagugaagcaggacgaggauggcagcuuuuccauucgggacguggaggaaacaaacaugaucacccugcuuguuaaacuggcgcucauuacagucucugggcuguacccccucgccaucccgaucacgaugacccugugguauauguggcaggugaagacacaaagaagcggagcucuuugggaugugccuucccccgccgccacccagaaagcugcccugucugagggcgucuaccgcauuaugcagcggggccuguucgggaagacacaggugggaguuggcauccacauggaagggguguuccacaccauguggcaugucacgagaggaagcgugauuugucacgagaccggccgccucgaaccuuccugggcggacguucggaaugauaugaucucuuaugggggaggcuggagacugggcgacaaaugggauaaggaggaggacgugcaaguccuugcuauugaacccgggaagaacccgaaacaugugcagacaaagccuggacuguuuaaaacccucacaggcgagaucggggccguuacccuggacuucaagcccggaacaagcggcuccccuaucauuaaucgcaaagggaaggugaucggccucuacggaaacggcgucgugacgaaaagcggggauuaugugucugccauuacccaggcugaacggaucggagagcccgacuacgaggucgaugaagacauuuuuagaaagaagcggcugacaaucauggaucuucaccccggcgccgggaaaaccaagcgcauucugccuuccaucguuagagaggcgcugaaacggcgccucagaacccugauccuugcuccgacacgggugguggccgccgaaauggaggaagcucugagaggacuccccauucgcuaucagacgccugccgucaagagcgagcauaccggccgggagaucguggaccugaugugccacgcuacauucaccacaagacuccugucuuccacccgcguucccaauuacaaccuuauugugauggaugaagcccacuuuacggacccuagcuccgucgcggcccggggguacaucucuacaagaguggagaugggcgaagcugccgcuauuuucaugaccgccacccccccuggagccacagauccguuuccccaaagcaauuccccuaucgaggacaucgaacgcgagauucccgagcggagcuggaacaccggcuucgauuggaucacagacuaucaggggaaaaccguuugguuugugccuucuauuaaggcuggaaaugacaucgcgaacugccugagaaaguccggcaaaaaggucauucagcugagccgcaaaacguucgauacagaauaccccaagaccaaacucacagacugggauuuuguggucaccacggacaucucugagaugggggccaacuucagagcuggacgggugaucgauccgcgcagaugucugaagccuguuauucuuaccgacggccccgaacgggugauccuggccgggcccauuccugugacacccgccagcgcugcccaacgcagaggccggaucggaagaaauccugcgcaggaggaugaccaguaugucuucuccggcgauccgcucaagaacgacgaagaucaugcucacuggaccgaggccaaaaugcugcuggacaauauuuacacacccgaggggaucauuccuacccucuuuggacccgaacgcgagaagacacaggccaucgauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauucuggaagagaacauggaagucgagaucuggacaagagagggggaaaagaagaaacuucggcccaaguggcuggaugcgcgcguguaugccgacccgauggcucucaaagauuuuaaggaguucgccucuggaagaaaaagcauuacccuggacauccugaccgaaauugcuucccucccuacauaccuuagcucucgggccaagcuggcucuggauaauaucguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaauuggcaaacugagcaugggccugaucacaauugcugucgccuccgggcuccuguggguggccgaaauccaaccucaguggauugcugcgucuaucauccuugaguucuuucugaugguccuccugauucccgaaccugagaagcagcggaccccccaggacaaucaacugaucuaugugauucucacaauccuuaccauuaucggacugauugccgcuaacgaaaugggccugaucgagaaaacgaagaccgauuucggguuuuaccagguuaaaacagagaccacaauccucgacguggaucugcgcccggccagcgccuggacccuuuaugcugucgccacgacaauucugaccccuaugcucagacacacaaucgaaaauaccuccgcgaaccugucucuggccgcuauugccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuaucauuggcccggggcugcaagccaaagcuaccagagaggcccagaagcgcacagcugccggaaucaugaagaaucccaccguggauggcaucacaguuauugaccucgaaccuaucagcuacgaucccaaauucgagaagcagcuugggcaagucaugcugcuggugcucugcgcgggacagcugcuucugaugcggaccacgugggccuucugugaggugcucacacuggcuaccggcccuauucugacccucugggaagggaaccccggaagauuuuggaacacaaccaucgccgucucuacagcuaauauuuuccgcggcuccuaucuugccggcgccgggcuggcguuuagccugaucaaaaacgcucagacgccucggagaggaaccggcacagccggggagacccucggagaaaaguggaaacgccagcugaauucucuugaccggaaggaguucgaagaguacaagagauccggcauccuggagguugaccgcacagaagcuaaaagcgcccucaaggaugggucuaaaauuaagcaugccgugagccggggauccucuaaaaucagauggauuguggagcgcggcauggucaagccgaagggcaaagugguugaccuggggugcggacggggcggguggagcuacuauauggcuacccugaagaacgugacggaagucaaaggauacaccaagggcgggcccggacacgaggaaccuauccccauggccacauauggcuggaaucucgugaaacuucauuccggcguugauguguuuuacaagccuaccgagcaagucgacacacugcugugugauauuggggagagcuccucuaaccccaccaucgaagagggaagaacacuccgcgugcugaagaugguggaaccguggcuuagcuccaaaccugaguucugcauuaagguccugaaucccuauaugcccaccguuaucgaagagcucgagaaacugcagagaaagcacggcgggaaccuggugcgguguccucucucucgcaauagcacgcacgaaauguacuggguguccggagcgucuggcaacaucgucagcuccgugaauacaaccagcaaaaugcuucugaacagauuuaccacacggcauagaaagcccacguaugagaaagacguugaucugggggccggaacccggucuguguccacagaaaccgagaagccugacaugacaauuaucggccgcagacuccagcggcugcaggaggaacacaaggagaccuggcauuacgaucaagaaaauccguaccgcacaugggcuuaucacggcagcuacgaggcccccucuaccggguccgcuagcucuauggucaacggagugguuaaacuucugacgaagccuugggacgugauucccauggucacccagcucgccaugacagauaccacaccuuucggccagcagagaguguuuaaagaaaagguugacacccggacgccccaaccgaaaccugggacacgcauggugaugaccacaaccgcgaauuggcugugggcccugcucggaaagaagaaaaaccccagacugugcacgcgggaggaguucaucuccaagguccgcagcaaugcugccauuggcgcuguguuucaggaagagcagggguggaccuccgccagcgaagcugucaacgacucuagauucugggagcuuguggauaaagaacgggcccugcaccaagagggcaagugugagagcugcguuuauaacaugaugggaaaacgcgaaaagaagcucggcgaguuugggagagcgaaaggaucccgggccaucugguacauguggcugggcgcucgcuuccuugaauucgaggcccugggguuucucaaugaagaccauugguucggaagagagaacucuuggagcggcguggagggggaaggccugcaccggcugggauauauccucgaggaaauugauaagaaagacggcgaucugauguacgcugacgauacagccgggugggacaccagaaucacagaggaugaccuucagaaugaggaacugauuaccgagcagauggccccucaucacaagauccucgcgaaagcuauuuuuaagcugacauaucagaacaaggucgugaaagugcuucgccccaccccucggggagccguuauggauaucaucuccagaaaggaccaacgcggcucugggcaggugggaacguacggccugaauacauucaccaacauggaaguccagcucauucggcagauggaggccgaaggggugaucacccaagaugacaugcagaaucccaaaggccugaaggagagaguugagaaauggcugcgcgaaugcggaguggaccggcucaagagaauggcuauuagcggcgaugacugugucgugaaaccgcuggaugagcgcuuugggacaucccuucuguuccucaacgacaugggaaagguccggaaggauaucccucagugggaacccucuaaaggcuggaagaauuggcaggaggugcccuuuugcagccaucacuuccacaaaauuuuuaugaaggacgggagaucccugguugugccuugucgcaaccaagaugaacuuaucggacgggccagaaucagccagggcgcuggguggucucugcgggagaccgccugccucggcaaagcguacgcccagauguggucccugauguauuuccauagacgcgaccugcggcucgcuagcauggccauuuguucugcugucccgacagagugguuucccacguccagaaccacauggagcauccacgcccaucaccaguggaugaccacagaagauaugcugaagguguggaaucgcguuuggauugaggacaacccuaauaugaucgauaagacccccgugcacuccugggaagacauuccuuaccuuggaaaaagagaggaccuguggugcggcucucucaucgggcugagcucccgggcgacgugggccaagaacauucauaccgcuaucacacaaguccgcaaucuuaucggaaaagaagaguauguggauuacaugcccgugaugaagagauauagcgccccuucugaguccgaaggcguucuguga

SEQ ID NO: 21046 - RNA, 9867 nt, Artificial Sequence
  derived and/or modified CDS sequence (opt5) from DENV-4__KJ596659__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaaucauaaagagagaauggugacauucaaggucccccacgcuaaacgccaggaugugaccguucucggcucccaggaaggagccaugcacagcgcccuggcuggcgcgacagagguggacuccggggauggaaaccauauguuugccggccaccuuaaguguaagguccggauggaaaaacugagaaucaaggggaugucuuacaccaugugcagcggaaaauucuccauugacaaggagauggcugagacgcaacauggcacaaccguggugaaaguuaaguaugaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuacauugugaucggggucggaaacagcgcgcugacacuccacugguuuagaaaaggcucuagcauugggaagauguucgaguccacguaucgcggagcuaaacggauggccauccugggcgaaaccgccugggauuuugggucugugggcggacuuuucacaagccugggcaaggcuguucaucagguguuuggguccgucuacaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcacacauggaccgaacaauauaaauuucagcccgagagcccugcgagacuggccuccgcuauucucaacgcccacaaggacggcgugugugggauccgcucuacaacgcggcuggagaaugucauguggaaacagauuaccaacgaacuuaauuacgugcugugggagggaggccaugaccucacaguuguggcuggcgaugucaagggggugcugaccaaaggaaagagagcccugacacccccugcgagcgaccuuaaguauuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccacagacugauguccgcugccaucaaagaucagaaggccguccaugcugacaugggauacuggauugaaagcucuaaaaaccaaaccuggcagaucgagcgcgcgucccugauugaagugaagacaugccucuggcccaagacccacacgcuguggagcaauggcguucuugagucucagaugcugaucccuaaaagcuaugccggccccuuuucccagcacaacuaccggcaaggguaugcuacacagaccgugggaccuuggcaucucggcaagcuggagaucgauuucggggaaugccccggaaccacagucaccauucaggagaacugugaccacagaggcccgagccugcgcacgacaaccgccucugggaaacuugugacacaguggugcuguagauccugcaccaugccuccccuccgguuucugggagaagauggcuguugguacggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcauaugauucuggcuguggucaucacccugugcgccauuauccuugggggacucacauggauggaccugcugcgggcgcucaucauucugggcgauaccauguccgggcgcaucggaggccagacgcaccuugcuauuauggccguguucaagaugucuccuggcuauguucuggggguguuucucagaaaacugacaagccgggagaccgcccugauggucaucggaauggcuaugacaaccacccuuuccauuccgcaugaccugauggagcucaucgacggcaucucucuggggcucauucugcuuaagaucgugacacaguucgauaacacgcaaguuggaacccuggcccucagccugacauuuauucgcuccaccaugagccuggugauggcguggagaacaaucauggcuguccuuuucguggucacccugauuccccucugucggacgucuugccugcagaaacagucccacuggguggaaaucacagcccucauucugggcgcccaagcucuuccuguuuaccugaugacccucaugaagggggccagcagacgcucuuggccccugaaugagggaaucauggcugugggccuggucucccuucugggcagcgcccuccugaaaaacgacgugccucucgcggggcccaugguugccggaggccugcuucuggcugccuaugugaugucuggguccagcgcugaucugucccucgaaaaggccgccaauguccagugggacgagauggcugauaucaccggaagcucuccuauuaucgaagugaagcaggacgaggauggcagcuuuuccauucgggacguggaggaaacaaacaugaucacccugcuuguuaaacuggcgcucauuacagucucugggcuguacccccucgccaucccgaucacgaugacccugugguacauguggcaggugaagacacaaagaagcggagcucuuugggaugugccuucccccgccgccacccagaaagcugcccugucugagggcgucuaucgcauuaugcagcggggccuguucgggaagacacaggugggaguuggcauccacauggaagggguguuccauaccauguggcacgucacgagaggaagcgugauuugucaugagaccggccgccucgaaccuuccugggcggacguucggaaugauaugaucucuuacgggggaggcuggagacugggcgacaaaugggauaaggaggaggacgugcaaguccuugcuauugaacccgggaagaacccgaaacacgugcagacaaagccuggacuguuuaaaacccucacaggcgagaucggggccguuacccuggacuucaagcccggaacaagcggcuccccuaucauuaaucgcaaagggaaggugaucggccucuauggaaacggcgucgugacgaaaagcggggauuacgugucugccauuacccaggcugaacggaucggagagcccgacuaugaggucgaugaagacauuuuuagaaagaagcggcugacaaucauggaucuucaucccggcgccgggaaaaccaagcgcauucugccuuccaucguuagagaggcgcugaaacggcgccucagaacccugauccuugcuccgacacgggugguggccgccgaaauggaggaagcucugagaggacuccccauucgcuaccagacgccugccgucaagagcgagcacaccggccgggagaucguggaccugaugugccacgcuacauucaccacaagacuccugucuuccacccgcguucccaauuauaaccuuauugugauggaugaagcccauuuuacggacccuagcuccgucgcggcccggggguacaucucuacaagaguggagaugggcgaagcugccgcuauuuucaugaccgccacccccccuggagccacagauccguuuccccaaagcaauuccccuaucgaggacaucgaacgcgagauucccgagcggagcuggaacaccggcuucgauuggaucacagacuaccaggggaaaaccguuugguuugugccuucuauuaaggcuggaaaugacaucgcgaacugccugagaaaguccggcaaaaaggucauucagcugagccgcaaaacguucgauacagaauaucccaagaccaaacucacagacugggauuuuguggucaccacggacaucucugagaugggggccaacuucagagcuggacgggugaucgauccgcgcagaugucugaagccuguuauucuuaccgacggccccgaacgggugauccuggccgggcccauuccugugacacccgccagcgcugcccaacgcagaggccggaucggaagaaauccugcgcaggaggaugaccaguacgucuucuccggcgauccgcucaagaacgacgaagaucacgcucauuggaccgaggccaaaaugcugcuggacaauauuuauacacccgaggggaucauuccuacccucuuuggacccgaacgcgagaagacacaggccaucgauggcgaauuccggcuuagaggggagcaacgcaaaaccuuuguugagcugaugcggagaggagaccugccuguguggcucucuuacaagguggcuagcgccggcaucuccuauaaagaccgggaauggugcuucacgggcgagcgcaacaaucagauucuggaagagaacauggaagucgagaucuggacaagagagggggaaaagaagaaacuucggcccaaguggcuggaugcgcgcguguacgccgacccgauggcucucaaagauuuuaaggaguucgccucuggaagaaaaagcauuacccuggacauccugaccgaaauugcuucccucccuacauaucuuagcucucgggccaagcuggcucuggauaauaucguuaugcuccacaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaauuggcaaacugagcaugggccugaucacaauugcugucgccuccgggcuccuguggguggccgaaauccaaccucaguggauugcugcgucuaucauccuugaguucuuucugaugguccuccugauucccgaaccugagaagcagcggaccccccaggacaaucaacugaucuacgugauucucacaauccuuaccauuaucggacugauugccgcuaacgaaaugggccugaucgagaaaacgaagaccgauuucggguuuuaucagguuaaaacagagaccacaauccucgacguggaucugcgcccggccagcgccuggacccuuuacgcugucgccacgacaauucugaccccuaugcucagacauacaaucgaaaauaccuccgcgaaccugucucuggccgcuauugccaaucaggcugccgugcucaugggacuuggcaagggguggccccugcaccggauggaccugggaguuccccuccuggcgaugggcuguuauagccaggugaacccuaccacacuuacggccucccuggucaugcuccuggugcauuacgcuaucauuggcccggggcugcaagccaaagcuaccagagaggcccagaagcgcacagcugccggaaucaugaagaaucccaccguggauggcaucacaguuauugaccucgaaccuaucagcuaugaucccaaauucgagaagcagcuugggcaagucaugcugcuggugcucugcgcgggacagcugcuucugaugcggaccacgugggccuucugugaggugcucacacuggcuaccggcccuauucugacccucugggaagggaaccccggaagauuuuggaacacaaccaucgccgucucuacagcuaauauuuuccgcggcuccuaccuugccggcgccgggcuggcguuuagccugaucaaaaacgcucagacgccucggagaggaaccggcacagccggggagacccucggagaaaaguggaaacgccagcugaauucucuugaccggaaggaguucgaagaguauaagagauccggcauccuggagguugaccgcacagaagcuaaaagcgcccucaaggaugggucuaaaauuaagcacgccgugagccggggauccucuaaaaucagauggauuguggagcgcggcauggucaagccgaagggcaaagugguugaccuggggugcggacggggcggguggagcuacuacauggcuacccugaagaacgugacggaagucaaaggauauaccaagggcgggcccggacaugaggaaccuauccccauggccacauacggcuggaaucucgugaaacuucacuccggcguugauguguuuuauaagccuaccgagcaagucgacacacugcugugugauauuggggagagcuccucuaaccccaccaucgaagagggaagaacacuccgcgugcugaagaugguggaaccguggcuuagcuccaaaccugaguucugcauuaagguccugaaucccuacaugcccaccguuaucgaagagcucgagaaacugcagagaaagcacggcgggaaccuggugcgguguccucucucucgcaauagcacgcaugaaauguauuggguguccggagcgucuggcaacaucgucagcuccgugaauacaaccagcaaaaugcuucugaacagauuuaccacacggcacagaaagcccacguacgagaaagacguugaucugggggccggaacccggucuguguccacagaaaccgagaagccugacaugacaauuaucggccgcagacuccagcggcugcaggaggaacauaaggagaccuggcacuaugaucaagaaaauccguaccgcacaugggcuuaccacggcagcuaugaggcccccucuaccggguccgcuagcucuauggucaacggagugguuaaacuucugacgaagccuugggacgugauucccauggucacccagcucgccaugacagauaccacaccuuucggccagcagagaguguuuaaagaaaagguugacacccggacgccccaaccgaaaccugggacacgcauggugaugaccacaaccgcgaauuggcugugggcccugcucggaaagaagaaaaaccccagacugugcacgcgggaggaguucaucuccaagguccgcagcaaugcugccauuggcgcuguguuucaggaagagcagggguggaccuccgccagcgaagcugucaacgacucuagauucugggagcuuguggauaaagaacgggcccugcaucaagagggcaagugugagagcugcguuuacaacaugaugggaaaacgcgaaaagaagcucggcgaguuugggagagcgaaaggaucccgggccaucugguauauguggcugggcgcucgcuuccuugaauucgaggcccugggguuucucaaugaagaccacugguucggaagagagaacucuuggagcggcguggagggggaaggccugcaucggcugggauacauccucgaggaaauugauaagaaagacggcgaucugauguaugcugacgauacagccgggugggacaccagaaucacagaggaugaccuucagaaugaggaacugauuaccgagcagauggccccucaccauaagauccucgcgaaagcuauuuuuaagcugacauaccagaacaaggucgugaaagugcuucgccccaccccucggggagccguuauggauaucaucuccagaaaggaccaacgcggcucugggcaggugggaacguauggccugaauacauucaccaacauggaaguccagcucauucggcagauggaggccgaaggggugaucacccaagaugacaugcagaaucccaaaggccugaaggagagaguugagaaauggcugcgcgaaugcggaguggaccggcucaagagaauggcuauuagcggcgaugacugugucgugaaaccgcuggaugagcgcuuugggacaucccuucuguuccucaacgacaugggaaagguccggaaggauaucccucagugggaacccucuaaaggcuggaagaauuggcaggaggugcccuuuugcagccaccacuuccauaaaauuuuuaugaaggacgggagaucccugguugugccuugucgcaaccaagaugaacuuaucggacgggccagaaucagccagggcgcuggguggucucugcgggagaccgccugccucggcaaagcguacgcccagauguggucccugauguacuuccacagacgcgaccugcggcucgcuagcauggccauuuguucugcugucccgacagagugguuucccacguccagaaccacauggagcauccaugcccaccaccaguggaugaccacagaagauaugcugaagguguggaaucgcguuuggauugaggacaacccuaauaugaucgauaagacccccgugcauuccugggaagacauuccuuaucuuggaaaaagagaggaccuguggugcggcucucucaucgggcugagcucccgggcgacgugggccaagaacauucacaccgcuaucacacaaguccgcaaucuuaucggaaaagaagaguacguggauuauaugcccgugaugaagagauacagcgccccuucugaguccgaaggcguucuguga

SEQ ID NO: 21047 - RNA, 9867 nt, Artificial Sequence
  derived and/or modified CDS sequence (opt5) from DENV-4__KJ596661__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccauguccgggcgcauuggaggccagacgcaucuugcuaucauggccguguucaagaugucuccuggcuacguucuggggguguuucucagaaaacugacaagccgggagaccgcccugauggucauuggaauggcuaugacaaccacccuuuccaucccgcacgaccugauggagcucauugacggcaucucucuggggcucauccugcuuaagauugugacacaguucgauaacacgcaaguuggaacccuggcccucagccugacauuuauccgcuccaccaugagccuggugauggcguggagaacaauuauggcuguccuuuucguggucacccugaucccccucugucggacgucuugccugcagaaacagucccauuggguggaaauuacagcccucauccugggcgcccaagcucuuccuguuuaucugaugacccucaugaagggggccagcagacgcucuuggccccugaaugagggaauuauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuaucauugaagugaagcaggacgaggauggcagcuuuuccauccgggacguggaggaaacaaacaugauuacccugcuuguuaaacuggcgcucaucacagucucugggcuguacccccucgccauuccgaucacgaugacccugugguauauguggcaggugaagacacaaagaagcggagcucuuugggaugugccuucccccgccgccacccagaaagcugcccugucugagggcgucuaccgcaucaugcagcggggccuguucgggaagacacaggugggaguuggcauucacaucgaagggguguuccacaccauguggcaugucacgagaggaagcgugauuugucacgagaccggccgccucgaaccuuccugggcggacguucggaaugauaugaucucuuaugggggaggcuggagacugggcgacaaaugggauaaggaggaggacgugcaaguccuugcuauugaacccgggaagaacccgaaacaugugcagacaaagccuggacuguuuaaaacccucacaggcgagaucggggccguuacccuggacuucaagcccggaacaagcggcuccccuaucauuaaucgcaaagggaaggugaucggccucuacggaaacggcgucgugacgaaaagcggggauuaugugucugccauuacccaggcugaacggaucggagagcccgacuacgaggucgaugaagacauuuuuagaaagaagcggcugacaaucauggaucuucaccccggcgccgggaaaaccaagcgcauucugccuuccaucguuagagaggcgcugaaacggcgccucagaacccugauccuugcuccgacacgggugguggccgccgaaauggaggaagcucugagaggacuccccauucgcuaucagacgccugccgucaagagcgagcauaccggccgggagaucguggaccugaugugccacgcuacauucaccacaagacuccugucuuccacccgcguucccaauuacaaccuuauugugauggaugaagcccacuuuacggacccuagcuccgucgcggcccggggguacaucucuacaagaguggagaugggcgaagcugccgcuauuuucaugaccgccacccccccuggagccacagauccguuuccccaaagcaauuccccuaucgaggacaucgaacgcgagauucccgagcggagcuggaacaccggcuucgauuggaucacagacuaucaggggaaaaccguuugguuugugccuucuauuaaggcuggaaaugacaucgcgaacugccugagaaaguccggcaaaaaggucauucagcugagccgcaaaacguucgauacagaauaccccaagaccaaacucacagacugggauuuuguggucaccacggacaucucugagaugggggccaacuucagagcuggacgggugaucgauccgcgcagaugucugaagccuguuauucuuaccgacggccccgaacgggugauccuggccgggcccauuccugugacacccgccagcgcugcccaacgcagaggccggaucggaagaaauccugcgcaggaggaugaccaguaugucuucuccggcgauccgcucaagaacgacgaagaucaugcucacuggaccgaggccaaaaugcugcuggacaauauuuacacacccgaggggaucauuccuacccucuuuggacccgaacgcgagaagacacaggccaucgauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauucuggaagagaacauggaagucgagaucuggacaagagagggggaaaagaagaaacuucggcccaaguggcuggaugcgcgcguguaugccgacccgauggcucucaaagauuuuaaggaguucgccucuggaagaaaaagcauuacccuggacauccugaccgaaauugcuucccucccuacauaccuuagcucucgggccaagcuggcucuggauaauaucguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaauuggcaaacugagcaugggccugaucacaauugcugucgccuccgggcuccuguggguggccgaaauccaaccucaguggauugcugcgucuaucauccuugaguucuuucugaugguccuccugauucccgaaccugagaagcagcggaccccccaggacaaucaacugaucuaugugauucucacaauccuuaccauuaucggacugauugccgcuaacgaaaugggccugaucgagaaaacgaagaccgauuucggguuuuaccagguuaaaacagagaccacaauccucgacguggaucugcgcccggccagcgccuggacccuuuaugcugucgccacgacaauucugaccccuaugcucagacacacaaucgaaaauaccuccgcgaaccugucucuggccgcuauugccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuaucauuggcccggggcugcaagccaaagcuaccagagaggcccagaagcgcacagcugccggaaucaugaagaaucccaccguggauggcaucacaguuauugaccucgaaccuaucagcuacgaucccaaauucgagaagcagcuugggcaagucaugcugcuggugcucugcgcgggacagcugcuucugaugcggaccacgugggccuucugugaggugcucacacuggcuaccggcccuacccugacacucugggaagggaaccccggaagauuuuggaacaccacaauugccgucucuacggcuaauaucuuccgcggcuccuaucuugccggcgccgggcuggcguuuagccugauuaaaaacgcucagaccccucggagaggaacaggcaccgccggggagacacucggagaaaaguggaaacgccagcugaauucucuugaccggaaggaguucgaagaguacaagagauccggcauccuggagguugaccgcaccgaagcuaaaagcgcccucaaggaugggucuaaaaucaagcaugccgugagccggggauccucuaaaauuagauggaucguggagcgcggcauggucaagccgaagggcaaagugguugaccuggggugcggacggggcggguggagcuacuauauggcuacgcugaagaacgugaccgaagucaaaggauacacaaagggcgggcccggacacgaggaaccuauucccauggccaccuauggcuggaaucucgugaaacuucauuccggcguugauguguuuuacaagccuacagagcaagucgacacccugcugugugauaucggggagagcuccucuaaccccacaauugaagagggaagaacccuccgcgugcugaagaugguggaaccguggcuuagcuccaaaccugaguucugcaucaagguccugaaucccuauaugcccacgguuauugaagagcucgagaaacugcagagaaagcacggcgggaaccuggugcgguguccucucucucgcaauagcacacacgaaauguacuggguguccggagcgucuggcaacaucgucagcuccgugaauaccaccagcaaaaugcuucugaacagauuuacaacgcggcauagaaagcccaccuaugagaaagacguugaucugggggccggaacacggucuguguccaccgaaacagagaagccugacaugaccaucauuggccgcagacuccagcggcugcaggaggaacacaaggagacauggcauuacgaucaagaaaauccguaccgcaccugggcuuaucacggcagcuacgaggcccccucuacgggguccgcuagcucuauggucaacggagugguuaaacuucugaccaagccuugggacgugauccccauggucacacagcucgccaugaccgauacaaccccuuucggccagcagagaguguuuaaagaaaagguugacacgcggacaccccaaccgaaaccugggacccgcauggugaugacaaccacggcgaauuggcugugggcccugcucggaaagaagaaaaaccccagacugugcacccgggaggaguucauuuccaagguccgcagcaaugcugccaucggcgcuguguuucaggaagagcagggguggacauccgccagcgaagcugucaacgacucuagauucugggagcuuguggauaaagaacgggcccugcaccaagagggcaagugugagagcugcguuuauaacaugaugggaaaacgcgaaaagaagcucggcgaguuugggagagcgaaaggaucccgggccauuugguacauguggcugggcgcucgcuuccuugaauucgaggcccugggguuucucaaugaagaccauugguucggaagagagaacucuuggagcggcguggagggggaaggccugcaccggcugggauauauccucgaggaaaucgauaagaaagacggcgaucugauguacgcugacgauaccgccgggugggacacaagaauuaccgaggaugaccuucagaaugaggaacugaucacagagcagauggccccucaucacaagauucucgcgaaagcuaucuuuaagcugaccuaucagaacaaggucgugaaagugcuucgccccacgccucggggagccguuauggauauuaucuccagaaaggaccaacgcggcucugggcaggugggaacauacggccugaauaccuucaccaacauggaaguccagcucauccggcagauggaggccgaaggggugauuacacaagaugacaugcagaaucccaaaggccugaaggagagaguugagaaauggcugcgcgaaugcggaguggaccggcucaagagaauggcuaucagcggcgaugacugugucgugaaaccgcuggaugagcgcuuugggaccucccuucuguuccucaacgacaugggaaaggcccggaaggauauuccucagugggaacccucuaaaggcuggaagaauuggcaggagguccccuuuugcagccaucacuuccacaaaaucuuuaugaaggacgggagaucccuggugguuccuugucgcaaccaagaugaacuuauuggacgggcuagaaucagccagggcgccggguggucucugcgggagacagcgugccucggcaaagccuacgcucagauguggucccugauguauuuccauagacgcgaccugcggcucgccagcauggcuaucuguucugccgugccgacggagugguuucccaccuccagaacaaccuggagcauucacgcgcaucaccaguggaugacaaccgaagauaugcugaaggucuggaaucgcguguggaucgaggacaacccuaauaugauugauaagacgcccguucacuccugggaagacaucccuuaccuuggaaaaagagaggaccuguggugcggcucucucauugggcugagcucccgggccaccugggcuaagaacauccauacagccauuacccaagugcgcaaucuuaucggaaaagaagaguaugucgauuacaugcccgugaugaagagauauagcgcuccuucugaguccgaaggcgugcuguga

SEQ ID NO: 21048 - RNA, 9867 nt, Artificial Sequence
  derived and/or modified CDS sequence (opt5) from DENV-4__KJ596663__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucauucugggcgauaccauguccgggcgcaucggaggccagacgcaucuugcuauuauggccguguucaagaugucuccuggcuacguucuggggguguuucucagaaaacugacaagccgggagaccgcccugauggucaucggaauggcuaugacaaccacccuuuccauuccgcacgaccugauggagcucaucgacggcaucucucuggggcucauucugcuuaagaucgugacacaguucgauaacacgcaaguuggaacccuggcccucagccugacauuuauucgcuccaccaugagccuggugauggcguggagaacaaucauggcuguccuuuucguggucacccugauuccccucugucggacgucuugccugcagaaacagucccauuggguggaaaucacagcccucauucugggcgcccaagcucuuccuguuuaucugaugacccucaugaagggggccagcagacgcucuuggccccugaaugagggaaucauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuauuaucgaagugaagcaggacgaggauggcagcuuuuccauucgggacguggaggaaacaaacaugaucacccugcuuguuaaacuggcgcucauuacagucucugggcuguacccccucgccaucccgaucacgaugacccugugguauauguggcaggugaagacacaaagaagcggagcucuuugggaugugccuucccccgccgccacccagaaagcugcccugucugagggcgucuaccgcauuaugcagcggggccuguucgggaagacacaggugggaguuggcauccacauggaagggguguuccacaccauguggcaugucacgagaggaagcgugauuugucacgagaccggccgccucgaaccuuccugggcggacguucggaaugauaugaucucuuaugggggaggcuggagacugggcgacaaaugggauaaggaggaggacgugcaaguccuugcuauugaacccgggaagaacccgaaacaugugcagacaaagccuggacuguuuaaaacccucacaggcgagaucggggccguuacccuggacuucaagcccggaacaagcggcuccccuaucauuaaucgcaaagggaaggugaucggccucuacggaaacggcgucgugacgaaaagcggggauuaugugucugccauuacccaggcugaacggaucggagagcccgacuacgaggucgaugaagacauuuuuagaaagaagcggcugacaaucauggaucuucaccccggcgccgggaaaaccaagcgcauucugccuuccaucguuagagaggcgcugaaacggcgccucagaacccugauccuugcuccgacacgggugguggccgccgaaauggaggaagcucugagaggacuccccauucgcuaucagacgccugccgucaagagcgagcauaccggccgggagaucguggaccugaugugccacgcuacauucaccacaagacuccugucuuccacccgcguucccaauuacaaccuuauugugauggaugaagcccacuuuacggacccuagcuccgucgcggcccggggguacaucucuacaagaguggagaugggcgaagcugccgcuauuuucaugaccgccacccccccuggagccacagauccguuuccccaaagcaauuccccuaucgaggacaucgaacgcgagauucccgagcggagcuggaacaccggcuucgauuggaucacagacuaucaggggaaaaccguuugguuugugccuucuauuaaggcuggaaaugacaucgcgaacugccugagaaaguccggcaaaaaggucauucagcugagccgcaaaacguucgauacagaauaccccaagaccaaacucacagacugggauuuuguggucaccacggacaucucugagaugggggccaacuucagagcuggacgggugaucgauccgcgcagaugucugaagccuguuauucuuaccgacggccccgaacgggugauccuggccgggcccauuccugugacacccgccagcgcugcccaacgcagaggccggaucggaagaaauccugcgcaggaggaugaccaguaugucuucuccggcgauccgcucaagaacgacgaagaucaugcucacuggaccgaggccaaaaugcugcuggacaauauuuacacacccgaggggaucauuccuacccucuuuggacccgaacgcgagaagacacaggccaucgauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauucuggaagagaacauggaagucgagaucuggacaagagagggggaaaagaagaaacuucggcccaaguggcuggaugcgcgcguguaugccgacccgauggcucucaaagauuuuaaggaguucgccucuggaagaaaaagcauuacccuggacauccugaccgaaauugcuucccucccuacauaccuuagcucucgggccaagcuggcucuggauaauaucguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaauuggcaaacugagcaugggccugaucacaauugcugucgccuccgggcuccuguggguggccgaaauccaaccucaguggauugcugcgucuaucauccuugaguucuuucugaugguccuccugauucccgaaccugagaagcagcggaccccccaggacaaucaacugaucuaugugauucucacaauccuuaccauuaucggacugauugccgcuaacgaaaugggccugaucgagaaaacgaagaccgauuucggguuuuaccagguuaaaacagagaccacaauccucgacguggaucugcgcccggccagcgccuggacccuuuaugcugucgccacgacaauucugaccccuaugcucagacacacaaucgaaaauaccuccgcgaaccugucucuggccgcuauugccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuaucauuggcccggggcugcaagccaaagcuaccagagaggcccagaagcgcacagcugccggaaucaugaagaaucccaccguggauggcaucacaguuauugaccucgaaccuaucagcuacgaucccaaauucgagaagcagcuugggcaagucaugcugcuggugcucugcgcgggacagcugcuucugaugcggaccacgugggccuucugugaggugcucacacuggcuaccggcccuauucugacccucugggaagggaaccccggaagauuuuggaacacaaccaucgccgucucuacagcuaauauuuuccgcggcuccuaucuugccggcgccgggcuggcguuuagccugaucaaaaacgcucagacgccucggagaggaaccggcacagccggggagacccucggagaaaaguggaaacgccagcugaauucucuugaccggaaggaguucgaagaguacaagagauccggcauccuggagguugaccgcacagaagcuaaaagcgcccucaaggaugggucuaaaauuaagcaugccgugagccggggauccucuaaaaucagauggauuguggagcgcggcauggucaagccgaagggcaaagugguugaccuggggugcggacggggcggguggagcuacuauauggcuacccugaagaacgugacggaagucaaaggauacaccaagggcgggcccggacacgaggaaccuauccccauggccacauauggcuggaaucucgugaaacuucauuccggcguugauguguuuuacaagccuaccgagcaagucgacacacugcugugugauauuggggagagcuccucuaaccccaccaucgaagagggaagaacacuccgcgugcugaagaugguggaaccguggcuuagcuccaaaccugaguucugcauuaagguccugaaucccuauaugcccaccguuaucgaagagcucgagaaacugcagagaaagcacggcgggaaccuggugcgguguccucucucucgcaauagcacgcacgaaauguacuggguguccggagcgucuggcaacaucgucagcuccgugaauacaaccagcaaaaugcuucugaacagauuuaccacacggcauagaaagcccacguaugagaaagacguugaucugggggccggaacccggucuguguccacagaaaccgagaagccugacaugacaauuaucggccgcagacuccagcggcugcaggaggaacacaaggagaccuggcauuacgaucaagaaaauccguaccgcacaugggcuuaucacggcagcuacgaggcccccucuaccggguccgcuagcucuauggucaacggagugguuaaacuucugacgaagccuugggacgugauucccauggucacccagcucgccaugacagauaccacaccuuucggccagcagagaguguuuaaagaaaagguugacacccggacgccccaaccgaaaccugggacacgcauggugaugaccacaaccgcgaauuggcugugggcccugcucggaaagaagaaaaaccccagacugugcacgcgggaggaguucaucuccaagguccgcagcaaugcugccauuggcgcuguguuucaggaagagcagggguggaccuccgccagcgaagcugucaacgacucuagauucugggagcuuguggauaaagaacgggcccugcaccaagagggcaagugugagagcugcguuuauaacaugaugggaaaacgcgaaaagaagcucggcgaguuugggagagcgaaaggaucccgggccaucugguacauguggcugggcgcucgcuuccuugaauucgaggcccugggguuucucaaugaagaccauugguucggaagagagaacucuuggagcggcguggagggggaaggccugcaccggcugggauauauccucgaggaaauugauaagaaagacggcgaucugauguacgcugacgauacagccgggugggacaccagaaucacagaggaugaccuucagaaugaggaacugauuaccgagcagauggccccucaucacaagacacucgcgaaagcuaucuuuaagcugaccuaucagaacaaggucgugaaagugcuucgccccacgccucggggagccguuauggauauuaucuccagaaaggaccaacgcggcucugggcaggugggaacauacggccugaauaccuucaccaacauggaaguccagcucauccggcagauggaggccgaaggggugauuacacaagaugacaugcagaaucccaaaggccugaaggagagaguugagaaauggcugcgcgaaugcggaguggaccggcucaagagaauggcuaucagcggcgaugacugugucgugaaaccgcuggaugagcgcuuugggaccucccuucuguuccucaacgacaugggaaagguccggaaggauauuccucagugggaacccucuaaaggcuggaagaauuggcaggaggugcccuuuugcagccaucacuuccacaaaaucuuuaugaaggacgggagaucccugguugugccuugucgcaaccaagaugaacuuauuggacgggccagaaucagccagggcgcuggguggucucugcgggagacagccugccucggcaaagcguacgcccagauguggucccugauguauuuccauagacgcgaccugcggcucgcuagcauggccaucuguucugcugucccgacggagugguuucccaccuccagaacaaccuggagcauucacgcccaucaccaguggaugacaaccgaagauaugcugaagguguggaaucgcguuuggaucgaggacaacccuaauaugauugauaagacgcccgugcacuccugggaagacaucccuuaccuuggaaaaagagaggaccuguggugcggcucucucauugggcugagcucccgggcgaccugggccaagaacauccauacagcuauuacccaaguccgcaaucuuaucggaaaagaagaguauguggauuacaugcccgugaugaagagauauagcgccccuucugaguccgaaggcguucuguga

SEQ ID NO: 21049 - RNA, 9867 nt, Artificial Sequence
  derived and/or modified CDS sequence (opt5) from DENV-4__KJ596664__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccauguccgggcgcauuggaggccagacgcaucuugcuaucauugccguguucaagaugucuccuggcuacguucuggggguguuucucagaaaacugacaagccgggagaccgcccugauggucaucggaauggcuaugacaaccacccuuuccauuccgcacgaccugauggagcucaucgacggcaucucucuggggcucauucugcuuaagaucgugacacaguucgauaacacgcaaguuggaacccuggcccucagccugacauuuauucgcuccaccaugagccuggugauggcguggagaacaaucauggcuguccuuuucguggucacccugauuccccucugucggacgucuugccugcagaaacagucccauuggguggaaaucacagcccucauucugggcgcccaagcucuuccuguuuaucugaugacccucaugaagggggccagcagacgcucuuggccccugaaugagggaaucauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuauuaucgaagugaagcaggacgaggauggcagcuuuuccauucgggacguggaggaaacaaacaugaucacccugcuuguuaaacuggcgcucauuacagucucugggcuguacccccucgccaucccgaucacgaugacccugugguauauguggcaggugaagacacaaagaagcggagcucuuugggaugugccuucccccgccgccacccagaaagcugcccugucugagggcgucuaccgcauuaugcagcggggccuguucgggaagacacaggugggaguuggcauccacauggaagggguguuccacaccauguggcaugucacgagaggaagcgugauuugucacgagaccggccgccucgaaccuuccugggcggacguucggaaugauaugaucucuuaugggggaggcuggagacugggcgacaaaugggauaaggaggaggacgugcaaguccuugcuauugaacccgggaagaacccgaaacaugugcagacaaagccuggacuguuuaaaacccucacaggcgagaucggggccguuacccuggacuucaagcccggaacaagcggcuccccuaucauuaaucgcaaagggaaggugaucggccucuacggaaacggcgucgugacgaaaagcggggauuaugugucugccauuacccaggcugaacggaucggagagcccgacuacgaggucgaugaagacauuuuuagaaagaagcggcugacaaucauggaucuucaccccggcgccgggaaaaccaagcgcauucugccuuccaucguuagagaggcgcugaaacggcgccucagaacccugauccuugcuccgacacgggugguggccgccgaaauggaggaagcucugagaggacuccccauucgcuaucagacgccugccgucaagagcgagcauaccggccgggagaucguggaccugaugugccacgcuacauucaccacaagacuccugucuuccacccgcguucccaauuacaaccuuauugugauggaugaagcccacuuuacggacccuagcuccgucgcggcccggggguacaucucuacaagaguggagaugggcgaagcugccgcuauuuucaugaccgccacccccccuggagccacagauccguuuccccaaagcaauuccccuaucgaggacaucgaacgcgagauucccgagcggagcuggaacaccggcuucgauuggaucacagacuaucaggggaaaaccguuugguuugugccuucuauuaaggcuggaaaugacaucgcgaacugccugagaaaguccggcaaaaaggucauucagcugagccgcaaaacguucgauacagaauaccccaagaccaaacucacagacugggauuuuguggucaccacggacaucucugagaugggggccaacuucagagcuggacgggugaucgauccgcgcagaugucugaagccuguuauucuuaccgacggccccgaacgggugauccuggccgggcccauuccugugacacccgccagcgcugcccaacgcagaggccggaucggaagaaauccugcgcaggaggaugaccaguaugucuucuccggcgauccgcucaagaacgacgaagaucaugcucacuggaccgaggccaaaaugcugcuggacaauauuuacacacccgaggggaucauuccuacccucuuuggacccgaacgcgagaagacacaggccaucgauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauucuggaagagaacauggaagucgagaucuggacaagagagggggaaaagaagaaacuucggcccaaguggcuggaugcgcgcguguaugccgacccgauggcucucaaagauuuuaaggaguucgccucuggaagaaaaagcauuacccuggacauccugaccgaaauugcuucccucccuacauaccuuagcucucgggccaagcuggcucuggauaauaucguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaauuggcaaacugagcaugggccugaucacaauugcugucgccuccgggcuccuguggguggccgaaauccaaccucaguggauugcugcgucuaucauccuugaguucuuucugaugguccuccugauucccgaaccugagaagcagcggaccccccaggacaaucaacugaucuaugugauucucacaauccuuaccauuaucggacugauugccgcuaacgaaaugggccugaucgagaaaacgaagaccgauuucggguuuuaccagguuaaaacagagaccacaauccucgacguggaucugcgcccggccagcgccuggacccuuuaugcugucgccacgacaauucugaccccuaugcucagacacacaaucgaaaauaccuccgcgaaccugucucuggccgcuauugccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuaucauuggcccggggcugcaagccaaagcuaccagagaggcccagaagcgcacagcugccggaaucaugaagaaucccaccguggauggcaucacaguuauugaccucgaaccuaucagcuacgaucccaaauucgagaagcagcuugggcaagucaugcugcuggugcucugcgcgggacagcugcuucugaugcggaccacgugggccuucugugaggugcucacacuggcuaccggcccuauucugacccucugggaagggaaccccggaagauuuuggaacacaaccaucgccgucucuacagcuaauauuuuccgcggcuccuaucuugccggcgccgggcuggcguuuagccugaucaaaaacgcucagacgccucggagaggaaccggcacagccggggagacccucggagaaaaguggaaacgccagcugaauucucuugaccggaaggaguucgaagaguacaagagauccggcauccuggagguugaccgcacagaagcuaaaagcgcccucaaggaugggucuaaaauuaagcaugccgugagccggggauccucuaaaaucagauggauuguggagcgcggcauggucaagccgaagggcaaagugguugaccuggggugcggacggggcggguggagcuacuauauggcuacccugaagaacgugacggaagucaaaggauacaccaagggcgggcccggacacgaggaaccuauccccauggccacauauggcuggaaucucgugaaacuucauuccggcguugauguguuuuacaagccuaccgagcaagucgacacacugcugugugauauuggggagagcuccucuaaccccaccaucgaagagggaagaacacuccgcgugcugaagaugguggaaccguggcuuagcuccaaaccugaguucugcauuaagguccugaaucccuauaugcccaccguuaucgaagagcucgagaaacugcagagaaagcacggcgggaaccuggugcgguguccucucucucgcaauagcacgcacgaaauguacuggguguccggagcgucuggcaacaucgucagcuccgugaauacaaccagcaaaaugcuucugaacagauuuaccacacggcauagaaagcccacguaugagaaagacguugaucugggggccggaacccggucuguguccacagaaauugagaagccugacaugaccaucauuggccgcagacuccagcggcugcaggaggaacacaaggagacauggcauuacgaucaagaaaauccguaccgcaccugggcuuaucacggcagcuacgaggcccccucuacaggguccgcuagcucuauggucaacggagugguuaaacuucugaccaagccuugggacgugauccccauggucacgcagcucgccaugaccgauacaaccccuuucggccagcagagaguguuuaaagaaaagguugacacacggaccccccaaccgaaaccugggacgcgcauggugaugacaaccacagcgaauuggcugugggcccugcucggaaagaagaaaaaccccagacugugcacccgggaggaguucauuuccaagguccgcagcaaugcugccaucggcgcuguguuucaggaagagcagggguggacguccgccagcgaagcugucaacgacucuagauucugggagcuuguggauaaagaacgggcccugcaccaagagggcaagugugagagcugcguuuauaacaugaugggaaaacgcgaaaagaagcucggcgaguuugggagagcgaaaggaucccgggccaucugguacauguggcugggcgcucgcuuccuugaauucgaggcccugggguuucucaaugaagaccauugguucggaagagagaacucuuggagcggcguggagggggaaggccugcaccggcugggauauauucucgaggaaaucgauaagaaagacggcgaucugauguacgcugacgauaccgccgggugggacacaagaauuaccgaggaugaccuucagaaugaggaacugaucacagagcagauggccccucaucacaagauucucgcgaaagcuaucuuuaagcugaccuaucagaacaaggucgugaaagugcuucgccccacaccucggggagccguuauggauaucauuuccagaaaggaccaacgcggcucugggcaggugggaaccuacggccugaauacguucacaaacauggaaguccagcucauccggcagauggaggccgaaggggugauuacccaagaugacaugcagaaucccaaaggccugaaggagagaguugagaaauggcugcgcgaaugcggaguggaccggcucaagagaauggcuaucagcggcgaugacugugucgugaaaccgcuggaugagcgcuuugggaccucccuucuguuccucaacgacaugggaaagguccggaaggauauuccucagugggaacccucuaaaggcuggaagaauuggcaggaggugcccuuuugcagccaucacuuccacaaaaucuuuaugaaggacgggagaucccugguugugccuugucgcaaccaagaugaacuuaucggacgggccagaauuagccagggcgcuggguggaaucugcgggagacagccugccucggcaaagcguacgcccagauguggucucugauguauuuccauagacgcgaccugcggcucgcuuccauggccaucuguagcgcugucccgaccgagugguuucccacaucuagaacgaccugguccauucacgcccaucaccaguggaugacaaccgaagauaugcugaagguguggaaccgcguuuggaucgaggacaauccuaacaugauugauaagacacccgugcacagcugggaagacaucccuuaccuuggaaaaagagaggaccuguggugcggcucccucauugggcugucuagccgggcgaccugggccaagaauauccauacggcuaucacccaaguccgcaaccuuauuggaaaagaagaguauguggauuacauguccgugaugaagagauauagcgcccccucugaguccgaaggcguucuguga

SEQ ID NO: 21050 - RNA, 9867 nt, Artificial Sequence
  derived and/or modified CDS sequence (opt5) from DENV-4__KJ596665__SS-prME
agcaccaucacccugcucugccugauucccacggugauggccuuccaccuuuccaccagagacggagagccucugaugaucgucgcuaagcaugaacgggggcgcccgcuccuguuuaagaccaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcggccuuaaguacuccuggaaaaccugggggaaggccaaaaucuucacgcccgaagcucggaacucuaccuuucucaucgacggaccggauacaagcgagugcccuaaugaacgcagagccuggaacuccuucgagguugaggacuacggcuucgggauguuuaccacaaauauuuggaugaaguuccgggaaggaagcucugaggugugugaucauagacugauguccgcugccaucaaagaccagaaggccguccacgcugauaugggcuauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccgggcccuuuucccagcacaacuaucggcaaggauacgcuacacagaccgugggcccuuggcaccucgggaagcuggagaucgacuucggagaaugccccggcaccacagucaccauucaggagaacugugaucauagagggccgagccugcgcacgacaaccgccucuggaaaacuugugacacaguggugcuguagauccugcaccaugccuccccuccgguuucugggcgaagacggcuguugguaugggauggagauccgcccccugagcgagaaggaagagaauauggugaaaucccaagucacagccggacagggcaccucugaaacguucagcauggggcuccugugccuuacccuguuuguugaggaaugucucagacggcgcgugacaagaaagcacaugauucuggcuguggucaucacccugugcgccauuauccuuggaggccucacauggauggaucugcugcgggcgcucaucauucugggggacaccauguccggacgcaucggcggccagacgcaucuugcuauuauggccguguucaagaugucuccuggguacguucugggaguguuucucagaaaacugacaagccgggagaccgcccugauggucaucggcauggcuaugacaaccacccuuuccauuccgcacgaucugauggagcucaucgacgggaucucucugggacucauucugcuuaagaucgugacacaguucgacaacacgcaaguuggcacccuggcccucagccugacauuuauucgcuccaccaugagccuggugauggcguggagaacaaucauggcuguccuuuucguggucacccugauuccccucugucggacgucuugccugcagaaacagucccauuggguggaaaucacagcccucauucugggggcccaagcccuuccuguuuaucugaugacccucaugaagggagccagcagacgcucuuggccccugaaugagggcaucauggcugugggccuggucucccuucuggggagcgcccuccugaaaaacgaugugccucucgcgggacccaugguugccggcgggcugcuucuggcugccuacgugaugucuggauccagcgcugaccugucccucgaaaaggccgccaauguccagugggaugagauggcugacaucaccggcagcucuccuauuaucgaagugaagcaggaugaggacgggagcuuuuccauucgggauguggaggaaacaaacaugaucacccugcuuguuaaacuggcgcucauuacagucucuggacuguacccccucgccaucccgaucacgaugacccugugguauauguggcaagugaagacacaaagaagcggcgcucuuugggacgugccuucccccgccgccacccagaaagcugcccugucugagggcgucuaccgcauuaugcagcgggggcuguucggaaagacacaggugggcguugggauccacauggaaggaguguuccacaccauguggcaugucacgagaggcagcgugauuugucacgagaccgggcgccucgaaccuuccugggcggauguucggaaugacaugaucucuuauggaggcggcuggagacugggggauaaaugggacaaggaggaggaugugcaaguccuugcuauugaacccggaaagaacccgaaacaugugcagacaaagccuggccuguuuaaaacccucacaggggagaucggagccguuacccuggacuucaagcccggcacaagcggguccccuaucauuaaucgcaaaggcaaggugaucggacucuacggcaacggggucgugacgaaaagcggagacuaugugucugccauuacccaggcugaacggaucggcgagcccgauuacgaggucgacgaagauauuuuuagaaagaagcggcugacaaucauggaccuucaccccggggccggaaaaaccaagcgcauucugccuuccaucguuagagaggcgcugaaacggcgccucagaacccugauccuugcuccgacacgggugguggccgccgaaauggaggaagcucugagaggccuccccauucgcuaucagacgccugccgucaagagcgagcauaccgggcgggagaucguggaucugaugugccacgcuacauucaccacaagacuccugucuuccacccgcguucccaauuacaaccuuauugugauggacgaagcccacuuuacggauccuagcuccgucgcggcccggggcuacaucucuacaagaguggagaugggagaagcugccgcuauuuucaugaccgccacacccccuggcgccacagacccguuuccccaaagcaauuccccuaucgaggauaucgaacgcgagauucccgagcggagcuggaacaccggguucgacuggaucacagauuaucagggaaaaaccguuugguuugugccuucuauuaaggcuggcaaugacaucgcgaacugccugagaaaguccgggaaaaaggucauucagcugagccgcaaaacguucgacacagaauaccccaagaccaaacucacagauugggacuuuguggucaccacggauaucucugagaugggagccaacuucagagcuggccgggugaucgacccgcgcagaugucugaagccuguuauucuuaccgaugggcccgaacgggugauccuggccggccccauuccugugacacccgccagcgcugcccaacgcagaggacggaucggcagaaauccugcgcaggaggacgaucaguaugucuucuccggggacccgcucaagaacgaugaagaccaugcucacuggaccgaggccaaaaugcugcuggauaauauuuacacacccgagggaaucauuccuacccucuuuggccccgaacgcgagaagacacaggccaucgacggggaguuccggcuuagaggagagcaacgcaaaaccuuuguugagcugaugcggagaggcgaucugccuguguggcucucuuauaagguggcuagcgccggcaucuccuacaaagaccgggaauggugcuucacgggggagcgcaacaaucagauucuggaagagaacauggaagucgagaucuggacaagagagggagaaaagaagaaacuucggcccaaguggcuggacgcgcgcguguaugccgauccgauggcucucaaagacuuuaaggaguucgccucuggcagaaaaagcauuacccuggauauccugaccgaaauugcuucccucccuacauaccuuagcucucgggccaagcuggcucuggacaauaucguuaugcuccauaccacagagcgcgggggcagagcuuaccagcacgcgcugaacgaacuucccgagucccuggagacgcucaugcugguggcccugcucggagcuaugaccgccgggaucuuucuuuucuuuaugcagggaaagggcauuggcaaacugagcauggggcugaucacaauugcugucgccuccggacuccuguggguggccgaaauccaaccucaguggauugcugcgucuaucauccuugaguucuuucugaugguccuccugauucccgaaccugagaagcagcggacaccccaggauaaucaacugaucuaugugauucucacaauccuuaccauuaucggccugauugccgcuaacgaaauggggcugaucgagaaaacgaagaccgacuucggauuuuaccagguuaaaacagagaccacaauccucgauguggaccugcgcccggccagcgccuggacccuuuaugcugucgccacgacaauucugaccccuaugcucagacacacaaucgaaaauaccuccgcgaaccugucucuggccgcuauugccaaucaggcugccgugcucaugggccuugggaagggauggccccugcaucggauggaucugggcguuccccuccuggcgaugggcuguuacagccaggugaacccuaccacacuuacggccucccuggucaugcuccuggugcacuaugcuaucauugggccgggacugcaagccaaagcuaccagagaggcccagaagcgcacagcugccggcaucaugaagaaucccaccguggacgggaucacaguuauugaucucgaaccuaucagcuacgaccccaaauucgagaagcagcuuggacaagucaugcugcuggugcucugcgcgggccagcugcuucugaugcggaccacgugggccuucugugaggugcucacacuggcuaccgggccuauucugacccucugggaaggaaaccccggcagauuuuggaacacaaccaucgccgucucuacagcuaauauuuuccgcggcuccuaucuugccggggccggacuggcguuuagccugaucaaaaacgcucagacgccucggagaggcaccgggacagccggagagacccucggcgaaaaguggaaacgccagcucaauucucuugaucggaaggaguucgaagaguacaagagauccgggauccuggagguugaccgcacagaagcuaaaagcgcccucaaggacggaucuaaaauuaagcaugccgugagccggggcuccucuaaaaucagauggauuguggagcgcggcauggucaagccgaaggggaaagugguugaucugggaugcggcagagggggauggagcuacuauauggcuacccugaagaacgugacggaagucaaaggcuacaccaaagggggacccggccacgaggaaccuauccccauggccacauauggcuggaaucucgugaaacuucauuccgggguugacguguuuuacaagccuaccgagcaagucgauacacugcugugugacauuggagagagcuccucuaaccccaccaucgaagagggcagaacacuccgcgugcugaagaugguggaaccguggcuuagcuccaaaccugaguucugcauuaagguccugaaucccuauaugcccaccguuaucgaagaacuggagaaacugcagagaaagcacgggggaaaccuggugcgguguccucucucucgcaauagcacgcacgaaauguacuggguguccggcgcgucugggaacaucgucagcuccgugaauacaaccagcaaaaugcuucugaacagauuuaccacacggcauagaaagcccacguaugagaaagauguugaccugggagccggcacccggucuguguccacagaaaccgagaagccugauaugacaauuaucggccgcagacuccagcggcugcaggaggaacacaaggagaccuggcauuacgaccaagaaaauccguaccgcacaugggcuuaucacgggagcuacgaggcccccucuaccggauccgcuagcucuauggucaacggcgugguuaaacuucugacgaagccuugggaugugauucccauggucacccagcucgccaugacagacaccacaccuuucgggcagcagagaguguuuaaagaaaagguugauacccggacgccccaaccgaaaccuggaacacgcauggugaugaccacaaccgcgaauuggcugugggcccugcucggcaagaagaaaaaccccagacugugcacgcgggaggaguucaucuccaagguccgcagcaaugcugccauuggggcuguguuucaggaagaacagggcuggaccuccgccagcgaagcugucaacgacucuagauucugggagcuuguggacaaagaacgggcccugcaccaagagggaaagugugagagcugcguuuauaacaugaugggcaaacgcgaaaagaagcucggggaguuuggacgggcgaaaggcucccgggccaucugguacauguggcugggggcucgcuuccuugaguucgaggcccugggauuucucaaugaagaucauugguucggcagagagaacucuuggagcgggguggagggcgaaggacugcaccggcugggcuauauccucgaggaaauugacaagaaagauggggaccugauguacgcugaugacacagccggaugggauaccagaaucacagaggacgaucuucagaaugaggaacugauuaccgagcagauggccccucaucacaagauccucgcgaaagcuauuuuuaagcugacauaucagaacaaggucgugaaagugcuucgccccaccccucggggcgccguuauggacaucaucuccagaaaggaucaacgcgggucuggacaggugggcacguacgggcugaauacauucaccaacauggaaguccagcucauucggcagauggaggccgaaggcgugaucacccaagacgauaugcagaaucccaaaggacugaaggagagaguugagaaauggcugcgcgaaugcggcguggaccggcucaagagaauggcuauuagcggggacgauugugucgugaaaccgcuggacgagcgcuuuggaacaucccuucuguuccucaacgauaugggcaagguccggaaggacaucccucagugggaacccucuaaaggguggaagaauuggcaggaggugcccuuuugcagccaucacuuccacaaaauuuuuaugaaggauggaagaucccugguugugccuugucgcaaccaagacgaacuuaucggccgggccagaaucagccagggggcuggcuggucucugcgggagaccgccugccucggaaaagcguacgcccagauguggucccugauguauuuccauagacgcgaucugcggcucgcuagcauggccauuuguucugcugucccgacagagugguuucccacguccagaaccacauggagcauccacgcccaucaccaguggaugaccacagaaaauaugcugaagguguggaaccgcguuuggauugaggacaauccuaacaugaucgauaagacccccgugcacuccugggaagacauuccuuaccuuggcaaaagagaggaucuguggugcgggucucucaucggacugagcucccgggcgacgugggccaagaauauucauaccgcuaucacacaaguccgcaaccuuaucggcaaagaagaguauguggacuacaugcccgugaugaagagauauagcgccccuucugaguccgaagggguucuguga

SEQ ID NO: 21051 - RNA, 9867 nt, Artificial Sequence
  derived and/or modified CDS sequence (opt5) from DENV-4__KJ596668__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucauucugggcgauaccauguccgggcgcaucggaggccagacgcaucuugcuauuauggccguguucaagaugucuccuggcuacguucuggggguguuucucagaaaacugacaagccgggagaccgcccugauggucaucggaauggcuaugacaaccacccuuuccauuccgcacgaccugauggagcucaucgacggcaucucucuggggcucauucugcuuaagaucgugacacaguucgauaacacgcaaguuggaacccuggcccucagccugacauuuauucgcuccaccaugagccuggugauggcguggagaacaaucauggcuguccuuuucguggucacccugauuccccucugucggacgucuugccugcagaaacagucccauuggguggaaaucacagcccucauucugggcgcccaagcucuuccuguuuaucugaugacccucaugaagggggccagcagacgcucuuggccccugaaugagggaaucauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuauuaucgaagugaagcaggacgaggauggcagcuuuuccauucgggacguggaggaaacaaacaugaucacccugcuuguuaaacuggcgcucauuacagucucugggcuguacccccucgccaucccggugacgaugacccugugguauauguggcaggugaagacacaaagaagcggagcucuuugggaugucccuucccccgccgccacccagaaagcugcccugucugagggcguguaccgcaucaugcagcggggccuguucgggaagacacagguuggagugggcauucacauggaaggggucuuccacaccauguggcaugugacgagaggaagcguuaucugucacgagaccggccgccucgaaccuuccugggcggacgugcggaaugauaugauuucuuaugggggaggcuggagacugggcgacaaaugggauaaggaggaggacguccaagugcuugcuaucgaacccgggaagaacccgaaacauguucagacaaagccuggacuguuuaaaacccucacaggcgagauuggggccgugacccuggacuucaagcccggaacaagcggcuccccuaucaucaaucgcaaagggaaggucauuggccucuacggaaacggcguggugacgaaaagcggggauuaugucucugccaucacccaggcugaacggauuggagagcccgacuacgagguugaugaagacaucuuuagaaagaagcggcugacaauuauggaucuucaccccggcgccgggaaaaccaagcgcauccugccuuccauugugagagaggcgcugaaacggcgccucagaacccugauccuugcuccgacacggguggucgccgccgaaauggaggaagcucugagaggacuccccauccgcuaucagacgccugccgugaagagcgagcauaccggccgggagauuguugaccugaugugccacgcuacauucaccacaagacuccugucuuccacccgcgugcccaauuacaaccuuaucgucauggaugaagcccacuuuacggacccuagcuccguggcggcccggggguacauuucuacaagaguugagaugggcgaagcugccgcuaucuucaugaccgccacccccccuggagccacagauccguuuccccaaagcaauuccccuauugaggacaucgaacgcgagauccccgagcggagcuggaacaccggcuucgauuggauuacagacuaucaggggaaaaccgugugguuugucccuucuaucaaggcuggaaaugacauugcgaacugccugagaaaguccggcaaaaaggugauccagcugagccgcaaaacguucgauacagaauaccccaagaccaaacucacagacugggauuuugucgugaccacggacauuucugagaugggggccaacuucagagcuggacggguuaucgauccgcgcagaugucugaagccugugauccuuaccgacggccccgaacgggugauucuggccgggcccaucccugucacacccgccagcgcugcccaacgcagaggccggauuggaagaaauccugcgcaggaggaugaccaguauguuuucuccggcgauccgcucaagaacgacgaagaucaugcucacuggaccgaggccaaaaugcugcuggacaauaucuacacacccgaggggauuaucccuacccucuuuggacccgaacgcgagaagacacaggccauugauggcgaauuccggcuuagaggggagcaacgcaaaaccuuuguggagcugaugcggagaggagaccugccuguguggcucucuuauaaggucgcuagcgccggcaucuccuacaaagaccgggaauggugcuucacgggcgagcgcaacaaucagauccuggaagagaacauggaaguggagauuuggacaagagagggggaaaagaagaaacuucggcccaaguggcuggaugcgcgcguuuaugccgacccgauggcucucaaagauuuuaaggaguucgccucuggaagaaaaagcaucacccuggacauucugaccgaaaucgcuucccucccuacauaccuuagcucucgggccaagcuggcucuggauaauauugugaugcuccauaccacagagcgcggcgggagagccuaccagcacgcgcugaacgaacuucccgagucccuggagacgcucaugcuggucgcccugcucggagcuaugaccgccggcaucuuucuuuucuuuaugcaggggaagggaaucggcaaacugagcaugggccugauuacaaucgcuguggccuccgggcuccugugggucgccgaaauucaaccucaguggaucgcugcgucuauuauccuugaguucuuucugauggugcuccugauccccgaaccugagaagcagcggaccccccaggacaaucaacugauuuauguuauccucacaauucuuaccaucauuggacugaucgccgcuaacgaaaugggccugauugagaaaacgaagaccgauuucggguuuuaccaggugaaaacagagaccacaauccucgacgucgaucugcgcccggccagcgccuggacccuuuaugcuguggccacgacaauccugaccccuaugcucagacacacaauugaaaauaccuccgcgaaccugucucuggccgcuaucgccaaucaggcugccguucucaugggacuuggcaagggguggccccugcaucggauggaccugggagugccccuccuggcgaugggcuguuacagccaggucaacccuaccacacuuacggccucccuggugaugcuccuggugcacuaugcuauuaucggcccggggcugcaagccaaagcuaccagagaggcccagaagcgcacagcugccggaauuaugaagaaucccaccguugauggcaucacagucaucgaccucgaaccuauuagcuacgaucccaaauucgagaagcagcuugggcaagugaugcugcuggugcucugcgcgggacagcugcuucugaugcggaccacgugggccuucugugagguccucacacuggcuaccggcccuauccugacccucugggaagggaaccccggaagauuuuggaacacaaccauugccguuucuacagcuaauaucuuccgcggcuccuaucuugccggcgccgggcuggcguuuagccugauuaaaaacgcucagacgccucggagaggaaccggcacagccggggagacccucggagaaaaguggaaacgccagcugaauucucuugaccggaaggaguucgaagaguacaagagauccggcauccuggagguggaccgcacagaagcuaaaagcgcccucaaggaugggucuaaaaucaagcaugccgugagccggggauccucuaaaauuagauggaucgucgagcgcggcauggugaagccgaagggcaaaguuguggaccuggggugcggacggggcggguggagcuacuauauggcuacccugaagaacgucacggaagugaaaggauacaccaagggcgggcccggacacgaggaaccuauucccauggccacauauggcuggaaucucguuaaacuucauuccggcguggaugucuuuuacaagccuaccgagcaaguggacacacugcugugugauaucggggagagcuccucuaaccccaccauugaagagggaagaacacuccgcgugcugaagauggucgaaccguggcuuagcuccaaaccugaguucugcaucaagguucugaaucccuauaugcccaccgugauugaagagcucgagaaacugcagagaaagcacggcgggaaccuggugcgguguccucucucucgcaauagcacgcacgaaauguacugggucuccggagcgucuggcaacaucgugagcuccguuaauacaaccagcaaaaugcuucugaacagauuuaccacacggcauagaaagcccacguaugagaaagacguggaucugggggccggaacccggucugucuccacagaaaccgagaagccugacaugacaaucauuggccgcagacuccagcggcugcaggaggaacacaaggagaccuggcauuacgaucaagaaaauccguaccgcacaugggcuuaucacggcagcuacgaggcccccucuaccggguccgcuagcucuauggugaacggaguugugaaacuucugacgaagccuugggacgucauccccauggugacccagcucgccaugacagauaccacaccuuucggccagcagagaguuuuuaaagaaaagguggacacccggacgccccaaccgaaaccugggacacgcauggucaugaccacaaccgcgaauuggcugugggcccugcucggaaagaagaaaaaccccagacugugcacgcgggaggaguucauuuccaaggugcgcagcaaugcugccaucggcgcugucuuucaggaagagcagggguggaccuccgccagcgaagcugugaacgacucuagauucugggagcuuguugauaaagaacgggcccugcaccaagagggcaagugugagagcugcguguauaacaugaugggaaaacgcgaaaagaagcucggcgaguuugggagagcgaaaggaucccgggccauuugguacauguggcugggcgcucgcuuccuugaauucgaggcccugggguuucucaaugaagaccauugguucggaagagagaacucuuggagcggcgucgagggggaaggccugcaccggcugggauauauccucgaggaaaucgauaagaaagacggcgaucugauguacgcugacgauacagccgggugggacaccagaauuacagaggaugaccuucagaaugaggaacugaucaccgagcagauggccccucaucacaagauucucgcgaaagcuaucuuuaagcugacauaucagaacaagguggugaaaguucuucgccccaccccucggggagccgugauggauauuaucuccagaaaggaccaacgcggcucugggcaggucggaacguacggccugaauacauucaccaacauggaagugcagcucauccggcagauggaggccgaagggguuauuacccaagaugacaugcagaaucccaaaggccugaaggagagaguggagaaauggcugcgcgaauacggagucgaccggcucaagagaauggcuaucagcggcgaugacugcguggucaaaccgcuggaugagcgcuuugggacaucccuucuguuccucaacgacaugggaaaggugcggaaggauauuccucagugggaacccucuaaaggcuggaagaauuggcaggagguucccuuuuguagccaucacuuccacaaaaucuuuaugaaggacgggagaucccugguggucccuugccgcaaccaagaugaacuuauuggacgggccagaaucagccagggcgcuggguggucucugcgggagaccgccugucucggcaaagcguaugcccagauguggucccugauguacuuccauagacgcgaccugcggcucgcuagcauggccaucugcucugcugugccgacagagugguuucccacguccagaaccacauggagcauucacgcccaucaccaguggaugaccacagaagauaugcugaagguuuggaaucgcguguggaucgaggacaacccuaauaugauugauaagacccccguccacuccugggaagacaucccuuaucuuggaaaaagagaggaccugugguguggcucucucauugggcugagcucccgggcgacgugggccaagaacauccauaccgcuauuacacaagugcgcaaucuuaucggaaaagaagaguacguggauuauaugcccguuaugaagagauacagcgccccuucugaguccgaaggcguccuguga

SEQ ID NO: 21052 - RNA, 9867 nt, Artificial Sequence
  derived and/or modified CDS sequence (opt5) from DENV-4__KJ596670__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauugugcuugggggacucacauggauggaccugcugcgggcgcucaucaugcugggcgauaccauguccgggcgcaucggaggccagacgcaucuugcuauuaucgccguuuucaagaugucuccuggcuacgugcugggggucuuucucagaaaacugacaagccgggagaccgcccugauggugauuggaauggcuaugacaaccacccuuuccaucccgcacgaccugauggagcucauugacggcaucucucuggggcucauccugcuuaagauuguuacacaguucgauaacacgcaagugggaacccuggcccucagccugacauuuauccgcuccaccaugagccuggucauggcguggagaacaauuauggcugugcuuuucgucgugacccugaucccccucugucggacgucuugccugcagaaacagucccauuggguugaaauuacagcccucauccugggcgcccaagcucuuccuguguaucugaugacccucaugaagggggccagcagacgcucuuggccccugaaugagggaauuauggcugucggccuggugucccuucugggcagcgcccuccugaaaaacgacguuccucucgcggggcccaugguggccggaggccugcuucuggcugccuacgucaugucuggguccagcgcugaucugucccucgaaaaggccgccaaugugcagugggacgagauggcugauaucaccggaagcucuccuaucauugaagugaagcaggacgaggauggcagcuuuuccauccgggacguugaggaaacaaacaugauuacccugcuugucaaacuggcgcucaucacagugucugggcuguacccccucgccauuccgaucacgaugacccugugguauauguggcaggugaagacacaaagaagcggagcucuuugggaugucccuucccccgccgccacccagaaagcugcccugucugagggcguguaccgcaucaugcagcggggccuguucgggaagacacagauuggaguuggcauccacauggaagggguguuccacaccauguggcaugucacgagaggaagcgugauuugucacgagaccggccgccucgaaccuuccugggcggacguucggaaugauaugaucucuuaugggggaggcuggagacugggcgacaaaugggauaaggaggaggacgugcaaguccuugcuauugaacccgggaagaacccgaaacaugugcagacaaagccuggacuguuuaaaacccucacaggcgagaucggggccguuacccuggacuucaagcccggaacaagcggcuccccuaucauuaaucgcaaagggaaggugaucggccucuacggaaacggcgucgugacgaaaagcggggauuaugugucugccauuacccaggcugaacggaucggagagcccgacuacgaggucgaugaagacauuuuuagaaagaagcggcugacaaucauggaucuucaccccggcgccgggaaaaccaagcgcauucugccuuccaucguuagagaggcgcugaaacggcgccucagaacccugauccuugcuccgacacgggugguggccgccgaaauggaggaagcucugagaggacuccccauucgcuaucagacgccugccgucaagagcgagcauaccggccgggagaucguggaccugaugugccacgcuacauucaccacaagacuccugucuuccacccgcguucccaauuacaaccuuauugugauggaugaagcccacuuuacggacccuagcuccgucgcggcccggggguacaucucuacaagaguggagaugggcgaagcugccgcuauuuucaugaccgccacccccccuggagccacagauccguuuccccaaagcaauuccccuaucgaggacaucgaacgcgagauucccgagcggagcuggaacaccggcuucgauuggaucacagacuaucaggggaaaaccguuugguuugugccuucuauuaaggcuggaaaugacaucgcgaacugccugagaaaguccggcaaaaaggucauucagcugagccgcaaaacguucgauacagaauaccccaagaccaaacucacagacugggauuuuguggucaccacggacaucucugagaugggggccaacuucagagcuggacgggugaucgauccgcgcagaugucugaagccuguuauucuuaccgacggccccgaacgggugauccuggccgggcccauuccugugacacccgccagcgcugcccaacgcagaggccggaucggaagaaauccugcgcaggaggaugaccaguaugucuucuccggcgauccgcucaagaacgacgaagaucaugcucacuggaccgaggccaaaaugcugcuggacaauauuuacacacccgaggggaucauuccuacccucuuuggacccgaacgcgagaagacacaggccaucgauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauucuggaagagaacauggaagucgagaucuggacaagagagggggaaaagaagaaacuucggcccaaguggcuggaugcgcgcguguaugccgacccgauggcucucaaagauuuuaaggaguucgccucuggaagaaaaagcauuacccuggacauccugaccgaaauugcuucccucccuacauaccuuagcucucgggccaagcuggcucuggauaauaucguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaauuggcaaacugagcaugggccugaucacaauugcugucgccuccgggcuccuguggguggccgaaauccaaccucaguggauugcugcgucuaucauccuugaguucuuucugaugguccuccugauucccgaaccugagaagcagcggaccccccaggacaaucaacugaucuaugugauucucacaauccuuaccauuaucggacugauugccgcuaacgaaaugggccugaucgagaaaacgaagaccgauuucggguuuuaccagguuaaaacagagaccacaauccucgacguggaucugcgcccggccagcgccuggacccuuuaugcugucgccacgacaauucugaccccuaugcucagacacacaaucgaaaauaccuccgcgaaccugucucuggccgcuauugccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuaucauuggcccggggcugcaagccaaagcuaccagagaggcccagaagcgcacagcugccggaaucaugaagaaucccaccguggauggcaucacaguuauugaccucgaaccuaucagcuacgaucccaaauucgagaagcagcuugggcaagucaugcugcuggugcucugcgcgggacagcugcuucugaugcggaccacgugggccuucugugaggugcucacacuggcuaccggcccuauucugacccucugggaagggaaccccggaagauuuuggaacacaaccaucgccgucucuacagcuaauauuuuccgcggcuccuaucuugccggcgccgggcuggcguuuagccugaucaaaaacgcucagacgccucggagaggaaccggcacagccggggagacccucggagaaaaguggaaacgccagcugaauucucuugaccggaaggaguucgaagaguacaagagauccggcauccuggagguugaccgcacagaagcuaaaagcgcccucaaggaugggucuaaaauuaagcaugccgugagccggggauccucuaaaaucagauggauuguggagcgcggcauggucaagccgaagggcaaagugguugaccuggggugcggacggggcggguggagcuacuauauggcuacccugaagaacgugacggaagucaaaggauacaccaagggcgggcccggacacgaggaaccuauccccauggccacauauggcuggaaucucgugaaacuucauuccggcguugauguguuuuacaagccuaccgagcaagucgacacacugcugugugauauuggggagagcuccucuaaccccaccaucgaagagggaagaacacuccgcgugcugaagaugguggaaccguggcuuagcuccaaaccugaguucugcauuaagguccugaaucccuauaugcccaccguuaucgaagagcucgagaaacugcagagaaagcacggcgggaaccuggugcgguguccucucucucgcaauagcacgcacgaaauguacuggguguccggagcgucuggcaacaucgucagcuccgugaauacaaccagcaaaaugcuucugaacagauuuaccacacggcauagaaagcccacguaugagaaagacguugaucugggggccggaacccggucuguguccacagaaauugagaagccugacaugaccaucauuggccgcagacuccagcggcugcaggaggaacacaaggagacauggcauuacgaucaagaaaauccguaccgcaccugggcuuaucacggcagcuacgaggcccccucuacaggguccgcuagcucuauggucaacggagugguuaaacuucugaccaagccuugggacgugauccccauggucacgcagcucgccaugaccgauacaaccccuuucggccagcagagaguguuuaaagaaaagguugacacacggaccccccaaccgaaaccugggacgcgcauggugaugacaaccacagcgaauuggcugugggcccugcucggaaagaagaaaaaccccagacugugcacccgggaggaguucauuuccaagguccgcagcaaugcugccaucggcgcuguguuucaggaagagcagggguggacguccgccagcgaagcugucaacgacucuagauucugggagcuuguggauaaagaacgggcccugcaccaagagggcaagugugagagcugcguuuauaacaugaugggaaaacgcgaaaagaagcucggcgaguuugggagagcgaaaggaucccgggccaucugguacauguggcugggcgcucgcuuccuugaauucgaggcccugggguuucucaaugaagaccauugguucggaagagagaacucuuggagcggcguggagggggaaggccugcaccggcugggauauauucucgaggaaaucgauaagaaagacggcgaucugauguacgcugacgauaccgccgggugggacacaagaauuaccgaggaugaccuucagaaugaggaacugaucacagagcagauggccccucaucacaagauucucgcgaaagcuaucuuuaagcugaccuaucagaacaaggucgugaaagugcuucgccccacaccucggggagccguuauggauaucauuuccagaaaggaccaacgcggcucugggcaggugggaaccuacggccugaauacguucacaaacauggaaguccagcucauccggcagauggaggccgaaggggugauuacccaagaugacaugcagaaucccaaaggccugaaggagagaguugagaaauggcugcgcgaaugcggaguggaccggcucaagagaauggcuaucagcggcgaugacugugucgugaaaccgcuggaugagcgcuuugggaccucccuucuguuccucaacgacaugggaaagguccggaaggauauuccucagugggaacccucuaaaggcuggaagaauuggcaggaggugcccuuuugcagccaucacuuccacaaaaucuuuaugaaggacgggagaucccugguugugccuugucgcaaccaagaugaacuuaucggacgggccagaauuagccagggcgcuggguggucucugcgggagacagccugccucggcaaagcguacgcccagauguggucccugauguauuuccauagacgcgaccugcggcucgcuagcauggccaucuguucugcugucccgaccgagugguuucccacauccagaacgaccuggagcauucacgcccaucaccaguggaugacaaccgaagauaugcugaagguguggaaucgcguuuggaucgaggacaacccuaauaugauugauaagacacccgugcacuccugggaagacaucccuuaccuuggaaaaagagaggaccuguggugcggcucucucauugggcugagcucccgggcgaccugggccaagaacauccauacggcuaucacccaaguccgcaaucuuauuggaaaagaagaguauguggauuacaugagcgugaugaagagauauucugcccccuccgagagcgaaggcguucuguga

SEQ ID NO: 21053 - RNA, 9867 nt, Artificial Sequence
  derived and/or modified CDS sequence (opt5) from DENV-4__KJ596671__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccauguccgggcgcauuggaggccagacgcaucuugcuaucauugccguguucaagaugucuccuggcuacguucuggggguguuucucagaaaacugacaagccgggagaccgcccugauggucaucggaauggcuaugacaaccacccuuuccauuccgcacgaccugauggagcucaucgacggcaucucucuggggcucauucugcuuaagaucgugacacaguucgauaacacgcaaguuggaacccuggcccucagccugacauuuauucgcuccaccaugagccuggugauggcguggagaacaaucauggcuguccuuuucguggucacccugauuccccucugucggacgucuugccugcagaaacagucccauuggguggaaaucacagcccucauucugggcgcccaagcucuuccuguuuaucugaugacccucaugaagggggccagcagacgcucuuggccccugaaugagggaaucauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuauuaucgaagugaagcaggacgaggauggcagcuuuuccauucgggacguggaggaaacaaacaugaucacccugcuuguuaaacuggcgcucauuacagucucugggcuguacccccucgccaucccgaucacgaugacccugugguauauguggcaggugaagacacaaagaagcggagcucuuugggaugugccuucccccgccgccacccagaaagcugcccugucugagggcgucuaccgcauuaugcagcggggccuguucgggaagacacaggugggaguuggcauccacauggaagggguguuccacaccauguggcaugucacgagaggaagcgugauuugucacgagaccggccgccucgaaccuuccugggcggacguucggaaugauaugaucucuuaugggggaggcuggagacugggcgacaaaugggauaaggaggaggacgugcaaguccuugcuauugaacccgggaagaacccgaaacaugugcagacaaagccuggacuguuuaaaacccucacaggcgagaucggggccguuacccuggacuucaagcccggaacaagcggcuccccuaucauuaaucgcaaagggaaggugaucggccucuacggaaacggcgucgugacgaaaagcggggauuaugugucugccauuacccaggcugaacggaucggagagcccgacuacgaggucgaugaagacauuuuuagaaagaagcggcugacaaucauggaucuucaccccggcgccgggaaaaccaagcgcauucugccuuccaucguuagagaggcgcugaaacggcgccucagaacccugauccuugcuccgacacgggugguggccgccgaaauggaggaagcucugagaggacuccccauucgcuaucagacgccugccgucaagagcgagcauaccggccgggagaucguggaccugaugugccacgcuacauucaccacaagacuccugucuuccacccgcguucccaauuacaaccuuauugugauggaugaagcccacuuuacggacccuagcuccgucgcggcccggggguacaucucuacaagaguggagaugggcgaagcugccgcuauuuucaugaccgccacccccccuggagccacagauccguuuccccaaagcaauuccccuaucgaggacaucgaacgcgagauucccgagcggagcuggaacaccggcuucgauuggaucacagacuaucaggggaaaaccguuugguuugugccuucuauuaaggcuggaaaugacaucgcgaacugccugagaaaguccggcaaaaaggucauucagcugagccgcaaaacguucgauacagaauaccccaagaccaaacucacagacugggauuuuguggucaccacggacaucucugagaugggggccaacuucagagcuggacgggugaucgauccgcgcagaugucugaagccuguuauucuuaccgacggccccgaacgggugauccuggccgggcccauuccugugacacccgccagcgcugcccaacgcagaggccggaucggaagaaauccugcgcaggaggaugaccaguaugucuucuccggcgauccgcucaagaacgacgaagaucaugcucacuggaccgaggccaaaaugcugcuggacaauauuuacacacccgaggggaucauuccuacccucuuuggacccgaacgcgagaagacacaggccaucgauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauucuggaagagaacauggaagucgagaucuggacaagagagggggaaaagaagaaacuucggcccaaguggcuggaugcgcgcguguaugccgacccgauggcucucaaagauuuuaaggaguucgccucuggaagaaaaagcauuacccuggacauccugaccgaaauugcuucccucccuacauaccuuagcucucgggccaagcuggcucuggauaauaucguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaauuggcaaacugagcaugggccugaucacaauugcugucgccuccgggcuccuguggguggccgaaauccaaccucaguggauugcugcgucuaucauccuugaguucuuucugaugguccuccugauucccgaaccugagaagcagcggaccccccaggacaaucaacugaucuaugugauucucacaauccuuaccauuaucggacugauugccgcuaacgaaaugggccugaucgagaaaacgaagaccgauuucggguuuuaccagguuaaaacagagaccacaauccucgacguggaucugcgcccggccagcgccuggacccuuuaugcugucgccacgacaauucugaccccuaugcucagacacacaaucgaaaauaccuccgcgaaccugucucuggccgcuauugccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuaucauuggcccggggcugcaagccaaagcuaccagagaggcccagaagcgcacagcugccggaaucaugaagaaucccaccguggauggcaucacaguuauugaccucgaaccuaucagcuacgaucccaaauucgagaagcagcuugggcaagucaugcugcuggugcucugcgcgggacagcugcuucugaugcggaccacgugggccuucugugaggugcucacacuggcuaccggcccuauucugacccucugggaagggaaccccggaagauuuuggaacacaaccaucgccgucucuacagcuaauauuuuccgcggcuccuaucuugccggcgccgggcuggcguuuagccugaucaaaaacgcucagacgccucggagaggaaccggcacagccggggagacccucggagaaaaguggaaacgccagcugaauucucuugaccggaaggaguucgaagaguacaagagauccggcauccuggagguugaccgcacagaagcuaaaagcgcccucaaggaugggucuaaaauuaagcaugccgugagccggggauccucuaaaaucagauggauuguggagcgcggcauggucaagccgaagggcaaagugguugaccuggggugcggacggggcggguggagcuacuauauggcuacccugaagaacgugacggaagucaaaggauacaccaagggcgggcccggacacgaggaaccuauccccauggccacauauggcuggaaucucgugaaacuucauuccggcguugauguguuuuacaagccuaccgagcaagucgacacacugcugugugauauuggggagagcuccucuaaccccaccaucgaagagggaagaacacuccgcgugcugaagaugguggaaccguggcuuagcuccaaaccugaguucugcauuaagguccugaaucccuauaugcccaccguuaucgaagagcucgagaaacugcagagaaagcacggcgggaaccuggugcgguguccucucucucgcaauagcacgcacgaaauguacuggguguccggagcgucuggcaacaucgucagcuccgugaauacaaccagcaaaaugcuucugaacagauuuaccacacggcauagaaagcccacguaugagaaagacguugaucugggggccggaacccggucuguguccacagaaauugagaagccugacaugaccaucauuggccgcagacuccagcggcugcaggaggaacacaaggagacauggcauuacgaucaagaaaauccguaccgcaccugggcuuaucacggcagcuacgaggcccccucuacaggguccgcuagcucuauggucaacggagugguuaaacuucugaccaagccuugggacgugauccccauggucacgcagcucgccaugaccgauacaaccccuuucggccagcagagaguguuuaaagaaaagguugacacacggaccccccaaccgaaaccugggacgcgcauggugaugacaaccacagcgaauuggcugugggcccugcucggaaagaagaaaaaccccagacugugcacccgggaggaguucauuuccaagguccgcagcaaugcugccaucggcgcuguguuucaggaagagcagggguggacguccgccagcgaagcugucaacgacucuagauucugggagcuuguggauaaagaacgggcccugcaccaagagggcaagugugagagcugcguuuauaacaugaugggaaaacgcgaaaagaagcucggcgaguuugggagagcgaaaggaucccgggccaucugguacauguggcugggcgcucgcuuccuugaauucgaggcccugggguuucucaaugaagaccauugguucggaagagagaacucuuggagcggcguggagggggaaggccugcaccggcugggauauauucucgaggaaaucgauaagaaagacggcgaucugauguacgcugacgauaccgccgggugggacacaagaauuaccgaggaugaccuucagaaugaggaacugaucacagagcagauggccccucaucacaagauucucgcgaaagcuaucuuuaagcugaccuaucagaacaaggucgugaaagugcuucgccccacaccucggggagccguuauggauaucauuuccagaaaggaccaacgcggcucugggcaggugggaaccuacggccugaauacguucacaaacauggaaguccagcucauccggcagauggaggccgaaggggugauuacccaagaugacaugcagaaucccaaaggccugaaggagagaguugagaaauggcugcgcgaaugcggaguggaccggcucaagagaauggcuaucagcggcgaugacugugucgugaaaccgcuggaugagcgcuuugggaccucccuucuguuccucaacgacaugggaaagguccggaaggauauuccucagugggaacccucuaaaggcuggaagaauuggcaggaggugcccuuuugcagccaucacuuccacaaaaucuuuaugaaggacgggagaucccugguugugccuugucgcaaccaagaugaacuuaucggacgggccagaauuagccagggcgcuggguggucucugcgggagacagccugccucggcaaagcguacgcccagauguggucccugauguauuuccauagacgcgaccugcggcucgcuagcauggccaucuguucugcugucccgaccgagugguuucccacauccagaacgaccuggagcauucacgcccaucaccaguggaugacaaccgaagauaugcugaagguguggaaucgcguuuggaucgaggacaacccuaauaugauugauaagacacccgugcacuccugggaagacaucccuuaccuuggaaaaagagaggaccuguggugcggcucucucauugggcugagcucccgggcgaccugggccaagaacauccauacggcuaucacccaaguccgcaaucuuauuggaaaagaagaguauguggauuacaugagcgugaugaagagauauucugcccccuccgagagcgaaggcguucuguga

SEQ ID NO: 21054 - RNA, 9867 nt, Artificial Sequence
  derived and/or modified CDS sequence (opt5) from DENV-4__KJ579241__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaagaucccccaugcuaaacgccaggaugucaccgugcucggcucccaggaaggagccaugcacagcgcccuggcuggcgcgacagagguugacuccggggauggaaaccacauguuugccggccaucuuaaguguaaggugcggauggaaaaacugagaauuaaggggaugucuuauaccaugugcagcggaaaauucuccaucgacaaggagauggcugagacgcaacacggcacaaccgucgugaaagugaaguacgaaggggccggcgccccuuguaagguucccauugagauccgcgaugucaauaaagaaaagguggugggacgggucaucagcgcuacaccccucgccgagaacaccaacucugugaccaauauugagcuggaaccuccguucggcgacuccuauaucguuauuggggugggaaacagcgcgcugacacuccauugguuuagaaaaggcucuagcaucgggaagauguucgaguccacguaccgcggagcuaaacggauggccauucugggcgaaaccgccugggauuuugggucugucggcggacuuuucacaagccugggcaaggcugugcaccagguuuuuggguccguguauaccacaauguucggaggcgucagcuggaugaucagaauccucauuggguuucuggugcuguggaucggaaccaauucucgcaacacguccauggccaugacaugcauugcuguuggcgggaucacccuuuuccucggcuuuaccgugcaggccgacaugggaugugucgugagcuggucuggccgggagcugaagugcggguccggaauuuucguggucgauaauguucauacauggaccgaacaauacaaauuucagcccgagagcccugcgagacuggccuccgcuauccucaacgcccacaaggacggcgugugugggauucgcucuacaacgcggcuggagaaugugauguggaaacagaucaccaacgaacuuaauuauguccugugggagggaggccacgaccucacagugguugcuggcgaugugaaggggguccugaccaaaggaaagagagcccugacacccccugcgagcgaccuuaaguacuccuggaaaaccuggggcaaggccaaaaucuucacgcccgaagcucggaacucuaccuuucucauugaugggccggacacaagcgagugcccuaaugaacgcagagccuggaacuccuucgagguggaggauuacggauucggcauguuuaccacaaauaucuggaugaaguuccgggaagggagcucugagguuugugaccauagacugauguccgcugccauuaaagaucagaaggccgugcacgcugacaugggauauuggaucgaaagcucuaaaaaccaaaccuggcagauugagcgcgcgucccugaucgaagucaagacaugccucuggcccaagacccauacgcuguggagcaauggcgugcuugagucucagaugcugaucccuaaaagcuacgccggccccuuuucccagcacaacuaucggcaaggguacgcuacacagaccguuggaccuuggcaccucggcaagcuggagauugauuucggggaaugccccggaaccacagugaccauccaggagaacugugaccauagaggcccgagccugcgcacgacaaccgccucugggaaacuugucacacaguggugcuguagauccugcaccaugccuccccuccgguuucugggagaagauggcuguugguauggcauggagauucgcccccugagcgagaaggaagagaauauggugaaaucccaagugacagccgggcagggaaccucugaaacguucagcaugggccuccugugccuuacccuguuugucgaggaaugucucagacggcgcguuacaagaaagcacaugauccuggcuguggugauuacccugugcgccaucauccuugggggacucacauggauggaccugcugcgggcgcucauuauccugggcgauaccauguccgggcgcauuggaggccagacgcaucuugcuaucauggccgucuucaagaugucuccuggcuacgugcuggggguuuuucucagaaaacugacaagccgggagaccgcccugauggugauuggaauggcuaugacaaccacccuuuccaucccgcacgaccugauggagcucaucgacggcauuucucuggggcucauccugcuuaagauugucacacaguucgauaacacgcaagugggaacccuggcccucagccugacauuuauccgcuccaccaugagccugguuauggcguggagaacaauuauggcugugcuuuucgucgugacccugaucccccucugucggacgucuugccugcagaaacagucccauugggucgaaauuacagcccucauccugggcgcccaagcucuuccuguguaucugaugacccucaugaagggggccagcagacgcucuuggccccugaaugagggaaucauggcuguuggccuggugucccuucugggcagcgcccuccugaaaaacgacgucccucucgcggggcccaugguggccggaggccugcuucuggcugccuacguuaugucuggguccagcgcugaucugucccucgaaaaggccgccaaugugcagugggacgagauggcugauauuaccggaagcucuccuaucauugaagucaagcaggacgaggauggcagcuuuuccauccgggacguggaggaaacaaacaugauuacccugcuugugaaacuggcgcucaucacaguuucugggcuguacccccucgccaucccgauuacgaugacccugugguauauguggcaggucaagacacaaagaagcggagcucuuugggaugugccuucccccgccgccacccagaaagcugcccugucugagggcguguaccgcaucaugcagcggggccuguucgggaagacacaggucggagugggcauucacauggaagggguuuuccacaccauguggcaugugacgagaggaagcgucaucugucacgagaccggccgccucgaaccuuccugggcggacgugcggaaugauaugauuucuuaugggggaggcuggagacugggcgacaaaugggauaaggaggaggacguucaagugcuugcuaucgaacccgggaagaacccgaaacauguccagacaaagccuggacuguuuaaaacccucacaggcgagaucggggccgugacccuggacuucaagcccggaacaagcggcuccccuauuaucaaucgcaaagggaagguuauuggccucuacggaaacggcguggucacgaaaagcggggauuaugugucugccaucacccaggcugaacggauuggagagcccgacuacgagguggaugaagacaucuuuagaaagaagcggcugacaauuauggaucuucaccccggcgccgggaaaaccaagcgcauccugccuuccaucgucagagaggcgcugaaacggcgccucagaacccugauucuugcuccgacacggguuguggccgccgaaauggaggaagcucugagaggacuccccauccgcuaucagacgccugccgugaagagcgagcauaccggccgggagauugucgaccugaugugccacgcuacauucaccacaagacuccugucuuccacccgcgugcccaauuacaaccuuaucguuauggaugaagcccacuuuacggacccuagcuccguggcggcccggggguacauuucuacaagagucgagaugggcgaagcugccgcuaucuucaugaccgccacccccccuggagccacagauccguuuccccaaagcaauuccccuaucgaggacauugaacgcgagauccccgagcggagcuggaacaccggcuucgauuggauuacagacuaucaggggaaaaccgugugguuuguuccuucuaucaaggcuggaaaugacauugcgaacugccugagaaaguccggcaaaaaggugauccagcugagccgcaaaacguucgauacagaauaccccaagaccaaacucacagacugggauuuugucgugaccacggacaucucugagaugggggccaacuucagagcuggacgggucauugauccgcgcagaugucugaagccugugauccuuaccgacggccccgaacggguuauucuggccgggcccaucccugugacacccgccagcgcugcccaacgcagaggccggauuggaagaaauccugcgcaggaggaugaccaguauguguucuccggcgauccgcucaagaacgacgaagaucaugcucacuggaccgaggccaaaaugcugcuggacaauaucuacacacccgaggggauuaucccuacccucuuuggacccgaacgcgagaagacacaggccaucgauggcgaauuccggcuuagaggggagcaacgcaaaaccuuugucgagcugaugcggagaggagaccugccuguuuggcucucuuauaagguggcuagcgccggcauuuccuacaaagaccgggaauggugcuucacgggcgagcgcaacaaucagauccuggaagagaacauggaaguggagauuuggacaagagagggggaaaagaagaaacuucggcccaaguggcuggaugcgcgcgucuaugccgacccgauggcucucaaagauuuuaaggaguucgccucuggaagaaaaagcaucacccuggacauucugaccgaaaucgcuucccucccuacauaccuuagcucucgggccaagcuggcucuggauaauaucgugaugcuccauaccacagagcgcggcgggagagccuaccagcacgcgcugaacgaacuucccgagucccuggagacgcucaugcugguugcccugcucggagcuaugaccgccggcauuuuucuuuucuuuaugcaggggaagggaaucggcaaacugagcaugggccugauuacaaucgcuguggccuccgggcuccugugggucgccgaaauucaaccucaguggaucgcugcgucuaucauucuugaguucuuucugauggugcuccugauccccgaaccugagaagcagcggaccccccaggacaaucaacugauuuaugucauccucacaauucuuaccaucauuggacugaucgccgcuaacgaaaugggccugaucgagaaaacgaagaccgauuucggguuuuaccaggugaaaacagagaccacaauucucgacguugaucugcgcccggccagcgccuggacccuuuaugcuguggccacgacaauccugaccccuaugcucagacacacaauugaaaauaccuccgcgaaccugucucuggccgcuaucgccaaucaggcugccguccucaugggacuuggcaagggguggccccugcaucggauggaccugggagugccccuccuggcgaugggcuguuacagccagguuaacccuaccacacuuacggccucccuggugaugcuccugguccacuaugcuauuaucggcccggggcugcaagccaaagcuaccagagaggcccagaagcgcacagcugccggaaucaugaagaaucccaccguggauggcauuacagugaucgaccucgaaccuauuagcuacgaucccaaauucgagaagcagcuugggcaaguuaugcugcugguccucugcgcgggacagcugcuucugaugcggaccacgugggccuucugugaggugcucacacuggcuaccggcccuauccugacccucugggaagggaaccccggaagauuuuggaacacaaccauugccgugucuacagcuaauaucuuccgcggcuccuaucuugccggcgccgggcuggcguuuagccugaucaaaaacgcucagacgccucggagaggaaccggcacagccggggagacccucggagaaaaguggaaacgccagcugaauucucuugaccggaaggaguucgaagaguacaagagauccggcauucuggaggucgaccgcacagaagcuaaaagcgcccucaaggaugggucuaaaaucaagcaugccguuagccggggauccucuaaaauuagauggaucguggagcgcggcauggugaagccgaagggcaaagucguggaccuggggugcggacggggcggguggagcuacuauauggcuacccugaagaacguuacggaagugaaaggauacaccaagggcgggcccggacacgaggaaccuauucccauggccacauauggcuggaaucucgucaaacuucauuccggcguggauguuuuuuacaagccuaccgagcaaguggacacacugcugugugauaucggggagagcuccucuaaccccaccauugaagagggaagaacaaugcgcguccucaagaugguggaaccguggcugagcuccaaaccugaguucugcaucaaggugcuuaaucccuauaugcccaccgucaucgaagagcuggagaaacuccagagaaagcacggcgggaaccugguucgguguccucugucucgcaauagcacgcacgaaauguacuggguguccggagcgucuggcaacauugugagcuccgucaauacaaccagcaaaaugcuccuuaacagauuuaccacacggcauagaaagcccacguaugagaaagacguggaucugggggccggaacccggucuguuuccacagaaaccgagaagccugacaugacaaucauuggccgcagacugcagcggcuccaggaggaacacaaggagaccuggcauuacgaucaagaaaauccguaccgcacaugggcuuaucacggcagcuacgaggcccccucuaccggguccgcuagcucuauggugaacggagucgugaaacugcuuacgaagccuugggacguuauccccauggugacccagcuggccaugacagauaccacaccuuucggccagcagagagucuuuaaagaaaagguggacacccggacgccccaaccgaaaccugggacacgcaugguuaugaccacaaccgcgaauuggcucugggcccugcugggaaagaagaaaaaccccagacucugcacgcgggaggaguucauuuccaaggugcgcagcaaugcugccaucggcgcugucuuucaggaagagcagggguggaccuccgccagcgaagcugugaacgacucuagauucugggagcuggucgauaaagaacgggcccuucaccaagagggcaagugugagagcugcguguauaacaugaugggaaaacgcgaaaagaagcugggcgaguuugggagagcgaaaggaucccgggccaucugguacauguggcucggcgcucgcuuccuggaauucgaggcccuuggguuucugaaugaagaccauugguucggaagagagaacucuuggagcggcguugagggggaaggccuccaccggcugggauauauucuggaggaaaucgauaagaaagacggcgaucucauguacgcugacgauacagccgggugggacaccagaauuacagaggaugaccugcagaaugaggaacuuaucaccgagcagauggccccucaucacaagauucuggcgaaagcuaucuuuaagcucacauaucagaacaagguggucaaagugcugcgccccaccccucggggagccgugauggauaucauuuccagaaaggaccaacgcggcucugggcagguuggaacguacggccuuaauacauucaccaacauggaagugcagcugauccggcagauggaggccgaaggggucauuacccaagaugacaugcagaaucccaaaggccucaaggagagaguggagaaauggcugcgcgaaugcggaguugaccggcugaagagaauggcuaucagcggcgaugacuguguggucaaaccgcucgaugagcgcuuugggacaucccugcuuuuccugaacgacaugggaaaggugcggaaggauauuccucagugggaacccucuaaaggcuggaagaauuggcaggagguccccuuuugcagccaucacuuccacaaaaucuuuaugaaggacgggagaucccucgugguuccuugucgcaaccaagaugaacugaucggacgggccagaauuagccagggcgcuggguggucucuucgggagaccgccugccugggcaaagcguacgcccagauguggucccucauguauuuccauagacgcgaccugcggcuggcuagcauggccaucuguucugcugugccgacagagugguuucccacguccagaaccacauggagcauucacgcccaucaccaguggaugaccacagaagauaugcucaaggucuggaaucgcguguggaucgaggacaacccuaauaugauugauaagacccccguucacuccugggaagacaucccuuaccugggaaaaagagaggaccuuuggugcggcucucugauugggcucagcucccgggcgacgugggccaagaacauccauaccgcuaucacacaagugcgcaaucugauuggaaaagaagaguaugucgauuacaugcccgugaugaagagauauagcgccccuucugaguccgaaggcgugcuuuga

SEQ ID NO: 21055 - RNA, 9867 nt, Artificial Sequence
  derived and/or modified CDS sequence (opt5) from DENV-4__KJ596672__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccauguccgggcgcauuggaggccagacgcaucuugcuaucauugccguguucaagaugucuccuggcuacguucuggggguguuucucagaaaacugacaagccgggagaccgcccugauggucaucggaauggcuaugacaaccacccuuuccauuccgcacgaccugauggagcucaucgacggcaucucucuggggcucauucugcuuaagaucgugacacaguucgauaacacgcaaguuggaacccuggcccucagccugacauuuauucgcuccaccaugagccuggugauggcguggagaacaaucauggcuguccuuuucguggucacccugauuccccucugucggacgucuugccugcagaaacagucccauuggguggaaaucacagcccucauucugggcgcccaagcucuuccuguuuaucugaugacccucaugaagggggccagcagacgcucuuggccccugaaugagggaaucauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuauuaucgaagugaagcaggacgaggauggcagcuuuuccauucgggacguggaggaaacaaacaugaucacccugcuuguuaaacuggcgcucauuacagucucugggcuguacccccucgccaucccgaucacgaugacccugugguauauguggcaggugaagacacaaagaagcggagcucuuugggaugugccuucccccgccgccacccagaaagcugcccugucugagggcgucuaccgcauuaugcagcggggccuguucgggaagacacaggugggaguuggcauccacauggaagggguguuccacaccauguggcaugucacgagaggaagcgugauuugucacgagaccggccgccucgaaccuuccugggcggacguucggaaugauaugaucucuuaugggggaggcuggagacugggcgacaaaugggauaaggaggaggacgugcaaguccuugcuauugaacccgggaagaacccgaaacaugugcagacaaagccuggacuguuuaaaacccucacaggcgagaucggggccguuacccuggacuucaagcccggaacaagcggcuccccuaucauuaaucgcaaagggaaggugaucggccucuacggaaacggcgucgugacgaaaagcggggauuaugugucugccauuacccaggcugaacggaucggagagcccgacuacgaggucgaugaagacauuuuuagaaagaagcggcugacaaucauggaucuucaccccggcgccgggaaaaccaagcgcauucugccuuccaucguuagagaggcgcugaaacggcgccucagaacccugauccuugcuccgacacgggugguggccgccgaaauggaggaagcucugagaggacuccccauucgcuaucagacgccugccgucaagagcgagcauaccggccgggagaucguggaccugaugugccacgcuacauucaccacaagacuccugucuuccacccgcguucccaauuacaaccuuauugugauggaugaagcccacuuuacggacccuagcuccaucgcggcccggggguacauuucuacaagagucgagaugggcgaagcugccgcuaucuucaugaccgccacccccccuggagccacagauccguuuccccaaagcaauuccccuaucgaggacauugaacgcgagauccccgagcggagcuggaacaccggcuucgauuggauuacagacuaucaggggaaaaccgugugguuuguuccuucuaucaaggcuggaaaugacauugcgaacugccugagaaaguccggcaaaaaggugauccagcugagccgcaaaacguucgauacagaauaccccaagaccaaacucacagacugggauuuugucgugaccacggacaucucugagaugggggccaacuucagagcuggacgggucauugauccgcgcagaugucugaagccugugauccuuaccgacggccccgaacggguuauucuggccgggcccaucccugugacacccgccagcgcugcccaacgcagaggccggauuggaagaaauccugcgcaggaggaugaccaguauguguucuccggcgauccgcucaagaacgacgaagaucaugcucacuggaccgaggccaaaaugcugcuggacaauaucuacacacccgaggggauuaucccuacccucuuuggacccgaacgcgagaagacacaggccaucgauggcgaauuccggcuuagaggggagcaacgcaaaaccuuugucgagcugaugcggagaggagaccugccuguuuggcucucuuauaagguggcuagcgccggcauuuccuacaaagaccgggaauggugcuucacgggcgagcgcaacaaucagauccuggaagagaacauggaaguggagauuuggacaagagagggggaaaagaagaaacuucggcccaaguggcuggaugcgcgcgucuaugccgacccgauggcucucaaagauuuuaaggaguucgccucuggaagaaaaagcaucacccuggacauucugaccgaaaucgcuucccucccuacauaccuuagcucucgggccaagcuggcucuggauaauaucgugaugcuccauaccacagagcgcggcgggagagccuaccagcacgcgcugaacgaacuucccgagucccuggagacgcucaugcugguugcccugcucggagcuaugaccgccggcauuuuucuuuucuuuaugcaggggaagggaaucggcaaacugagcaugggccugauuacaaucgcuguggccuccgggcuccugugggucgccgaaauucaaccucaguggaucgcugcgucuaucauucuugaguucuuucugauggugcuccugauccccgaaccugagaagcagcggaccccccaggacaaucaacugauuuaugucauccucacaauucuuaccaucauuggacugaucgccgcuaacgaaaugggccugaucgagaaaacgaagaccgauuucggguuuuaccaggugaaaacagagaccacaauucucgacguugaucugcgcccggccagcgccuggacccuuuaugcuguggccacgacaauccugaccccuaugcucagacacacaauugaaaauaccuccgcgaaccugucucuggccgcuaucgccaaucaggcugccguccucaugggacuuggcaagggguggccccugcaucggauggaccugggagugccccuccuggcgaugggcuguuacagccagguuaacccuaccacacuuacggccucccuggugaugcuccugguccacuaugcuauuaucggcccggggcugcaagccaaagcuaccagagaggcccagaagcgcacagcugccggaaucaugaagaaucccaccguggauggcauuacagugaucgaccucgaaccuauuagcuacgaucccaaauucgagaagcagcuugggcaaguuaugcugcugguccucugcgcgggacagcugcuucugaugcggaccacgugggccuucugugaggugcucacacuggcuaccggcccuauccugacccucugggaagggaaccccggaagauuuuggaacacaaccauugccgugucuacagcuaauaucuuccgcggcuccuaucuugccggcgccgggcuggcguuuagccugaucaaaaacgcucagacgccucggagaggaaccggcacagccggggagacccucggagaaaaguggaaacgccagcugaauucucuugaccggaaggaguucgaagaguacaagagauccggcauucuggaggucgaccgcacagaagcuaaaagcgcccucaaggaugggucuaaaaucaagcaugccguuagccggggauccucuaaaauuagauggaucguggagcgcggcauggugaagccgaagggcaaagucguggaccuggggugcggacggggcggguggagcuacuauauggcuacccugaagaacguuacggaagugaaaggauacaccaagggcgggcccggacacgaggaaccuauucccauggccacauauggcuggaaucucgucaaacuucauuccggcguggauguuuuuuacaagccuaccgagcaaguggacacacugcugugugauaucggggagagcuccucuaaccccaccauugaagagggaagaacacuccgcguccugaagaugguggaaccguggcuuagcuccaaaccugaguucugcaucaaggugcugaaucccuauaugcccaccgucaucgaagagcucgagaaacugcagagaaagcacggcgggaaccugguucgguguccucucucucgcaauagcacgcacgaaauguacuggguguccggagcgucuggcaacauugugagcuccgucaauacaaccagcaaaaugcuucugaacagauuuaccacacggcauagaaagcccacguaugagaaagacguggaucugggggccggaacccggucuguuuccacagaaaucgagaagccugacaugaccauuaucggccgcagacuccagcggcugcaggaggaacacaaggagacauggcauuacgaucaagaaaauccguaccgcaccugggcuuaucacggcagcuacgaggcccccucuacaggguccgcuagcucuauggugaacggagucgugaaacuucugaccaagccuugggacguuauucccauggugacgcagcucgccaugaccgauacaaccccuuucggccagcagagagucuuuaaagaaaagguggacacacggaccccccaaccgaaaccugggacgcgcaugguuaugacaaccacagcgaauuggcugugggcccugcucggaaagaagaaaaaccccagacugugcacccgggaggaguucaucuccaaggugcgcagcaaugcugccaucggcgcugucuuucaggaagagcagggguggacguccgccagcgaagcugugaacgacucuagauucugggagcuugucgauaaagaacgggcccugcaccaagagggcaagugugagagcugcguguauaacaugaugggaaaacgcgaaaagaagcucggcgaguuugggagagcgaaaggaucccgggccauuugguacauguggcugggcgcucgcuuccuugaauucgaggcccugggguuucucaaugaagaccauugguucggaagagagaacucuuggagcggcguugagggggaaggccugcaccggcugggauauauccucgaggaaauugauaagaaagacggcgaucugauguacgcugacgauaccgccgggugggacacaagaaucaccgaggaugaccuucagaaugaggaacugauuacagagcagauggccccucaucacaagauccucgcgaaagcuaucuuuaagcugaccuaucagaacaagguggucaaagugcuucgccccacaccucggggagccgugauggauauuaucuccagaaaggaccaacgcggcucugggcagguuggaaccuacggccugaauacguucacaaacauggaagugcagcucauucggcagauggaggccgaaggggucaucacccaagaugacaugcagaaucccaaaggccugaaggagagaguggagaaauggcugcgcgaaugcggaguugaccggcucaagagaauggcuauuagcggcgaugacuguguggucaaaccgcuggaugagcgcuuugggaccucccuucuguuccucaacgacaugggaaaggugcggaaggauaucccucagugggaacccucuaaaggcuggaagaauuggcaggagguccccuuuugcagccaucacuuccacaaaaucuuuaugaaggacgggagaucccuggugguuccuugucgcaaccaagaugaacuuauuggacgggccagaaucagccagggcgcuggguggucucugcgggagacagccugccucggcaaagcguacgcccagauguggucccugauguauuuccauagacgcgaccugcggcucgcuagcauggccauuuguucugcugugccgaccgagugguuucccacauccagaacgaccuggagcauccacgcccaucaccaguggaugacaaccgaagauaugcugaaggucuggaaucgcguguggauugaggacaacccuaauaugaucgauaagacacccguucacuccugggaagacauuccuuaccuuggaaaaagagaggaccuguggugcggcucucucaucgggcugagcucccgggcgaccugggccaagaacauccauacggcuauuacccaagugcgcaaucuuaucggaaaagaagaguaugucgauuacaugagcgugaugaagagauauucugcccccuccgagagcgaaggcgugcuguga

SEQ ID NO: 21056 - RNA, 9867 nt, Artificial Sequence
  derived and/or modified CDS sequence (opt5) from DENV-4__KJ579242__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucauucugggcgauaccauguccgggcgcaucggaggccagacgcaucuugcuauuauggccguguucaagaugucuccuggcuacguucuggggguguuucucagaaaacugacaagccgggagaccgcccugauggucaucggaauggcuaugacaaccacccuuuccauuccgcacgaccugauggagcucaucgacggcaucucucuggggcucauucugcuuaagaucgugacacaguucgauaacacgcaaguuggaacccuggcccucagccugacauuuauucgcuccaccaugagccuggugauggcguggagaacaaucauggcuguccuuuucguggucacccugauuccccucugucggacgucuugccugcagaaacagucccauuggguggaaaucacagcccucauucugggcgcccaagcucuuccuguuuaucugaugacccucaugaagggggccagcagacgcucuuggccccugaaugagggaaucauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuauuaucgaagugaagcaggacgaggauggcagcuuuuccauucgggacguggaggaaacaaacaugaucacccugcuuguuaaacuggcgcucauuacagucucugggcuguacccccucgccaucccgaucacgaugacccugugguauauguggcaggugaagacacaaagaagcggagcucuuugggaugugccuucccccgccgccacccagaaagcugcccugucugagggcgucuaccgcauuaugcagcggggccuguucgggaagacacaggugggaguuggcauccacauggaagggguguuccacaccauguggcaugucacgagaggaagcgugauuugucacgagaccggccgccucgaaccuuccugggcggacguucggaaugauaugaucucuuaugggggaggcuggagacugggcgacaaaugggauaaggaggaggacgugcaaguccuugcuauugaacccgggaagaacccgaaacaugugcagacaaagccuggacuguuuaaaacccucacaggcgagaucggggccguuacccuggacuucaagcccggaacaagcggcuccccuaucauuaaucgcaaagggaaggugaucggccucuacggaaacggcgucgugacgaaaagcggggauuaugugucugccauuacccaggcugaacggaucggagagcccgacuacgaggucgaugaagacauuuuuagaaagaagcggcugacaaucauggaucuucaccccggcgccgggaaaaccaagcgcauucugccuuccaucguuagagaggcgcugaaacggcgccucagaacccugauccuugcuccgacacgggugguggccgccgaaauggaggaagcucugagaggacuccccauucgcuaucagacgccugccgucaagagcgagcauaccggccgggagaucguggaccugaugugccacgcuacauucaccacaagacuccugucuuccacccgcguucccaauuacaaccuuauugugauggaugaagcccacuuuacggacccuagcuccgucgcggcccggggguacaucucuacaagaguggagaugggcgaagcugccgcuauuuucaugaccgccacccccccuggagccacagauccguuuccccaaagcaauuccccuaucgaggacaucgaacgcgagauucccgagcggagcuggaacaccggcuucgauuggaucacagacuaucaggggaaaaccguuugguuugugccuucuauuaaggcuggaaaugacaucgcgaacugccugagaaaguccggcaaaaaggucauucagcugagccgcaaaacguucgauacagaauaccccaagaccaaacucacagacugggauuuuguggucaccacggacaucucugagaugggggccaacuucagagcuggacgggugaucgauccgcgcagaugucugaagccuguuauucuuaccgacggccccgaacgggugauccuggccgggcccauuccugugacacccgccagcgcugcccaacgcagaggccggaucggaagaaauccugcgcaggaggaugaccaguaugucuucuccggcgauccgcucaagaacgacgaagaucaugcucacuggaccgaggccaaaaugcugcuggacaauauuuacacacccgaggggaucauuccuacccucuuuggacccgaacgcgagaagacacaggccaucgauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauucuggaagagaacauggaagucgagaucuggacaagagagggggaaaagaagaaacuucggcccaaguggcuggaugcgcgcguguaugccgacccgauggcucucaaagauuuuaaggaguucgccucuggaagaaaaagcauuacccuggacauccugaccgaaauugcuucccucccuacauaccuuagcucucgggccaagcuggcucuggauaauaucguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaauuggcaaacugagcaugggccugaucacaauugcugucgccuccgggcuccuguggguggccgaaauccaaccucaguggauugcugcgucuaucauccuugaguucuuucugaugguccuccugauucccgaaccugagaagcagcggaccccccaggacaaucaacugaucuaugugauucucacaauccuuaccauuaucggacugauugccgcuaacgaaaugggccugaucgagaaaacgaagaccgauuucggguuuuaccagguuaaaacagagaccacaauccucgacguggaucugcgcccggccagcgccuggacccuuuaugcugucgccacgacaauucugaccccuaugcucagacacacaaucgaaaauaccuccgcgaaccugucucuggccgcuauugccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuaucauuggcccggggcugcaagccaaagcuaccagagaggcccagaagcgcacagcugccggaaucaugaagaaucccaccguggauggcaucacaguuauugaccucgaaccuaucagcuacgaucccaaauucgagaagcagcuugggcaagucaugcugcuggugcucugcgcgggacagcugcuucugaugcggaccacgugggccuucugugaggugcucacacuggcuaccggcccuauucugacccucugggaagggaaccccggaagauuuuggaacacaaccaucgccgucucuacagcuaauauuuuccgcggcuccuaucuugccggcgccgggcugguuuuuagccugaucaaaaacgcgcagacgccucggagaggaaccggcacagcuggggagacccucggagaaaaguggaaacgccagcugaauucucuugaccggaaggaguucgaagaguacaagagauccggcauccuggagguggaccgcacagaagccaaaagcgcucucaaggaugggucuaaaauuaagcaugccgugagccggggauccucuaaaaucagauggauugucgagcgcggcauggugaagccgaagggcaaaguuguggaccuggggugcggacggggcggguggagcuacuauauggccacccugaagaacgucacggaagugaaaggauacaccaagggcgggcccggacacgaggaaccuauccccauggcuacauauggcuggaaucucguuaaacuucauuccggcguggaugucuuuuacaagccuaccgagcaaguggacacacugcugugugauauuggggagagcuccucuaaccccaccaucgaagagggaagaacaaugcgcgugcucaagauggucgaaccguggcugagcuccaaaccugaguucugcauuaagguucuuaaucccuauaugcccaccgugaucgaagagcuggagaaacuccagagaaagcacggcgggaaccuggugcgguguccucugucucgcaauagcacgcacgaaauguacugggucuccggagccucuggcaacaucgugagcuccguuaauacaaccagcaaaaugcuccuuaacagauuuaccacacggcauagaaagcccacguaugagaaagacguggaucugggggcgggaacccggucugucuccacagaaaccgagaagccugacaugacaauuaucggccgcagacugcagcggcuccaggaggaacacaaggagaccuggcauuacgaucaagaaaauccguaccgcacaugggccuaucacggcagcuacgaggcucccucuaccggguccgccagcucuauggugaacggaguugugaaacugcuuacgaagccuugggacgucauucccauggugacccagcuggcuaugacagauaccacaccuuucggccagcagagaguuuuuaaagaaaagguggacacccggacgccccaaccgaaaccugggacacgcauggucaugaccacaaccgccaauuggcucugggcgcugcugggaaagaagaaaaaccccagacucugcacgcgggaggaguucaucuccaaggugcgcagcaaugccgcuauuggcgccgucuuucaggaagagcagggguggaccuccgcuagcgaagccgugaacgacucuagauucugggagcugguugauaaagaacgggcucuucaccaagagggcaagugugagagcugcguguauaacaugaugggaaaacgcgaaaagaagcugggcgaguuugggagagccaaaggaucccgggcgaucugguacauguggcucggcgcccgcuuccuggaauucgaggcucuuggguuucugaaugaagaccauugguucggaagagagaacucuuggagcggcgucgagggggaaggccuccaccggcugggauauauccuggaggaaauugauaagaaagacggcgaucucauguacgccgacgauacagcugggugggacaccagaaucacagaggaugaccugcagaaugaggaacuuauuaccgagcagauggccccucaucacaagauccuggccaaagcgauuuuuaagcucacauaucagaacaagguggugaaaguucugcgccccaccccucggggagcugugauggauaucaucuccagaaaggaccaacgcggcucugggcaggucggaacguacggccuuaauacauucaccaacauggaagugcagcugauucggcagauggaggccgaagggguuaucacccaagaugacaugcagaaucccaaaggccucaaggagagaguggagaaauggcugcgcgaaugcggagucgaccggcugaagagaauggccauuagcggcgaugacuguguggucaaaccgcucgaugagcgcuuugggacaucccugcuuuuccugaacgacaugggaaaggugcggaaggauaucccucagugggaacccucuaaaggcuggaagaauuggcaggagguucccuuuugcagccaucacuuccacaaaauuuuuaugaaggacgggagaucccucguggucccuugucgcaaccaagaugaacugaucggacgggcuagaaucagccagggcgccggguggucucuucgggagaccgcuugccugggcaaagccuacgcgcagauguggucccucauguauuuccauagacgcgaccugcggcuggccagcauggcuauuuguucugccgugccgacagagugguuucccacguccagaaccacauggagcauccacgcucaucaccaguggaugaccacagaagauaugcucaagguuuggaaucgcguguggauugaggacaacccuaauaugaucgauaagacccccguccacuccugggaagacauuccuuaccugggaaaaagagaggaccuuuggugcggcucucugaucgggcucagcucccgggccacgugggcgaagaacauucauaccgccaucacacaagugcgcaaucugaucggaaaagaagaguauguggauuacaugcccguuaugaagagauauagcgcuccuucugaguccgaaggcguccuuuga

SEQ ID NO: 21057 - RNA, 9867 nt, Artificial Sequence
  derived and/or modified CDS sequence (opt5) from DENV-4__GQ398256__SS-prME
agcaccaugacacugcugugccugauccccacggugauggccuuccaccuuuccacccgggacggagaaccucugaugauuguugcuaagcaugaacgggggagaccgcuccuguuuaaaacaaccgaaggaaucaacaaguguacacuuauugccauggaucugggcgaaaugugcgaagacaccguuacauacaaauguccccuccuggugaauaccgaaccugaagauaucgacugcugguguaaccugacgucuaccugggugauguaugggacaugcacccagaauggagagagacggcgcgaaaagagaagcguggcccucacaccccacuccggcauggggcuggagacccgggcugaaacguggaugucuagcgagggagccuggaaacaugcccagcgcguggaguccuggauucuuagaaacccuggcuucgcucugcucgccggcuuuauggcuuacaugaucgggcagacaggaauccagcggaccguuuucuuugugcugaugaugcuugucgcccccucuuauggcaugcgcuguguggggguuggaaauagagauuucguggaaggcgucagcgggggagcguggguggaccuggugcucgagcacggcggcugcgucacaaccauggcccaggggaagccuacccuggauuuugaacugacaaagacgaccgcuaaagagguugcccuccugcggacauacuguauugaggcuuccaucagcaacauuaccacagccacccgcugcccgacgcaaggagagcccuaucuuaaggaggaacaggaccagcaguacaucuguagacgggaugugguggaccgcggcugggggaauggaugcggccuguucgggaaaggaggcgucgugacaugcgcgaaguuucucuguucuggcaaaauuaccgggaaccugguucaaaucgagaaucuugaauauaccguggccgucacagugcauaacggagauacccacgcuguuggcaaugacacauccagccacggggugacggccaccauuacaccuagaucucccuccgucgaggugaagcugccugauuacggagaacucacccuggacugcgagccccggagcggcaucgacuucaacgagaugauccugaugaagaugaaaaagaaaacauggcucguccauaagcagugguuucuggaucuuccgcugccuuggaccgcuggggccgacacgucugaagugcacuggaaucauaaagagagaaugguuaccuucaaggugccccacgccaaacgccaggaugucacagugcucggcucccaggaaggagcuaugcacagcgcgcuggccggcgcuaccgagguugacuccggggauggaaaccauauguuugccggccaccuuaaguguaaggugcggauggaaaaacugagaauuaaggggaugucuuacacaaugugcagcggaaaauucuccaucgacaaggagauggccgagacccaacauggcacgacagucgugaaagugaaguaugaaggggcuggcgccccuuguaagguucccauugagauccgcgaugucaauaaagaaaagguggugggacggauuaucagcucuacccccuucgcggagaacacaaacuccgucaccaauaucgagcucgaaccuccguuuggcgacagcuacauugugaucgggguuggagagucugcucugacccugcacugguucagaaaaggcagcuccauugggaagauguuugaaucuacauaucgcggagccaaacggauggccauccucggcgagacggcuugggauuucgggagcgugggcggacuguuuaccucccuuggcaaggccguccaucagguguucgggagcguuuacacaaccauguuuggaggcgugucuuggaugguccgcauucugaucggguuccucgugcuguggaucggaacaaacucccgcaauaccagcauggcuaugacgugcauugccguuggcgggaucacacuguuucuuggcuucaccgugcaggcggacaugggaugugucgugucuuggaacggcaaggaacucaaaugcggguccggaauuuuuguggucgauaauguucacaccuggacagagcaauauaaguuccagcccgagagcccugcccggcuggcuuccgccauccugaacgcucacaaagacggcgugugugggauuagaucuaccacacgccucgaaaaugugauguggaagcagaucacgaacgagcugaauuacguccuuugggaaggaggccaugaccugaccgugguugccggcgaugugaaagggguccucacaaagggaaagcgggcgcugacacccccugugaacgaccugaaauauagcuggaagacauggggcaaagccaagauuuuuacccccgaggcuagaaauuccacguuccuuaucgaugggccggacaccucugaaugcccuaacgagcggcgcgccuggaauuucuuugagguugaagauuacggauucggcauguuuacaaccaacaucuggaugaaauucagagaggggagcuccgaagugugugaccaccggcucaugagcgcugccauuaaggaucagaaagccguccaugcugacaugggauacuggaucgagucuuccaagaaucaaacauggcagauugaaaaggcgagccugaucgaggugaaaaccugccuguggcccaagacacacacccucuggucuaacggcguucuggagucccagaugcuuauuccuagaagcuaugccggccccuuuucucagcacaacuaccgccaaggguaugcuacgcagacagugggaccuuggcaucugggcaaacucgaaaucgauuucggggagugccccggaaccaccgucgccauccgggaagacugugaucacagaggcccgagccugcgcacaaccacggccuccgggaagcuggugacacaguggugcuguagaagcugcaccaugccuccccuucgguuucucggagaggacggcuguugguacggcauggagauucgcccccugucugaaaaagaggaaaauauggugaagucccaggucacagcugggcaaggaaccagcgagacauucuccaugggccugcucugccugacccuuuuuguugaagagugucugagacggcgcgugacgagaaagcauaugauccucguggucgugauuaccuucugcgccaucauucucgggggacugacauggauggaucuucuccgggcgcugaucaugcugggcgacaccaugucugggcgcaucggaggccagauucaccucgcuaucauggccguuuuuaaaaugagcccuggcuaugugcugggggucuuccuuagaaagcugacaucccgggagaccgcccucauggugauuggaauggcuaugacgacagucuuuucuaucccgcaugaccugauggaacugauugauggcaucagccuugggcugauccuccugaaaauugugacccacuucgacaacacacaggucggaacccucgcccugucccuuaccuuccugcgcucuacaaucccccucgugauggcguggagaacgauuauggcugucuuuuucgugguuacccugaucccucugugucggacaagcugccuucagaagcaaucccacuggguggagauuaccgcccugauccucggcgcccaggcucugcccgucuaccucaugacacugaugaaaggggccagcagacgcucuuggccucuuaaugaaggaauuauggcugugggccugguuucccuccugggcagcgcccugcuuaagaacgaugugccccuggcggggccuauggucgccggaggccuccugcucgcugccuaugugaugucuggguccagcgcugaccugucucuugagaaggccgccaaugugcagugggaugaaauggcugacaucaccggauccagccccaucauugagguuaaacaagaugaggacggcuccuuuagcauccgggaugucgaagagacgaacaugauuacacugcuggugaagcucgcgcugaucaccgugucugggcuuuacccgcuggccauuccugucaccauggcucucugguacaucuggcaagugaaaacacagagaagcggagcccugugggacguucccuccccugccgcuacccagaaggccacacucucugaaggcguguaucgcaucaugcaacggggccuguucgggaaaacgcaggucggagugggcauucauauggaggggguuuuucacaccauguggcaugugacaagaggaagcgucaucugucacgaaaccggccgccuugagcccuccugggcggaugugcggaaugacaugauuucuuacgggggaggcuggagacugggcgauaagugggacaaggaggaagacguucaggugcuggcuaucgagccggggaaaaacccuaagcauguccagacaaaacccggacucuucaagacccugacgggcgaaauuggggccgugacccuugauuuuaaaccuggaacaagcggcucccccaucaucaauaagaaagggaaggugauuggccuguauggaaacggcgucguuaccaagucuggggacuacgugagcgccaucacacaagcugagcgcauuggagagcccgauuaugaaguggacgaggauaucuuccggaaaaagagacucaccauuauggaccugcacccuggcgccgggaaaacaaagcggauccucccguccauuguccgcgaagcgcugaaaagacggcuucgcacgcugauccuggcucccaccagagugguugccgccgagauggaagaggcucuccggggacugccuaucagauaccagacacccgccgucaagagcgagcacaccggccgcgaaauugucgaucuuaugugccaugcuaccuuuacaacgcggcugcucucuuccaccagagugccuaauuauaaccugaucguuauggacgaggcccacuucacagaucccugcagcguggcggcccgcggguacauuucuacccgggucgaaaugggcgaggcugccgcuaucuuuaugacagccaccccuccgggagccacggaccccuucccucaguccaauagccccauugaagauaucgagagagagaucccugaacgcuccuggaacacaggcuucgacuggauuaccgacuaccaggggaagaccgugugguuuguccccucuaucaaagcuggaaaugauauugcgaacugucucagaaagagcggcaaaagagugauccaacugucccgcaagacauucgacaccgaguauccgaaaacaaaacuuaccgauugggacuuuguugugacgacagauauuagcgaaaugggggccaacuucagagcuggacgggugaucgacccucgcagaugccugaagcccgucauccugaccgauggccccgagcggguuauucucgccgggccuauccccgugaccccugccucugcugcccagcgcagaggccggauuggaagaaauccggcgcaggaagacgaucaauacguguuuuccggcgacccccugaaaaacgaugaggaccaugcucacuggacagaggccaagaugcuucuggauaauaucuauacgccugaagggauuauccccacccucuucggaccugagcgcgagaagacccaggccauugacggcgaguuucggcugagaggggagcagcgcaagaccuucgucgaacugaugaaacggggagaccuccccguguggcuuagcuacaagguugcuucugccggcaucagcuauaaggauagagagugguguuuuacaggcgaacggaacaaucagauccuggaggaaaacauggagguggagauuuggaccaaagaaggggagaagaaaaagcugcgcccgaaauggcucgacgcgagagucuacgccgauccuauggcucugaaggacuucaaggaauuugccuccggacggaaaucuaucacacuugauauucugaccgagaucgcuagccuccccacguaucuguccucuaaggccaaacuggcucucgacaauauugugaugcuucacacaaccgaaaagggcgggcgcgccuaccaacaugcgcugaacgagcugccugagagccucgaaacccugaugcuugucgcccugcucggagcuaugacagccggcaucuuccuguuuuucaugcaggggaaaggaaucggcaagcuguccaugggccucauugcuaucgccguggccagcgggcuucuguggguugcugagauucagccccaguggaucgcggccucuauuauccuggaguucuuucucauggugcugcuuaucccugagcccgaaaaacaaagaaccccgcaggauaaucagcugauuuacgucauccucacaauucugacgaucauuggacugaucgcugccaacgagaugggccucauugagaagaccaagacagacuucggguuuuaucaggugaaaaccgaaacaaccauccuugauguugaccugcggccugccuccgcuuggacgcuguacgccguggcgaccacaauccucacccccaugcugcgccacacaauugagaauaccagcgccaaccuuucccuggcugccaucgcuaaucaagccgcgguccucaugggacugggcaagggguggccccugcauagaauggaucucggagugccucuucuggccauuggcugcuauucucaggugaacccgacgacacugaccgcuagccucguuaugcugcuuguccacuacgccaucauuggccccgggcugcaggcuaaagccacacgggaagcucagaagcgcaccgccgcgggaaucaugaaaaauccuaccguggacggcaucacagugauugaucucgagcccaucuccuaugacccuaaguucgagaagcaacuggggcaggucaugcugcucguucuuugugugggacagcugcugcucaugagaacgaccugggcccugugcgaagugcuuacacuggcuaccggccccgccaugacacucugggaggggaacccuggacgguuuuggaacaccacgauugcugucucuacagccaauaucuucagaggcagcuaccuggccggcgcggggcuggcuuuuucccucauuaaaaacgcccaaaccccgcgccggggaaccggcacaaccggggaaacacuuggagagaaguggaaaagacagcugaauagccuggaccgcaaggaguucgaggaguauaaacggucuggcauccucgaaguggauagaacggaggcuaaguccgcccugaaggacgggagcaaaaucaagcaugccguuucucgcggauccagcaaaauucgguggaucguggaaagaggcauggucaagcccaaaggcaaggugguugaucuuggguguggacgcggcggguggucuuacuacauggcuacccugaagaacgugacagaggucaaaggauauaccaagggcgggccuggacacgaagaacccauuccuauggccacauacggcuggaaucucgugaaacugcacagcggcguggacgucuuuuauaagcccaccgagcagguugauacgcugcucugcgacaucggggaauccucuagcaacccgaccauugaggaaggacggacacuuagagugcugaaaaugguggagccuuggcuguccagcaagcccgaguucuguaucaaaguccucaaucccuacaugccuaccgugauugaggagcuggaaaaacuucagcgccgguauggcgggucccugguuagaugcccccucucucgcaacagcacacaugagauguacuggguguccggagcgucuggcaauaucgucagcuccgugaacaccaucucuaagaugcugcugaauagauuuacaacccggcaccgcaaaccuacguaugaaaaggauguugaccucggggccggaacaagaagcguguccaccgagaccgagaaaccggauaugacagucauuggccggagacuucaacggcugcaggaagaacauaaggaaacguggcacuacgaccaggagaaccccuaccgcaccugggcuuaucacggcagcuacgaagccccuucuacaggguccgcuagcucuauggugaauggaaucguuaaacugcucaccaagcccugggaugugauuccuauggucacacagcuggccaugaccgacacaacccccuucggccaacagagaguguuuaaggagaaagucgacacgcggaccccgcagccuaagcccgggacacgcaugaucaugaccacaaccgcgaacuggcuuugggcccugcucggcaagaagaaauccccuagacuguguacgcgggaggaguucauuagcaaggugcgcucuaaugcugccaucggcgcuguuuuccaggaggaacaaggguggacauccgccagcgaggcugugaacgauuccagauuuugggaacuggucaauaaggagcgggcccuccaucaggagggcaaaugcgaaagcugcguguauaacaugaugggaaagcgcgagaaaaagcugggcgaguucgggagagcgaaaggaucucgggccaucugguacauguggcuuggcgcucgcuuucuggaguucgaagcccucggguuucugaacgaggaccacugguucagcagagaaaauuccuggucuggaguggaaggcgaggggcuucaucggcugggcuauauucucgaagauaucgacaagcaggauggagaccugauuuacgcugaugacaccgccggcugggauacacgcaucaccgaggacgaucugcucaacgaggaacugauuacggagcaaauggcgccccaccauaagacccuugcgaaagcuaucuuuaagcugacauaucagaauaaaguugugaagguccucagaccuacccccaaaggggccgugauggacaucauuagccggaaggaucagagaggauccggccagguugggacauacggacugaacaccuucacaaauauggaagugcaacuuauccgccagauggaggccgaaggcgucauuacccaggacgacaugcagaacccgaaagggcugaaggagcggguggagaaguggcucacggaauguggcgucgauagacugaaacgcauggcuaucucuggagacgauugcgugguuaagccucuggacgagcgguuuagcgccucccuccuguuccuuaaugauaugggcaaagugagaaaggacauuccccaaugggaacccucuaaaggguggaagaacuggcaggaggucccuuuuuguagccaccacuuccauaagaucuuuaugaaagauggacgcucccuggugguuccgugccggaaucaggacgaacucaucggcagagcucgcauuagccagggggccggauggucucugcgggagacagcgugucuuggcaaggccuacgcucaaauguggucccugauguauuuccacagacgcgaucuccggcuggccagcauggcuaucugcucugccgugcccaccgagugguucccuaccuccagaacaaccuggagcauucaugcgcaccaccaguggaugacaacggaagacaugcugaaagucuggaaccggguguggaucgaggauaaucccaacaugaccgacaagacaccugugcauuccugggaagacauucccuaccucgggaaaagagaggaucugugguguggcucucuuaucggacugagcucccgcgccaccugggcuaagaauauucacacagccaucacccagguucggaaccucaucggcaaggaagaguaugucgacuacaugccugugaugaaaagauauagcgcucccucugaguccgaaggggugcuguga

SEQ ID NO: 21058 - RNA, 9867 nt, Artificial Sequence
  derived and/or modified CDS sequence (opt5) from DENV-4__KC333651__SS-prME
agcaccaugacacugcugugccugauccccacggugauggccuuccaccuuuccaccagagacggagaaccucugaugauugucgcuaagcaugaacgggggcgcccgcuccuguuuaaaacaaccgaaggaaucaacaaguguacacuuauugccauggaucugggcgaaaugugcgaagacaccguuacauacaaauguccccuccuggugaauaccgaaccugaggauaucgacugcugguguaaccugacgucuaccugggugauguaugggacaugcacccagaauggagagagacggcgcgaaaagagaagcgucgcccucacaccccacuccggcauggggcuggagacccgggcugaaacguggaugucuagcgagggagccuggaaacaugcccaacgcguggaguccuggauucuuagaaacccuggcuucgcucugcucgccggcuuuauggcuuacaugaucgggcagacaggaauccagcggauuguuuucuuugugcugaugaugcuugucgcccccucuuauggcaugcgcuguguggggguuggaaauagagauuucguggaaggcgucagcgggggagcguggguggaccuggugcucgagcacggcggcugcgucaccacaauggcccaggggaagccuacccuggauuuugaacugaccaagacaacggcuaaagagguugcccuccugcggaccuacuguaucgaggcuuccauuagcaacaucacaaccgccacacgcugcccgacccaaggagagcccuaucuuaaggaggaacaggaccagcaguacauuuguagacgggaugugguggaccgcggcugggggaauggaugcggccuguucgggaaaggaggcgucgugacgugcgcgaaguuucucuguucuggcaaaaucacagggaaccugguucaaauugagaaucuugaauauaccguggucgugaccguucauaacggagauacacacgccgugggcaaugacaccuccaaccacggggucacagcuacgaucaccccuagaagccccucuguggaggucaagcugccugauuacggagaacucacacuggacugcgagccccgguccggcaucgacuucaaugagaugauucugaugaagaugaaaaagaaaaccuggcucgugcauaagcagugguuucuggaucuuccgcugccuuggacagccggggcugacaccagcgaaguucacuggaaccauaaagagagaauggugacguucaaggucccccacgccaaacgccaggaugugaccguucucggcucucaggaaggagccaugcacuccgcucuggcgggcgccacagagguggacagcggggauggaaaucauauguuugcuggccaccuuaaguguaagguccggauggaaaaacugagaaucaaggggauguccuacaccaugugcucuggaaaauucagcauugacaaggagauggccgagacacaacauggcaccacgguggugaaaguuaaguaugaaggggccggcgcuccuuguaagguccccaucgagauucgcgaugugaacaaagaaaagguggucggacggaucaucuccagcacacccuucgccgagaacaccaauucugugacaaacauugagcucgaaccuccguuuggcgacuccuacaucguuauuggggugggagagagcgcgcugacccugcacugguucagaaaaggcucuagcaucgggaagauguuugaauccaccuaucgcggagcuaaacggauggccauucucggcgagacagccugggauuucgggucugucggcggacuguuuacgagccuuggcaaggcugugcaucagguuuucggguccguguacaccacaauguuuggaggcgucagcuggauggugagaauccugaucggguuccucguucuguggauuggaaccaauucucgcaacacauccauggccaugaccugcaucgcugugggcgggauuacgcuguuucuuggcuucacaguccaggccgacaugggauguguggugagcuggaauggcaaggaacucaaaugcgggucuggaaucuuugucguugauaacgugcacaccuggaccgagcaauauaaguuccagcccgaguccccugcgcggcuggccagcgcuauucugaaugcccacaaagacggcgugugugggaucagauccacaacccgccucgaaaacgucauguggaagcagauuacaaaugagcugaacuacgugcuuugggaaggaggccaugaccugacgguuguggcuggcgaugucaaaggggugcucaccaagggaaagcgggcccugacacccccuguuaaugaccugaaauauucuuggaagaccuggggcaaagcgaagaucuuuacacccgaggccagaaacagcaccuuccuuaucgaugggccggacacguccgaaugcccuaaugagcggcgcgcuuggaacuucuuugagguggaagauuacggauucggcauguuuaccacaaauauuuggaugaaauucagagaggggucuagcgaagucugugaccaccggcucauguccgccgcuaucaaggaucagaaagccgugcaugccgacaugggauacuggauugagagcucuaagaaccaaaccuggcagaucgaaaaggcuucccugauugagguuaaaacaugccuguggcccaagacccacacacucuggagcaacggcgugcuggagucucagaugcuuaucccuagauccuaugcgggccccuuuagccagcacaauuaccgccaaggguaugccacccagacggucggaccuuggcaucugggcaaacucgaaaucgauuucggggagugccccggaacaaccguggcuauucgggaagacugugaucacagaggcccgucucugcgcaccacaaccgccagcgggaagcuggugacgcaguggugcuguagauccugcacaaugccuccccuucgguuucucggagaggacggcuguugguacggcauggagauccgcccccugagcgaaaaagaggaaaacauggucaagucucagguuaccgccgggcaaggaacauccgagaccuucagcaugggccugcucugccugacacuuuuuguggaagagugucugagacggcgcgugaccagaaagcauaugauucucgucgugguuaucacguucugcgcuauuauccucgggggacugaccuggauggaucuucuccgggcccugaucaugcugggcgacacaauguccgggcgcauuggaggccagauccaccucgcgauuauggcuguguuuaaaaugucuccuggcuauguccuggggguguuccuuagaaagcugaccagccgggagacagcccucaugguuaucggaauggccaugaccacgguguuuuccauuccgcaugaccugauggaacugaucgauggcaucucucuugggcugauucuccugaaaaucgucacacacuucgacaauacccaggugggaacacucgcucugagccuuaccuuccugcgcuccaccauuccccucgucauggccuggagaacaaucauggcgguguuuuucguugugacgcugauuccucugugucggaccucuugccuucagaagcacagccauugggucgagaucacagcucugauucucggcgcccaagcccugcccguguaccucaugacccugaugaaaggggcuuccagacgcagcuggccucuuaacgaaggaaucauggccguuggccuggugucucuccugggcuccgcucugcuuaagaaugaugucccccuggccgggccuaugguggcgggaggccuccugcucgccgcuuaugugaugagcgggucuuccgccgaccugcuucuggagaaggcugccaacguucagugggaugaaauggccgacaucacaggaagcucucccauuaucgaggucaaacaggaugaggacggcuccuuuagcauucgggauguggaagagaccaauaugaugacgcugcucgugaagcuggcucuuaucacagucuccgggcuguacccgcucgcgauuccugugaccauggcccugugguacaucuggcaaguuaaaacccagagaagcggagcucucugggacgugcccucuccugccgccacacagaaggcuacccugagcgaaggcgucuaucgcaucaugcagcggggccuuuucgggaaaacacaagugggaguuggcauucacauggaggggguguuucauacgauguggcacgucaccagaggauccgugaucugucaugaaacaggccgccuggagcccucuugggccgauguucggaacgacaugauuagcuacgggggaggcuggagacugggcgauaagugggacaaggaggaagacgugcagguccucgcgaucgagccggggaaaaauccuaagcacgugcagaccaaacccggacuguucaagacacuuaccggcgaaauuggggcugugacgcuggauuuuaaaccuggaaccuccggcucucccaucaucaacaagaaagggaaggucauuggccucuauggaaauggcguugugacaaagagcggggacuacguguccgccaucacccaggccgagcgcauuggagagcccgauuaugaagucgacgaggauaucuuccggaaaaagagacugacaauuauggaccuccacccuggcgcugggaaaaccaagcggauccugccgucuauugugcgcgaagcccuuaaaagacggcugcgcacacugauccucgcgcccacgagaguuguggcugccgagauggaagaggcccugcggggacuuccuaucagauaccaaacccccgcugucaagagcgagcauacaggccgcgaaauuguggaucugaugugccacgccaccuuuaccacacggcuccuguccagcacgagaguuccuaacuauaaucucaucgugauggacgaggcucauuucaccgaucccugcucugucgccgcgcgcggguacauuuccacacggguggaaaugggcgaggccgcugccaucuuuaugaccgcuacaccuccgggagccaccgaccccuucccucagagcaacucucccauugaagauaucgagagagagaucccugaacgcuccuggaauacgggcuucgacuggauuacagacuaccaggggaagaccgucugguuugugcccagcaucaaagccggaaacgauauugcuaacugucugcggaaguccggcaaaagaguuauccagcuuucucgcaagaccuucgacacagaguauccgaaaaccaagcugacagauugggacuuuguggugaccacggauauuagcgaaaugggggcgaauuucagagccggacgggucaucgacccucgcagaugccugaagcccguuauccucacagauggccccgagcgggugauucuggcugggccuauccccgugaccccugccuccgccgcucaacgcagaggccggauuggaagaaacccggcccaggaagacgaucaguacgucuuuagcggcgacccccuuaaaaaugaugaggaccacgcgcacuggacagaggcuaagaugcugcucgauaacaucuauaccccugaagggauuauccccacgcuguucggaccugagcgcgagaagacccaagccauugacggcgaguuucggcugagaggggagcagcgcaagacauucguggaacucaugaaacggggagaccuucccguuuggcugucuuacaagguggccuccgcuggcaucagcuauaaggauagagagugguguuuuaccggcgaacggaauaaccagauccuggaggaaaauauggaggucgagauuuggacaaaagaaggggagaagaaaaagcuccgcccgaaauggcuggacgccagaguguacgcggauccuauggcccuuaaggacuucaaggaauuugcuucuggacggaaaagcaucacccuggauauucucacagagaucgccucccugcccaccuaucugucuagcaaggcuaaacucgcccuugacaacauugucaugcugcauacgacagaaaagggcgggcgcgcuuaccagcacgcccugaaugagcucccugagucccuggaaacccuuaugcugguggcgcuccugggagccaugaccgcuggcaucuuccuguuuuucaugcaagggaaaggaaucggcaagcucucuaugggccuuauugccaucgcuguugccagcgggcugcuguggguggccgagauucagccccaguggaucgcugcguccauuauccucgaguucuuucugaugguccuucugaucccugagcccgaaaaacagagaacaccgcaagauaaccagcucauuuacgugauccugaccauucugacaaucauuggacucaucgccgcuaaugagaugggccuuauugagaagacgaagaccgacuucggguuuuaucagguuaaaacagaaaccacaauccuggauguggaccugcggccugccagcgccuggacccucuacgcugucgccacgaccauccugacacccaugcuucgccauaccauugagaacacaucugcgaaucugucccucgccgcuaucgccaaccaggcugccgugcugaugggacugggcaagggguggccccuccacagaauggaucuuggagugccucugcuggcgauuggcugcuauagccaaguuaauccgaccacgcucacagccucccuggucaugcuucuggugcauuacgcuaucauuggccccgggcuccaggccaaagcuacccgggaagcccagaagcgcacagcugccggaaucaugaaaaacccuaccguggacggcaucaccgucauugaucuggagcccaucucuuaugacccuaaguucgagaagcagcuggggcaaguuaugcuccuugugcugugugcgggacagcugcuccugaugagaacaacgugggcccuuugcgaagugcugacccucgcuacaggccccgccaugacccugugggaggggaacccuggacgguuuuggaauacaaccauugcugucagcacggccaacaucuucagaggcuccuaccuggccggcgcggggcucgcuuuuucucuuauuaaaaaugcccagacaccgcgccggggaaccggcaccacaggggaaacccugggagagaaguggaaaagacaacugaacagccucgaccgcaaggaguucgaggaguauaaacgguccggcauccuggaaguggauagaacagaggcuaagagcgcccuuaaggacgggucuaaaaucaagcacgccguuucccgcggaagcucuaaaauucgguggaucguggaaagaggcauggucaagcccaaaggcaaggugguugaucugggguguggacgcggcgggugguccuacuacauggcuacgcucaagaaugugaccgaggucaaaggauauacaaagggcgggccuggacacgaagaacccauuccuauggccaccuacggcuggaaccuggugaaacugcauagcggcguggacgucuuuuauaagcccacagagcagguugauacccuccuuugcgacaucggggaaucuagcuccaauccgacgauugaggaaggacggacccugagagugcugaaaaugguggagccuuggcucucuagcaagcccgaguucuguaucaaaguccugaaccccuacaugccuacagugauugaggagcuugaaaagcugcagcgccgguauggcgggucccucguuagaugcccccugagccgcaauuccacccacgagauguacugggugucuggagcgagcggcaacaucgucuccucugugaauacaaucagcaagaugcugcucaacagauuuaccacacggcaucgcaaaccuaccuaugaaaaggauguugaccuuggggccggaacgagauccgugucuacagagaccgagaaaccggauaugaccgucauuggccggagacugcagcggcugcaagaagaacacaaggaaacauggcacuacgaccaggagaaucccuaccgcacgugggcuuaucauggcagcuacgaagccccuuccaccgggagcgcuucuuccauggugaacggaguugugaaacuccugacaaagcccugggaugucaucccuauggugacccagcuugccaugacagacaccacacccuucggccagcaaagagucuuuaaggagaaaguggacacccggacgccgcagccuaagcccgggacccgcaugauuaugacaaccacagcgaauuggcugugggcccuccugggcaaaaagaaaagcccuagacuguguacccgggaggaguucaucucuaagguucgcuccaacgcugccauuggcgcuguguuccaggaggaacagggguggacgagcgccucugaggcugucaaugauuccagauuuugggaacucguggacaaggagcgggcccugcaccaagagggcaaaugcgaaagcugcguguauaacaugaugggaaagcgcgagaagaaacuuggcgaguucgggagagcgaaaggaucccgggccaucugguacauguggcugggcgcucgcuuucucgaguucgaagcccugggguuucuuaacgaggaucauugguucagcagagaaaauucuuggagcggaguugaaggcgaggggcugcaccggcucggcuauauccuggaagacauugauaaacaggagggagaccugaucuacgcugaugacacagccggcugggauacccgcauuacagaggacgaucuccugaacgaagaacuuaucaccgaacagauggcgccccaucacaagacgcuggcgaaagcuauuuuuaagcucaccuaucaaaauaaaguggucaaggugcugagaccuacacccaaaggggccguuauggacaucaucucccggaaggaucagagaggaucuggccagguggggaccuacggacuuaacacauucaccaauauggagguccagcugauucgccaaauggaagccgagggcgugaucacacaggacgacaugcagaacccgaaagggcucaaggagcgggucgaaaaguggcugaccgaguguggcguggauagacugaaacgcauggcuauuagcggagacgauugcguugugaagccucucgacgaacgguuuuccacgucucugcuuuuccugaaugauaugggcaaagucagaaaggacaucccccagugggagcccagcaaaggguggaagaacuggcaagaagugccuuuuuguucccaccauuuccacaagauuuuuaugaaagauggacgcucucucguugugccgugccggaaucaggacgagcugaucggcagagcccgcaucagccagggggcuggauggucccuucgggagacagccugucugggcaaggcguacgcccagauguggagccucauguauuuccauagacgcgaucugcggcuggcuucuauggccauuugcuccgcuguccccaccgaaugguucccuaccagcagaacaaccuggucuauccacgcccaccaucaauggaugacaacggaggacaugcucaaaguguggaaccggguguggauugaagauaaucccaacaugaccgacaagacaccuguucacuccugggaggacauccccuaccuggggaaaagagaagaucuuugguguggcagccugauuggacucuccucucgcgcgaccugggccaagaauauccauacagcuauuacccagguccggaaccugaucggcaaggaggacuauguggauuacaugccugugaugaaaagauauagcgcccccuccgagagcgaagggguccuuuga

SEQ ID NO: 21059 - RNA, 9867 nt, Artificial Sequence
  derived and/or modified CDS sequence (opt5) from DENV-4__JN559740__SS-prME
agcaccaucacacugcucugccugauucccacggugauggccuuccaccuuuccaccagagacggagagccucugaugaucgucgcuaagcaugaacgggggcgcccgcuccuguuuaaaaccaccgagggaauuaacaaguguacacuuaucgccauggaucugggagaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauaccagagccgugggcaacgacaucucuaaucacggggucacagcuaugaucacgccucggucccccagcguggaggucaaacuuccugauuacggagaacugacccucgacugcgagcccagaucuggcauugacuucaacgagaugauccugaugaagaugaaaaagaaaacauggcuggugcacaagcagugguuucucgaucugccgcuuccuuggaccgccggggcugacacauccgaaguucauuggaauuacaaagagcgcauggugaccuucaaggucccccacgccaaacggcaggaugugacgguucugggcagccaggaaggagccaugcauuccgcucucgcgggcgccaccgagguggacucuggggauggaaaccacauguuugcuggccaccugaaguguaaggucagaauggaaaaacuucgcauuaaggggaugagcuauacaaugugcuccggaaaauucagcaucgacaaggagauggccgagacccaacauggcacaaccguggugaaaguuaaguacgaaggggccggcgcuccuuguaagguccccauugagauccgggaugugaauaaagaaaagguggucggaagaaucauuucuuccacgccccuggccgagaacacaaacagcgugaccaauaucgagcucgaaccuccguucggcgacucuuauauuguuaucggggugggaaacagcgcgcugacacugcacugguuucgcaaaggcuccucuauugggaagauguucgagagcaccuaccggggagcuaaaagaauggccauccucggcgaaaccgccugggauuuuggguccgucggcggacuguucacaagccuuggcaaggcugugcaucagguuuuugggucuguguauacgaccauguucggaggcgucuccuggaugauccgcauucugaucggguuucucgugcuguggauuggaacaaauagccggaacaccucuauggccaugacaugcaucgcuguuggcgggauuacccuguuccuuggcuuuacggugcaggccgacaugggaugugucguguccuggagcggcaaggagcucaaaugcggguccggaaucuucguggucgauaauguucacacauggaccgaacaauacaaguuucagcccgagucuccugcgagacuggccagcgcuauucugaacgcccauaaagacggcgugugugggauccgcuccaccacacggcucgagaaugugauguggaagcagaucaccaacgaacugaauuauguccuuugggagggaggccacgaccugacagugguugcuggcgaugugaaagggguccucacgaagggaaagagagcccugacacccccugugucugaccugaaauacagcuggaagacauggggcaaagcgaagauuuucacccccgaagcccggaacuccacauuucuuaucgaugggccggacaccagcgagugcccuaaugaacgcagagcuuggaacucucucgagguugaggauuacggauucggcauguucacgaccaauauuuggaugaaauuucgggaaggguccagcgaggugugugaccacagacugaugucugccgcuaucaaggaucagaaagccguccaugccgacaugggauauuggauugaauccagcaagaaccaaacauggcagaucgagaaggcuucucugaucgaagugaaaaccugccucuggcccaagacacacacccuguggagcaauggcguucuugagucccagaugcugauuccuaaaagcuacgcgggccccuucucucagcauaacuaucgccaaggguacgccacacagaccgugggaccuuggcaccucggcaagcuggagaucgauuuuggggaaugccccggaacgacagucaccauucaggaggacugugaucaccggggcccgucccugagaaccacaaccgcuagcgggaaacuugugacgcaguggugcugucgcuccugcacaaugccuccccucagauuccugggagaagacggcuguugguauggcauggagauccggccccugucugagaaggaagagaacauggugaaaagccaagucaccgccgggcagggaacauccgaaaccuuuucuaugggccuccugugccuuacacuguucguugaggaaugucuccgcagacgggugacccgcaaacauaugauucugguggucgugaucacgcugugcgccaucauucuugggggacucaccuggauggaucugcugagagcucucaucaugcugggcgacacaaugagcgggcggauuggaggccagauccaccuugccauuauggcgguuuuuaagauguccccuggcuacgugcugggggucuuccuccgcaaacugaccucuagagagacagcucugauggugaucggaauggccaugaccacgguucuuagcaucccgcaugaccugauggagcucauugauggcaucucccuggggcucauucugcuuaagaucgugacacaguuugacaauacccaagucggaacacuggcccucagccugaccuucauucggucuaccaugccccuggugauggcuuggcgcacaaucauggccguccuuuuugugguuacgcugauuccucucuguagaaccuccugccugcagaaacagagccacuggguggaaaucacagcgcucauccugggcgcucaagcccuucccgucuaucugaugacccucaugaagggggccucucggagauccuggccucugaacgagggaauuauggcugugggccugguuagccuucugggcucugcccuccugaagaaugaugugccccucgcugggccuauggucgccggaggccugcuucuggcggccuacgugauguccgggagcuccgcugaccugagccucgaaaaagccgcuaacgugcagugggaugagauggccgacaucacaggaucuagccccauuaucgaaguuaagcaggaugaggacggcuccuucucuauucgcgaugucgaggaaaccaauaugaucacgcugcuugugaaacuggcccucaucacagugagcgggcuguacccgcucgcuauuccugucaccaugacccugugguauauguggcaagugaagacacaacgguccggagcgcuuugggacguucccucuccugccgcuacccagaaagccgcccugagcgagggcguguacagaaucaugcagcgcggccuguuugggaagacacaggucggagugggcauucauauggaagggguuuuccacacgauguggcacgugacccggggauccgucaucugucaugagacaggcagacucgaacccucuugggcugaugugcgcaacgacaugauuagcuaugggggaggcuggcggcugggcgauaagugggacaaagaggaggacguucaagugcuugccaucgaaccggggaagaauccuaaacacguccagaccaagcccggacuguucaaaacacucaccggcgagaucggggcggugacgcuggauuuuaagccuggaaccuccggcagccccauuaucaacagaaaagggaaggugauuggccucuacggaaauggcgucguuacaaagucuggggacuauguguccgcuaucacccaggccgaacgcauuggagagcccgauuacgagguggacgaagauaucuuccggaaaaagagacugacaauuauggaccuucauccuggcgccgggaaaaccaagcggauccugccgagcaucguccgcgaggcucugaaaagacggcuccgcacacugauucuugcccccacgagagugguugcggcugaaauggaggaagcccugcggggacucccuaucagauaucagacccccgccgugaagucugagcacacaggccgcgagauugucgaucugaugugccaugcuaccuuuaccacacggcuccuguccagcacgagagugccuaacuacaaucuuaucguuauggacgaagcccacuucaccgaucccuccucuguggcugcccgcggguacauuagcacacgggucgagaugggcgaagcggccgcuaucuuuaugaccgccacaccuccgggagcuaccgaccccuucccucaauccaacagccccaucgaggauauugaaagagagaucccugagcgcucuuggaauacgggcuuugacuggauuacagacuaucaggggaagaccgugugguucguccccuccaucaaagccggaaacgauauugccaauugccugagaaagagcggcaaaaaggugauccagcugucuagaaaaaccuuugacacagaauacccgaagaccaagcucacagauugggacuucguugugaccacggauaucagcgagaugggggcuaacuuucgcgcgggaagagugauugacccucggcgcugucugaaacccgucauccuuacagauggccccgaaagaguuauucuggccgggccuauccccgugaccccugcuuccgccgcccaacggcgcggcagaauuggacggaacccggcucaggaggacgaucaguauguguucucuggcgacccccucaagaaugaugaagaccacgcccauuggacagaggcgaaaaugcugcuggauaacaucuacaccccugaggggauuauccccacccucuucggaccugaaagagagaagacgcaggcuaucgacggcgaauuucgccuuagaggggaacaacggaaaacauucgucgagcugaugcgccggggagaccugcccguguggcucagcuauaagguugccuccgccggcauuucuuacaaggauagagaauggugcuuuaccggcgagcggaauaaccagauccuggaagagaauauggaaguggagauuuggacacgcgagggggagaagaagaaacuuagaccgcgguggcuggacgcucgcgucuaugccgauccuauggcgcucaaggacuucaaagaguuugccagcggaagaaaguccaucacccuggauauucugacagaaaucgcuagccuccccaccuaccuuucuucccgggccaagcuggcucuggacaacaucgugaugcuccacacgacagagcgcggcgggagagccuaccagcaugcucugaaugaacuuccugagagccuggagacccucaugcuggucgcccugcucggagcgaugaccgccggcauuuuccucuuuuucaugcaggggaaaggaaucggcaagcuguccaugggccugauuacaaucgcuguggccucugggcuccuguggguugcugaaauucaaccccaguggaucgccgccagcaucauucuugaguuuuuccugauggugcuccugaucccugaacccgagaaacagcggaccccgcaggauaaccaacugauuuaugucauccucacaauucuuacgaucauuggacugaucgcugcgaaugaaaugggccugaucgagaagaccaaaacagacuuuggguucuaccaggugaagaccgagacaaccauucucgauguugaccugaaaccugccuccgcuuggacgcuuuaugccguggccaccacaauccugacccccaugcuccgccacacaauugaaaacaccucugcuaaucugagccuggccgcgaucgccaaccaggcugccguccucaugggacuuggcaagggguggccccugcacagaauggaucugggagugccucuccuggcuaugggcuguuacucccaggugaauccgauuacgcuuacagccagccugguuaugcuccugguccauuaugcgaucaucggccccgggcugcaagccaaggcuacccgggaggcccagaaaagaacagcugccggaauuaugaagaacccuaccguggacggcaucaccgugauugaucucgaacccaucucuuacgacccuaaauuugagaagcagcuugggcaagucaugcugcugguucucugcgcuggacagcugcuucugaugcgcacaacgugggccuucugugaggugcucacccuggcgacaggccccauucugacccucugggaagggaauccuggacgguucuggaacacaaccaucgccguguccacggcuaacaucuuuagaggcagcuaucuugccggcgcugggcuggccuucucucugauuaaaaauguccagacaccgcgccggggaaccggcaccacaggggagacccucggagaaaaguggaagagacagcugaacucccuugaccgcaaagaguuugaagaguacaagcggagcggcauccuggagguggauagaacagaagccaaaucugcgcucaaggacgggagcaaaauuaagcacgcuguuucccgcggaucuagcaagauccgguggauuguggagagaggcauggucaaacccaagggcaaagugguugaucuggggugcggacgcggcgggugguccuacuauauggccacgcugaagaaugugaccgaagucaaaggauacacaaagggcgggccuggacaugaggaacccaucccuauggcuaccuauggcuggaaccucgugaaacuucacagcggcguggacgucuucuacaaacccacagagcaaguugauacccugcugugugacauuggggaguccucuagcaauccgacgaucgaagagggacggacccucagagugcugaagaugguggaaccuuggcuuuccucuaaacccgaguuuugcaucaagguccugaaccccuauaugccuacagugauugaagaacuugagaaacugcagcgcaagcauggcgggaaucugguuagauguccccucagccggaacuccacccacgaaauguacugggugucuggagccagcggcaauaucgucuccagcgugaacacaaccucuaaaaugcuucugaaucgcuucacaaccagacaccggaagccuacguaugagaaggauguugaccugggggccggaacaagauccgugagcaccgaaaccgagaaaccggauaugacaauuaucggccggcgccuccagagacugcaggaggaacauaaggagacguggcacuacgaccaagaaaaccccuaccggaccugggcuuaucauggcucuuacgaggccccuuccacagggagcgcgucuuccauggucaauggagugguuaaacuucugaccaagcccugggaugugauuccuauggucacacagcucgccaugaccgacacaacccccuuuggccagcagcgcguguucaaagaaaaggucgacacgagaaccccgcaaccuaagcccgggacacggauggugaugaccacaaccgcuaacuggcugugggcccugcucggcaagaagaaaaauccucgccugugcacgagagaggaguuuaucagcaagguucgguccaacgcugccaucggcgcgguguuccaggaagaacagggguggacaagcgccucugaagcugucaaugauagccgcuuuugggagcuuguggacaaagaaagagcccugcaccaagagggcaagugugaguccugcguguauaacaugaugggaaagcgggagaaaaagcucggcgaguucgggcgcgcuaaaggaucuagagccauuugguacauguggcugggcgcucgguuucuugaguucgaggcccugggguuccucaacgaagaucacugguuuggacgcgagaauagcugguccggcguugagggggaaggccugcauagacugggauauauccucgaggaaauugacaagaaagauggcgaccugauguacgcggaugacaccgccgggugggauacacggaucaccgaggacgaucuucagaacgaggaacugauuacggagcagauggcuccccaccauaagauccucgccaaggcuaucuucaaacugaccuaucagaauaagguggucaaagugcuuagaccuacaccccgcggagccguuauggacauuaucucucggaaggaucaaagaggcagcggacaggugggaaccuacggccugaacacauuuaccaauauggaaguccagcucauucgccagauggaggccgaaggggugaucacacaagacgacaugcagaacccgaaaggccugaaggagcgggucgagaaauggcugaaggaaugcggaguggauagacucaagcgcauggcgauuuccggcgacgauuguguugugaaaccucuggacgagcgguucgggaccucucuucuguuucucaaugauaugggaaaggucagaaaagacaucccccagugggaacccagcaagggcuggaaaaacuggcaggaggugccuuucugcucccaccauuuucacaagaucuucaugaaggaugggcgcagccugguugugccgugucggaaucaagacgaacuuauugggcgggcucgcaucucucagggcgccggguggucccugcgggagacggccugccucggcaaggcuuacgcccagauguggagccugauguauuuucacagacgggaucugagacucgcuucuauggccauuuguuccgcgguccccacagagugguucccuaccagccgcaccacaugguccauccaugcccaccaucaguggaugaccacagaagacaugcugaagguguggaaccggguguggauugaggauaaucccaacaugacggacaaaaccccuguucacucuugggaagacauccccuaccuuggaaagagagaggaucuguggugcggcagccucauugggcuguccagccgcgcuacaugggccaaaaauauccacaccgcuaucacacaagucagaaaccuuauuggaaaggaagaguauguggacuacaugccugugaugaagcgguauucugcccccuccgagagcgaaggcguccuguga

SEQ ID NO: 21060 - RNA, 9867 nt, Artificial Sequence
  derived and/or modified CDS sequence (opt5) from DENV-4__JN559741__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccauguccgggcgcauuggaggccagacgcaucuugcuaucauggccguguucaagaugucuccuggcuacguucuggggguguuucucagaaaacugacaagccgggagaccgcccugauggucauuggaauggcuaugacaaccacccuuuccaucccgcacgaccugauggagcucauugacggcaucucucuggggcucauccugcuuaagauugugacacaguucgauaacacgcaaguuggaacccuggcccucagccugacauuuauccgcuccaccaugagccuggugauggcguggagaacaauuauggcuguccuuuucguggucacccugaucccccucugucggacgucuugccugcagaaacagucccauuggguggaaauuacagcccucauccugggcgcccaagcucuuccuguuuaucugaugacccucaugaagggggccagcagacgcucuuggccccugaaugagggaauuauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuaucauugaagugaagcaggacgaggauggcagcuuuuccauccgggacguggaggaaacaaacaugauuacccugcuuguuaaacuggcgcucaucacagucucugggcuguacccccucgccauuccgaucacgaugacccugugguauauguggcaggugaagacacaaagaagcggagcucuuugggaugugccuucccccgccgccacccagaaagcugcccugucugagggcgucuaccgcaucaugcagcggggccuguucgggaagacacaggugggaguuggcauucacauggaagggguguuccacaccauguggcaugucacgagaggaagcgugaucugucacgagaccggccgccucgaaccuuccugggcggacguucggaaugauaugauuucuuaugggggaggcuggagacugggcgacaaaugggauaaggaggaggacgugcaaguccuugcuaucgaacccgggaagaacccgaaacaugugcagacaaagccuggacuguuuaaaacccucacaggcgagauuggggccguuacccuggacuucaagcccggaacaagcggcuccccuaucaucaaucgcaaagggaaggugauuggccucuacggaaacggcgucgugacgaaaagcggggauuaugugucugccaucacccaggcugaacggauuggagagcccgacuacgaggucgaugaagacaucuuuagaaagaagcggcugacaauuauggaucuucaccccggcgccgggaaaaccaagcgcauccugccuuccauuguuagagaggcgcugaaacggcgccucagaacccugauccuugcuccgacacgggugguggccgccgaaauggaggaagcucugagaggacuccccauccgcuaucagacgccugccgucaagagcgagcauaccggccgggagauuguggaccugaugugccacgcuacauucaccacaagacuccugucuuccacccgcguucccaauuacaaccuuaucgugauggaugaagcccacuuuacggacccuagcuccgucgcggcccggggguacauuucuacaagaguggagaugggcgaagcugccgcuaucuucaugaccgccacccccccuggagccacagauccguuuccccaaagcaauuccccuauugaggacaucgaacgcgagauccccgagcggagcuggaacaccggcuucgauuggauuacagacuaucaggggaaaaccguuugguuugugccuucuaucaaggcuggaaaugacauugcgaacugccugagaaaguccggcaaaaaggucauccagcugagccgcaaaacguucgauacagaauaccccaagaccaaacucacagacugggauuuuguggucaccacggacauuucugagaugggggccaacuucagagcuggacgggugaucgauccgcgcagaugucugaagccuguuauccuuaccgacggccccgaacgggugauucuggccgggcccaucccugugacacccgccagcgcugcccaacgcagaggccggauuggaagaaauccugcgcaggaggaugaccaguaugucuucuccggcgauccgcucaagaacgacgaagaucaugcucacuggaccgaggccaaaaugcugcuggacaauaucuacacacccgaggggauuaucccuacccucuuuggacccgaacgcgagaagacacaggccauugauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauccuggaagagaacauggaagucgagauuuggacaagagagggggaaaagaagaaacuucggcccaaguggcuggaugcgcgcguguaugccgacccgauggcucucaaagauuuuaaggaguucgccucuggaagaaaaagcaucacccuggacauucugaccgaaaucgcuucccucccuacauaccuuagcucucgggccaagcuggcucuggauaauauuguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaaucggcaaacugagcaugggccugauuacaaucgcugucgccuccgggcuccuguggguggccgaaauucaaccucaguggaucgcugcgucuauuauccuugaguucuuucugaugguccuccugauccccgaaccugagaagcagcggaccccccaggacaaucaacugauuuaugugauccucacaauucuuaccaucauuggacugaucgccgcuaacgaaaugggccugauugagaaaacgaagaccgauuucggguuuuaccagguuaaaacagagaccacaauccucgacguggaucugcgcccggccagcgccuggacccuuuaugcugucgccacgacaauccugaccccuaugcucagacacacaauugaaaauaccuccgcgaaccugucucuggccgcuaucgccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuauuaucggcccggggcugcaagccaaagcuaccagagaggcccagaagcgcacagcugccggaauuaugaagaaucccaccguggauggcaucacaguuaucgaccucgaaccuauuagcuacgaucccaaauucgagaagcagcuugggcaagucaugcugcuggugcucugcgcgggacagcugcuucugaugcggaccacgugggccuucugugaggugcucacacuggcuaccggcccuauccugacccucugggaagggaaccccggaagauuuuggaacacaaccauugccgucucuacagcuaauaucuuccgcggcuccuaucuugccggcgccgggcuggcguuuagccugauuaaaaacgcucagacgccucggagaggaaccggcacagccggggagacccucggagaaaaguggaaacgccagcugaauucucuugaccggaaggaguucgaagaguacaagagauccggcauccuggagguugaccgcacagaagcuaaaagcgcccucaaggaugggucuaaaaucaagcaugccgugagccggggauccucuaaaauuagauggaucguggagcgcggcauggucaagccgaagggcaaagugguugaccuggggugcggacggggcggguggagcuacuauauggcuacccugaagaacgugacggaagucaaaggauacaccaagggcgggcccggacacgaggaaccuauucccauggccacauauggcuggaaucucgugaaacuucauuccggcguugauguguuuuacaagccuaccgagcaagucgacacacugcugugugauaucggggagagcuccucuaaccccaccauugaagagggaagaacacuccgcgugcugaagaugguggaaccguggcuuagcuccaaaccugaguucugcaucaagguccugaaucccuauaugcccaccguuauugaagagcucgagaaacugcagagaaagcacggcgggaaccuggugcgguguccucucucucgcaauagcacgcacgaaauguacuggguguccggagcgucuggcaacaucgucagcuccgugaauacaaccagcaaaaugcuucugaacagauuuaccacacggcauagaaagcccacguaugagaaagacguugaucugggggccggaacccggucuguguccacagaaaccgagaagccugacaugacaaucauuggccgcagacuccagcggcugcaggaggaacacaaggagaccuggcauuacgaucaagaaaauccguaccgcacaugggcuuaucacggcagcuacgaggcccccucuaccggguccgcuagcucuauggucaacggagugguuaaacuucugacgaagccuugggacgugauccccauggucacccagcucgccaugacagauaccacaccuuucggccagcagagaguguuuaaagaaaagguugacacccggacgccccaaccgaaaccugggacacgcauggugaugaccacaaccgcgaauuggcugugggcccugcucggaaagaagaaaaaccccagacugugcacgcgggaggaguucauuuccaagguccgcagcaaugcugccaucggcgcuguguuucaggaagagcagggguggaccuccgccagcgaagcugucaacgacucuagauucugggagcuuguggauaaagaacgggcccugcaccaagagggcaagugugagagcugcguuuauaacaugaugggaaaacgcgaaaagaagcucggcgaguuugggagagcgaaaggaucccgggccauuugguacauguggcugggcgcucgcuuccuugaauucgaggcccugggguuucucaaugaagaccauugguucggaagagagaacucuuggagcggcguggagggggaaggccugcaccggcugggauauauccucgaggaaaucgauaagaaagacggcgaucugauguacgcugacgauacagccgggugggacaccagaauuacagaggaugaccuucagaaugaggaacugaucaccgagcagauggccccucaucacaagauucucgcgaaagcuaucuuuaagcugacauaucagaacaaggucgugaaagugcuucgccccaccccucggggagccguuauggauauuaucuccagaaaggaccaacgcggcucugggcaggugggaacguacggccugaauacauucaccaacauggaaguccagcucauccggcagauggaggccgaaggggugauuacccaagaugacaugcagaaucccaaaggccugaaggagagaguugagaaauggcugcgcgaaugcggaguggaccggcucaagagaauggcuaucagcggcgaugacugugucgugaaaccgcuggaugagcgcuuugggacaucccuucuguuccucaacgacaugggaaagguccggaaggauauuccucagugggaacccucuaaaggcuggaagaauuggcaggaggugcccuuuugcagccaucacuuccacaaaaucuuuaugaaggacgggagaucccugguugugccuugucgcaaccaagaugaacuuauuggacgggccagaaucagccagggcgcuggguggucucugcgggagaccgccugccucggcaaagcguacgcccagauguggucccugauguauuuccauagacgcgaccugcggcucgcuagcauggccaucuguucugcugucccgacagagugguuucccacguccagaaccacauggagcauucacgcccaucaccaguggaugaccacagaagauaugcugaagguguggaaucgcguuuggaucgaggacaacccuaauaugauugauaagacccccgugcacuccugggaagacaucccuuaccuuggaaaaagagaggaccuguggugcggcucucucauugggcugagcucccgggcgacgugggccaagaacauccauaccgcuauuacacaaguccgcaaucuuaucggaaaagaagaguauguggauuacaugcccgugaugaagagauauagcgccccuucugaguccgaaggcguucuguga

SEQ ID NO: 21061 - RNA, 9867 nt, Artificial Sequence
  derived and/or modified CDS sequence (opt5) from DENV-4__JQ513334__SS-prME
agcaccaucacccugcucugccugauucccacggugauggccuuccaccuuuccacccgggacggagagccucugaugaucguggcuaagcaugaacgggggcgcccgcuccuguuuaaaaccaccgagggaauuaacaaguguacacuuaucgccauggaucugggagaaaugugcgaggacaccguuacauacaaauguccccuccuggugaauaccgaaccugaggauauugacugcugguguaaccugacgucuaccugggugauguaugggacaugcacccagagcggagagcggcggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuauggagguugcccuccugcggacauacuguaucgaagcuagcauuucuaauaucaccacagccacccgcugcccgacgcaaggagagcccuaucuuaaagaggaacaggaccagcaguacauuuguagacgggaugugguggaccgcggcugggggaacggaugcggccuguucgggaagggaggcgucgugacaugcgcgaaauuuuccuguagcgagaagaucaccggcaaucucguucaaauugaaaaccuggaguauaccguggucgugacaguucauaauggggauacccacgccgugggaaacgacacaucuaaucacggcgucacggcuaccaucacaccuagaucccccagcguggaagucgagcuuccugauuacggggagcugacccucgacugcgaaccccggucuggaaucgacuucaacgagaugauucugaugaaaaugaagaagaaaacauggcuggugcauaagcagugguuucucgaucugccgcuuccuugggccgcuggcgccgacaccuccgaaguucacuggaauuacaaagagagaauggugacguucaaggucccccaugccaaacgccaggaugugaccguucuggggagccaggaaggcgcuaugcacuccgcgcucgccggagcuacagagguggacucuggcgaugggaaccacauguuugccggacaucugaaguguaaaguccggauggagaaacuuagaaucaagggcaugagcuauaccaugugcuccgggaaauucagcauugacaaggaaauggccgagacacaacacggaaccacgguggugaaaguuaaguacgaaggcgcuggggccccuuguaaaguccccaucgagauucgcgaugugaauaaggagaagguggucggccgggugaucucuuccaucccccuggcggaaaacacaaacagcguuaccaauauugagcucgaaccuccguucggagacucuuauaucgugauuggcgucgggaacagcgcucugacacugcauugguuuagaaaaggauccucuaucggcaagauguucgagagcaccuaccgcggggccaaacggguggccauucucggagaaaccgcuugggauuuuggcuccguugggggccuguucacaagccuuggaaaggccgugcaccaggucuuuggcucuguguauacgaccauguucgggggaguuuccuggauggugagaauccugaucggccuccugguccuguggauugggacaaauagccgcaacaccucuauggcuaugacaugcaucgccgugggaggcauuacccuuuuucucggguucacggugcaggcggacaugggcugugucguuuccuggagcggacgggagcugaaaugcggcuccgggaucuuugugguggauaauguccauacauggaccgagcaauacaaguuccagcccgaaucuccugccagacuggcuagcgccauucucaacgcucacaaggacggaguguguggcauccgcuccaccacacggcuggagaauguuauguggaaacagauuaccaacgaacuuaauuaugugcugugggaaggcgggcacgaccucacagucguggccggggauguuaagggcgugcugacgaaagggaagagagcgcugacacccccugucucugaccuuaaauacagcuggaagacauggggaaaggccaaaaucuuuacccccgaagcucggaacuccacauuccucaucgauggcccggacaccagcgagugcccuaaugagcgcagagccuggaacucucuggaaguggaggauuacggguuuggaauguucacgaccaauauuuggaugaaguuccgggaaggcuccagcgagguuugugaccauagacugaugucugcugccaucaaagaucagaaggccgugcacgcugacaugggguauuggauugaauccagcaaaaaccaaacauggcagaucgagaaggcgucucucauugaggucaaaaccugccuguggcccaagacacauacccuuuggagcaauggagugcuggaaucccagaugcucaucccuaagagcuacgccggccccuuuucucagcacaacuaucgccaaggcuacgcuacacagaccguggggccuuggcaccugggaaaacuggagaucgauuucggcgaaugccccgggacgacagucaccauucaggaggacugugaucaucggggaccgucccuuagaaccacaaccgccagcggcaagcucguuacgcaguggugcugucgcuccugcacaaugccuccccugagauuucugggggaggacggauguugguauggcauggaaauccggccccucucugagaaagaagagaacauggucaagagccaaguggccgcuggccaggggaccuccgaaacauucucuaugggacugcuuugccugacccucuuugucgaggagugucugcgcagacgggugacacgcaaacacaugauucuggccguugugaucacccuuugcgcgauuauccucggcgggcugacguggauggaucugcucagagcucugaucaugcuuggagacaccaugagcggccggauugggggacagacacaucuggccaucauggccgucuucaagauguccccuggcuacgugcucggcguuuuucugcgcaagcugaccucuagagaaacagcucuuauggugauugggauggccaugaccacgacacugagcaucccgcacgaccucauggagcugauugauggaaucucccucggccugauccuucugaaaauugucacccaguucgacaauacacaaguggggacccucgcgcugagccugaccuuuauccggucuacaaugucccuugucauggcuuggcgcacgauuauggccgugcuguucguugugacccucaucccccuguguagaacaagcugccuccagaagcagucucauugggucgaaauuaccgcccugauccuuggagcucaagcccugccuguguaucucaugacacugaugaaaggcgcuucccggagaagcuggccccugaacgaggggauuauggccguuggacuugugucucugcucggcuccgcgcugcucaagaaugaugucccucuggccggccccaugguggcugggggacuucugcuggccgcuuacgugaugagcggcuccagcgccgaccucucucuggaaaaagccgcuaacguucagugggaugagauggcggacaucaccgggagcuccccuaucauugaggucaagcaggaugaagacggaucuuuuagcauccgcgauguggaggaaacgaauaugauuacacuucuggugaagcucgcccugaucaccgucuccggccucuacccccuggcuauuccggugaccaugacacuuugguauauguggcagguuaaaacccaacggucuggggcccugugggacgugccuagccccgccgcuacacagaaggccgcgcuguccgagggagucuacagaaucaugcagcgcggccucuucggcaaaacacagguggggguuggaauccacauggaaggcguguuucacaccauguggcaugucacacgggggucugugauuugucacgagaccggaagacuggagccuagcugggcugauguucgcaacgacaugaucuccuauggcgggggauggcggcuuggcgauaagugggacaaagaagaggacgugcaaguccuggccauugaacccggcaagaauccgaagcaugugcagacaaaaccuggacucuucaagacccugacgggagagaucggcgccgugacccucgauuucaaacccgggacaagcggaucuccuauuaucaacagaaagggcaaagucaucgggcuguacggcaauggaguugugaccaaguccggcgacuaugugagcgcuauuacacaggccgagcgcaucggggaacccgauuacgaggucgacgaagauauuuuucggaaaaagagacuuaccaucauggaccugcaccccggagcgggcaagacaaaacggauucugccuucuaucgugcgcgaggcucucaagagacggcugcgcacgcuuauucuggccccgaccagaguuguggccgcugaaauggaggaggcccuccgggggcugcccaucagauaucagacgccugcugucaaauccgaacauaccggacgcgagaucguggaucucaugugccacgccaccuucacaacgcggcugcuuagcuccaccagaguucccaacuacaaucugauugugauggacgaagcgcacuuuacagauccuucuagcgucgccgcucgcggcuacaucuccacccggguggagaugggggaagccgcugccauuuucaugacagccacacccccuggcgcuacggacccguuuccccaaagcaacucuccuaucgaggauauugagagagaaauccccgagcgcuccuggaauacaggauucgacuggaucaccgacuaucagggcaagaccgucugguuugugccuagcauuaaagcggggaacgauaucgccaauugccugcggaagucuggaaagaaaguuauucagcucagcagaaagacauucgacaccgaauaccccaaaacaaagcugaccgauugggacuuuguggugacgacagauaucuccgagaugggcgcuaacuuccgcgccgggagagucauugacccgcggcgcugucuuaaaccuguuauccugaccgauggacccgaaagagugauccucgccggccccauuccugugacacccgcuucugccgcgcaacggcgcgggagaaucggccggaacccugcucaggaggacgaucaguaugucuuuagcggagacccgcugaagaaugaugaggaccaugcccacuggaccgaagccaagaugcugcucgauaacauuuacacgcccgagggcaucauuccuacccuuuucgggcccgaaagagagaaaacacaggcuaucgacggagaguuccgccugcggggcgaacaaagaaagaccuuuguggagcugaugcgcagaggggaccucccuguuuggcuguccuauaaaguggccucugcgggaauuagcuacaaggauagagaauggugcuucacaggcgagcggaauaaccagauccuugaagagaauauggaggucgaaaucuggacccgcgagggcgagaagaagaagcugagaccccgguggcucgacgcccgcguguaugcugauccgauggcccugaaagacuuuaaggaguucgcuuccgggagaaaaagcauuacacuggauauccucaccgaaauugccucucuuccuacguaccuguccagccgggcuaagcuggcccucgacaacaucgucaugcugcauacaaccgagcgcggaggcagagcguaccagcacgcccuuaaugagcugcccgaaucccucgagacccugaugcugguggcucuccuuggggccaugacagcuggaauuuuucuguucuuuaugcagggcaaagggaucggaaagcugucuaugggccucaucaccauugccguugccagcggccugcuuuggguggcugaaauccaaccucaguggauugcggccuccaucauucuggaguucuuucucaugguccugcugauccccgaaccugagaagcagcggacaccccaggauaaccaacucaucuaugugauucuugcuauccugacgauuaucgggcugauugccgccaaugagaugggacucaucgagaagaccaagacagacuucggcuuuuaccagguuaaaaccgagacaaccauucuggauguggaccuucgcccggcuucugccuggacgcuguaugcggucgccaccacaauccucaccccuaugcugagacacacaaucgaaaacaccagcgcuaaucugucccucgccgcuauugccaaccaggcggccgugcuuauggggcugggaaagggcuggccccugcaucggauggaucucggggugccccugcuugcuaugggauguuacagccagguuaauccuacgacacugaccgccucucucgucaugcugcuggugcacuaugcuaucauuggcccgggccuccaagccaaagcuacaagagaggcccagaagcgcaccgcggccgggaucaugaaaaaccccaccguggacggaauuacagucaucgaucuugagccuaucuccuacgaccccaaguucgaaaagcagcugggccaaguuaugcugcucgugcugugcgcugggcagcuucugcucaugcggacgaccugggccuuuugugaggugcugacacuggcuaccggaccuauucucacacuuugggaaggcaaucccgggagauucuggaacaccacgaucgccgucagcacagccaacauuuuccgcggaucuuaucuggcgggcgcuggccuggccuuuucccucaucaaaaaugcucagaccccucggagagggaccggaacaaccggcgagacacugggggaaaaguggaaacgccagcuuaacagccuggaccggaaggaguucgaggaauacaaaagaucuggcauucucgagguggaucgcacggaagccaagagcgcccugaaggacggcuccaaaaucaagcaugcuguuucucgggggagcuccaaaaucagauggauuguggagcgcggaauggucaagccgaaaggcaaggugguugaucugggcugcgggcggggaggcuggagcuacuauauggccacccucaagaaugugacagaagucaaaggguacaccaagggaggccccgggcacgaggagccuauccccauggcgacauauggauggaaccuugugaaacugcauuccggcguggacgucuuuuacaagccuaccgaacaaguugauacgcugcucugugacauuggcgagucuagcuccaaucccaccaucgaagaggggagaacacugcgcgugcuuaaaaugguggaaccguggcugucuagcaagccugaguucugcauuaagguccucaaccccuauaugcccaccgugaucgaggaacuggagaaacugcagagaaagcacggaggcaaucucguucgguguccucuuucccgcaacucuacacacgaaauguacugggugagcggggccuccggaaauauugucagcucugugaacaccacauccaaaaugcugcugaauagauuuaccacgcggcauagaaagcccacauaugagaaagauguugaccucggcgcugggacccggagcgugucuaccgagacagaaaagccugauaugacgaucaucggacgcagacugcagcggcuucaggaggaacacaaagagaccuggcauuacgaccaagaaaacccguaccgcacaugggccuaucacggcuccuacgaggcucccagcaccggcucugccuccagcauggucaauggggugguuaagcugcucacaaagccuugggaugugauucccauggucacccagcuggcgaugacagacaccacgccuuucggacagcagagaguguuuaaagagaaggucgacacccggacaccccaaccgaaaccuggcacccgcauggugaugacaaccacggccaacuggcugugggcucuccuggggaagaaaaagaaucccagacuuugcacacgggaagaguucaucuccaagguucgcagcaacgccgcuauuggagccguguuucaggaagaacagggcuggaccucugcuagcgaagccgucaaugauuccagauucugggagcugguggacaaagagcgggcgcuccaccaagaagggaagugugagucuugcguguauaacaugaugggcaaacgcgaaaagaaacugggagaguuuggcagagccaaggggagccgggcuaucugguacauguggcuuggagcccgcuuccuggaauuugaggcucucggcuuccugaacgaggaucauugguucgggagagaaaauuccuggucuggaguugagggcgaagggcugcaccggcucggcuauauucuggaggagaucgacaagaaagauggagaccuuauguacgccgaugacacagccggcugggauaccagaaucacggaagacgaucugcagaacgaggaacucauuaccgagcagauggcgccucaucacaagauccuggcuaaagccauuuuuaaacuuacauaucagaauaaaguggucaaggugcugcgccccaccccuagaggggccguuauggacaucauuagcagaaaggaucaacgcggauccggccagguggggacauacggacucaacaccuucacaaauauggaaguccagcugauccggcagauggaggcugagggcgugaucacccaagacgacaugcagaaccccaaagggcugaaggaaagagucgagaaauggcuccgcgaaugcggcguggaucggcugaagagaauggccauuucuggagacgauuguguugugaaaccgcuugacgagcgcuuuggcacgagccuccuguuccugaaugauauggggaagguccggaaagacaucccucagugggaacccuccaagggauggaagaacuggcaggaggugcccuuuugcagccaucacuuccacaaaauuuuuaugaaggauggcagaucucuuguugugccuugucgcaaucaagacgagcugaucgggcgggcuagaauuucccagggagccggcuggagccuccgggaaacagcgugccuggggaaagccuacgcucagauguggucucugauguauuuccauagacgcgaucuccggcuggccuccauggcuaucuguagcgccgucccgaccgagugguuucccaccuccagaacaaccuggucuauccacgcgcaucaccaguggaugacaacggaagacaugcuuaagguguggaaccgcguguggauugaggauaauccuaacaugaucgacaaaacccccguucacagcugggaagacauuccuuaccugggcaagagagaggaucucuggugcggaucccugaucggccuuagcucucgggccacaugggcuaagaauauucauaccgccaucacacaaguccgcaaccugauugggaaagaggaauauguggacuacaugcccgugaugaagagauauuccgcuccuagcgagucugaaggaguccucuga

SEQ ID NO: 21062 - RNA, 9867 nt, Artificial Sequence
  derived and/or modified CDS sequence (opt5) from DENV-4__JQ513336__SS-prME
agcaccaucacccugcucugccugauucccacggugauggccuuccaccuuuccacccgggacggagagccucugaugaucgucgcuaagcaugaacgggggcgcccgcuccuguuuaaaaccaccgagggaauuaacaaguguacacuuaucgccauggaucugggagaaaugugcgaggacaccguuacauacaaauguccccuccuggugaauaccgaaccugaggauauugacugcugguguaaccugacgucuaccugggugauguaugggacaugcacccagagcggagagcggcggcgcgaaaagagauccgucgcgcucacaccccacucuggcauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcgagaaaaucaccggcaaucucguucaaauugaaaaccuggaguauaccguggucgugacaguucauaauggggauacccacgccgugggaaacgacacaucuaaucacggcgucacggcuaccaucacaccuagaucccccagcguggaagucgagcuuccugauuacggggagcugacccucgacugcgaaccccggucuggaaucgacuucaacgagaugauucugaugaagaugaagaaaaagacauggcuggugcauaaacagugguuucucgaucugccgcuuccuugggccgcuggcgccgacaccuccgaaguucacuggaauuacaaggagagaauggugacguucaaagucccccaugccaagcgccaggaugugaccguucuggggagccaggaaggcgcuaugcacuccgcgcucgccggagcuacagagguggacucuggcgaugggaaccacauguuugccggacaucugaaauguaagguccggauggagaaacuuagaaucaaaggcaugagcuauaccaugugcuccgggaaguucagcauugacaaagaaauggccgagacacaacacggaaccacgguggugaagguuaaauacgaaggcgcuggggccccuuguaagguccccaucgagauucgcgaugugaauaaggagaaaguggucggccgggugaucucuuccaucccccuggcggaaaacacaaacagcguuaccaauauugagcucgaaccuccguucggagacucuuauaucgugauuggcgucgggaacagcgcucugacacugcauugguuuagaaagggauccucuaucggcaaaauguucgagagcaccuaccgcggggccaagcggauggccauucucggagaaaccgcuugggauuuuggcuccguugggggacuguucacaagccuuggaaaagccgugcaccagguguuuggcucugucuauacgaccauguucgggggaguguccuggaugguuagaauccugaucggccuccuggugcuguggauugggacaaauagccgcaacaccucuauggcuaugacaugcaucgccgucggaggcauuacccuuuuucucggguucacggugcaggcggacaugggcuguguggucuccuggagcggacgggagcugaagugcggcuccgggaucuuuguuguggauaaugugcauacauggaccgagcaauacaaguuccagcccgaaucuccugccagacuggcuagcgccauucucaacgcucacaaagacggagucuguggcauccgcuccaccacacggcuggagaaugugauguggaagcagauuaccaacgaacuuaauuauguucugugggagggcgggcacgaccucacaguggucgccggggaugugaaaggcguucugacgaaggggaaaagagcgcugacacccccugugucugaccuuaaguacagcuggaagacauggggaaaagccaagaucuuuacccccgaagcucggaacuccacauuccucaucgauggcccggacaccagcgagugcccuaaugagcgcagagccuggaacucucuggaagucgaggauuacggguuuggaauguucacgaccaauauuuggaugaaauuccgggaaggcuccagcgaggugugugaccauagacugaugucugcugccaucaaggaucagaaagccguucacgcugacaugggguauuggauugaauccagcaagaaccaaacauggcagaucgagaaagcgucucucauugaggugaagaccugccuguggcccaagacacauacccuuuggagcaauggaguccuggaaucccagaugcucaucccuaaaagcuacgccggccccuuuucucagcacaacuaucgccaaggcuacgcuacacagaccguggggccuuggcaccugggaaagcuggagaucgauuucggcgaaugccccgggacgacagugaccauucaggaggacugugaucaucggggaccgucccuuagaaccacaaccgccagcggcaaacucgucacgcaguggugcugucgcuccugcacaaugccuccccugagauuucugggggaggacggauguugguauggcauggaaauccggccccucucugagaaggaagagaacaugguuaaaagccaaguggccgcuggccaggggaccuccgaaacauucucuaugggacugcuuugccugacccucuuuguggaggagugucugcgcagacgggucacacgcaagcacaugauucuggccgugguuaucacccuuugcgcgauuauccucggcgggcugacguggauggaucugcucagagcucugaucaugcuuggagacaccaugagcggccggauugggggacagacacaucuggccaucauggccguguucaagauguccccuggcuacguccucggcguguuucugcgcaaacugaccucuagagaaacagcucuuaugguuauugggauggccaugaccacgacacugagcaucccgcacgaccucauggagcugauugauggaaucucccucggccugauccuucugaagauugugacccaguucgacaauacacaagucgggacccucgcgcugagccugaccuuuauccggucuacaaugucccuugugauggcuuggcgcacgauuauggccguccuguucgugguuacccucaucccccuguguagaacaagcugccuccagaaacagucucauuggguggaaauuaccgcccugauccuuggagcucaagcccugccugucuaucucaugacacugaugaagggcgcuucccggagaagcuggccccugaacgaggggauuauggccgugggacuuguuucucugcucggcuccgcgcugcucaaaaaugaugugccucuggccggccccauggucgcugggggacuucugcuggccgcuuacgugaugagcggcuccagcgccgaccucucucuggaaaaggccgcuaacgugcagugggaugagauggcggacaucaccgggagcuccccuaucauugagguuaagcaggaugaagacggaucuuuuagcauccgcgaugucgaggaaacgaauaugauuacacuucuggugaaacucgcccugaucaccguguccggccucuacccccuggcuauuccggucaccaugacacuuugguauauguggcaagugaagacccaacggucuggggcccugugggacguuccuagccccgccgcuacacagaaagccgcgcuguccgagggaguguacagaaucaugcagcgcggccucuucggcaagacgcaggucggggugggaauccacauggaaggcguuuuucacaccauguggcaugugacacgggggucugucauuugucacgagaccggaagacuggagccuagcugggcugaugugcgcaacgacaugaucuccuauggcgggggauggcggcuuggcgauaaaugggacaaggaagaggacguucaagugcuggccauugaacccggcaagaauccgaaacauguccagacaaagccuggacuguucaaaacccugacgggagagaucggcgccgugacccucgauuucaagcccgggacaagcggaucuccuauuaucaacagaaaaggcaaggugaucgggcuguacggcaauggagucguuaccaaauccggcgacuaugugagcgcuauuacacaggccgagcgcaucggggaacccgauuacgagguggacgaagauauuuuucggaagaagagacuuaccaucauggaccugcaccccggagcgggcaaaacaaagcggauucugccuucuaucguccgcgaggcucucaaaagacggcugcgcacgcuuauucuggccccgaccagagugguugccgcugaaauggaggaggcccuccgggggcugcccaucagauaucagaccccugcugugaaguccgaacauacaggacgcgagaucgucgaucucaugugccacgccaccuucacaacgcggcugcuuagcuccaccagagugcccaacuacaaucugauuguuauggacgaagcgcacuuuacagauccuucuagcguggccgcucgcggcuacaucuccacccgggucgagaugggggaagccgcugccauuuucaugacagccacacccccuggcgcuacggacccguuuccccaaagcaacucuccuaucgaggauauugagagagaaauccccgagcgcuccuggaauacaggauucgacuggaucaccgacuaucagggcaaaaccgugugguuugucccuagcauuaaggcggggaacgauaucgccaauugccugcggaagucuggcaagaaggugauucagcucagcagaaaaacauucgacaccgaauaccccaagacaaaacugaccgauugggacuuuguugugacgacagauaucuccgagaugggcgcuaacuuccgcgccgggagagugauugacccgcggcgcugucuuaagccugucauccugaccgauggacccgaaagaguuauccucgccggccccauuccugugacacccgcuucugccgcgcaacggcgcgggagaaucggccggaacccugcucaggaggacgaucaguauguguuuagcggagacccgcugaagaaugaugaggaccaugcccacuggaccgaagccaaaaugcugcucgauaacauuuacacgcccgagggcaucauuccuacccuuuucgggcccgaaagagagaagacacaggcuaucgacggagaguuccgccugcggggcgaacaaagaaaaaccuuugucgagcugaugcgcagaggggaccucccuguguggcuguccuauaagguugccucugcgggaauuagcuacaaagauagagaauggugcuucacaggcgagcggaauaaccagauccuugaagagaauauggagguggaaaucuggacccgcgagggcgaaaagaagaaacugagaccccgguggcucgacgcccgcgucuaugcugauccgauggcccugaaggacuuuaaagaguucgcuuccgggagaaagagcauuacacuggauauccucaccgaaauugccucucuuccuacguaccuguccagccgggcuaaacuggcccucgacaacaucgugaugcugcauacaaccgagcgcggaggcagagcguaccagcacgcccuuaaugagcugcccgaaucccucgagacccugaugcuggucgcucuccuuggggccaugacagcuggaauuuuucuguucuuuaugcagggcaaggggaucggaaagcugucuaugggccucaucaccauugccguggccagcggccugcuuuggguugcugaaauccaaccucaguggauugcggccuccaucauucuggaguucuuucucauggugcugcugauccccgaaccugagaaacagcggacaccccaggauaaccaacucaucuaugucauucuugcuauccugacgauuaucgggcugauugccgccaaugagaugggacucaucgaaaagaccaaaacagacuucggcuuuuaccaggugaagaccgagacaaccauucuggauguugaccuucgcccggcuucugccuggacgcuguaugcgguggccaccacaauccucaccccuaugcugagacacacaaucgaaaacaccagcgcuaaucugucccucgccgcuauugccaaccaggcggccguccuuauggggcugggaaaaggcuggccccugcaucggauggaucucggggugccccugcuugcuaugggauguuacagccaggugaauccuacgacacugaccgccucucucguuaugcugcugguccacuaugcuaucauuggcccgggccuccaagccaaggcuacaagagaggcccagaaacgcaccgcggccgggaucaugaagaaccccaccguggacggaauuacagugaucgaucuugagccuaucuccuacgaccccaaguucgaaaaacagcugggccaagucaugcugcucguucugugcgcugggcagcuucugcucaugcggacgaccugggccuuuugugaggugcugacacuggcuaccggaccuauucucacacuuugggaaggcaaucccgggagauucuggaacaccacgaucgccgugagcacagccaacauuuuccgcggaucuuaucuggcgggcgcuggccuggccuuuucccucaucaagaaugcucagaccccucggagagggaccggaacaaccggcgagacacugggggaaaaauggaagcgccagcuuaacagccuggaccggaaagaguucgaggaauacaagagaucuggcauucucgaggucgaucgcacggaagccaagagcgcccugaaagacggcuccaagaucaaacaugcugugucucgggggagcuccaagaucagauggauuguugagcgcggaauggugaaaccgaagggcaaggucguggaucugggcugcgggcggggaggcuggagcuacuauauggccacccucaaaaauguuacagaagugaagggguacaccaaaggaggccccgggcacgaggagccuauccccauggcgacauauggauggaaccuugucaagcugcauuccggcguggacguguuuuacaaaccuaccgaacaagucgauacgcugcucugugacauuggcgagucuagcuccaaucccaccaucgaagaggggagaacacugcgcguucuuaagaugguggaaccguggcugucuagcaagccugaguucugcauuaaagugcucaaccccuauaugcccaccgucaucgaggaacuggagaagcugcagagaaaacacggaggcaaucucgugcgguguccucuuucccgcaacucuacacacgaaauguacuggguuagcggggccuccggaaauauugugagcucugucaacaccacauccaagaugcugcugaauagauuuaccacgcggcauagaaaacccacauaugagaaggauguggaccucggcgcugggacccggagcguuucuaccgagacagaaaaaccugauaugacgaucaucggacgcagacugcagcggcuucaggaggaacacaaggagaccuggcauuacgaccaagaaaacccguaccgcacaugggccuaucacggcuccuacgaggcucccagcaccggcucugccuccagcauggugaauggggucgugaagcugcucacaaaaccuugggauguuauucccauggugacccagcuggcgaugacagacaccacgccuuucggacagcagagagucuuuaaggagaaaguggacacccggacaccccaaccgaagccuggcacccgcauggucaugacaaccacggccaacuggcugugggcucuccuggggaaaaagaagaaucccagacuuugcacacgggaagaguucaucuccaaagugcgcagcaacgccgcuauuggagccguuuuucaggaagaacagggcuggaccucugcuagcgaagccgugaaugauuccagauucugggagcuggucgacaaggagcgggcgcuccaccaagaagggaaaugugagucuugcguguauaacaugaugggcaagcgcgagaaaaagcugggagaguuuggcagagccaaggggagccgggcuaucugguacauguggcuuggagcccgcuuccuggaauuugaggcucucggcuuccugaacgaggaucauugguucgggagagaaaauuccuggucuggaguggagggcgaagggcugcaccggcucggcuauauucuggaggagaucgacaaaaaggauggagaccuuauguacgccgaugacacagccggcugggauaccagaaucacggaagacgaucugcagaacgaggaacucauuaccgagcagauggcgccucaucacaaaauccuggcuaaggccauuuuuaaacuuacauaucagaauaagguugugaagguccugcgccccaccccuagaggggccgugauggacaucauuagcagaaaagaucaacgcggauccggccagguugggacauacggacucaacaccuucacaaauauggaagugcagcugauccggcagauggaggcugagggcgucaucacccaagacgacaugcagaaccccaaggggcugaaagaaagaguggagaaguggcuccgcgaaugcggcgucgaucggcugaaaagaauggccauuucuggagacgauugugugguuaagccgcuugacgagcgcuuuggcacgagccuccucuuccugaaugauauggggaaagugcggaaggacaucccucagugggaacccuccaagggauggaaaaacuggcaggagguccccuuuugcagccaucacuuccacaagauuuuuaugaaagauggcagaucucuugugguuccuugucgcaaucaagacgagcugaucgggcgggcuagaauuucccagggagccggcuggagccuccgggaaacagcgugccuggggaaggccuacgcucagauguggucucugauguauuuccauagacgcgaucuccggcuggccuccauggcuaucuguagcgccgugccgaccgagugguuucccaccuccagaacaaccuggucuauccacgcgcaucaccaguggaugacaacggaagacaugcuuaaagucuggaaccgcguguggauugaggauaauccuaacaugaucgacaagacccccgugcacagcugggaagacauuccuuaccugggcaagagagaggaucucuggugcggaucccugaucggccuuagcucucgggccacaugggcuaaaaauauucauaccgccaucacacaaguucgcaaccugauugggaaggaggaauaugucgacuacaugcccgugaugaaaagauauuccgcuccuagcgagucugaaggagugcucuga

SEQ ID NO: 21063 - RNA, 9867 nt, Artificial Sequence
  derived and/or modified CDS sequence (opt5) from DENV-4__JQ513338__SS-prME
agcaccaucacccugcucugccugauucccacggugauggccuuccaccuuuccaccagagacggagaaccucugaugaucguugcuaagcaugaacgggggcgcccgcuccuguuuaaaacaaccgagggaauuaacaaguguacacuuaucgccauggaucugggagaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggagcagcaguacauuuguagacgggacgugguggaucgcggcugggggaacggaugcggccucuucgggaaaggaggcgucgugacaugcgcgaaguuuucuuguuccggcaaaaucaccgggaaucugguucaaauugaaaaccuugaguauaccguggucgugacaguucauaauggaaacaccccugccgugggcaaugacacaagcaaccacggggucacggcucccaucaccccuagaucucccuccguggaagucaagcugccggauuacggagagcucacacuggacugcgagccucggagcggcaucgauuucaaugaaaugauucugaugaagaugaaaaagaaaaccuggcucgugcacaagcagugguuucuggaccuuccccugccuuggacaaccggggccgacacgucugagguucauuggaacuacaaagaaagaauggugaccuucaaggucccccacgcuaaacgccaggaugugacaguucucggcucccaggagggagccaugcauagcgcccuggcuggcgcgaccgaaguggacuccggggaugagaaucacauguuugccggacaccuuaaguguaagguccggaugggcaaacugagaaucaaggggaugucuuauacaaugugcagcggaaaauucuccauugacaaggagauggcugaaacccaacauggcacgacaguggugaaaguuaaguacgagggggccggcgcccccuguaaggucccuaucgaaauucgcgaugugaacaaagagaagguggucggacgggugaucagcgcuaccccgcucgccgagaacacaaauucuguuaccaacaucgaacuggagcccccuuucggcgacagauauauugugaucggggucggaaauuccgcgcugacccuccacugguuucgcaaaggcagcucuauugggaagauguucgaaagcacauaccggggagcuaaaagaauggccauccugggcgagacggccugggauuuuggguccgugggcggacuuuucaccucucugggcaaggcuguucaucagguguuugggagcgucuauacaaccauguucggaggcguguccuggaugauucgcauccucaucggguuucugguucuguggauuggaacaaacagccggaauaccucuauggccaugacgugcaucgcugugggcgggauuacacuuuuccucggcuuuaccguccaggccgacaugggaugugugguguccuggagcggcagagaacugaagugcgggucuggaaucuucgucguugauaacgugcacaccuggacagagcaauacaaauuucagcccgaguccccugcgcgccuggccagcgcuauucucaaugcccauaaggacggcgugugugggauccgguccaccacaagacuggaaaacgucauguggaaacagauuacgaaugagcuuaacuaugugcugugggaaggaggccacgaucucaccguuguggcuggcgacgucaagggggugcugacaaaaggaaagcgggcccugacacccccggcgucugaccuuaaguacagcuggaaaacauggggcaaggccaaaaucuucaccccugaggcucgcaauuccacguuucucaucgaugggcccgacaccucugaaugcccuaacgagagacgggccuggaauagcuucgagguugaagauuacggauucggcauguuuacaaccaacauuuggaugaaguucagagagggguccagcgaagugugugaccaccgccugaugucugcugccaucaaagaucagaaggccguccaugcugacaugggauauuggauugaguccagcaaaaaucaaacauggcagaucgaacgggcgucucugauugaggugaagaccugccucuggcccaagacacacacccugugguccaacggcguucuugagagccagaugcugaucccuaaaucuuacgccggccccuuuagccagcauaacuauagacaaggguacgcuacgcagacagugggaccguggcaccucggcaagcuggaaaucgauuucggggagugcccuggaaccaccgucacaauucaggaaaauugugaccaccgcggccccucccugagaaccacgacagccagcgggaaacuugugacccaguggugcugucggucuugcacaaugcccccucuccgcuuucugggagaggauggcuguugguauggcauggagaucagaccgcuguccgaaaaggaggaaaacauggugaaaagccaagucaccgccgggcagggaacauccgagaccuucucuaugggccuccugugccuuacgcuguuuguugaagagugucuccggcgcagagugacccggaagcauaugauucuggcuguggucaucacacugugcgccauuauccuugggggacucaccuggauggaccugcugcgcgcgcucaucaugcugggcgauacaaugagcgggagaauuggaggccagacccaccuugcuaucauggccguguucaagaugucccccggcuacguucuggggguguuucuccggaaacugacgucucgcgagacagcccugauggucauuggaauggcuaugaccacaacccuuagcaucccucaugaccugauggaacucauugauggcaucucccuggggcucauccugcuuaagauugugacccaguucgacaauacacaaguuggaacgcuggcccucucucugaccuuuaucagaagcacaaugucccuggugauggcguggcggaccauuauggcuguccuuuucguggucacacugaucccccucuguagaaccagcugccugcagaaacagucucacuggguggagauuacggcccucauccugggcgcccaagcccuuccuguuuaucugaugacacucaugaagggggccucccgccggagcuggccccugaacgaaggaauuauggcugugggccuggucucucuucugggcuccgcccuccugaaaaaugacgugccucucgcggggcccaugguugccggaggccugcuucuggcugccuacgugaugagcgggucuuccgcugaucugagccucgagaaggccgccaacguccagugggacgaaauggcugauaucaccggauccagcccgaucauugaggugaagcaggacgaggauggcucuuuuagcaucagagacguggaagagaccaauaugauuacacugcuuguuaaacuggcgcucaucaccgucuccgggcuguacccucucgccauucccaucacaaugacgcugugguauauguggcaagugaagacccaacgcucuggagcucuuugggaugugccuagccccgccgccacacagaaagcugcccuguccgaaggcgucuaccggaucaugcagagaggccuguucgggaagacccaggugggaguuggcauucauauggaggggguguuccacacaauguggcacgucacccgcggaucugugaucugucaugaaacgggccggcucgagccgagcugggcggacguuagaaacgauaugauuuccuaugggggaggcuggcgccugggcgacaaaugggauaaggaggaagacgugcaaguccuugcuaucgagccugggaagaaucccaaacacgugcagaccaagccuggacuguuuaaaacacucaccggcgaaauuggggccguuacacuggauuucaagcccggaaccucuggcagccccaucaucaaccggaaagggaaggugauuggccucuacggaaauggcgucgugacaaaauccggggacuaugugagcgccaucacgcaggcugagagaauuggagagccugacuacgaagucgaugaggacaucuuucggaagaagcgccugaccauuauggaucuucauccgggcgccgggaaaacaaagagaauccugcccucuauuguucgggaagcgcugaaacgcagacuccggacccugauccuugcuccuaccagagugguggccgccgagauggaagaggcucugcgcggacuccccauccgguaucagacgccugcugucaaguccgagcacacaggcagagaaauuguggaccugaugugccaugcuaccuucacaacccgccuccugagcucuacacggguucccaacuacaaucuuaucgugauggaugaggcccacuuuaccgacccuuccagcgucgcggccagaggguacauuuccacgcgcguggaaaugggcgaggcugccgcuaucuucaugacagccaccccgcccggagccaccgauccuuuuccccaaucuaacagcccuauugaagacaucgagcgggagauccccgaaagauccuggaauacaggcuucgauuggauuaccgacuaucaggggaaaacaguuugguuugugccgagcaucaaggcuggaaacgauauugcgaacugccugcgcaagucuggcaaaaaggucauccagcuguccagaaaaaccuucgacacggaguacccuaagacaaaacucaccgacugggauuuuguggucacaaccgacauuagcgaaaugggggccaauuuccgggcuggacgcgugaucgaucccagacggugucugaagcccguuauccuuacggacggcccugagcgcgugauucuggccgggcccaucccugugaccccggccucugcugcccaaagacggggcagaauuggacgcaaccccgcgcaggaagaugaccaguaugucuucagcggcgauccucucaagaaugacgaggaucacgcucauuggacagaggccaaaaugcugcuggacaacaucuacacccccgaagggauuaucccuacacucuuuggacccgagcgggaaaagacccaggccauugauggcgaguucagacuucgcggggagcaacggaaaacauuuguugaacugaugagacggggagaccugccgguguggcucuccuauaagguggcuucugccggcaucagcuacaaagaucgcgaguggugcuucaccggcgaaagaaauaaccagauccuggaggaaaauauggaggucgagauuuggacgcgggaaggggagaagaagaaacuucgcccuaaguggcuggacgcgagaguguaugccgaccccauggcucucaaagauuuuaaggaguucgccuccggacggaaaucuaucacacuggacauucugaccgagaucgcuagccucccuaccuaccuuuccagccgcgccaagcuggcucuggauaacauuguuaugcuccacacaaccgaaagaggcgggcgggccuaccagcaugcgcugaaugagcuucccgagucucuggaaacacucaugcugguggcccugcucggagcuaugacggccggcaucuuucuuuucuuuaugcaggggaagggaaucggcaaacuguccaugggccugauuaccaucgcugucgccagcgggcuccuguggguggccgagauucaaccucaguggaucgcugcguccauuauccuugaguucuuucugaugguccuccugauccccgagccggaaaagcagcgcacaccucaggacaaccaacugauuuaugugauccucaccauucuuacaaucauuggacugaucgccgcuaaugagaugggccugauugagaaaaccaagacggauuucggguuuuaccagguuaaaaccgaaacaaccauccucgacguggaucugagacccgccucugccuggacacuuuaugcugucgccaccacgauccugacacccaugcuccggcacaccauugagaacacaagcgcgaaucugucccuggccgcuaucgccaaccaggcugccgugcucaugggacuuggcaagggguggccucugcacagaauggaccugggaguuccgcuccuggcgaugggcuguuacucucaggugaaucccaccacccuuacagccagccuggucaugcuccuggugcauuaugcuauuaucggcccugggcugcaagccaaagcuacgcgcgaagcccagaagcggaccgcugccggaauuaugaagaaccccacaguggauggcaucaccguuaucgaccucgagccuauuuccuacgaucccaaauucgagaagcagcuugggcaagucaugcugcuggugcucugcgcgggacagcugcuucugaugagaacaaccugggccuucugugaagugcucacgcuggcuacaggcccuauccugacccucugggaggggaacccgggacgcuuuuggaauaccacaauugccgucagcaccgcuaacaucuuccggggcucuuaucuugccggcgccgggcuggcguuuucccugauuaaaaaugcucagacacccagacgcggaacgggcaccacaggggaaacccucggagagaaguggaaacggcagcugaacagccuugacagaaaggaguucgaggaguacaagcgcucuggcauccuggaaguugaucggacagaggccaaauccgcucucaaggacgggagcaaaaucaagcacgccgugucuagaggaagcuccaaaauucgcuggaucguggaacggggcauggucaagccuaagggcaaagugauugaccuggggugcggaagaggcggguggucuuacuauauggccacccugaagaauguuacggaggugaaaggauacaccaagggcgggcccggacaugaagaaccuauccccauggcuacauauggcuggaaccucgucaaacuucacagcggcguggaugucuuuuacaagccgaccgagcaaguggacacacugcugugugauauuggggaauccagcuccaauccuaccaucgaggaaggacgcacacucagaguccugaagaugguggagcccuggcuuucuagcaaacccgaguucugcauuaaggugcugaacccuuauaugcccaccgucaucgaggagcucgaaaaacugcagcggaagcauggcgggaaucugguucgcuguccucucuccagaaacucuacgcacgagauguacugggugagcggagccuccggcaauaucgugucuagcgucaacacaaccuccaaaaugcuucugaaucgguuuaccacaagacaccggaagccgacguaugaaaaagacguggaucugggggcgggaacccgcagcguuucuacagagaccgagaagcccgacaugacaauuaucggcagacggcuccagcgccugcaggaagaacauaaggaaaccuggcacuacgaucaagagaacccuuacagaacaugggccuaucauggcuccuacgaagcucccagcaccgggucugccuccagcauggugaauggagucgugaaacuucugacgaagccuugggacguuauucccauggugacccagcucgcuaugacagauaccacaccguucggccagcagcgggucuuuaaagagaagguggacacccgcacgccucaacccaaaccugggacaagaaugguuaugaccacaaccgccaacuggcugugggcgcugcucggaaagaagaaaaauccccggcugugcacgcgcgaggaguucaucucuaaggugagauccaacgccgcuauuggcgccgucuuucaggaggaacagggguggaccagcgcuuccgaggccgugaacgauagccgguucugggaacuugucgacaaagagcgcgcucugcaccaagagggcaagugugaaucuugcguguauaauaugaugggaaaaagagagaagaagcucggcgaauuugggcgggccaaaggaagccgcgcgaucugguacauguggcugggcgccagauuccuugaguucgaagcucugggguuucucaacgaggaccacugguucggacgggaaaauuccuggucuggcguugaaggggagggccugcauagacugggauauauccucgaagagauugauaagaaagacggcgaucugauguacgccgacgauacagcugggugggacacccgcaucacagaggaugaccuucagaacgaagaacugauuaccgaacagauggccccucaccauaagauccucgccaaagcgauuuuuaagcugacauaucagaauaagguggucaaagugcuucggcccaccccgagaggagcugugauggauaucaucagccgcaaggaccaacggggcuccgggcagguuggaacguacggccugaacacauucaccaauauggaggugcagcucauuagacagauggaagccgagggggucaucacccaagaugacaugcagaacccuaaaggccugaaggagcgcguggaaaaauggcugcgggagugcggaguugauagacucaagcgcauggccauuucuggcgacgacuguguggucaaaccccuggaugaacgguuugggacaagccuucuguuccucaaugacaugggaaaggugagaaaggauaucccccagugggagccuuccaaaggcuggaagaacuggcaggaagucccguuuugcucucaccauuuccacaaaauuuuuaugaaggacgggcgcagccuggugguucccugucggaaucaagaugagcuuaucggcagagcucggaucucccagggcgccggguggagccugagagagaccgcuugccucggcaaagccuacgcgcagauguggucucugauguauuuccaccgccgggaccugagacucgccuccauggcuauuuguagcgccgugccuacagaaugguuucccacgucucgcaccacaugguccauccaugcucaccaucaguggaugaccacagaggauaugcugaaggucuggaacagaguguggauugaagacaauccuaacaugaucgauaagacccccguucacagcugggaggacauuccuuaccuuggaaaacgggaagaucuguggugcggcucccucaucgggcugucuagccgcgccacgugggcgaagaauauucacaccgccaucacacaagugagaaaccuuaucggaaaagaggaguaugucgacuacaugcccgugaugaagcgguauuccgcuccgagcgaaucugagggcgugcuguga

SEQ ID NO: 21064 - RNA, 9867 nt, Artificial Sequence
  derived and/or modified CDS sequence (opt5) from DENV-4__JQ513339__SS-prME
agcaccaucacccugcugugccugauucccacggugauggcuuuccaccuuuccacccgggacggagagccucugaugaucguggcuaagcaugaacgggggcgcccgcugcuguuuaagaccaccgagggaauuaacaaguguacgcuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggcuacauucaaggugccccaugccaaacgccaggaugucacccuccugggcucccaggaaggagccaugcacagcgcucuugcgggcgccacagagguggacuccggggaugaaaaccacauguuugcuggacaucugaaguguaagguucggaugggcaaacucagaaucaaggggaugucuuauaccaugugcagcggaaaauucuccauugacaaggagauggccgagacgcaacacggcacaaccguggucaaagugaaguacgaaggggccggcgcuccuuguaaggugcccaucgagauucgcgauguuaauaaagaaaaggucgugggacgggugcugagcgccacaccccuggcggagaacaccaacucugucaccaauaucgagcucgaaccuccguucggcgacuccuauaucgugauugggguuggaaacagcgcucugacacuucauugguuuacgaaaggcucuagcaucgggaagauguucgaguccaccuacagaggagccaaacgcauggccauucugggcgaaacagcuugggauuuugggucugugggcggacucuucaccagccugggcaaggccguccaccagguguuuggguccguuuauacaaccauguucggaggcgugagcuggaugauccggauucugaucggguuucuuguccucuggaucggaacaaauucuagaaacacauccauggcuaugaccugcauugccgugggcgggaucacccuguuccugggcuuuacaguucaggcggacaugggauguguggucagcuggucuggccgcgagcucaagugcggguccggaauuuucgugguggauaauguccauaccuggacagaacaauacaaauuucagcccgagagcccugcccggcuggcuuccgccauccuuaacgcucacaaggacggcguuugugggauuagaucuacgacccgccuggagaaugugauguggaaacagaucacaaacgaacucaauuaugugcugugggagggaggccacgaccugaccgucguggccggcgauguuaagggggugcuuacaaaaggaaagcgggcgcucacacccccugccagcgaccugaaguacuccuggaaaacguggggcaaggcuaaaauuuucacccccgaagccagaaacucuacauuucugaucgaugggccggacaccagcgagugcccuaaugaacggcgcgcuuggaacuccuucgaggucgaggauuacggauucggcauguuuacaaccaauaucuggaugaaguucagagaagggagcucugaggugugugaccaucggcucauguccgccgccauuaaagaucagaaggcuguucacgcggacaugggauauuggaucgaaagcucuaaaaaccaaacauggcagauugagagagccucccugaucgaagugaagaccugccuuuggcccaagacgcauacacuguggagcaauggcguccucgagucucagaugcugauuccuaaaagcuacgcuggccccuuuucccagcacaacuaucgccaaggguacgccacccagaccgugggaccuuggcaccugggcaaacuugagaucgauuucggggaaugccccggaacaaccguuacgauccaggagaacugugaccaucggggcccgagccucagaacaaccacagccucugggaaacuggugacccaguggugcugucgcuccugcacaaugccuccccugagauuucucggagaagauggcuguugguauggcauggagauucggccccugagcgagaaggaagagaauauggucaaaucccaagugaccgcugggcagggaacgucugaaaccuucagcaugggccuucugugccucacacuguuuguggaggaaugucugcgcagacgggucacccgcaagcacaugauccuugccguugugauuacacucugcgcgaucauucucggcgggcugaccuggauggaccuccugagagcucuuaucaugcugggggauacgauguccgggcggaucggaggccagacacaucucgccauuauggccguguucaagaugucuccuggcuacguccuggggguguuucugcgcaaacuuaccagcagagagacagcucugaugguuaucggaauggccaugaccaccacacucuccauuccgcacgaccugauggagcucaucgacggcauuucucuggggcuuauccugcucaagaucgugacgcaguucgauaacacccaagucggaacacuggcgcugagccuuaccuuuauucgguccacaaugagccuggugauggcuuggcgcaccaucauggccguucucuucguggucacgcugauuccccucuguagaacaucuugccugcagaaacagucccauuggguggaaaucaccgcccuuauucugggcgcucaagcccucccugucuaucugaugacccugaugaagggggcuagccggagaucuuggccccuuaaugagggaaucauggccgugggccugguuucccuccugggcagcgcgcuccugaaaaacgacgugccucuugccgggcccauggucgcuggaggccugcugcucgccgcuuacgugaugucuggguccagcgccgaucugucccuugaaaaggccgcuaauguucagugggacgagauggcggauauuacaggaagcucuccuaucaucgaagugaagcaggacgaggauggcagcuuuuccauucgcgacgucgaggaaaccaacaugaucacacugcucgugaaacuggcccucauuacggugucugggcuguacccccuugcuaucccgauuaccaugacacugugguauauguggcagguuaagacccaacggagcggagcccugugggaugucccuucccccgccgcuacacagaaagccgcgcucucugagggcguguacagaaucaugcagcgcggccuguucgggaagacccaggugggagucggcauccacauggaagggguguuccacacgauguggcauguuacccggggaagcgugauuugucacgagacaggcagacuugaaccuuccugggcugacguccgcaaugauaugaucucuuaugggggaggcuggcggcugggcgacaaaugggauaaggaggaggacgugcaaguucucgccauugaacccgggaagaacccgaaacaugugcagaccaagccuggacuguuuaaaacacucaccggcgagaucggggccgucacacuggacuucaagcccggaacgagcggcuccccuauuaucaauagaaaagggaaggugaucggccuuuacggaaacggcguugugaccaaaagcggggauuaugucucugcuauuacacaggccgaacgcaucggagagcccgacuacgagguggaugaagacauuuuucggaagaagagacugaccaucauggaucugcaccccggcgcggggaaaaccaagcggauucucccuuccaucgugcgcgaggcucugaaaagacggcuucgcacacugauucucgccccgacgagagucguugccgcugaaauggaggaagcccugcggggacuccccaucagauaucagaccccugcugucaagagcgagcauacaggccgcgagaucguggaccugaugugccacgccaccuucacaacccggcuucugucuuccacgagaguccccaauuacaaccugauugugauggaugaagcgcacuuuacagacccuagcuccguugccgcucgcggguacaucucuacccggguggagaugggcgaagccgcugccauuuucaugaccgccacacccccuggagcuaccgauccguuuccccaaagcaauuccccuaucgaggacauugaaagagagauccccgagcgcagcuggaacacaggcuucgauuggaucaccgacuaucaggggaaaacggucugguuugugccuucuauuaaggcgggaaaugacaucgccaacugccuccggaaguccggcaaaaagguuauucagcugagcagaaaaacauucgauaccgaauaccccaagacaaaacuuaccgacugggauuuuguggucacgaccgacaucucugagaugggggcuaacuuccgcgccggaagagugauugauccgcggcgcugucugaagccugucauccucacagacggccccgaaagagugauccuggccgggcccauuccuguuacccccgcuagcgccgcgcaacggcgcggcagaaucggacggaauccugcucaggaggaugaccaguauguguucuccggcgauccgcugaagaacgacgaagaucaugcccacuggacagaggccaaaaugcuccuugacaauauuuacacccccgaggggaucauuccuacacuguuuggacccgaaagagagaagacccaggcuaucgauggcgaguuccgccugagaggggaacaaagaaaaacguuuguggagcucaugcgccggggagaccugccugucuggcuuucuuauaagguugccagcgcgggcauuuccuacaaagacagagaauggugcuucacaggcgagcggaacaaucagauccuggaagagaacauggaaguggagaucuggacccgcgagggggaaaagaagaaacucagacccaaguggcuggaugcccggguguaugcugacccgauggcccugaaagauuuuaaggaguucgcuucuggacgcaaaagcauuacccucgacauccuuacagaaauugccucccugccuaccuaccugagcucuagagcuaagcucgcccuggauaauaucgucaugcuucauacaacggagcggggcgggcgcgcguaccagcacgcccugaacgaacuccccgagucccuggagacccugaugcucguggcccuucugggagccaugacagcuggcauuuuucuguucuuuaugcaggggaagggaaucggcaaacucagcaugggccugaucaccauugccguugccuccgggcuucuguggguggcugaaauccaaccucaguggauugcggccucuaucauucucgaguucuuucugaugguccugcucauccccgaaccugagaagcagagaacaccccaggacaaucaacuuaucuaugugauucugaccauccugacgauuaucggacucauugcugccaacgaaaugggccugaucgagaaaaccaagacagauuucggguuuuaccaggucaaaaccgagacaaccauucuugacguggaucugcggccggccagcgcuuggacgcucuaugccguugcgacaaccauccugacaccuaugcugcgccacaccaucgaaaauaccuccgccaaccucucucuugcugccauugcuaaucaggccgcggugcugaugggacugggcaagggguggccccuccauagaauggaccugggagucccccuucuggccaugggcuguuacagccaggugaacccuacaacgcucaccgcuucccugguuaugcugcucgugcacuaugccaucauuggcccggggcuucaagcuaaagccacacgggaggcucagaagagaaccgccgcgggaaucaugaagaaucccacagucgauggcauuaccgugaucgaccuggaaccuaucagcuacgaucccaaauucgagaagcagcuggggcaagugaugcuccugguucuuugcgccggacagcugcuccugaugcgcacgacaugggcuuucugugagguccugacccucgccaccggcccuauucuuacacugugggaagggaaccccggacgguuuuggaacaccacaaucgcugugucuacggccaauauuuucagaggcuccuaucuggccggcgcggggcucgcuuuuagccugaucaaaaacgcccagaccccucgccggggaacaggcaccacaggggagacccuuggagaaaaguggaaaagacagcucaauucucucgaccgcaaggaguucgaagaguacaagcgguccggcauucuggagguggacagaacggaagcuaaaagcgcccugaaggaugggucuaaaaucaagcaugccgucagccgcggauccucuaaaauccgguggauuguugagagaggcauggugaagccgaagggcaaagugaucgaccucgggugcggacgcggcggguggagcuacuauauggcuacccuuaagaacgucacagaagugaaaggauacaccaagggcgggcccggacacgaggaaccuauucccauggccacauauggcuggaaucugguuaaacugcauuccggcguggaugucuuuuacaagccuaccgagcaaguggacacacuccugugugauaucggggagagcuccucuaaccccaccauugaagagggacggacgcuuagaguucugaagaugguggaaccguggcucagcuccaaaccugaguucugcaucaagguccugaaucccuauaugcccacagugauugaagaacuggagaaacuccagcgcaagcacggcgggaaccuugugagauguccucugucucggaauagcacccacgaaauguacugggucuccggagcgucuggcaacaucguuagcuccgugaauaccacaagcaaaaugcugcucaaccgcuuuacgaccagacaucggaagcccacauaugagaaagacguggaucugggggccggaaccagaucugucuccacagaaaccgagaagccugacaugacaaucauuggccggcgccuucagagacugcaggaggaacacaaggagaccuggcauuacgaucaagaaaauccguaccggacgugggcuuaucacggcagcuacgaggcccccucuaccggguccgcuagcucuauggugaacggaguugugaaacuccugacaaagccuugggacgucauccccauggugacccagcuggccaugacagauaccacgccuuucggccagcagcgcguuuuuaaagaaaagguggacacaagaacaccccaaccgaaaccugggacacggauggucaugaccacgaccgcgaauuggcucugggcccugcuuggaaagaagaaaaacccccgccugugcacaagagaggaguucauuuccaaggugcggagcaaugcugccaucggcgcuguuuuucaggaggaacagggguggaccuccgccagcgaagcugugaacgacucucgcuucugggagcucgucgauaaagaaagagcccugcaccaagagggcaagugugagagcugcguguauaacaugaugggaaaacgggaaaagaaacuuggcgaguuugggcgcgcgaaaggauccagagccauuugguacauguggcugggcgcucgguuccucgaguucgaggcccugggguuucugaaugaagaccauugguucggacgcgagaacucuuggagcggcgucgagggggaaggccuccacagacugggauauauccuugaggaaaucgauaagaaagacggcgaucugauguacgcugacgauacagccgggugggacacccggauuacagaggaugaccuccagaaugaggaacugaucaccgagcagauggccccucaucacaagauucuugcgaaagcuaucuuuaagcugacguaucagaacaaggugguuaaagugcucagacccacaccucgcggagccgucauggauauuaucucccggaaggaccaaagaggcucuggacaggugggaaccuacggccugaauaccuucacaaacauggaagugcagcugauccgccagauggaggccgaagggguuauuacccaagaugacaugcagaaucccaaaggccucaaggagcggguggagaaauggcugagagaaugcggagucgaccgccuuaagcggauggcuaucagcggcgaugacugugugguuaaaccgcuggaugagagauuugggacaucccuccuguuccuuaacgacaugggaaaggugcgcaaggauauuccucagugggaacccucuaaaggcuggaagaauuggcaggagguccccuuuugcagccaucacuuccacaaaaucuuuaugaaggacgggcggucccugguggucccuuguagaaaccaagaugaacucauuggacgcgcccggaucagccagggcgcuggguggucucugagagagacggccugccugggcaaagcguacgcccagauguggucccucauguauuuccaucggagagaccugcgccuugcuagcauggccaucuguucugcugugccgaccgagugguuucccacaucccggaccacauggagcauucacgcccaucaccaguggaugaccacggaagauaugcugaagguuuggaauagaguguggaucgaggacaacccuaauaugauugauaagacccccguccacuccugggaagacaucccuuaccucggaaaacgcgaggaccuguggugcggcucucuuauugggcugagcuccagagcgacaugggccaagaacauccauaccgcuauuacacaagugcggaaucucaucggaaaagaagaguauguugauuacaugcccgugaugaagcgcuauagcgccccuucugaguccgaaggcguccuguga

SEQ ID NO: 21065 - RNA, 9867 nt, Artificial Sequence
  derived and/or modified CDS sequence (opt5) from DENV-4__JQ513343__SS-prME
agcaccaucacccugcucugccugauucccacggugauggccuuccaccuuuccacccgggacggagagccucugaugaucguggcuaagcaugaacgggggcgcccgcuccuguuuaaaaccaccgagggaauuaacaaguguacacuuaucgccauggaucugggagaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggaauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggaaacauucaaggugccccaugcuaaacgccaggaugucacccuccugggcucccaggagggagccaugcacagcgcccuugcuggcgcgacagaaguggacuccggggaugagaaccacauguuugccggacaucugaaguguaagguucggauggagaaacucagaaucaagggcaugucuuauaccaugugcagcgggaaauucuccauugacaaggaaauggcugagacgcaacacggaacaaccguggucaaagugaaguacgaaggcgccggggccccuuguaaggugcccaucgagauucgcgauguuaauaaagagaaggucgugggccgggugaucagcgcuacaccccuggccgaaaacaccaacucugucaccaauaucgagcuggaaccuccguucggagacuccuauauugugaucggcguugggaacagcgcgcucacacugcauugguuuagaaaaggaucuagcauuggcaagauguucgaguccacguaccgcggggcuaaacggauggccauccuuggagaaaccgccugggauuuuggcucugucgggggacuguucacaagccucggaaaggcugugcaccagguguuuggcuccguuuauaccacaauguucgggggagugagcuggaugauuagaauccugaucggcuuucugguccuuuggauugggaccaauucucgcaacacguccauggccaugacaugcaucgcugugggaggcauuacccucuuccugggguuuaccguucaggccgacaugggcuguguggucagcuggucuggacgggagcugaagugcggcuccgggaucuucgugguggauaauguccauacauggaccgagcaauacaaauuucagcccgaaagcccugcgagacucgccuccgcuauucugaacgcccacaaggacggaguuuguggcauccgcucuacaacgcggcuugagaaugugauguggaaacagauuaccaacgaacugaauuaugugcucugggaagggggacacgaccugacagucguggcuggcgauguuaagggcgugcugaccaaagggaagagagcccuuacacccccugcgagcgaccucaaguacuccuggaaaaccuggggaaaggccaaaaucuucacgcccgaagcucggaacucuaccuuucugaucgauggcccggacacaagcgagugcccuaaugagcgcagagccuggaacuccuucgaagucgaggauuacggguucggaauguuuaccacaaauauuuggaugaaguuccgggaaggcagcucugaggugugugaccauagacugauguccgcugccaucaaagaucagaaggccguucacgcugacaugggguauuggauugaaagcucuaaaaaccaaaccuggcagaucgagcgcgcgucccucauugaggugaagacaugccuguggcccaagacccauacgcuuuggagcaauggaguccuggaaucucagaugcucaucccuaaaagcuacgccggccccuuuucccagcacaacuaucggcaaggcuacgcuacacagaccguggggccuuggcaccugggaaagcuggagaucgauuucggcgaaugccccgggaccacaguuaccauucaggagaacugugaccauagaggaccgagccuucgcacgacaaccgccucuggcaaacucgugacacaguggugcuguagauccugcaccaugccuccccugcgguuucugggggaggauggauguugguauggcauggaaauccgcccccucagcgagaaggaagagaauauggucaaaucccaagugacagccggccaggggaccucugaaacguucagcaugggacugcuuugccugacccucuuuguggaggagugucugagacggcgcgucacaagaaagcacaugauucuggcuguugugaucacccuuugcgccauuauccucggcgggcugacauggauggaccugcuccgggcgcugaucaugcuuggagauaccauguccggccgcauugggggacagacgcaucuggcuaucauggccguguucaagaugucuccuggcuacguccucggcguguuucugagaaaacugacaagccgggaaaccgcccuuaugguuauugggauggcuaugacaaccacccuguccaucccgcacgaccucauggagcugauugacggaaucucucucggccugauccuucugaagauugugacacaguucgauaacacgcaagucgggacccucgcccugagccugacauuuauccgcuccaccaugagccuugugauggcguggagaacaauuauggcuguucuguucguggucacccucaucccccugugucggacgucuugccuccagaaacagucccauuggguggaaauuacagcccugauccuuggagcccaagcucugccugucuaucucaugacccugaugaagggcgccagcagacgcucuuggccccugaaugaggggauuauggcugugggacuuguuucccugcucggcagcgcccugcucaaaaacgacgugccucuggcgggccccauggucgccgggggacuucugcuggcugccuacgugaugucuggcuccagcgcugaucucucccuggaaaaggccgccaauguucagugggacgagauggcugauaucaccgggagcucuccuaucauugaggugaagcaggacgaagauggcagcuuuuccauccgggacgucgaggaaacaaacaugauuacccuucuggugaaacucgcgcugaucacagugucuggccucuacccccuggccauuccgaucacgaugacccuuugguauauguggcagguuaagacacaaagaagcggggcucugugggaugucccuucccccgccgccacccagaaagcugcccugucugagggaguguaccgcaucaugcagcggggccucuucggcaagacacaggugggggucggcauucacauggaaggcguguuccacaccauguggcauguuacgagagggagcgugaucugucacgagaccggacgccuggagccuuccugggcggacguccggaaugauaugauuucuuauggcgggggauggagacuuggcgacaaaugggauaaggaagaggacgugcaaguucuggcuaucgaacccggcaagaacccgaaacaugugcagacaaagccugggcucuuuaaaacccugacaggagagauuggcgccgucacccucgacuucaagcccgggacaagcggauccccuaucaucaaucgcaaaggcaaggugauugggcuguacggcaacggaguugugacgaaaagcggcgauuaugucucugccaucacccaggcugagcggauuggggaacccgacuacgagguggaugaagacaucuuuagaaagaagcggcuuacaauuauggaucugcaccccggagccggcaaaaccaagcgcauccugccuuccauugugagagaggcgcucaaacggcgccugagaacccuuauccuggcuccgacacgggucguugccgccgaaauggaggaggcucucagagggcugcccauccgcuaucagacgccugccgucaagagcgaacauaccggacgggagauuguggaccucaugugccacgcuacauucaccacaagacugcuuucuuccacccgcguccccaauuacaaccugaucgugauggaugaagcccacuuuacggacccuagcuccguugcggcccggggcuacauuucuacaagaguggagaugggggaagcugccgcuaucuucaugaccgccacacccccuggcgccacagauccguuuccccaaagcaauuccccuauugaggacaucgagcgcgaaauccccgagcggagcuggaacaccggauucgauuggauuacagacuaucagggcaaaaccgucugguuugugccuucuaucaaggcugggaaugacauugcgaacugccugagaaaguccggcaagaagguuauccagcucagccgcaaaacguucgauacagaauaccccaagaccaaacugacagacugggauuuuguggucaccacggacauuucugagaugggcgccaacuucagagcugggcgggugaucgauccgcgcagaugucuuaagccugucauccugaccgacggacccgaacgggugauucucgccggccccaucccuguuacacccgccagcgcugcccaacgcagagggcggauuggcagaaauccugcgcaggaggaugaccaguauguguucuccggagauccgcugaagaacgacgaggaucaugcucacuggaccgaagccaaaaugcugcucgacaauaucuacacacccgagggcauuaucccuacccuuuuugggcccgaacgcgagaagacacaggccauugauggagaguuccggcugagaggcgaacaacgcaaaaccuuuguggagcugaugcggagaggggaccucccugucuggcugucuuauaagguugcuagcgccggaaucuccuacaaagaccgggaauggugcuucacgggcgagcgcaacaaucagauccuugaagagaacauggagguggaaauuuggacaagagagggcgaaaagaagaaacugcggcccaaguggcucgaugcgcgcguguaugccgacccgauggcucugaaagauuuuaaggaguucgccucugggagaaaaagcaucacccuggacauucucaccgaaaucgcuucccuuccuacauaccugagcucucgggccaagcuggcucucgauaauauugucaugcugcauaccacagagcgcggaggcagagccuaccagcacgcgcuuaacgagcugcccgaaucccucgagacgcugaugcugguggcccuccuuggggcuaugaccgccggaaucuuucuguucuuuaugcagggcaaggggaucggaaaacugagcaugggccucauuacaaucgcuguugccuccggccugcuuuggguggccgaaauucaaccucaguggaucgcugcgucuauuauccuggaguucuuucucaugguccugcugauccccgaaccugagaagcagcggacaccccaggacaaucaacucauuuaugugauccuuacaauucugaccaucauugggcugaucgccgcuaacgagaugggacucauugagaaaacgaagaccgauuucggcuuuuaccaggucaaaacagagaccacaauccuggacguggaucuucgcccggccagcgccuggacccuguaugcuguugccacgacaauccucaccccuaugcugagacacacaauugaaaauaccuccgcgaaccugucucucgccgcuaucgccaaucaggcugccgugcuuauggggcugggaaagggcuggccccugcaucggauggaccucggggucccccugcuugcgaugggauguuacagccaggugaacccuaccacacugacggccucccucguuaugcugcuggugcacuaugcuauuaucggcccgggccuccaagccaaagcuaccagagaggcccagaagcgcacagcugccgggauuaugaagaaucccaccgucgauggaaucacagugaucgaccuugagccuauuagcuacgaucccaaauucgaaaagcagcugggccaagugaugcugcucguucugugcgcggggcagcuucugcucaugcggaccacgugggccuucugugagguccugacacuggcuaccggaccuauccucacccuuugggaaggcaaccccgggagauuuuggaacacaaccauugccgugucuacagcuaauaucuuccgcggauccuaucuggccggcgccggccuggcguuuagccucauuaaaaacgcucagacgccucggagagggaccggaacaaccggcgagacacugggggaaaaguggaaacgccagcuuaauucucuggaccggaaggaguucgaggaauacaagagauccggaauccucgagguggaccgcaccgaagccaaaagcgcucugaaggauggcucuaaaaucaagcaugccgucagccggggguccucuaaaauuagauggaucguugagcgcggaauggugaagccgaagggcaaagugauugaccugggcugcgggcggggaggcuggagcuacuauauggccacgcucaagaacgucaccgaagugaaaggguacacaaagggaggccccgggcacgaggagccuauccccauggcuaccuauggauggaaucuuguuaaacugcauuccggcguggaugucuuuuacaagccuacagaacaaguggacacccugcucugugauauuggcgagagcuccucuaaccccacaaucgaagaggggagaacccugcgcguucuuaagaugguggaaccguggcugagcuccaaaccugaguucugcauuaagguccucaaucccuauaugcccacggugaucgaggaacuggagaaacugcagagaaagcacggaggcaaccucgugcgguguccucuuucucgcaauagcacacacgaaauguacugggucuccggggccucuggaaacaucguuagcuccgugaauaccaccagcaaaaugcugcugaacagauuuacaacgcggcauagaaagcccaccuaugagaaagacguggaucucggcgcggggacacggucugucuccaccgagacagaaaagccugacaugaccauuaucggacgcagacugcagcggcuucaggaggaacacaaggagacauggcauuacgaucaagaaaauccguaccgcaccugggccuaucacggcagcuacgaggcucccucuacgggcuccgccagcucuauggugaacgggguugugaaacugcucaccaagccuugggacgucauucccauggugacacagcuggcuaugaccgauacaaccccuuucggacagcagagaguuuuuaaagagaagguggacacgcggacaccccaaccgaaaccuggcacccgcauggucaugacaaccacggccaauuggcugugggcgcuccuggggaagaagaaaaaccccagacuuugcacccgggaagaguucaucuccaaggugcgcagcaaugccgcuauuggagccguuuuucaggaagaacagggcuggacauccgcuagcgaagccgugaacgacucuagauucugggagcuggucgauaaagagcgggcucuccaccaagaagggaagugugagagcugcguguauaacaugaugggcaaacgcgaaaagaagcugggagaguuuggcagagccaaagggucccgggcgaucugguacauguggcuuggagcccgcuuccuggaguucgaggcucucggcuuucugaaugaggaccauugguucgggagagaaaacucuuggagcggagucgagggcgaagggcugcaccggcucggcuauauccuggaggagauugauaagaaagacggagaucuuauguacgccgacgauaccgcuggcugggacacaagaaucaccgaagaugaccugcagaaugaggaacucauuacagagcagauggccccucaucacaagauccuggccaaagcgauuuuuaaacuuaccuaucagaacaaggugguuaaagugcugcgccccacgccuagaggggcugucauggauaucaucuccagaaaggaccaacgcggaucuggccagguggggacauacggacucaauaccuucaccaacauggaagugcagcugauucggcagauggaggccgagggcguuaucacacaagaugacaugcagaaucccaaagggcugaaggaaagaguggagaaauggcuccgcgaaugcggcgucgaccggcugaagagaauggccauuagcggagaugacugugugguuaaaccgcuugaugagcgcuuuggcaccucccuccuguuccugaacgacauggggaaggugcggaaggauaucccucagugggaacccucuaaaggauggaagaauuggcaggagguccccuuuugcagccaucacuuccacaaaauuuuuaugaaggacggcagaucccuuguggucccuugucgcaaccaagaugagcugaucgggcgggcuagaaucagccagggagccggcuggucucuccgggaaacagcuugccuggggaaagccuacgcgcagauguggucccugauguauuuccauagacgcgaccuccggcuggccagcauggcuauuuguucugccgugccgacggagugguuucccaccuccagaacaaccuggagcauccacgcucaucaccaguggaugacaaccgaagauaugcuuaagguuuggaaucgcguguggauugaggacaacccuaauaugaucgauaagacgcccguccacuccugggaagacauuccuuaccugggcaaaagagaggaccucuggugcggaucucugaucggccuuagcucccgggccaccugggcgaagaacauucauacagccaucacccaagugcgcaaucugaucgggaaagaggaauauguugauuacaugcccgugaugaagagauauagcgcuccuucugaguccgaaggaguccucuga

SEQ ID NO: 21066 - RNA, 9867 nt, Artificial Sequence
  derived and/or modified CDS sequence (opt5) from DENV-4__KT276273__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggcggccuacccuggauuuugaacugacaaagacgaccgcuaaggagguugcccuccugcgcacauacuguaucgaagcuagcauuucuaauaucaccacagccaccagaugcccgacgcaaggagagcccuaucuuaaagaggaacaggaccagcaguacauuugucggcgcgaugugguggacagaggcugggggaacggaugcggccuguucgggaagggaggcgucgugacaugcgcgaaauuuuccuguagcggcaagaucaccgggaaucucguucaaauugagaaccuggaauauaccguggucgugacaguucauaauggagauacccacgccgugggcaacgacacaucuaaucacggggucacggcuaccaucacaccucggucccccagcguggaggucgaacuuccugauuacggagagcugacccucgacugcgagcccagaucuggcaucgacuucaacgaaaugauucugaugaaaaugaauaagaagacauggcuggugcauaaacagugguuucucgaucugccgcuuccuuggaccgccggggcugacacguccgagguucacuggaacaauaaggaacgcauggugaccuucaaagucccccaugccaagcggcaggaugugacaguucugggcagccaggagggagccaugcacuccgcucucgcgggcgccaccgaaguggacucuggggauggaaaccacauguuugcuggccaucugaaauguaaggucagaauggagaaacuucgcaucaaggggaugagcuacacaaugugcuccggaaaguucagcauugacaaagagauggccgaaacccaacacggcacgacaguggugaagguuaaauaugagggggccggcgcuccuuguaagguccccaucgaaauucgggaugugaacaaagagaaggugaucggaagagucaucucuuccauuccccuggccgagaauaccaacagcgugacaaauaucgaacucgagccuccguucggcgacucuuacauuguuaucggggugggaaacagcgcgcugacccugcauugguuucgcaagggcuccucuauugggaaaauguucgaaagcaccuaucggggagcuaagagaauggccauccucggcgagacagccugggauuuuggguccgucggcggacuguucacgagccuuggcaaagcugugcaccagguuuuugggucuguguacaccacaauguucggaggcgucuccuggaugauccgcauucugaucggguuucucgugcuguggauuggaaccaauagccggaacacaucuauggccaugaccugcaucgcuguuggcgggauuacgcuguuccuuggcuuuacagugcaggccgacaugggaugugucguguccuggagcggcagagaacucaagugcggguccggaaucuucgugauugauaauguccauaccuggaccgagcaauauaaauuucagcccgagucuccugcgcgccuggccagcgcuauccugaacgcccacaaggacggcguuugugggauccgguccacaaccagacucgaaaaugugauguggaagcagauuacaaacgagcugaauuacgugcuuugggaaggaggccacgaccugacggucguggcuggcgauguuaaaggggugcucaccaagggaaaacgggcccugacacccccugcgucugaccugaaguauagcuggaaaaccuggggcaaggccaagaucuucacacccgaggcucgcaacuccaccuuucuuauugaugggccggacacgagcgaaugcccuaaugagagacgggccuggaacucucucgaggucgaagauuacggauucggcauguucaccacaaauaucuggaugaaauuuagagagggguccagcgaaaugugugaccaucgccugaugucugcugccauuaaggaucagaaagccgugcacgcugacaugggauacuggaucgaguccagcaagaaccaaaccuggcagaucgaaaaagcgucucugauugagguuaagacaugccucuggcccaaaacccauacacuguggagcaacggcgugcuugagucccagaugcugaucccuaagagcuaugccggccccuucucucagcacaauuaccggcaaggguaugcuacccagauugccggaccuuggcaccucggcaagcuggaaaucgauuuuggggagugccccggaacgacagucaccauucaggaagacugugaucauagaggcccgucccugcgcaccacaaccgccagcgggaaacuugugacgcaguggugcuguagauccugcacaaugccuccccuccgguuccugggagaggacggcuguugguacggcauggagauccgcccccugucugaaaaggaggaaaacaugguuaaaagccaaguggcugccgggcagggaaccuccgagacauuuucuaugggccuccugugccuuacccuguucgucgaagagugucucagacggcgcgugacaagaaagcacaugauccugguggucguuauuaccuuuugcgcgaucauucuggggggacuuacguggauggaucuccugcgggcucugaucaugcucggcgacaccaugagcgggcgcauuggaggccagauccaucuggccaucauggccguguucaaaauguccccuggcuaugugcuuggggucuuucugagaaagcucacaucucgggagaccgcucugauggugauuggaauggccaugacaaccguucugagcaucccguacgaccuuauggaacugauugauggcaucucccucgggcugauucuccugaagaucgugacgcaguucgacaauacacaagucggaacccuugcgcugagccucacauuuauucgcucuaccaugccccuggugauggcuuggagaaccaucauggccguucuguucguggucacacuuaucccucugugucggacguccugccuccagaaacagagccacuggguggagauuaccgcccugauccucggcgcucaagcccugcccgucuaucuuaugacacugaugaagggggcuucuagacgcuccuggccucucaacgaaggaauuauggccgugggccugguuagccugcuuggcucugcgcugcucaaaaaugaugugccccuggccgggccuauggucgcuggaggccuccugcuugccgcuuacgugauguccgggagcuccgccgaccugagccuggagaaggccgcuaacguucagugggaugaaauggcggacaucaccggaucuagccccauuaucgaggugaaacaggaugaggacggcuccuuuucuauccgggaugucgaagagacaaauaugauuacccuccuggugaagcuugcccugaucacggugagcgggcucuacccgcuggcuauuccuguuacaaugacccucugguauauguggcaggucaagacccaaagauccggagcccugugggacgugcccucuccugccgcuacacagaaagccgcgcuuagcgaaggcguguaccgcaucaugcagcggggccuguucgggaagacccaggucggagugggcauucauauggaggggguuuuccacacaauguggcacgugacgagaggauccgucaucugucaugaaaccggccgccuggagcccucuugggcugaugugcggaacgacaugaucagcuaugggggaggcuggagacucggcgauaaaugggacaaggaggaagacguucaagugcuggccauugagccggggaaaaauccuaagcacguccagacaaagcccggacuuuuuaaaacccugacaggcgaaaucggggccgugacccucgauuucaagccuggaacguccggcagccccauuaucaaccgcaaagggaagguuauuggccuguacggaaauggcguggucaccaaaucuggggacuauguguccgcuaucacacaggccgagcggauuggagagcccgauuacgaaguggacgaggauaucuuuagaaagaaacggcucaccaucauggaccugcauccuggcgcggggaagacaaagcgcauucuuccgagcaucgucagagaagcucugaaacggcgccugagaacccucauucuggcccccacacggguuguggccgcugagauggaagaggcccuuagaggacugccuauccgcuaucagacgcccgcugugaagucugagcacaccggccgggaaauugucgaucucaugugccaugccacauucaccaccagacugcucuccagcacacgcgugccuaacuacaaucugaucguuauggacgaggcgcacuuuacggaucccuccucuguggccgcucggggguacaucagcaccagagucgaaaugggcgaggccgcugccauuuucaugacagccaccccuccgggagcuacagaccccuuuccucaauccaacagccccaucgaagauauugagcgcgagaucccugaacggucuuggaauaccggcuucgacuggauuacggacuaucaggggaaaacagugugguuuguucccuccaucaaggcgggaaacgauaucgccaacugccuuagaaaaagcggcaagaaggugauucagcugucucgcaaaaccuucgacaccgaguacccgaagacaaaacugaccgauugggacuuugucgugacaaccgauaucagcgaaaugggggcuaauuucagagccggacgggucauugacccucgcagaugucucaagcccgugauccugacggauggccccgagcggguuauucuugccgggccuauccccgugacaccugcuuccgccgcgcaacgcagaggccggauuggaagaaacccggcucaggaagacgaucaguauguguucucuggcgacccccugaaaaaugaugaggaccacgcccauuggaccgaggccaagaugcuccuggauaacaucuacacaccugaagggaucauucccacccuguuuggaccugagcgcgaaaagacgcaggcuaucgacggcgaguuccggcucagaggggagcaacgcaaaaccuuugucgaacuuaugcggagaggagaccugcccguuuggcugagcuauaagguggccuccgcgggcauuucuuacaaagaucgggaguggugcuucacaggcgaacgcaauaaccagauccucgaggaaaauauggagguggagauuuggaccagagaaggggagaagaaaaagcugcggccgcgcuggcuugacgccagagucuaugcugauccuauggcccugaaggacuuuaaagaauucgcuagcggacggaaguccaucacacucgauauccugaccgagauugccagccugcccacauaccucucuucccgcgcuaaacuugcccuggacaacaucgugaugcugcacaccacggaaagaggcgggcgggcguaccagcaugcccucaaugagcugccugagagccuugaaacacugaugcucguugcucugcugggagccaugaccgcuggcauuuuucucuucuuuaugcaggggaagggaaucggcaaacuuuccaugggccugauuaccaucgccguggccucugggcugcucugggucgcugagauccaaccccaguggauugcggccagcaucauucuggaauucuuucuuauggugcugcucaucccugagcccgaaaagcagcgcacaccgcaggauaaccaacugauuuaugucauccugaccauucucacaaucaucggacuuauugcugccaaugagaugggccugaucgagaagacgaaaaccgacuucggguuuuaccaggugaagacagaaaccacaauucuggauguugaccucagaccugccuccgcuuggacccuguaugccguggcgacgaccauccuuacacccaugcugcggcacaccauugagaacacaucugccaaucucagccuggcugccaucgcuaaccaggccgcgguccugaugggacucggcaaaggguggccccuucacagaauggaucugggagugccucugcucgccaugggcuguuacucccagguuaauccgaccacgcugacagcuagccuugugaugcugcucguccauuaugccaucauuggccccgggcugcaagcuaaggccacccgcgaagcucagaaacggacagccgcgggaaucaugaagaacccuaccguggacggcauuaccgugaucgaucuggagcccauuucuuacgacccuaaauucgagaagcagcucgggcaaguuaugcuucugguccugugcgccggacagcuccugcuuaugagaacaacgugggcuuucugugaagugcugacccucgccacaggccccauccugacccugugggaggggaacccuggacgcuuuuggaauacaaccaucgcuguguccacggccaacauuuuccggggcagcuaucucgccggcgcggggcuugcuuuuucucugaucaagaaugcccagacaccgagacgcggaaccggcaccacaggggaaacccugggagagaaauggaagcggcagcucaacucccuggacagaaaagaauucgaggaguacaagcgcagcggcauucuugaagucgaucggacagaggcuaaaucugcccugaaggacgggagcaagaucaaacacgccguuuccagaggaucuagcaagauucgcuggaucguggaacggggcauggugaaacccaagggcaaagucguggaucucgggugcggaagaggcgggugguccuacuauauggcuacgcugaagaauguuaccgaggugaagggauacacaaaaggcgggccuggacaugaagagcccauuccuauggccaccuauggcuggaaccuggucaagcuccacagcggcguggacguuuuuuacaaacccacagagcaaguggauacccuucugugugacaucggggaauccucuagcaauccgacgaucgaggaaggacgcacccugagaguccucaagaugguggagccuuggcuguccucuaaacccgaauucugcauuaaggugcuuaaccccuauaugccuacagucaucgaggagcuggaaaagcuccagcggaaacauggcgggaaucugguucgcuguccccugagcagaaacuccacccacgagauguacugggugucuggagcgagcggcaauauuguguccagcgucaacacaaccucuaagaugcuccuuaaucgguuuacaaccagacaccggaaaccuacguaugaaaaggauguggaccugggggccggaacacgcuccguuagcaccgagaccgagaaaccggauaugacaaucauuggcagacggcugcagcgccuccaggaagagcauaaggaaacguggcacuacgaccaagagaaccccuacagaaccugggcuuaucauggcucuuacgaagccccuuccacagggagcgcuucuuccauggugaauggagucgugaaacugcuuaccaagcccugggauguuaucccuauggugacacagcuggccaugaccgacacaacccccuucggccagcagcgggucuuuaaggagaaaguggacacgcgcaccccgcaaccuaagcccgggacaagaaugguuaugaccacaaccgcgaacuggcucugggcccugcugggaaaaaagaaaaauccucggcucugcacgaaggaggaauucaucagcaaggugcgcgcuaacgccgcuauuggcgccgucuuucaggaggaacagggguggacauccgcuagcgaggccgugaacgauucuagauucugggaacuggucgacaaagagcgggcgcuucaccaagagggcaagugugaaagcugcguguauaauaugaugggaaaacgcgagaagaaacugggcgaauuugggagagccaagggaucccgggcuaucugguacauguggcucggcgcccgcuuccuggaguucgaagcucuuggguuucugaacgaggaucacugguucggaagagagaauucuuggagcggcguugaaggggagggccuccaucggcugggauauauucuggaagagaucgacaagaaagauggcgaccucauguacgccgaugacaccgccgggugggauacaagaauuaccgaggacgaucugcagaacgaagagcuuaucacggaacagauggcgccccaccauaagauccuggcuaaagccauuuuuaagcucaccuaucagaauaaaguggucaaggugcugcgcccuacaccccggggagccgugauggacaucauuuccagaaaggaucaacgcggcucugggcagguuggaaccuacggccuuaacacauucaccaauauggaggugcagcugauccggcagauggaagcugagggggucauuacacaagacgacaugcagaacccgaaaggccucaaggagagaguggaaaaauggcugcgcgagugcggaguugaucggcugaagagaauggccaucagcggcgacgauuguguggucaaaccucucgacgaacgcuuugcuaccucccugcuuuuccugaaugauauggggaaggugcggaaagacaucccccagugggagcccucuaagggauggaagaacuggcaggaagucccuuuuugcagccaccauuuccacaaaauuuuuaugaaggauggcagaucccucgugguuccgugucgcaaucaagacgagcugaucgggcgggccagaauuagccagggagcgggcuggucucuuaaagagacggccugccuggcuaaggccuacgcucagauguggucccucauguauuuccaccggagagaucugcgccuggccagcauggcgaucuguucugccgugcccacagaaugguuuccuaccucccggaccacauggagcauucaugcucaccaucaguggaugaccacagaggacaugcucaaagucuggaacagaguguggaucgaagauaaucccaacaugauugacaagacgccuguucacuccugggaggacauccccuaccuggggaagcgcgaagaucuuuggugcggcucucugaucggacucagcuccagagccaccugggcuaaaaauauucacacagccaucacccaagugcggaaccugauuggcaaggaggaguauauggacuacaugccugucaugcgcagauauagcgcucccucugaauccgagggggugcuuuga

SEQ ID NO: 21067 - RNA, 9867 nt, Artificial Sequence
  derived and/or modified CDS sequence (opt5) from DENV-4__KU523872__SS-prME
agcaccaugacccugcucugccugauccccacggugauggccuuccaccuuuccaccagagacggcgagccucugaugauuguugcuaagcaugaacgggggcgcccgcuucuguuuaagaccaccgaggggaucaacaaguguacacuuauugccauggaucugggcgaaaugugcgaggacaccguuacauacaaguguccccuccuggugaauaccgaaccugaggauaucgacugcugguguaaccugacgucuaccugggugauguaugggacaugcacccagagcggagagagacggcgcgaaaagagauccguugcccucacaccccacucuggcauggggcuggagacccgggcugaaacguggaugagcuccgagggagccuggaaacaugcccaacgcguggagucuuggauucuuagaaauccuggcuucgcucugcucgccggcuuuauggcucacaugaucgggcagacaggaauccagcggaccguuuucuuugugcugaugaugcuugucgcccccagcuacggcaugcgcuguguggggguuggaaacagagauuucguggaaggcgucuccgggggagcguggguggaccuggugcucgagcauggcggcugcgucacaaccauggcccaggggaagccuacccuggauuuugaacugacaaagacgaccgcuaaagagguugcccuccugcggacauauuguauugaagcuagcaucucuaauauuaccacagccacccgcugcccgacgcaaggagagcccuaccuuaaggaggaacaggaccagcaguauaucuguagacgggaugugguggaccgcggcugggggaacggaugcggccuguucgggaaaggaggcgucgugacaugcgcgaaguuuuccuguagcggcaaaauuaccgggaaucucguucaaaucgagaaccuggaauacaccguggucgugacaguucacaauggagauacccacgccgugggcaacgacacaucuaaucauggggucacggcuaccauuacaccuagaucccccagcguggaggucaaacuuccugauuauggagaacugacccucgacugcgagccccggucuggcaucgacuucaacgagaugauccugaugaagaugaaaaagaaaacauggcuggugcacaagcagugguuucucgaucugccgcuuccuuggaccgccggggcugacacguccgaaguucauuggaauuacaaagagagaauggugaccuucaaggucccccacgccaaacgccaggaugugacaguucugggcagccaggaaggagccaugcacuccgcucucgcgggcgccaccgagguggacucuggggauggaaaccauauguuugcuggccaccugaaguguaagguccggauggaaaaacuuagaauuaaggggaugagcuacacaaugugcuccggaaaauucagcaucgacaaggagauggccgagacccaacauggcacgacaguggugaaaguuaaguaugaaggggccggcgcuccuuguaagguccccauugagauccgcgaugugaauaaagaaaagguggucggacggauuaucucuuccacccccuucgccgagaacacaaacagcgugaccaauaucgagcuggaaccuccguuuggcgacucuuacauuguuaucggggugggagauagcgcgcucacccugcacugguucagaaaaggcuccucuauugggaagauguuugagagcacauaucgcggagcuaaacggauggccauccugggcgaaacggccugggacuucggguccgucggcggacucuuuaccagccugggcaaggcugugcaucagguuuucgggucuguguacacaaccauguuuggaggcgucuccuggaugauuagaauccuuaucggguuccuggugcucuggauuggaacaaacagccgcaauaccucuauggccaugacgugcaucgcuguuggcgggauuacacuguuucugggcuucaccgugcaggccgauaugggaugugucguguccuggaacggcaaggagcuuaaaugcgggaauggaaucuuuguggucgacaacguucacaccuggacagaacaauauaaguuccagcccgagagcccugcgcggcucgccuccgcuauucugaaugcccacaaagacggcgugugugggaucagaucuaccacacgccuggagaacgugauguggaagcagauuacgaaugaacucaacuacguccugugggagggaggccaugaucuuaccgugguugcuggcgacgugaaagggguccugacaaagggaaagcgggcccucacacccccugugaaugaucugaaauauagcuggaagacauggggcaaagcgaagaucuuuacccccgaagccagaaacuccacguuccugaucgacgggccggauaccucugagugcccuaaugaacggcgcgcuuggaacuucuuugagguugaggacuacggauucggcauguuuacaaccaauauuuggaugaaauucagagaagggagcuccgaggugugugaucaccggcuuaugagcgccgcuaucaaggaccagaaagccguccaugccgauaugggauacuggauugaaucuuccaagaaccaaacauggcagaucgagaaggcuagccucauugaagugaaaaccugccuguggcccaagacacacacccuguggucuaacggcguucucgagucccagaugcugaucccuagaagcuaugcgggccccuuuucucagcacaauuaccgccaaggguaugccacgcagacagcuggaccuuggcaucuuggcaaacuggagaucgacuucggggaaugccccggaaccaccgugacaauucaggaggauugugaccaccggggcccgagccucagaaccacgacagccuccgggaagcuggucacccaguggugcugucgcagcugcacaaugccuccccugagauuucuuggagaagauggcuguugguacggcauggagauccggccccucucugagaaagaagagaacauggugaagucccaagugaccgccgggcagggaacaagcgaaaccuucuccaugggccugcugugccucacgcuguuugucgaggaaugucuucgcagacggguuacccgcaagcauaugauucuggugguggucaucacauucugcgcuauuauccucgggggacugaccuggguggaccugcuuagagcccucaucaugcugggcgacacaaugucugggcggauuggaggccagauccaccuggcgauuauggcuguuuuuaaaaugagcccuggcuaugugcucggggucuuccugcgcaaacuuaccuccagagagacggcccugauggugaucggaauggccaugacaaccgucuuuucuauuccgcaugaucucauggagcugaucgacggcaucagccuggggcuuauucugcucaaaaucgugacacacuucgauaauacccaggucggaacccuggcucucucccugacauucauucggucuacgacaccccuugugauggccuggcgcacaaucauggcggucuuuuucgugguuacccugauuccucucuguagaacaagcugccugcaaaagcagucccacuggguggaaaucaccgcucugauucuuggcgcccaggcccugcccgucuaccucaugacgcugaugaaaggggcuagccggagaucuuggccucucaacgagggaaucauggccgugggccugguuucccuucugggcagcgcucuccugaagaaugacgugccccuggccgggccuauggucgcgggaggccuucugcucgccgcuuaugugaugucuggguccagcgccgaucugucucucgaaaaggcugccaacgugcaaugggacgagauggccgauaucacaggauccagccccguuauugaagucaaacaggacgaggauggcuccuuuagcauccgcgacguggaggaaaccaauaugauuacccugcuugugaagcuggcucugaucacagucucugggcucuacccgcuggcgauuccugugaccauggccaucugguacaucuggcagguuaaaacacagcggagcggagcucuuugggaugugcccuccccugccgccacgcaaaaggcuacccugucugagggcgucuauagaauuaugcagcgcggccucuucgggaaaacacaggugggaguuggcauccauauggaagggguguuucacaccauguggcaugucacacggggaagcgugauuugucacgagaccggcagacuggaacccuccugggccgacguucgcaacgauaugaucucuuacgggggaggcuggaagcucggcgacaagugggacaaagaggaggaugugcagguccuggcgauugaaccggggaagaauccuaaacaugugcaaacgaagcccggacuuuucaaaacccugacaggcgagaucggggcugugacccuggacuuuaagccuggaacaagcggcucccccaucauuaacaaaaaggggaaggucaucggccucuauggaaauggcguugugaccaaaucuggggauuacgugagcgccauuacacaggccgaacggaucggagagcccgacuaugaggucgaugaagacauuuucagaaagaaacgccugacgaucauggaucuucacccuggcgcugggaagaccaaacggauucugccguccaucgugagagaggcccucaagcggcgccugagaacacucauccuggcgcccacccggguuguggcugccgaaauggaggaagcccuucgcggacugccuauuagauaccagacccccgcugucaagagcgagcacacaggccgggagaucguggaccugaugugccaugccacguuuaccacaagacuccugucuuccacccgcguuccuaacuauaaucuuauugugauggaugaagcucacuucacagaccccugcagcgucgccgcgcggggguacaucucuaccagaguggagaugggcgaagccgcugccauuuuuaugacggcuacaccuccgggauccaucgaucccuucccucagagcaacucccccaucgaggacauugaacgcgagaucccugagcggucuuggaauaccggcuucgacuggauuaccgauuaccaagggaaaacagucugguuugugcccagcaucaaggccggaaacgacauugccaacugucugagaaaauccggcaagcgcguuauccagcucagccggaaaaccuucgauacagaauauccgaagaccaagcugacggacugggauuuuguggugacaaccgacaucucugagaugggggcuaauuucagagcgggacgcgucauugauccuagacggugccucaaacccguuauccugacagacggccccgaacgcgugauucuugccgggccuauccccgugaccccugcuuccgccgcccagagacggggccgcauuggaagaaacccggcucaagaggaugaccaguacgucuuuagcggcgauccccugcggaaugacgaagaucaugcccacuggacggaggcgaagaugcugcucgacaacaucuauaccccugaggggauuauccccacacuguucggaccugaaagagagaaaacccaggcuaucgacggcgaauuucgccuuagaggggaacagcggaagacauucguggagcugaugcgccggggagaucuccccguuuggcugucuuacaaaguggccagcgccggcauuuccuauaaggacagagaaugguguuuuaccggcgagcggaauaaccaaauccuggaagagaauauggaagucgagauuuggacacgcgagggggaaaagaaaaagcucagaccgaaauggcuugaugcucggguguacgccgacccuauggcgcugaaggauuucaaagaguuugccucuggacgcaagagcaucacccuggacauucucacggaaaucgcuacacugcccaccuaucuuuccucuaaggccaaacuggcucucgauaacaucgucaugcugcacaccacagagaagggcgggagagccuaccagcaugcucugaaugaacucccugagagccuugagacccugaugcugguggcccuccugggagcgaugacagccggcauuuuccucuuuuucaugcaggggaaaggaaucggcaagcuguccaugggccucauugcuaucgccguugcuagcgggcugcuguggguggccgaaauucagccccaauggaucgccgcuucuaucauucucgaguucuuucuuaugguccugcugaucccugaacccgagaaacagcggacgccgcaggacaaccagcucauuuacgugauccugaccauucuuacaaucauuggacugguugcggccaaugaaaugggccucaucgagaagaccaaaacagauuucggguuuuaucaagugaagaccgagacgaccauccuggacgucgaucugcgcccugcuuccgccuggacacucuacgccguggcuaccacaauucuuacccccaugcugagacacacgaucgaaaacacaagcgccaaucugucccucgcggccauugcuaaccaggccgcugugcugaugggacuuggcaagggguggccccugcaucggauggaccucggaguuccucugcuggccaucggcugcuauucucaggucaauccgaccacacucaccgcgagccuugugaugcugcuggugcacuacgccauuaucggccccgggcuccaggcuaaagccacccgcgaggcucaaaagagaacagccgcuggaaucaugaaaaacccuacggucgauggcauuaccguuaucgaccuggaacccauuuccuaugacccuaaguucgagaaacagcuuggacaggugaugcugcucgugcugugugucggacaacugcuccuuaugcggacaaccugggcccugugcgaggugcugacacucgcgaccggccccaucaugacgcugugggaagggaacccuggaagauuuuggaauacaaccauugccguuucuaccgcuaacaucuuccgcggcagcuaccuugccggcgcugggcuggccuuuucccucaucaagaaugcccagacaccgcggagaggaaccggcacaacgggggagacccugggagaaaaguggaaacgccagcugaacagccucgaucggaaggaguucgaagaguauaaaagaucuggcauucuugagguggaccgcacagaagcgaaguccgcucugcgggaugggagcaaaaccaagcaugccgucucuagaggauccagcaagauccgcuggauuguggagcggggcaugaucaaacccaagggcaaaguuguggaccugggguguggaagaggcggguggucuuacuacauggcuacacucaagaaugucaccgaagugaaaggauauacgaagggcgggccuggacacgaggaacccauuccuauggccaccuacggcuggaaccuggugaaacuucacagcggcgucgaugucuuuuauaaacccacagaacagguggacacccugcucugcgauaucggggaguccucuagcaauccgacaauugaagagggaaagacccugcgcgugcugaaaauggucgaaccuuggcucuccagcaagcccgaguucuguaucaaagugcuuaaccccuacaugccuacaguuaucgaggaacuggagaagcugcaacggagacauggcgggucccucgugcgcugcccccugucuagaaauagcacccacgaaauguauugggucuccggagccucuggcaacauugugagcuccguuaauacgaucucuaaaaugcuucugaaccgguuuacaacccgcuacagaaagccuaccuaugagaaggacguggaucucggggcuggaacacggagcgucuccacggaaaccgagaaaccggacaugacaauuaucggcagacggcugcagcgccugagagaggaacauaaggagaccuggcacuacgaucaggaaaaucccuaccggacaugggccuaucacggcagcuacgaggcgccuucuaccggguccgccagcucuauggugaacggaguugugaaacuccuuacaaagcccugggacgucgugccuauggucacccagcuggcuaugacggacaccacacccuucggccaacagcgcguguuuaaagaaaagguugauaccagaacaccgcagccuaagcccgggacccggaaaauuaugacgacaaccgccaauuggcugugggcucuccugggaaagaaaaaguccccucgccuuuguacaagagaggaguucaucagcaaagugcggucuaacgccgcgaucggcgccgucuuccaggaggagcaaggguggaccuccgcuagcgaagccgugaaugacucccgcuuuugggagcugguggauaaggaaagagcucuccaucaggagggccggugcgagagcugcguuuauaacaugaugggaaagcgcgagaagaagcugggcgaguucgggagagccaaaggaucucgggcuauuugguacauguggcugggcgcccgcuuucucgaguucgaggcgcugggguuucuuaacgaagaccacugguucagcagagaaaauuccuggucuggaguggagggcgaagggcugcaucggcucggcuauauccuggaggauauugacaagaaagauggagaccuuaucuacgccgaugacacggcuggcugggauaccagaauuacagaagacgaucugcucaacgaggagcugaucaccgaacagauggcgccccaccauaagacacuggcuaaggccaucuuuaaacucaccuaucaaaauaaggucgugaaaguucugcgcccuacacccaagggggccgugauggacauuaucagccggaaagaccagagaggauccggccaggucgggaccuacggacuuaacacguucacaaauauggaggugcagcugauucgccaaauggaagcggagggcgucaucacccaggaugacaugcagaacccggaagggcucaaggagcggguggagaaauggcugaaggaauguggcguugauagacuuaagcgcauggcuauuucuggagacgauugcguggucaaaccucuggacgagcgguuuagcaccucccuccuguuccugaaugauaugggcaaggugagaaaagacaucccccagugggaacccucuaagggguggaaaaacuggcaagagguuccuuuuuguagccaccacuuccauaagaucuuuaugaaggauggacgcucccucguggucccgugccggaaucaggacgaacugauuggcagagcccgcaucagccagggggccggauggucucuucgggagacagcuugucugggcaaagccuacgcucagauguggucccucauguauuuccacagacgggaucugagacuugccagcauggcgauuugcucugccgugcccaccgagugguucccuacaucccgcacgaccuggagcauccaugcucaccaccaauggaugacaaccgaagacaugcugaagguguggaaccggguuuggauugaggacaaucccaacaugacagauaaaaccccuguccauuccugggaagacauccccuaccucgggaagagagaggaucugugguguggcucucugauuggacucagcucccgcgccacgugggcuaaaaauauccacaccgccaucacacaggugagaaaccugauuggcaaggaagaguauguggacuacaugccugcgaugaagcgguauagcgcccccuuugagucugaagggguccuuuga

SEQ ID NO: 21068 - RNA, 9867 nt, Artificial Sequence
  derived and/or modified CDS sequence (opt5) from DENV-4__KP140942__SS-prME
agcaccaucacgcugcucugccugauucccacggugauggccuuccaccuuuccaccagagacggagagccucugaugaucgucgcuaaacaugaacgggggcgcccgcuccuguuuaaaacaaccgaggggauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggcggccuacccuggauuuugaacugacaaagacgaccgcuaaggagguugcccuccugcgcacauacuguaucgaagcuagcauuucuaauaucaccacagccaccagaugcccgacgcaaggagagcccuaucuuaaagaggaacaggaccagcaguacauuugucggcgcgaugugguggacagaggcugggggaacggaugcggccuguucgggaagggaggcgucgugacaugcgcgaaauuuuccuguagcggcaagaucaccgggaaucucguucaaauugagaaccuggaauauaccguggucgugacaguucauaauggagauacccacgccgugggcaacgacacaucuaaucacggggucacggcuaccaucacaccucggucccccagcguggaggucgaacuuccugauuacggagagcugacccucgacugcgagcccagaucuggcaucgacuucaacgaaaugauucugaugaaaaugaauaagaagacauggcuggugcauaaacagugguuucucgaucugccgcuuccuuggaccgccggggcugacacguccgagguucacuggaacaauaaggaacgcauggugaccuucaaagucccccaugccaagcggcaggaugugacaguucugggcagccaggagggagccaugcacuccgcucucgcgggcgccaccgaaguggacucuggggauggaaaccacauguuugcuggccaucugaaauguaaggucagaauggagaaacuucgcaucaaggggaugagcuacacaaugugcuccggaaaguucagcauugacaaagagauggccgaaacccaacacggcacgacaguggugaagguuaaauaugagggggccggcgcuccuuguaagguccccaucgaaauucgggaugugaacaaagagaaggugaucggaagagucaucucuuccauuccccuggccgagaauaccaacagcgugacaaauaucgaacucgagccuccguucggcgacucuuacauuguuaucggggugggaaacagcgcgcugacccugcauugguuucgcaagggcuccucuauugggaaaauguucgaaagcaccuaucggggagcuaagagaauggccauccucggcgagacagccugggauuuuggguccgucggcggacuguucacgagccuuggcaaagcugugcaccagguuuuugggucuguguacaccacaauguucggaggcgucuccuggaugauccgcauucugaucggguuucucgugcuguggauuggaaccaauagccggaacacaucuauggccaugaccugcaucgcuguuggcgggauuacgcuguuccuuggcuuuacagugcaggccgacaugggaugugucguguccuggagcggcagagaacucaagugcggguccggaaucuucgugauugauaauguccauaccuggaccgagcaauauaaauuucagcccgagucuccugcgcgccuggccagcgcuauccugaacgcccacaaggacggcguuugugggauccgguccacaaccagacucgaaaaugugauguggaagcagauuacaaacgagcugaauuacgugcuuugggaaggaggccacgaccugacggucguggcuggcgauguuaaaggggugcucaccaagggaaaacgggcccugacacccccugcgucugaccugaaguauagcuggaaaaccuggggcaaggccaagaucuucacacccgaggcucgcaacuccaccuuucuuauugaugggccggacacgagcgaaugcccuaaugagagacgggccuggaacucucucgaggucgaagauuacggauucggcauguucaccacaaauaucuggaugaaauuuagagagggguccagcgaaaugugugaccaucgccugaugucugcugccauuaaggaucagaaagccgugcacgcugacaugggauacuggaucgaguccagcaagaaccaaaccuggcagaucgaaaaagcgucucugauugagguuaagacaugccucuggcccaaaacccauacacuguggagcaacggcgugcuugagucccagaugcugaucccuaagagcuaugccggccccuucucucagcacaauuaccggcaaggguaugcuacccagauugccggaccuuggcaccucggcaagcuggaaaucgauuuuggggagugccccggaacgacagucaccauucaggaagacugugaucauagaggcccgucccugcgcaccacaaccgccagcgggaaacuugugacgcaguggugcuguagauccugcacaaugccuccccuccgguuccugggagaggacggcuguugguacggcauggagauccgcccccugucugaaaaggaggaaaacaugguuaaaagccaaguggcugccgggcagggaaccuccgagacauuuucuaugggccuccugugccuuacccuguucgucgaagagugucucagacggcgcgugacaagaaagcacaugauccuggcgguggucauuacccugugcgcuaucauucuugggggacucacguggauggaucugcugcgggcccucaucaugcugggcgacaccaugagcgggcgcaugggaggccagacacaucuugccauuauggcuguuuuuaaaauguccccuggcuaugugcuggggguguuccucagaaagcugaccucucgggagacagcccugauggucaucggaauggcgaugaccacgacacuuagcaucccgcacgaccugauggaacucauugauggcaucucccuggggcucauucugcuuaagaucgugacccaguuugacaauacacaaguuggaacccuggcucucagccugaccuucauucgcucuacaaugucccuggugauggccuggagaacgaucauggccguccuuuuugugguuacccugauuccccucugucggacaagcugccugcagaaacagucucauuggguggagaucaccgcucucauccugggcgcccaagcccuuccugucuaccugaugacacucaugaagggggccuccaaaagaagcuggccccugaacgaaggaauuauggcggugggccuggucucucuucugggcuccgcccuccugaagaaugaugugccucucgcugggcccaugguugccggaggccugcuucuggcugccuaugugaugagcggguccagcgccgaccugucucucgagaaagcugcgaacguccagugggaugaaauggccgacaucaccggaagcuccccuauuaucgaggugaagcaggaugaggacggcucuuucagcauucgcgauguugaagagacgaauaugaucacacugcuugugaagcuggcucucaucaccgucuccgggcuguacccccucgccauuccggugaccaugacacugugguacauguggcaagugaaaacccaacggucuggagcccuuugggacguuccuagccccgcugccacacagaaggcggcucuguccgaaggcgucuauagaaucaugcagcgcggccuguuugggaaaacacaggugggagugggcauucacauggagggggucuuccacaccauguggcaugugacacggggaucuguuaucugucacgaaaccggcagacucgagccuagcugggccgaugugcgcaacgacaugauuuccuacgggggaggcuggcggcugggcgauaagugggacaaagaggaagacguccaagugcuugccaucgagcccgggaagaauccgaagcauguucagacaaaaccuggacuguucaagacccucacgggcgaaaucggggcugugacccuggauuuuaaacccggaacaagcggcucuccuauuaucaacagaaaggggaaagucauuggccucuauggaaauggcgugguuaccaaguccggggacuacgugagcgccaucacacaggcggagcgcauuggagagcccgauuaugaagucgacgaggauaucuuccggaaaaagagacugaccauuauggaccuucaccccggcgcugggaagacaaaacggauccugccuucuaucgugcgcgaagcccugaagagacggcuccgcacgcugauucuugccccgaccagaguggucgcugccgagauggaagaggcucugcggggacuccccaucagauaccagaccccugcuguuaaauccgagcauaccggccgcgaaauuguggaucugaugugccacgcgaccuuuacaacgcggcuccugagcuccaccagagugcccaacuauaaucuuaucgucauggacgaggcccacuucacagauccuucuagcguggcugcccgcggguacauuuccacccggguugaaaugggcgaggcugccgccaucuuuaugacagcuacacccccuggagcgacggacccguucccccaaagcaacucuccuaucgaagauauugagagagagauccccgaacgcuccuggaauacaggcuuugacuggauuaccgacuaccaggggaagaccgugugguucgucccuagcaucaaagccggaaacgauauugcuaacugccugcggaagucuggcaagaaagugauccagcugagcagaaagacauuugacaccgaguaucccaaaacaaagcucaccgauugggacuucguugugacgacagauaucuccgaaaugggggccaauuuucgcgccggaagagucauugacccgcggcgcugucugaaaccugugauccuuaccgauggccccgagagagucauucuggcugggcccaucccugugacacccgccucugcggcucaacggcgcggcagaauuggacggaacccugcccaggaagacgaucaguacguuuucagcggcgacccgcucaagaaugaugaggaccaugcccacuggaccgaggcuaagaugcugcuggauaacaucuauacgcccgaagggauuaucccuacccucuucggacccgagagagagaagacccaggccaucgacggcgaguuucgccuuagaggggaacaacggaagaccuucguggaacugaugcgccggggagaccugccuguguggcucuccuacaaagucgcgucugccggcauuagcuauaaggauagagaguggugcuuuacaggcgaacggaauaaccagauccuggaggaaaauauggagguugagauuuggacccgcgaaggggagaaaaagaaacuuagaccccgguggcuggacgcucgcguguacgccgauccgauggcucucaaagacuucaaggaauuugccuccggaagaaaaagccugacacuggauauccucaccgagauugcuucucuuccuacguaucuguccagccgggccaagcuggcgcucgacaacaucgugaugcugcauacaaccgaacgcggcgggagagccuaccagcacgcucuuaaugagcugcccgagucccucgaaacccugaugcuggucgcccuccuuggagcuaugacagccggcaucuuccuguuuuucaugcaggggaaaggaauuggcaagcugucuaugggccucaucaccauugccguggcuagcgggcugcuuuggguugcggagauccaaccucaguggauugccgcuuccaucauccuggaauuuuuccucauggugcugcugauucccgagccugaaaagcagcggacaccccaggauaaccaacucaucuacgucauucuuacgauccugaccauuaucggacugauugccgccaaugagaugggccucaucgagaaaacaaagaccgacuuuggguucuaucaggugaaaacagaaaccacgauccuggaugucgaccuucgcccggcuucugccuggacccuguacgcgguggccacaaccauucucacaccuaugcugagacacaccaucgagaacacgagcgcuaaucugucccucgccgcuauugccaaccaggcggccguucuuaugggacugggcaagggguggccccugcaucggauggaucucggagugccccugcuugcuaugggcuguuauagccaggucaauccuacaacccugacagccucucucgugaugcugcugguucacuacgcuaucauuggcccggggcuccaagccaaagcuaccagagaagcccagaagcgcaccgcggccggaaucaugaaaaaccccacaguggacggcaucacggucauugaucuugagccuaucuccuaugaccccaaguuugagaagcagcuggggcaagugaugcugcucgugcugugcgcuggacagcuucugcucaugcggaccacaugggccuucugugaaguucugacccuggcuacaggcccuauucucacccuuugggaggggaaccccggaagauucuggaauacgacaaucgccgucagcaccgccaacauuuuucgcggcucuuaccuggcgggcgcugggcuggccuucucccucaucaaaaaugcucagaccccucggagaggaacaggcaccacaggggaaacgcugggagagaaguggaaacgccagcuuaacagccuggaccggaaggaauuugaggaguauaaaagaucuggcauccucgaaguggaucgcaccgaggccaagagcgcccugaaggacggguccaaaauuaagcaugcugugucucggggaagcuccaaaaucagauggauugucgaacgcggcaugguuaagccgaaaggcaaggugguggaucuggggugcggacggggcggguggagcuacuacauggccacacucaagaaugucaccgaggugaaaggauauacaaagggcgggcccggacacgaagaaccuauccccauggcgaccuacggcuggaaccuuguuaaacugcauuccggcguggacgucuucuauaagccuacggagcaaguggauacccugcucugugacauuggggaaucuagcuccaaucccacaaucgaggaaggaagaacccugcgcguucuuaaaaugguggagccguggcugucuagcaagccugaauuuugcauuaagguccucaaccccuacaugcccacagugaucgaggagcuggaaaaacugcagagaaagcacggcgggaaucucgugcgguguccucuuucccgcaacucuacccacgagauguauugggucagcggagccuccggcaauaucguuagcucugugaacacaaccuccaaaaugcugcugaauagauucacgacacggcauagaaagcccaccuacgaaaaagauguggaccucggggcuggaacccggagcgucucuacagagacggagaagccugauaugaccauuaucggccgcagacugcagcggcuucaggaggaacacaaagaaacauggcauuaugaccaagagaacccguaccgcaccugggccuaccacggcuccuaugaagcucccagcacagggucugccuccagcauggugaauggaguugugaagcugcucaccaagccuugggaugucauucccauggugacacagcuggcgaugaccgacacgaccccuuuuggccagcagagaguuuucaaagagaagguggacacacggacaccccagccgaaaccugggacacgcauggucaugaccacgacagccaacuggcugugggcucuccugggaaagaaaaagaaucccagacuuugcaccaaggaggaauuuaucuccaaagugcgggccaacgcugccauuggcgcuguuuuccaggaggaacagggguggacaagcgccucugaggcggugaacgauagccgcuuuugggaacuggucgacaaggagagagcccuccaccaagagggcaaaugugaauccugcguguacaauaugaugggaaagcgggagaaaaagcugggcgaguucgggcgcgcuaagggaucuagagccaucugguauauguggcuuggcgcucgguuucuggaguucgaagcccucggguuccugaacgaggaucauugguuuggacgcgagaauagcugguccggcgucgaaggggagggccugcacagacucggauacauccuggaagagauugacaaaaaggauggcgaccuuauguaugccgaugacaccgcggggugggauacgcggaucaccgaggacgaucugcagaacgaggaacucauuacagaacagauggcuccucaucacaaaauccuggccaaggccauuuucaaacuuaccuaccagaauaaggugguuaaggugcugagacccacaccucgcggagcugucauggacaucaucucucggaaagaucaaagaggcagcggacaggugggaaccuauggccucaacacauuuaccaauauggaggugcagcugauucgccagauggaagccgaggggguuaucacgcaagacgacaugcagaaccccaagggccugaaagagcggguggaaaaguggcucagagagugcggagucgaucgccugaaacggauggcuauuuccggcgacgauugugugguuaagccgcuugacgaaagauucgccacaucucugcucuuucugaaugauauggggaaagugcgcaaggacaucccucagugggagcccagcaagggauggaaaaacuggcaggaaguccccuucugcucccaucacuuucacaagauuuucaugaaagauggccggagccuuguggucccuuguagaaaucaagacgagcugaucgggcgcgcgcggaucucucagggagccggcuggucccucaaggagaccgcuugccuggccaaggcuuacgcccagauguggagccugauguacuuucauagacgggaucucagacuggcgucuauggccauuuguuccgcugugccgaccgaaugguuccccacaagccgcaccacaugguccauccacgcccaucaccaguggaugacgaccgaggacaugcuuaagguuuggaaccggguguggauugaagauaauccuaacaugaucgacaagacacccguccacucuugggaggacauuccuuaucuggggaaaagagaagaucucuggugcggcagccugaucggacuuuccagccgcgcuaccugggccaagaauauucauacagcuaucacccaagugagaaaccugaucggcaaagaggaguacauggacuauaugcccguuaugcggcgcuacucugccccuuccgaaagcgagggggugcucuga

SEQ ID NO: 21069 - RNA, 9867 nt, Artificial Sequence
  derived and/or modified CDS sequence (opt5) from DENV-4__KU523871__SS-prME
agcacaaugacacugcucugccugauccccacggugauggccuuccaccuuuccacccgggacggcgaaccucugaugauugucgcuaagcaugaacgggggcgcccgcuccuguuuaagacaaccgaagggaucaacaaguguacacuuauugccauggaucugggcgaaaugugcgaggacaccguuacauacaaguguccccuccuggugaauaccgaaccugaggauaucgacugcugguguaaccugacgucuaccugggugauguaugggacaugcacccagaauggagagagacggcgcgaaaagagaagcgucgcccucacaccccacuccggcauggggcuggagacccgggcugaaacguggaugucuagcgagggagccuggaaacaugcccagcgcguggaguccuggauucuuagaaacccuggcuucgcucugcucgccggcuuuauggcuuacaugaucgggcagacaggaauccagcggauuguuuucuuugugcugaugaugcuugucgcccccucuuauggcaugcgcuguguggggguuggaaauagagauuucguggaaggcgucagcgggggagcguggguggaccuggugcucgagcacggcggcugcgucaccacaauggcccaggggaagccuacccuggauuuugaacugaccaagacaacggcuaaagagguugcccuccugcggaccuacuguaucgaggcuuccauuagcaacaucacaaccgccacacgcugcccgacccaaggagagcccuaucuuaaggaggaacaggaccagcaguacauuuguagacgggaugugguggaccgcggcugggggaauggaugcggccuguucgggaaaggaggcgucgugacgugcgcgaaguuuucuuguuccggcaaaaucacagggaaccucguucaaauugagaaucuggaauauaccguggucgugaccguucauaacggagauacacacgccgugggcaaugacaccagcaaccacggggucacagcuacgaucaccccuagaucucccuccguggaggucaaacuuccugauuacggagaacugacacucgacugcgagccccggagcggcaucgacuucaaugagaugauucugaugaagaugaaaaagaaaaccuggcuggugcauaagcagugguuucucgaucugccgcuuccuuggacagccggggcugacaccucugaaguucacuggaaccauaaagagagaauggugacguucaaggucccccacgccaaacgccaggaugugaccguucugggcucccaggaaggagccaugcacagcgcucucgcgggcgccacagagguggacuccggggauggaaaucauauguuugcuggccaccugaaguguaagguccggauggaaaaacuuagaaucaaggggaugucuuacaccaugugcagcggaaaauucuccauugacaaggagauggccgagacacaacauggcaccacgguggugaaaguuaaguaugaaggggccggcgcuccuuguaagguccccaucgagauucgcgaugugaacaaagaaaagguggucggacggaucaucagcucuacacccuucgccgagaacaccaauuccgugacaaacauugagcuggaaccuccguuuggcgacagcuacaucguuauuggggugggagagucugcgcucacccugcacugguucagaaaaggcagcuccaucgggaagauguuugaaucuaccuaucgcggagcuaaacggauggccauucugggcgagacagccugggauuucgggagcgucggcggacucuuuacgucccugggcaaggcugugcaucagguuuucgggagcguguacaccacaauguuuggaggcgucucuuggauggugagaauccuuaucggguuccugguucucuggauuggaaccaauucccgcaacacaagcauggccaugaccugcaucgcugugggcgggauuacgcuguuucugggcuucacaguccaggccgacaugggauguguggugucuugguccggcaaggaacuuaaaugcgggagcggaaucuuugucguugauaaugugcacaccuggaccgagcaauauaaguuccagcccgaguccccugcgcggcucgccucugcuauucugaacgcccacaaagacggcgugugugggaucagaagcacaacccgccuggaaaaugucauguggaagcagauuacaaacgagcucaauuacgugcugugggaaggaggccaugaccuuacgguuguggcuggcgaugucaaaggggugcugacccggggaaagagagcccucacacccccuguuaacgaccugaaguauuccuggaaaaccuggggcaaggcgaaaaucuuuacacccgaggccagaaauucuaccuuccugaucgaugggccggacacgagcgaaugcccuaacgagcgcagagcuuggaauuucuuugagguggaagauuacggauucggcauguuuaccacaaacauuuggaugaaguuccgggagggguccagcgaagucugugaccacagacuuaugucugccgcuaucaaagaucagaaggccgugcaugccgacaugggauacuggauugaguccagcaaaaaucaaaccuggcagaucgaaaaggcuucucucauugagguuaagacaugccuguggcccaaaacccacacacugugguccaacggcgugcucgagagccagaugcugaucccucgcucuuaugcgggccccuuuagccagcacaacuaccggcaaggguaugccacccagacggucggaccuuggcaucuuggcaagcuggaaaucgauuucggggagugccccggaacaaccguggcuauuagagaagacugugaucaccgcggcccgucccucagaaccacaaccgccagcgggaaacuggugacgcaguggugcugucggucuugcacaaugccuccccugcgcuuucuuggagaggacggcuguugguacggcauggagaucagaccccucuccgaaaaggaggaaaauauggucaaaagccaggccaccgcugggcaaggaacauccgagaccuucucuaugggccugcugugccucacacuguuuguugaagagugucuucggcgcagagugacccggaagcauaugauucugguggucgugaucacguucugcgccauuauccucgggggacugaccuggauggaucugcuucgcgcgcucaucaugcugggcgacacaaugagcgggagaauuggaggccagauccaccuggcuauuauggccguuuuuaagauguccccuggcuaugugcucggggucuuccugcggaaacuuaccucucgcgagacagcccugauggugaucggaauggcuaugaccacgguuuuuagcauuccgcaugaccucauggaacugaucgauggcaucucccuggggcuuauucugcucaagaucgugacacacuucgacaacacccaggucggaacacuggcccucucucugaccuuccuuagaagcaccacaccccuggugauggcguggcggacgauuauggcugucuuuuucgugguuacccucaucccucuguguagaacauccugccugcagaaacaaagccacuggguggagauuaccgcccuuauccugggcgcccaggcucuccccgucuaccugaugacacucaugaagggggccucucgccgguccuggccucugaaugaaggaauuauggcugugggccuuguuagccugcucggcucugcccugcugaaaaacgaugugccccuugcggggccuauggucgccggaggccugcuccuggcugccuaugugauguccgggagcucugcugaccucucccuggagaaggccgccaaugugcagugggaugaaauggcugacaucaccggaagcucccccaucauugagguuaagcaagaugaggacggcagcuuuucuaucagagaugucgaagagacgaacaugaugacacuucuggugaaacuggcgcucauuaccgugagcgggcuguacccgcuugccaucccugucaccauggcucugugguacauuuggcaagugaagacacagcgcuccggagcccucugggacguucccucuccugccgcuacccagaaagccacacugagcgaaggcguguaucggaucaugcaaagaggccucuucgggaagacgcaggucggagugggcauccauauggaggggguuuuucacaccauguggcaugugacacgcggauccgucauuugucacgaaaccggccggcuggagcccucuugggcggaugugagaaaugacaugaucagcuacgggggaggcuggcgccuuggcgauaaaugggacaaggaggaagacguucaggugcuggcuauugagccggggaagaacccuaaacauguccagacaaagcccggacuguucaaaacccucacgggcgaaaucggggccgugacccuggauuuuaagccuggaacauccggcucucccauuaucaauaaaaaggggaaagugaucggccuuuauggaaacggcgucguuaccaagagcggggacuacguguccgccauuacacaagcugagcggaucggagagcccgauuaugaaguggacgaggauauuuucagaaagaaacggcugaccaucauggaccuccacccuggcgccgggaagacaaaacgcauucugccgagcaucgucagagaagcgcucaagcggcgccugagaacgcuuauucuggcucccacccgggugguugccgccgagauggaagaggcucugagaggacucccuauccgcuaccagacacccgccgugaaaucugagcacaccggccgggaaaucgucgaucugaugugccaugcuaccuuuacaacgagacuucuguccagcacccgcgugccuaauuauaaccucauuguuauggacgaggcccacuucacagaucccugcucuguggcggcccggggguacaucuccaccagagucgaaaugggcgaggcugccgcuauuuuuaugacagccaccccuccgggagccacggaccccuucccucagagcaauucccccaucgaagauauugagcgcgagaucccugaacggucuuggaacacaggcuucgacuggaucaccgacuaccaggggaagaccgugugguuuguccccagcauuaaggcuggaaaugauaucgcgaacugucugagaaaauccggcaagcgcgugauucaacucagcagaaaaacauucgacaccgaguauccgaagacaaaacugaccgauugggacuuuguugugacgacagauaucucugaaaugggggccaacuuccgggcuggacgcgugauugacccuagacggugccuuaagcccgucauccugaccgauggccccgagcgcguuauccuggccgggccuauucccgugaccccugccuccgcugcccagagacggggcagaaucggacgcaauccggcgcaggaagacgaucaauacguguuuagcggcgacccccucaagaacgaugaggaccaugcucacuggaccgaggccaaaaugcugcuugauaauauuuauacgccugaagggaucauucccacccuguucggaccugagcgggaaaagacacaggccaucgacggcgaguuuagacuccgcggggagcagcggaaaaccuucgucgaacugaugaagagaggagaccugcccguguggcucucuuacaaaguugcuagcgccggcauuuccuauaaggaucgggagugguguuuuacaggcgaacgcaacaaucagauccuugaggaaaacauggagguggagaucuggaccaaggaaggggagaaaaagaaacugagaccgaaguggcuggacgcgcgggucuacgccgauccuauggcucucaaagacuucaaggaauuugccucuggacgcaagagcauuacacuggauauccuuaccgagauugcuucccugcccacguaucucucuagcaaagccaagcuggcucuggacaauaucauuaugcuccacacaaccgaaaaaggcgggagagccuaccaacaugcgcuuaacgagcugccugagucccuggaaacccucaugcugguggcccuucugggagcuaugacagccggcaucuuccucuuuuucaugcaggggaagggaaucggcaaacugagcaugggccugauugcuaucgccgucgccucugggcuccuuuggguggcugagauucagccccaguggaucgcggccuccauuauccuggaguucuuucugaugguucuccugaucccugagcccgaaaagcaacggaccccgcaggauaaucagcuuauuuacgugauccugacaauucucacgaucauuggacugaucgcugccaacgagaugggccugauugagaaaaccaagacagacuucggguuuuaucaggucaagaccgaaacaaccauccucgauguggaccuucgcccugccagcgcuuggacgcuguacgccguugcgaccacaauccugacccccaugcucagacacacaauugagaauaccuccgccaaccugucucuugcugccaucgcuaaucaagccgcggugcugaugggacucggcaaaggguggccccugcaucggauggaucugggagucccucuccuugccauuggcugcuauagccaggugaacccgacgacacugaccgcuucccuggugaugcuccugguucacuacgccaucauuggccccgggcuucaggcuaaggccacacgcgaagcucagaaaagaaccgccgcgggaaucaugaagaauccuaccgucgacggcaucacagugauugaucuggagcccaucucuuaugacccuaaauucgagaagcaacucggacaggugaugcugcugguccucugugccggacagcuucugcugaugcggacgaccugggcucucugcgaaguucugacacuugccaccggccccgcuaugacacugugggaggggaacccuggaagauuuuggaacaccacgauugccgugagcacagccaauaucuuccgcggcuccuaccucgcgggcgcugggcuggccuuuagccugauuaagaacgcucaaaccccgcggagaggaaccggcacaaccggggaaacacucggagagaaauggaagcgccagcuuaauucucuggaccggaaagaguucgaagaguauaagagauccggcauccuggaaguggaucgcacggaggccaaaagcgcccucaaggacgggucuaagaucaaacaugcugucucccggggaagcucuaagauuagauggaucguggaacgcggcaugguuaaacccaagggcaaaguggucgaucugggguguggacggggcggguggagcuacuacauggccacccuuaagaacgugacagagguuaagggauauaccaaaggcgggccuggacacgaagaacccauuccuauggcgacauacggcuggaaucuggugaagcuccacuccggcgucgacguguuuuauaaacccaccgaacagguggauacgcugcugugcgacaucggggaaucuagcuccaacccgaccauugaggaaggaagaacacuccgcguccuuaagaugguugagccuuggcugagcuccaaacccgaguucuguaucaaggugcugaaucccuacaugccuaccgugauugaggagcucgaaaaacugcagcggagacauggcgggucucuuguccgcugcccccugagcagaaacuccacacacgagauguauugggugucuggagccagcggcaauaucguuuccucugugaacaccaucagcaagaugcuccugaaucgguuuacaacccgccauagaaagccuacguacgaaaaagaugucgaccugggggcuggaacacgguccgugagcaccgagaccgagaagccggauaugacaauuaucggcagacggcuccaacgccuuagagaagaacacaaagaaacguggcacuaugaccaggagaaccccuaccggaccugggccuaccauggcucuuaugaagcuccuuccacagggagcgccucuuccaugguuaauggaguggucaagcugcugaccaaacccugggaugugguuccuauggugacacagcucgcgaugaccgacacaacccccuucggccagcaacgcgucuuuaaggagaagguggacacgagaaccccgcagccuaaacccgggacacggaugauuaugaccacaaccgccaacuggcuguggacgcuucugggaaagaaaaagagcccucgccucuguacaagagaggaguucaucucuaaaguccgguccaaugcugccauuggcgcuguguuccaggaggaacagggguggaccagcgccuccgaggcuguuaacgauagccgcuuuugggaacugguggacaaggagagagcccugcaccaagagggcaagugcgaaucuugcgucuacaauaugaugggaaaacgggagaagaaacucggcgaguucgggcgcgcgaagggaagcagagccaugugguauauguggcugggcgcucgguuucuugaguucgaagcccugggguuucucaacgaggaucauugguucucccgcgagaacucuuggagcggaguggaaggcgaggggcugcacagacuuggcuacauccuggaagacaucgauaaaaaggacggagaucucauuuaugcugacgauacagccggcugggacacccggaucacggaggaugaccugcugaaugaggaacucauuaccgagcagauggcgccccaucacaagacacuggcgaaagcuaucuuuaaacuuaccuaccagaacaaagugguuaaggugcugagaccuacacccaaaggggccgucauggauauuaucucccgcaaggaccaacggggaucuggccagguggggaccuauggacucaauacauucaccaacauggaaguucagcugaucagacagauggaggccgaaggcgugauuacgcaagacgauaugcagaauccgaaagggcuuaaggagcgcgucgagaaguggcugacagaauguggcguggaccggcucaaaagaauggcuaucagcggagaugacugcgucgugaagccucuggaugagcgcuuuuccaccucucuccuguuccugaacgacaugggcaaaguucggaaggauauuccccagugggaacccagcaaaggguggaagaauuggcaggaggugccuuuuuguucccaccauuuccacaagaucuuuaugaaagacggaagaagccuugucgugccgugccgcaaccaagaugaacugauuggccgggccagaaucucucagggggcuggauggucccuccgcgagaccgccugucugggcaaggcguacgcccagauguggagccuuauguacuuccaucggagagaccugcggcucgcuucuauggccaucugcuccgcuguucccacagagugguucccuaccagcagaacaacgugguccauucacgcccaccaucaguggaugaccacagaagauaugcugaaaguguggaaucgcgucuggaucgaggacaaccccaauaugaccgacaagacaccuguguauucuugggaagauauucccuaccuggggaaacgggaggaccucugguguggcagccugaucggacuuuccagcagagcgaccugggccaagaacauucacacggcuaucacccaagugcgcaaucugauuggcaaggaagauuauguugacuacaugccuaucaugaaaagauauucugcccccuccgagagcgaggggguccucuga

SEQ ID NO: 21070 - RNA, 9867 nt, Artificial Sequence
  derived and/or modified CDS sequence (opt5) from DENV-4__HQ332175__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccauguccgggcgcauuggaggccagacgcaucuugcuaucauggccguguucaagaugucuccuggcuacguucuggggguguuucucagaaaacugacaagccgggagaccgcccugauggucauuggaauggcuaugacaaccacccuuuccaucccgcacgaccugauggagcucauugacggcaucucucuggggcucauccugcuuaagauugugacacaguucgauaacacgcaaguuggaacccuggcccucagccugacauuuauccgcuccaccaugagccuggugauggcguggagaacaauuauggcuguccuuuucguggucacccugaucccccucugucggacgucuugccugcagaaacagucccauuggguggaaauuacagcccucauccugggcgcccaagcucuuccuguuuaucugaugacccucaugaagggggccagcagacgcucuuggccccugaaugagggaauuauggcugugggccuggucucccuucugggcagcgcccuccugaaaaacgacgugccucucgcggggcccaugguugccggaggccugcuucuggcugccuacgugaugucuggguccagcgucgaucugucccucgaaaaggcugccaaugugcagugggacgagauggccgauaucaccggaagcucuccuaucauugaagugaagcaggacgaggauggcagcuuuuccauccgggacguugaggaaacaaacaugauuacccugcuugucaaacuggcucucaucacagugucugggcuguacccccucgcgauuccgaucacgaugacccugugguauauguggcaggugaagacacaaagaagcggagcccuuugggaugucccuucccccgcugccacccagaaagccgcucugucugagggcguguaccgcaucaugcagcggggccuguucgggaagacacagguuggagugggcauucacauggaaggggucuuccacaccauguggcaugugacgagaggaagcguuaucugucacgagaccggccgccucgaaccuuccugggccgacgugcggaaugauaugauuucuuaugggggaggcuggagacugggcgacaaaugggauaaggaggaggacguccaagugcuugcgaucgaacccgggaagaacccgaaacauguucagacaaagccuggacuguuuaaaacccucacaggcgagauuggggcugugacccuggacuucaagcccggaacaagcggcuccccuaucaucaaucgcaaagggaaggucauuggccucuacggaaacggcguggugacgaaaagcggggauuaugucucugccaucacccaggccgaacggauuggagagcccgacuacgagguugaugaagacaucuuuagaaagaagcggcugacaauuauggaucuucaccccggcgcugggaaaaccaagcgcauccugccuuccauugugagagaggcccugaaacggcgccucagaacccugauccuugcgccgacacggguggucgcugccgaaauggaggaagcccugagaggacuccccauccgcuaucagacgccugcugugaagagcgagcauaccggccgggagauuguugaccugaugugccacgccacauucaccacaagacuccugucuuccacccgcgugcccaauuacaaccuuaucgucauggaugaagcucacuuuacggacccuagcuccguggccgcgcggggguacauuucuacaagaguugagaugggcgaagccgcugccaucuucaugaccgcuacccccccuggagccacagauccguuuccccaaagcaauuccccuauugaggacaucgaacgcgagauccccgagcggagcuggaacaccggcuucgauuggauuacagacuaucaggggaaaaccgugugguuugucccuucuaucaaggccggaaaugacauugcuaacugccugagaaaguccggcaaaaaggugauccagcugagccgcaaaacguucgauacagaauaccccaagaccaaacucacagacugggauuuugucgugaccacggacauuucugagaugggggcgaacuucagagccggacggguuaucgauccgcgcagaugucugaagccugugauccuuaccgacggccccgaacgggugauucuggcugggcccaucccugucacacccgccagcgccgcucaacgcagaggccggauuggaagaaauccugcccaggaggaugaccaguauguuuucuccggcgauccgcucaagaacgacgaagaucaugcgcacuggaccgaggcuaaaaugcugcuggacaauaucuacacacccgaggggauuaucccuacccucuuuggacccgaacgcgagaagacacaggccauugauggcgaauuccggcuuagaggggagcaacgcaaaaccuuuguggagcugaugcggagaggagaccugccuguguggcucucuuauaaggucgccagcgcuggcaucuccuacaaagaccgggaauggugcuucacgggcgagcgcaacaaucagauccuggaagagaacauggaaguggagauuuggacaagagagggggaaaagaagaaacuucggcccaaguggcuggaugcccgcguuuaugcggacccgauggcccucaaagauuuuaaggaguucgcuucuggaagaaaaagcaucacccuggacauucugaccgaaaucgccucccucccuacauaccuuagcucucgggcuaagcuggcccuggauaauauugugaugcuccauaccacagagcgcggcgggagagcuuaccagcacgcccugaacgaacuucccgagucccuggagacgcucaugcuggucgcgcugcucggagccaugaccgcuggcaucuuucuuuucuuuaugcaggggaagggaaucggcaaacugagcaugggccugauuacaaucgccguggcuuccgggcuccugugggucgccgaaauucaaccucaguggaucgccgcuucuauuauccuugaguucuuucugauggugcuccugauccccgaaccugagaagcagcggaccccccaggacaaucaacugauuuauguuauccucacaauucuuaccaucauuggacugaucgcggccaacgaaaugggccugauugagaaaacgaagaccgauuucggguuuuaccaggugaaaacagagaccacaauccucgacgucgaucugcgcccggcuagcgccuggacccuuuaugccguggcuacgacaauccugaccccuaugcucagacacacaauugaaaauaccuccgccaaccugucucuggcggccaucgcuaaucaggccgcuguucucaugggacuuggcaagggguggccccugcaucggauggaccugggagugccccuccuggccaugggcuguuacagccaggucaacccuaccacacuuacggcgucccuggugaugcuccuggugcacuaugccauuaucggcccggggcugcaagcuaaagccaccagagaggcucagaagcgcacagccgcuggaauuaugaagaaucccaccguugauggcaucacagucaucgaccucgaaccuauuagcuacgaucccaaauucgagaagcagcuugggcaagugaugcugcuggugcucugcgccggacagcugcuucugaugcggaccacgugggcguucugugagguccucacacuggccaccggcccuauccugacccucugggaagggaaccccggaagauuuuggaacacaaccauugcuguuucuacagccaauaucuuccgcggcuccuaucuugcuggcgccgggcuggccuuuagccugauuaaaaacgcgcagacgccucggagaggaaccggcacaaccggggagacacucggagaaaaguggaaacgccagcugaauucucuugaccggaaggaguucgaagaguacaagagauccggcauccuggagguggaccgcaccgaagcuaaaagcgcccucaaggaugggucuaaaaucaagcaugcugugagccggggauccucuaaaauuagauggaucgucgagcgcggcauggugaagccgaagggcaaaguuguggaccuggggugcggacggggcggguggagcuacuauauggccacgcugaagaacgucaccgaagugaaaggauacacaaagggcgggcccggacacgaggaaccuauucccauggccaccuauggcuggaaucucguuaaacuucauuccggcguggaugucuuuuacaagccuacagagcaaguggacacccugcugugugauaucggggagagcuccucuaaccccacaauugaagagggaagaacccuccgcgugcugaagauggucgaaccguggcuuagcuccaaaccugaguucugcaucaagguucugaaucccuauaugcccacggugauugaagagcucgagaaacugcagagaaagcacggcgggaaccuggugcgguguccucucucucgcaauagcacacacgaaauguacugggucuccggagcuucuggcaacaucgugagcuccguuaauaccaccagcaaaaugcuucugaacagauuuacaacgcggcauagaaagcccaccuaugagaaagacguggaucugggggccggaacacggucugucuccaccgaaacagagaagccugacaugaccaucauuggccgcagacuccagcggcugcaggaggaacacaaggagacauggcauuacgaucaagaaaauccguaccgcaccugggcguaucacggcagcuacgaggcccccucuacgggguccgcuagcucuauggugaacggaguugugaaacuucugaccaagccuugggacgucauccccauggugacacagcucgccaugaccgauacaaccccuuucggccagcagagaguuuuuaaagaaaagguggacacgcggacaccccaaccgaaaccugggacccgcauggucaugacaaccacggcuaauuggcugugggcccugcucggaaagaagaaaaaccccagacugugcacccgggaggaguucauuuccaaggugcgcagcaaugcggccaucggcgcugucuuucaggaagagcagggguggacauccgccagcgaagcugugaacgacucuagauucugggagcuuguugauaaagaacgggcccugcaccaagagggcaagugugagagcugcguguauaacaugaugggaaaacgcgaaaagaagcucggcgaguuugggagagcuaaaggaucccgggccauuugguacauguggcugggcgcgcgcuuccuugaauucgaggcccugggguuucucaaugaagaccauugguucggaagagagaacucuuggagcggcgucgagggggaaggccugcaccggcugggauauauccucgaggaaaucgauaagaaagacggcgaucugauguacgcugacgauaccgccgggugggacacaagaauuaccgaggaugaccuucagaaugaggaacugaucacagagcagauggcuccucaucacaagauucucgccaaagccaucuuuaagcugaccuaucagaacaagguggugaaaguucuucgccccacgccucggggagcggugauggauauuaucuccagaaaggaccaacgcggcucugggcaggucggaacauacggccugaauaccuucaccaacauggaagugcagcucauccggcagauggaggcugaagggguuauuacacaagaugacaugcagaaucccaaaggccugaaggagagaguggagaaauggcugcgcgaaugcggagucgaccggcucaagagaauggccaucagcggcgaugacuguguggucaaaccgcuggaugagcgcuuugggaccucccuucuguuccucaacgacaugggaaaggugcggaaggauauuccucagugggaacccucuaaaggcuggaagaauuggcaggagguucccuuuugcagccaucacuuccacaaaaucuuuaugaaggacgggagaucccugguggucccuugucgcaaccaagaugaacuuauuggacgggccagaaucagccagggcgcuggguggucucugcgggagacagccugccucggcaaagcuuacgcccagauguggucccugauguauuuccauagacgcgaccugcggcucgcgagcauggccaucuguucugcugugccgacggagugguuucccaccuccagaacaaccuggagcauucacgcccaucaccaguggaugacaaccgaagauaugcugaagguuuggaaucgcguguggaucgaggacaacccuaauaugauugauaagacgcccguccacuccugggaagacaucccuuaccuuggaaaaagagaggaccuguggugcggcucucucauugggcugagcucccgggcuaccugggccaagaacauccauacagcgauugcccaagugcgcaaucuuaucggaaaagaagaguauguggauuacaugcccguuaugaagagauauagcgcuccuucugaguccgaaggcguccuguga

SEQ ID NO: 21071 - RNA, 9867 nt, Artificial Sequence
  derived and/or modified CDS sequence (opt5) from DENV-4__HQ332172__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucugcgugggugauguaugggaccugcacacagagcggagagagacggcgcgaaaagagauccgucgcucucaccccccacucuggcauggggcuggagacacgggccgaaaccuggaugagcuccgagggagccuggaaacaugcucaacgcguggagucuuggauccuuagaaauccuggcuucgcccugcucgcuggcuuuauggccuacaugaucgggcagacgggaauucagcggacaguuuucuuugugcugaugaugcuugucgcgcccagcuauggcaugcgcuguguggggguuggaaacagagauuucguggaaggcgucuccgggggagccuggguggaccuggugcucgagcacggcggcugcgucaccacaauggcucaggggaagccuacccuggauuuugaacugaccaagacaacggccaaagagguugcucuccugcggaccuacuguaucgaagcccuuauuagcaauaucacaaccgcgacacgcugcccgacccaaggagagcccuaucugaaggaggaacaggaccagcaguacauuuguagacgggaugugguggaccgcggcugggggaacggaugcggccucuucgggaaaggaggcgucgugacgugcgccaaguuuucuuguuccggcaaaaucacagggaaucugguucaaauugagaaccuugaauauaccguggucgugaccguucauaauggagauacacacgcugugggcaacgacaccagcaaucacggggucacagccacgaucaccccuagaucucccuccguggaggucaagcugccugauuacggagaacucacacuggacugcgagccccggagcggcaucgacuucaacgagaugauucugaugaagaugaaaaagaaaaccuggcucgugcauaagcagugguuucuggaucuuccgcugccuuggacaaccggggcugacacgucugaaguucacuggaauuacaaagagagaauggugaccuucaaggucccccaugccaaacgccaggaugugacaguucucggcucccaggaaggagccaugcacagcgcucuggcgggcgccaccgagguggacuccggggauggaaaccacauguuugcuggccaucuuaaguguaagguccggauggaaaaacugagaaucaaggggaugucuuauacaaugugcagcggaaaauucuccauugacaaggagauggccgagacccaacacggcacgacaguggugaaaguuaaguacgaaggggccggcgcuccuuguaagguccccaucgagauucgcgaugugaauaaagaaaagguggucggacgggugaucagcgccaccccccucgcggagaacacaaacucuguuaccaauaucgagcuggaaccuccguucggcgacuccuauauugugaucggggucggaaacagcgcucugacccuccauugguuuagaaaaggcucuagcauugggaagauguucgaguccacauaccgcggagccaaacggauggccauccugggcgaaacggcuugggauuuugggucugugggcggacuuuucaccagccugggcaaggccguucaccagguguuuggguccgucuauacaaccauguucggaggcgugagcuggaugauuagaauccucaucggguuucugguucuguggauuggaacaaauucucgcaacaccuccauggcuaugacgugcaucgccgugggcgggauuacacuuuuccucggcuuuaccguccaggcggacaugggauguguggugagcuggucuggccgggagcugaagugcggguccggaaucuucgucguugauaaugugcauaccuggacagaacaauacaaauuucagcccgagagcccugccagacuggcuuccgccauucucaacgcucacaaggacggcgugugugggauccgcucuaccacacggcuggagaaugucauguggaaacagauuacgaacgaacuuaauuaugugcugugggagggaggccacgaccucaccguuguggccggcgaugucaagggggugcugacaaaaggaaagagagcgcugacccccccugccagcgaccuuaaguacuccuggaaaacauggggcaaggcuaaaaucuucacccccgaagcccggaacucuacguuucucaucgaugggccggacaccagcgagugcccuaaugaacgcagagcuuggaacuccuucgagguugaggauuacggauucggcauguuuacaaccaauauuuggaugaaguuccgggaagggagcucugaggugugugaccauagacugauguccgccgccaucaaagaucagaaggcuguccacgcggacaugggauauuggauugaaagcucuaaaaaccaaacauggcagaucgagcgcgccucccugauugaagugaagaccugccucuggcccaagacacauacccuguggagcaauggcguucuugagucucagaugcugaucccuaaaagcuacgcuggccccuuuucccagcacaacuaucggcaaggguacgccacgcagacagugggaccuuggcaccucggcaagcuggagaucgauuucggggaaugccccggaaccaccgucacaauucaggagaacugugaccauagaggcccgagccugcgcaccacgacagccucugggaaacuugugacccaguggugcuguagauccugcacaaugccuccccuccgguuucugggagaagauggcuguugguauggcauggagauccgcccccugagcgagaaggaagagaauauggugaaaucccaagucaccgcugggcagggaacaucugaaaccuucagcaugggccuccugugccuuacgcuguuuguugaggaaugucucagacggcgcgugaccagaaagcacaugauucuggccguggucaucacacugugcgcgauuauccuugggggacucaccuggauggaccugcugcgggcucucaucaugcugggcgauacaauguccgggcgcauuggaggccagacccaucuugccaucauggccguguucaagaugucuccuggcuacguucuggggguguuucucagaaaacugacgagccgggagacagcucugauggucauuggaauggccaugaccacaacccuuuccaucccgcacgaccugauggagcucauugacggcaucucucuggggcucauccugcuuaagauugugacccaguucgauaacacacaaguuggaacgcuggcgcucagccugaccuuuauccgcuccacaaugagccuggugauggcuuggagaaccauuauggccguccuuuucguggucacacugaucccccucugucggaccucuugccugcagaaacagucccauuggguggaaauuacggcccucauccugggcgcucaagcccuuccuguuuaucugaugacacucaugaagggggcuagcagacgcucuuggccccugaaugagggaauuauggccgugggccuggucucccuucugggcagcgcgcuccugaaaaacgacgugccucucgccgggcccaugguugcuggaggccugcuucuggccgcuuacgugaugucuggguccagcgccgaucugucccucgaaaaggccgcuaauguccagugggacgagauggcggauaucaccggaagcucuccuaucauugaagugaagcaggacgaggauggcagcuuuuccauccgggacguggaggaaaccaacaugauuacacugcuuguuaaacuggcccucaucaccgucucugggcuguacccccucgcuauuccgaucacaaugacgcugugguauauguggcaggugaagacccaaagaagcggagcccuuugggaugugccuucccccacagccacccagaaagcugcccugucugagggcgucuaccgcaucaugcagcggggccuguucgggaagacacaggugggaguuggcauucacauggaagggguguuccacaccauguggcaugucacgagaggaagcgugaucugucacgagaccggccgccucgaaccuuccugggcggacguucggaaugauaugauuucuuaugggggaggcuggagacugggcgacaaaugggauaaggaggaggacgugcaaguccuugcuaucgaacccgggaagaacccgaaacaugugcagacaaagccuggacuguuuaaaacccucacaggcgagauuggggccguuacccuggacuucaagcccggaacaagcggcuccccuaucaucaaucgcaaagggaaggugauuggccucuacggaaacggcgucgugacgaaaagcggggauuaugugucugccaucacccaggcugaacggauuggagagcccgacuacgaggucgaugaagacaucuuuagaaagaagcggcugacaauuauggaucuucaccccggcgccgggaaaaccaagcgcauccugccuuccauuguuagagaggcgcugaaacggcgccucagaacccugauccuugcuccgacacgggugguggccgccgaaauggaggaagcucugagaggacuccccauccgcuaucagacgccugccgucaagagcgagcauaccggccgggagauuguggaccugaugugccacgcuacauucaccacaagacuccugucuuccacccgcguucccaauuacaaccuuaucgugauggaugaagcccacuuuacggacccuagcuccgucgcggcccggggguacauuucuacaagaguggagaugggcgaagcugccgcuaucuucaugaccgccacccccccuggagccacagauccguuuccccaaagcaauuccccuauugaggacaucgaacgcgagauccccgagcggagcuggaacaccggcuucgauuggauuacagacuaucaggggaaaaccguuugguuugugccuucuaucaaggcuggaaaugacauugcgaacugccugagaaaguccggcaaaaaggucauccagcugagccgcaaaacguucgauacagaauaccccaagaccaaacucacagacugggauuuuguggucaccacggacauuucugagaugggggccaacuucagagcuggacgggugaucgauccgcgcagaugucugaagccuguuauccuuaccgacggccccgaacgggugauucuggccgggcccaucccugugacacccgccagcgcugcccaacgcagaggccggauuggaagaaauccugcgcaggaggaugaccaguaugucuucuccggcgauccgcucaagaacgacgaagaucaugcucacuggaccgaggccaaaaugcugcuggacaauaucuacacacccgaggggauuaucccuacccucuuuggacccgaacgcgagaagacacaggccauugauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauccuggaagagaacauggaagucgagauuuggacaagagagggggaaaagaagaaacuucggcccaaguggcuggaugcgcgcguguaugccgacccgauggcucucaaagauuuuaaggaguucgccucuggaagaaaaagcaucacccuggacauucugaccgaaaucgcuucccucccuacauaccuuagcucucgggccaagcuggcucuggauaauauuguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaaucggcaaacugagcaugggccugauuacaaucgcugucgccuccgggcuccuguggguggccgaaauucaaccucaguggaucgcugcgucuauuauccuugaguucuuucugaugguccuccugauccccgaaccugagaagcagcggaccccccaggacaaucaacugauuuaugugauccucacaauucuuaccaucauuggacugaucgccgcuaacgaaaugggccugauugagaaaacgaagaccgauuucggguuuuaccagguuaaaacagagaccacaauccucgacguggaucugcgcccggccagcgccuggacccuuuaugcugucgccacgacaauccugaccccuaugcucagacacacaauugaaaauaccuccgcgaaccugucucuggccgcuaucgccaaucaggcugccauucucaugggacuuggcaagggguggccccugcaucggauggaccugggagugccccuccuggcgaugggcuguuacagccagguuaacccuaccacacuuacggccucccuggugaugcuccugguccacuaugcuaucauuggcccggggcugcaagccaaagcuaccagagaggcccagaagcgcacagcugccggaaucaugaagaaucccaccguggauggcaucacagugauugaccucgaaccuaucagcuacgaucccaaauucgagaagcagcuugggcaaguuaugcugcuggcgcucugcgccggacagcugcuucugaugcggaccacgugggcuuucugugagguccucacacuggccaccggcccuauucugacccucugggaagggaaccccggaagauuuuggaacacaaccaucgcugugucuacagccaauauuuuccgcggcuccuaucuugccggcgcggggcuggcuuuuagccugaucaaaaacgcccagacgccucggagaggaaccggcacaaccggggagacacucggagaaaaguggaaacgccagcugaauucucuugaccggaaggaguucgaagaguacaagagauccggcauccuggagguggaccgcaccgaagcuaaaagcgcccucaaggaugggucuaaaauuaagcaugccgucagccggggauccucuaaaaucagauggauuguugagcgcggcauggugaagccgaagggcaaaguggucgaccuggggugcggacggggcggguggagcuacuauauggcuacgcugaagaacgugaccgaaguuaaaggauacacaaagggcgggcccggacacgaggaaccuauccccauggccaccuauggcuggaaucucgugaaacuucauuccggcgucgauguguuuuacaagccuacagagcaaguugacacccugcugugugauauuggggagagcuccucuaaccccacaaucgaagagggaagaacccuccgcgugcugaagauggucgaaccguggcuuagcuccaaaccugaguucugcauuaaggugcugaaucccuauaugcccacggugaucgaagagcucgagaaacugcagagaaagcacggcgggaaccugguccgguguccucucucucgcaauagcacacacgaaauguacuggguuuccggagcgucuggcaacaucgugagcuccgugaauaccaccagcaaaaugcuucugaacagauuuacaacgcggcauagaaagcccaccuaugagaaagacgucgaucugggggccggaacacggucuguguccaccgaaacagagaagccugacaugaccauuaucggccgcagacuccagcggcugcaggaggaacacaaggagacauggcauuacgaucaagaaaauccguaccgcaccugggcuuaucacggcagcuacgaggcccccucuacgggguccgcuagcucuaugguuaacggaguggucaaacuucugaccaagccuugggacgugauucccaugguuacacagcucgccaugaccgauacaaccccuuucggccagcagagaguguuuaaagaaaaggucgacacgcggacaccccaaccgaaaccugggacccgcauggugaugacaaccacggcgaauuggcugugggcccugcucggaaagaagaaaaaccccagacugugcacccgggaggaguucaucuccaagguucgcagcaaugcugccauuggcgcuguguuucaggaagagcagggguggacauccgccagcgaagcugucaacgacucuagauucugggagcuuguggauaaagaacgggcccugcaccaagagggcaagugugagagcugcgucuauaacaugaugggaaaacgcgaaaagaagcucggcgaguuugggagagcgaaaggaucccgggccaucugguacauguggcugggcgcucgcuuccuugaauucgaggcccugggguuucucaaugaagaccauugguucggaagagagaacucuuggagcggcguggagggggaaggccugcaccggcugggauauauccucgaggaaauugauaagaaagacggcgaucugauguacgcugacgauaccgccgggugggacacaagaaucaccgaggaugaccuucagaaugaggaacugauuacagagcagauggccccucaucacaagauccucgcgaaagcuauuuuuaagcugaccuaucagaacaagguugugaaaguccuucgccccacgccucggggagccgugauggauaucaucuccagaaaggaccaacgcggcucugggcaggugggaacauacggccugaauaccuucaccaacauggaaguucagcucauucggcagauggaggccgaaggggugaucacacaagaugacaugcagaaucccaaaggccugaaggagagagucgagaaauggcugcgcgaaugcggaguggaccggcucaagagaauggcuauuagcggcgaugacuguguugugaaaccgcuggaugagcgcuuugggaccucccuucuguuccucaacgacaugggaaagguccggaaggauaucccucagugggaacccucuaaaggcuggaagaauuggcaggaggugcccuuuugcagccaucacuuccacaaaauuuuuaugaaggacgggagaucccuggucgugccuugucgcaaccaagaugaacuuaucggacgggccagaaucagccagggcgcuggguggucucugcgggagacagccugccucggcaaagcguacgcccagauguggucccugauguauuuccauagacgcgaccugcggcucgcuagcauggccauuuguucugcuguuccgacggagugguuucccaccuccagaacaaccuggagcauccacgcccaucaccaguggaugacaaccgaagauaugcugaagguguggaaucgcgucuggauugaggacaacccuaauaugaucgauaagacgcccgugcacuccugggaagacauuccuuaccuuggaaaaagagaggaccuguggugcggcucucucaucgggcugagcucccgggcgaccugggccaagaacauucauacagcuaucacccaaguucgcaaucuuaucggaaaagaagaguauguggauuacaugcccgucaugaagagauauagcgccccuucugaguccgaaggcgugcuguga

SEQ ID NO: 21072 - RNA, 9867 nt, Artificial Sequence
  derived and/or modified CDS sequence (opt5) from DENV-4__HQ332176__SS-prME
agcaccaucacacugcucugccugauucccacggugauggccuuccaccuuuccaccagagacggcgagccucugaugaucgucgcucggcaugaacgcgggagaccgcuccuguuuaagacaaccgagggaauuaacaaauguacacuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagcggcgcagagaaaaacgguccgucgcgcucacaccccacucuggcauggggcuggagacccgcgcugaaacguggaugagcuccgagggagccuggaagcaugcccaaagaguggagucuuggauccuucggaauccuggcuucgcucugcucgccggcuuuauggcuuacaugaucgggcagacaggaauucagcgcaccguuuucuuugugcugaugaugcuugucgcccccagcuauggcaugagauguguggggguuggaaaccgggauuucguggaaggcgucuccgggggagcguggguggaccuggugcucgagcacggcggcugcgucacaaccauggcccaggggaaaccuacccuggauuuugaacugacaaagacgaccgcuaaggagguugcccuccugcgcacauacuguaucgaagcucuuauuagcaauaucaccacagccaccagaugcccgacgcaaggagagcccuaucugaaagaggaacaggaccagcaguacauuugucggcgcgaugugguggacagaggcugggggaacggaugcggccucuucgggaagggaggcgucgugacaugcgcgaaauuuucuuguuccggcaagaucaccgggaaucugguucaaauugagaaccuugaauauaccguggucgugacaguucauaauggagauacccacgccgugggcaacgacacaagcaaucacggggucacggcuaccaucacaccucggucucccuccguggaggucaaacugccugauuacggagaacucacccuggacugcgagcccagaagcggcaucgacuucaacgagaugauucugaugaagaugaagaaaaagacauggcucgugcauaaacagugguuucuggaucuuccgcugccuuggaccacgggggccgacaccucugaaguucacuggaauuacaaggagcgcauggugacauucaaagucccccaugcuaagcggcaggaugugaccguucucggcucccaggaaggagccaugcacagcgcccuggcuggcgcgacagagguggacuccggggauggaaaccacauguuugccggccaucuuaaauguaaggucagaauggaaaagcugcgcaucaaagggaugucuuauaccaugugcagcggaaaguucuccauugacaaagagauggcugagacgcaacacggcacaaccguggugaagguuaaauacgaaggggccggcgccccuuguaagguccccaucgagauucgggaugugaauaaggaaaaaguggucggaagagugaucagcgcuacaccccucgccgagaacaccaacucuguuaccaauaucgagcuggaaccuccguucggcgacuccuauauugugaucggggucggaaacagcgcgcugacacuccauugguuucgcaagggcucuagcauugggaaaauguucgaguccacguaccggggagcuaagagaauggccauccugggcgaaaccgccugggauuuugggucugugggcggacuuuucacaagccugggcaaagcuguucaccagguguuuggguccgucuauaccacaauguucggaggcgugagcuggaugauucgcauccucaucggguuucugguucuguggauuggaaccaauucucggaacacguccauggccaugacaugcaucgcugugggcgggauuacccuuuuccucggcuuuaccguccaggccgacaugggauguguggugagcuggucuggcagagagcugaagugcggguccggaaucuucgucguugauaaugugcauacauggaccgaacaauacaaguuucagcccgagagcccugcgcgccuggccuccgcuauucucaacgcccacaaagacggcgugugugggauccggucuacaacgagacuggagaaugucauguggaagcagauuaccaacgaacuuaauuaugugcugugggagggaggccacgaccucacaguuguggcuggcgaugucaaaggggugcugaccaagggaaaacgggcccugacacccccugcgagcgaccuuaaguacuccuggaagaccuggggcaaagccaagaucuucacgcccgaagcucgcaacucuaccuuucucaucgaugggccggacacaagcgagugcccuaaugaaagacgggccuggaacuccuucgagguugaggauuacggauucggcauguuuaccacaaauauuuggaugaaauucagagaagggagcucugaggugugugaccaucgccugauguccgcugccaucaaggaucagaaagccguccacgcugacaugggauauuggauugaaagcucuaagaaccaaaccuggcagaucgagcgggcgucccugauugaagugaaaacaugccucuggcccaagacccauacgcuguggagcaauggcguucuugagucucagaugcugaucccuaagagcuacgccggccccuuuucccagcacaacuauagacaaggguacgcuacacagaccgugggaccuuggcaccucggcaaacuggagaucgauuucggggaaugccccggaaccacagucaccauucaggagaacugugaccaucgcggcccgagccugagaacgacaaccgccucugggaagcuugugacacaguggugcugucgguccugcaccaugccuccccuccgcuuucugggagaagauggcuguugguauggcauggagaucagaccccugagcgagaaagaagagaauauggugaagucccaagucacagccgggcagggaaccucugaaacguucagcaugggccuccugugccuuacccuguuuguugaggaaugucuccggcgcagagugacacggaaacacaugauucuggcuguggucaucacccugugcgccauuauccuugggggacucacauggauggaccugcugcgcgcgcucaucaugcugggcgauaccauguccgggagaauuggaggccagacgcaucuugcuaucauggccguguucaagaugucuccuggcuacguucuggggguguuucuccggaagcugacaagccgcgagaccgcccugauggucauuggaauggcuaugacaaccacccuuuccaucccgcacgaccugauggagcucauugacggcaucucucuggggcucauccugcuuaaaauugugacacaguucgauaacacgcaaguuggaacccuggcccucagccugacauuuaucagauccaccaugagccuggugauggcguggcggacaauuauggcuguccuuuucguggucacccugaucccccucuguagaacgucuugccugcagaagcagucccauuggguggaaauuacagcccucauccugggcgcccaagcucuuccuguuuaucugaugacccucaugaaaggggccagccgccggucuuggccccugaaugagggaauuauggcugugggccuggucucccuucugggcagcgcccuccugaagaacgacgugccucucgcggggcccaugguugccggaggccugcuucuggcugccuacgugaugucuggguccagcgcugaucugucccucgaaaaagccgccaauguccagugggacgagauggcugauaucaccggaagcucuccuaucauugaagugaagcaggacgaggauggcagcuuuuccaucagagacguggaggaaacaaacaugauuacccugcuuguuaagcuggcgcucaucacagucucugggcuguacccccucgccauuccgaucacgaugacccugugguauauguggcaggugaaaacacaacgcagcggagcucuuugggaugugccuucccccgccgccacccagaaggcugcccugucugagggcgucuaccggaucaugcagagaggccuguucgggaaaacacaggugggaguuggcauucacauggaagggguguuccacaccauguggcaugucacgcgcggaagcgugaucugucacgagaccggccggcucgaaccuuccugggcggacguuagaaaugauaugauuucuuaugggggaggcuggcgccugggcgacaagugggauaaagaggaggacgugcaaguccuugcuaucgaacccgggaagaacccgaagcaugugcagacaaaaccuggacuguuuaagacccucacaggcgagauuggggccguuacccuggacuucaaacccggaacaagcggcuccccuaucaucaaucggaaggggaaagugauuggccucuacggaaacggcgucgugacgaagagcggggauuaugugucugccaucacccaggcugaaagaauuggagagcccgacuacgaggucgaugaagacaucuuucggaaaaagcgccugacaauuauggaucuucaccccggcgccgggaagaccaaaagaauccugccuuccauuguucgggaggcgcugaagcgcagacuccggacccugauccuugcuccgacaagagugguggccgccgaaauggaggaagcucugcgcggacuccccauccgguaucagacgccugccgucaaaagcgagcauaccggcagagagauuguggaccugaugugccacgcuacauucaccacacgccuccugucuuccacccggguucccaauuacaaccuuaucgugauggaugaagcccacuuuacggacccuagcuccgucgcggccagaggguacauuucuacacgcguggagaugggcgaagcugccgcuaucuucaugaccgccacccccccuggagccacagauccguuuccccaaagcaauuccccuauugaggacaucgaacgggagauccccgagagaagcuggaacaccggcuucgauuggauuacagacuaucaggggaagaccguuugguuugugccuucuaucaaagcuggaaaugacauugcgaacugccugcgcaaguccggcaagaaagucauccagcugagcagaaagacguucgauacagaauaccccaaaaccaagcucacagacugggauuuuguggucaccacggacauuucugagaugggggccaacuuccgggcuggacgcgugaucgauccgagacggugucugaaaccuguuauccuuaccgacggccccgaacgcgugauucuggccgggcccaucccugugacacccgccagcgcugcccaaagacggggcagaauuggacgcaauccugcgcaggaggaugaccaguaugucuucuccggcgauccgcucaagaacgacgaagaucaugcucacuggaccgaggccaagaugcugcuggacaauaucuacacacccgaggggauuaucccuacccucuuuggacccgaacgggagaaaacacaggccauugauggcgaauucagacuucgcggggagcaacggaagaccuuuguugagcugaugagacggggagaccugccuguguggcucucuuauaaaguggcuagcgccggcaucuccuacaaggaccgcgaauggugcuucacgggcgagagaaacaaucagauccuggaagagaacauggaagucgagauuuggacacgggagggggaaaaaaagaagcuucgccccaaauggcuggaugcgagaguguaugccgacccgauggcucucaaggauuuuaaagaguucgccucuggacggaagagcaucacccuggacauucugaccgaaaucgcuucccucccuacauaccuuagcucucgcgccaaacuggcucuggauaauauuguuaugcuccauaccacagagagaggcgggcgggccuaccagcacgcgcugaacgaacuucccgagucccuggagacgcucaugcugguggcccugcucggagcuaugaccgccggcaucuuucuuuucuuuaugcaggggaagggaaucggcaagcugagcaugggccugauuacaaucgcugucgccuccgggcuccuguggguggccgaaauucaaccucaguggaucgcugcgucuauuauccuugaguucuuucugaugguccuccugauccccgaaccugagaaacagcgcaccccccaggacaaucaacugauuuaugugauccucacaauucuuaccaucauuggacugaucgccgcuaacgaaaugggccugauugagaagacgaaaaccgauuucggguuuuaccagguuaagacagagaccacaauccucgacguggaucugagaccggccagcgccuggacccuuuaugcugucgccacgacaauccugaccccuaugcuccggcacacaauugaaaauaccuccgcgaaccugucucuggccgcuaucgccaaucaggcugccgugcucaugggacuuggcaaaggguggccccugcauagaauggaccugggaguuccccuccuggcgaugggcuguuacagccaggugaacccuaccacacuuacggccucccuggucaugcuccuggugcacuaugcuauuaucggcccggggcugcaagccaaggcuacccgcgaggcccagaaacggacagcugccggaauuaugaagaaucccaccguggauggcaucacaguuaucgaccucgaaccuauuagcuacgaucccaaguucgagaaacagcuugggcaagucaugcugcuggugcucugcgcgggacagcugcuucugaugagaaccacgugggccuucugugaggugcucacacuggcuaccggcccuauccugacccucugggaagggaaccccggacgcuuuuggaacacaaccauugccgucucuacagcuaauaucuuccggggcuccuaucuugccggcgccgggcuggcguuuagccugauuaagaacgcucagacgccuagacgcggaaccggcacaaccggggagacacucggagaaaaauggaagcggcagcugaauucucuugacagaaaagaguucgaagaguacaagcgcuccggcauccuggagguugaccggaccgaagccaagagcgcucucaaagaugggucuaagaucaaacaugccgugagcagaggauccucuaagauucgcuggaucguggagcggggcauggucaaaccgaagggcaaggugguugaccuggggugcggaagaggcggguggagcuacuauauggccacgcugaaaaacgugaccgaagucaagggauacacaaaaggcgggcccggacacgaggaaccuauucccauggcuaccuauggcuggaaucucgugaagcuucauuccggcguugauguguuuuacaaaccuacagagcaagucgacacccugcugugugauaucggggagagcuccucuaaccccacaauugaagagggacgcacccucagagugcugaagaugguggaaccguggcuuagcuccaagccugaguucugcaucaaaguccugaaucccuauaugcccacgguuauugaagagcucgagaagcugcagcggaaacacggcgggaaccuggugcgcuguccucucucuagaaauagcacacacgaaauguacuggguguccggagccucuggcaacaucgucagcuccgugaauaccaccagcaagaugcuucugaaccgguuuacaacgagacaucggaaacccucuuaugagaaggacguugaucugggggcgggaacccgcuccgugagcacagaaaccgagaaaccugacaugacaaucauuggcagacggcuccagcgccugcaggaggaacacaaggagaccuggcauuacgaucaagaaaauccguacagaacaugggccuaucacggcucuuacgaggcucccuccaccgggagcgccucuuccauggucaacggagugguuaagcuucugacgaaaccuugggacgugauccccauggucacccagcucgcuaugacagauaccacaccuuucggccagcagcggguguuuaaggaaaaaguugacacccgcacgccccaaccgaagccugggacaagaauggugaugaccacaaccgccaauuggcugugggcgcugcucggaaaaaagaagaacccccggcugugcacgcgcgaggaguucauuagcaaagucagauccaaugccgcuaucggcgccguguuucaggaagagcagggguggaccagcgcuucugaagccgucaacgacagccgguucugggagcuuguggauaaggaacgcgcucugcaccaagagggcaaaugugaguccugcguuuauaacaugaugggaaagagagaaaaaaagcucggcgaguuugggcgggccaagggaucucgcgcgauuugguacauguggcugggcgccagauuccuugaauucgaggcucugggguuucucaaugaagaccauugguucggacgggagaacagcugguccggcguggagggggaaggccugcacagacugggauauauccucgaggaaaucgauaaaaaggacggcgaucugauguacgccgacgauacagcugggugggacacccgcauuacagaggaugaccuucagaaugaggaacugaucaccgagcagauggccccucaucacaaaauucucgccaaggcgaucuuuaaacugacauaucagaacaaggucgugaaggugcuucggcccaccccuagaggagcuguuauggauauuaucucucgcaaagaccaacggggcagcgggcaggugggaacguacggccugaauacauucaccaacauggaaguccagcucaucagacagauggaggccgaaggggugauuacccaagaugacaugcagaaucccaagggccugaaagagcgcguugagaaguggcugcgggaaugcggaguggacagacucaaacgcauggccaucuccggcgaugacugugucgugaagccgcuggaugagcgguuugggacaucucuucuguuccucaacgacaugggaaaagucagaaaggauauuccucagugggaacccagcaagggcuggaaaaauuggcaggaggugcccuuuugcucccaucacuuccacaagaucuuuaugaaagacgggcgcagccugguugugccuugucggaaccaagaugaacuuauuggaagagcucggaucucucagggcgccggguggucccugagagagaccgcuugccucggcaaggccuacgcgcagauguggagccugauguauuuccaucgccgggaccugagacucgccucuauggcuaucuguuccgccgucccgacagagugguuucccacgagccgcaccacaugguccauucacgcucaucaccaguggaugaccacagaagauaugcugaaaguguggaauagaguuuggaucgaggacaacccuaauaugauugauaagacccccgugcacucuugggaagacaucccuuaccuuggaaagcgggaggaccuguggugcggcagccucauugggcuguccagccgcgccacgugggcgaaaaacauccauaccgccauuacacaagucagaaaucuuaucggaaaggaagaguauguggauuacaugcccgugaugaaacgguauucugcuccuuccgagagcgaaggcguucuguga

SEQ ID NO: 21073 - RNA, 9867 nt, Artificial Sequence
  derived and/or modified CDS sequence (opt5) from DENV-4__HQ332174__SS-prME
agcaccaucacccugcucugccugauucccacggccauggcuuuccaccuuuccaccagagacggagagccucugaugaucguggccaagcaugaacgggggcgcccgcuccuguuuaaaacaaccgaggggauuaacaaguguacacuuaucgcgauggaucugggcgaaaugugcgaggacaccgucacauacaaauguccccuccugguuaauaccgaaccugaggauauugacugcugguguaaccugacgucuaccugggugauguaugggacaugcacccagagcggagagagacggcgcgaaaagagauccguggcucucacaccccacucuggcauggggcuggagacccgggccgaaacguggaugagcuccgagggagccuggaaacaugcucaacgcgucgagucuuggauccuuagaaauccuggcuucgcccugcucgcuggcuuuauggccuacaugaucgggcagacaggcauucagcggaccguguucuuuguucugaugaugcuuguggcgcccagcuauggcaugcgcugugucggggugggaaacagagauuucguugaaggcguguccgggggagccugggucgaccuggugcucgagcacggcggcugcgugacaaccauggcucaggggaagccuacccuggauuuugaacugacaaagacgaccgccaaagaggucgcucuccugcggacauacuguaucgaagcccuuauuagcaauaucaccacagcgacccgcugcccgacgcaaggagagcccuaucugaaggaggaacaggaccagcaguacauuuguagacgggauguuguggaccgcggcugggggaacggaugcggccucuucgggaaaggaggcguggucacaugcgccaaguuuucuuguuccggcaaaaucaccgggaaucuggugcaaauugagaaccuugaauauaccguuguggucacagugcauaauggagauacccacgcuguuggcaacgacacaagcaaucacggggugacggccaccaucacaccuagaucucccuccgucgaggugaagcugccugauuacggagaacucacccuggacugcgagccccggagcggcaucgacuucaacgagaugauucugaugaagaugaaaaagaaaacauggcucguccauaagcagugguuucuggaucuuccgcugccuuggaccacgggggcugacaccucugaagugcacuggaauuacaaagagagaaugguuacauucaaggugccccaugccaaacgccaggaugucaccgugcucggcucccaggaaggagccaugcacagcgcucuggcgggcgccacagagguugacuccggggauggaaaccacauguuugcuggccaucuuaaguguaaggugcggauggaaaaacugagaaucaaggggaugucuuauaccaugugcagcggaaaauucuccauugacaaggagauggccgagacgcaacacggcacaaccgucgugaaagugaaguacgaaggggccggcgcuccuuguaagguucccaucgagauucgcgaugucaauaaagaaaagguggugggacgggucaucagcgccacaccccucgcggagaacaccaacucugugaccaauaucgagcuggaaccuccguucggcgacuccuauauuguuaucggggugggaaacagcgcucugacacuccauugguuuagaaaaggcucuagcauugggaagauguucgaguccacguaccgcggagccaaacggauggccauccugggcgaaaccgcuugggauuuugggucugucggcggacuuuucacaagccugggcaaggccgugcaccagguuuuuggguccguguauaccacaauguucggaggcgucagcuggaugauuagaauccucaucggguuucuggugcuguggauuggaaccaauucucgcaacacguccauggcuaugacaugcaucgccguuggcgggauuacccuuuuccucggcuuuaccgugcaggcggacaugggaugugucgugagcuggucuggccgggagcugaagugcggguccggaaucuucguggucgauaauguucauacauggaccgaacaauacaaauuucagcccgagagcccugccagacuggcuuccgccauucucaacgcucacaaggacggcgugugugggauccgcucuacaacgcggcuggagaaugugauguggaaacagauuaccaacgaacuuaauuauguccugugggagggaggccacgaccucacagugguugccggcgaugugaaggggguccugaccaaaggaaagagagcgcugacacccccugccagcgaccuuaaguacuccuggaaaaccuggggcaaggcuaaaaucuucacgcccgaagcccggaacucuaccuuucucaucgaugggccggacacaagcgagugcccuaaugaacgcagagcuuggaacuccuucgagguggaggauuacggauucggcauguuuaccacaaauauuuggaugaaguuccgggaagggagcucugagguuugugaccauagacugauguccgccgccaucaaagaucagaaggcugugcacgcggacaugggauauuggauugaaagcucuaaaaaccaaaccuggcagaucgagcgcgccucccugauugaagucaagacaugccucuggcccaagacccauacgcuguggagcaauggcgugcuugagucucagaugcugaucccuaaaagcuacgcuggccccuuuucccagcacaacuaucggcaaggguacgccacacagaccaugggaccuuggcaccucggcaagcuggagaucgauuucggggaaugccccggaaccacaguuaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggucaaaucccaagugacagcugggcagggagccucugaaaccuucagcaugggccuccugugccuuacgcuguuuguggaggaaugucucagacggcgcgucaccagaaagcacaugauucuggcgguugugaucacacugugcgcuauuauccuugggggacucaccuggauggaccugcugcgggcccucaucaugcugggcgauacaauguccgggcgcauuggaggccagacccaucuugccaucauggcuguguucaagaugucuccuggcuacguccuggggguguuucucagaaaacugacgagccgggagacagcccugaugguuauuggaauggcgaugaccacaacccuuuccaucccgcacgaccugauggagcucauugacggcaucucucuggggcucauccugcuuaagauugugacccaguucgauaacacacaagucggaacgcuggcucucagccugaccuuuauccgcuccacaaugagccuggugauggccuggagaaccauuauggccguucuuuucguggucacacugaucccccucugucggaccucuugccugcagaaacagucccauuggguggaaauuacggcucucauccugggcgcccaagcccuuccugucuaucugaugacacucaugaagggggccagcagacgcucuuggccccugaaugagggaauuauggcggugggccugguuucccuucugggcagcgcccuccugaaaaacgacgugccucucgcugggcccauggucgccggaggccugcuucuggcugccuacgugaugucuggguccagcgccgaucugucccucgaaaaggcugcgaauguucagugggacgagauggccgauaucaccggaagcucuccuaucauugaagugaagcaggacgaggauggcagcuuuuccauccgggacgucgaggaaaccaacaugauuacacugcuugugaaacuggcucucaucaccgugucugggcuguacccccucgccauuccgaucacaaugacgcugugguauauguggcagguuaagacccaaagaagcggagcccuuugggaugucccuucccccgcugccacacagaaagcggcucugucugagggcguguaccgcaucaugcagcggggccuguucgggaagacccaggugggagucggcauucacauggaagggguguuccacacaauguggcauguuaccagaggaagcgugaucugucacgagacgggccgccucgaaccuuccugggccgacguccggaaugauaugauuucuuaugggggaggcuggagacugggcgacaaaugggauaaggaggaggacgugcaaguucuugccaucgaacccgggaagaacccgaaacaugugcagaccaagccuggacuguuuaaaacacucaccggcgagauuggggcugucacacuggacuucaagcccggaaccagcggcuccccuaucaucaaucgcaaagggaaggugauuggccucuacggaaacggcguugugacaaaaagcggggauuaugucucugccaucacgcaggcggaacggauuggagagcccgacuacgagguggaugaagacaucuuuagaaagaagcggcugaccauuauggaucuucaccccggcgcugggaaaacaaagcgcauccugccuuccauugugagagaggcccugaaacggcgccucagaacccugauccuugccccgacccgggucguugcugccgaaauggaggaagcucugagaggacuccccauccgcuaucagacgccugcugugaaaagcgagcauacaggccgggagauuguggaccugaugugccacgcgaccuucacaaccagacuccugucuuccacacgcguccccaauuacaaccuuaucgugauggaugaagcccacuuuaccgacccuagcuccguugcugcccggggguacauuucuacgagaguggagaugggcgaagcugccgccaucuucaugacagcuacacccccuggagcgaccgauccguuuccccaaagcaauuccccuauugaggacaucgaacgcgagauccccgagcggagcuggaacacaggcuucgauuggauuaccgacuaucaggggaaaacagucugguuugugccuucuaucaaggccggaaaugacauugcuaacugccugagaaaguccggcaaaaagguuauccagcugagccgcaaaaccuucgauacggaauaccccaagacaaaacucaccgacugggauuuuguggucacaaccgacauuucugagaugggggccaacuucagagccggacgggugaucgauccgcgcagaugucugaagccugucauccuuacggacggccccgaacgggugauucuggcugggcccaucccuguuacccccgccagcgcggcucaacgcagaggccggauuggaagaaauccugcccaggaggaugaccaguauguguucuccggcgauccgcucaagaacgacgaagaucaugcccacuggacagaggcuaaaaugcugcuggacaauaucuacacccccgaggggauuaucccuacacucuuuggacccgaacgcgagaagacccaggccauugauggcgaguuccggcuuagaggggagcaacgcaaaacauuuguggagcugaugcggagaggagaccugccugucuggcucucuuauaagguugcgagcgccggcaucuccuacaaagaccgggaauggugcuucaccggcgagcgcaacaaucagauccuggaagagaacauggaaguggagauuuggacgagagagggggaaaagaagaaacuucggcccaaguggcuggaugcucgcguguaugccgacccgauggcucucaaagauuuuaaggaguucgccucuggaagaaaaagcaucacacuggacauucugaccgaaaucgcuucccucccuaccuaccuuagcucucgggccaagcuggcgcuggauaauauugucaugcuccauacaaccgagcgcggcgggagagccuaccagcacgcucugaacgaacuucccgagucccuggagacacucaugcugguggcccugcucggagcuaugacggccggcaucuuucuuuucuuuaugcaggggaagggaaucggcaaacugagcaugggccugauuaccaucgccguugcuuccgggcuccuguggguggcggaaauucaaccucaguggaucgccgcuucuauuauccuugaguucuuucugaugguccuccugauccccgaaccugagaagcagcggacaccccaggacaaucaacugauuuaugugauccucaccauucuuacaaucauuggacugaucgccgccaacgaaaugggccugauugagaaaaccaagacggauuucggguuuuaccaggcuaaaaccgagacaaccauccucgacgucgaucugcgcccggccagcgcguggacacuuuaugccguggcuaccacgauccugacaccuaugcucagacacaccauugaaaauacauccgccaaccugucucuggcugccaucgcgaaucaggccgcuguucucaugggacuuggcaagggguggccccugcaucggauggaccugggagugccccuccuggccaugggcuguuacagccaggucaacccuaccacccuuacagcuucccuggugaugcuccugguucacuaugccauuaucggcccggggcugcaagcuaaagccacgagagaggcgcagaagcgcaccgccgcuggaauuaugaagaaucccacaguggauggcaucaccgucaucgaccucgaaccuauuagcuacgaucccaaauucgagaagcagcuugggcaagugaugcugcuggugcucugcgccggacagcugcuucugaugcggacaaccugggcuuucugugagguucucacgcuggccacaggcccuauccugacccucugggaagggaaccccggaagauuuuggaacaccacaauugccgucucuaccgcgaauaucuuccgcggcuccuaucuugcuggcgccgggcuggcuuuuagccugauuaaaaacgcccagacaccucggagaggaacgggcaccacaggggagacccucggagaaaaguggaaacgccagcucaauucucuugaccggaaggaguucgaagaguacaagagauccggcauccuggagguggaccgcacagaagccaaaagcgcucucaaggaugggucuaaaaucaagcaugccgugagccggggauccucuaaaauuagauggaucgucgagcgcggcaugguuaagccgaagggcaaagugguggaccuggggugcggacggggcggguggagcuacuauauggcgacccugaagaacgucacggaagugaaaggauacaccaagggcgggcccggacacgaggaaccuauucccauggccacauauggcuggaaucucguuaaacuucauuccggcguggaugucuuuuacaagccuaccgagcaaguggacacacugcugugugauaucggggagagcuccucuaaccccaccauugaagagggaagaacacuccgcguucugaagaugguggaaccguggcuuagcuccaaaccugaguucugcaucaagguccugaaucccuauaugcccaccgugauugaagaacuggagaaacugcagagaaagcacggcgggaaccuggugcgguguccucucucucgcaauagcacgcacgaaauguacugggucuccggagcuucuggcaacaucguuagcuccgugaauacaaccagcaaaaugcuucugaacagauuuaccacacggcauagaaagcccacguaugagaaagacguggaucugggggccggaacccggucugucuccacagaaaccgagaagccugacaugacaaucauuggccgcagacuccagcggcugcaggaggaacacaaggagaccuggcauuacgaucaagaaaauccguaccgcacaugggcuuaucacggcagcuacgaggcccccucuaccggguccgcgagcucuauggugaacggaguugugaaacuucugacgaagccuugggacgucauccccauggugacccagcucgccaugacagauaccacaccuuucggccagcagagaguuuuuaaagaaaagguggacacccggacgccccaaccgaaaccugggacacgcaccgucaugacaaccacggcuaauuggcugugggcccugcucggaaagaagaaaaaccccagacugugcacccgggaggaguucauuuccaaggugcgcagcaaugcugccaucggcgcuguuuuucaggaagaacagggguggacauccgccagcgaagcggugaacgacucuagauucugggagcuugucgauaaagaacgggcccugcaccaagagggcaagugugagagcugcguguauaacaugaugggaaaacgcgaaaagaagcucggcgaguuugggagagcuaaaggaucccgggccauuugguacauguggcugggcgcucgcuuccuugaguucgaggcccugggguuucucaaugaagaccauugguucggaagagagaacucuuggagcggcgucgagggggaaggccugcaccggcugggauauauccucgaggaaaucgauaagaaagacggcgaucugauguacgccgacgauaccgcggggugggacacaagaauuaccgaggaugaccuucagaaugaggaacugaucacagagcagauggcuccucaucacaagauucucgccaaagccaucuuuaagcugaccuaucagaacaaggugguuaaagugcuucgccccacgccucggggagcugucauggauauuaucuccagaaaggaccaacgcggcucuggacaggugggaacauacggccugaauaccuucaccaacauggaagugcagcucauccggcagauggaggccgaagggguuauuacacaagaugacaugcagaaucccaaaggccugaaggagagaguggagaaauggcugcgcgaaugcggagucgaccggcucaagagaauggcuaucagcggcgaugacugugugguuaaaccgcuggaugagcgcuuugggaccucccuucuguuccucaacgacaugggaaaggugcggaaggauauuccucagugggaacccucuaaaggcuggaagaauuggcaggagguccccuuuugcagccaucacuuccacaaaaucuuuaugaaggacgggagaucccugguggucccuugucgcaaccaagaugaacuuauuggacgggccagaaucagccagggcgcgggguggucucugcgggagacagccugccucggcaaggcuuacgcccagauguggucccugauguauuuccauagacgcgaccugcggcucgcuagcauggccaucuguucugcggugccgacggagugguuucccaccuccagaacaaccuggagcauucacgcccaucaccaguggaugacaaccgaagauaugcugaagguuuggaaucgcguguggaucgaggacaacccuaauaugauugauaagacgcccguccacuccugggaagacaucccuuaccuuggaaaaagagaggaccuguggugcggcucucucauugggcugagcucccgggcuaccugggccaagaacauccauacagcuauuacccaagugcgcaaucuuaucggaaaagaagaguauguugauuacaugcccgugaugaagagauauagcgccccuucugaguccgaaggcguccuguga

SEQ ID NO: 21074 - RNA, 9867 nt, Artificial Sequence
  derived and/or modified CDS sequence (opt5) from DENV-4__KT026308__SS-prME
agcaccaucacccugcugugccugauucccacggugauggccuuccaccuuuccaccagagacggagagccucugaugaucguggcuaagcaugaacgggggagaccgcugcuguuuaagacaaccgagggaauuaacaaguguacacuuaucgccauggaucugggagaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucagcggaccguuuucuuuauccugaugaugcuuguggcccccagcuauggcaugcgcugugucggggugggaaacagagauuucguugaaggcguguccgggggagcgugggucgaccuggugcucgagcacggcggcugcgugacaaccauggcccaggggaagccuacccuggauuuugaacugauuaagacaacggcuaaagaggucgcccuccugcggaccuacuguaucgaagcuagcauuucuaauaucacaaccgccacacgcugcccgacccaaggagagcccuaucuuaaggaggaacaggaccagcaguacauuuguagacgggauaugguugaccgcggcugggggaacggaugcggccuguucgggaaaggaggcguggugacgugcgcgaaguuuuccugucucggcaaaaucacagggaaucugguccaaaucgagaaccuugaauauaccgugguugugaccguccauaauggagauacacacgccgugggcaacgacaccagcaaucacgggguuacagcuacgauuaccccuagaucucccuccguggagguccagcugccugauuacggagaacucacacuggacugcgagccccggagcggcaucgacuucaacgagaugauucugaugaagaugaagaccaaaacauggcucgugcauaagcagugguuucuggaucuuccgcugccuuggaccacgggggccgacacccucgaaguccacuggaaucauaaagagagaauggugacauucaagguuccccacgcuaaacgccaggaugugaccguccugggcucucaagaaggagccaugcacuccgcccuugcuggcgcgacagagguggacagcggggauggaaaccauauguuugccggccaccugaaguguaaaguucggauggaaaagcucagaaucaaggggauguccuacaccaugugcucuggaaaauucagcauugacaaggagauggcugagacgcagcauggcacaaccguggucaaagugaaguaugaagggacaggcgccccuuguaaagugcccaucgagauccgcgauguuaauaaggaaaaggucgugggacggauuaucuccagcacccccuucgccgagaacaccaacucugugacaaauauugagcuggaaccuccguuuggcgacuccuacaucgucauuggggugggagauagcgcucugacgcuccacugguucagaaaaggcucuagcaucgggaagauguuugaguccaccuaucgcggagccaaacggauggcgauccugggcgaaacagcuugggacuucgggucuguuggcggacuucugaccagccucggcaaggccgugcaucaggucuuuggguccguguacacaaccauguucggaggcguuagcuggauggugcgcauucugaucgggcugcuuguccucuggauuggaacgaacucucgcaauacauccauggccaugagcugcaucgcugugggcgggauuacccuguuucugggcuucaccguucacgccgauaugggauguguggucucuugguccggcaaagagcucaagugcgggagcggaaucuuugugauugacaacgugcacacauggaccgaacaauauaaguuccagcccgaguccccugcucggcuggccucugcgauccuuaaugcccauaaagagggcgucugugggaucagaagcacaacgcgccuggaaaacguuauguggaagcagauuaccaaugagcucaacuacgugcugugggaaggaggccacgaccugacaguggucgcuggcgaugugaaagggguucuuuccaagggaaaacgggcccucgcucccccugugaaugaccugaaguauucuuggaagaccuggggcaaagccaagaucuuuacacccgagaccagaaacagcacguuccuggucgaugggccggacaccuccgaaugcccuaaugagcggcgcgcguggaacuuucucgagguggaagauuacggauucggcauguucacaaccaauauuuggaugaaauuuagagaggggagcucugaaguuugugaccaucggcugauguccgccgcuaucaaggaucagaaagccgugcacgcugacaugggauacuggauugagagcucuaagaaccaaacauggcagaucgaaaaagccucccuuaucgaggucaagaccugccuguggcccaagacacacacccucuggagcaauggcgugcuggagucucagaugcugauuccuaaagccuaugcuggccccaucagccagcauaacuacagacaaggguaugcgacgcagacagccggaccuuggcaccuuggcaagcucgaaauugauuucggggagugccccggaaccaccguuacagugcaggaagacugugaucaucgcggcccgucccugcggaccacgacagcuagcgggaaacuggucacccaguggugcuguagaucuugcacaaugccuccccuccgcuuucugggagaggacggcuguugguacggcauggagaucagaccccuuaacgaaaaggaggaaaauauggugaaaucccaagugagcgccgggcacggaaccuccgagacauucucuaugggccugcucugccugacccuguuugucgaagagugucuucggcgcagaguuacgcggaagcauaugauucucgugguggucaccacacugugcgccaucauccucgggggacucaccuggauggaucugcuucgcgcucugauuaugcucggcgacacaaugagcgggagaaugggaggccagauccaccuggccauuauggcgguguucaagauguccccuggcuauguucuggggaucuuucuucggaaacugaccucucgcgagacggcucucauggugauuggaauggccaugacaaccguccugagcaucccgcacgaccucauggaguucaucgauggcauuucccuggggcuuauccugcucaagauggugacacauuuugacaacacccagguuggaacccuggcccuggcucuuacauucauuaaaucuacgaugccccuggugauggccuggagaaccaucauggcgguccucuuuguggucacacugauuccucucugucggaccagcugccugcagaagcaaucccacuggguggagaucacagcucuuauucugggcgcccaggcccuccccguuuaccugaugacccugaugaaaggggcuagcaagcgcucuuggccucuuaaugaaggaaucauggccgugggccuggucucccuccugggcagcgcucuccugaagaacgaugugccccuugccgggccuaugguugcgggaggccugcugcucgccgcuuaugugaugucuggguccagcgccgaccugucucuugagaaagcugccaauguccagugggaugaaauggccgacaucacgggauccagccccauuaucgaggugaagcaagaugaggacggcuccuucagcauuagagauguggaagagacaaacaugaucacccugcucguuaaacuggcucucauuaccgucucugggcuguacccgcuugcgaucccugugacaaugacccugugguacauguggcaagugaagacacagcggagcggagcccugugggacguccccuccccugcugccgcccagaaagcuacgcucaccgaaggcguguauagaaucaugcaacgcggccuguuugggaagacacagguuggagugggcauucauaccgagggggucuuccacacaauguggcaugugacccggggaucuguuaucugucacgaaagcggcagacuugagcccuccugggccgaugugcgcaaugacaugauuucuuacgggggaggcuggcggcugggcgauaagugggacaaagaggaagacguccaggugcucgcgaucgagccggggaagaacccuaaacacguucagacgaagcccggacuguucaaaacccucacaggcgaaauuggggcugugacccuggauuuuaagccuggaacaagcggcucccccaucaucaauagaaaagggaaggucauuggccuuuauggaaacggcguggugaccaagucuggggacuacgucagcgccaucacacaagccgagcgcauuggagagcccgauuaugaaguugacgaggauaucuuccggaaaaagagacugacgauuauggaccugcauccuggcgcugggaaaaccaagcgcauccucccguccauugugcgggaagcccugaaaagacggcuucgcacacugauccucgcgcccaccagaguggucgcugccgagauggaagaggcccugcggggacucccuauccgcuaccagacccccgcugucaagagcgagcacacaggcagagaaauuguugaucugaugugccaugccacguuuaccacacggcuucugucuuccaccagagugccuaauuauaaccugaucgucauggacgaggcucacuucacagaucccagcucuguggccgcgcgcggguacauuuccacccggguugaaaugggcgaggccgcugccguguuuaugacggcuacaccuccgggaaccaccgaccccuucccucagagcaauucccccaucgaagauauugagagagagaucccugaacgcucuuggaacacaggcuuugacuggaucaccgacuaccaggggaagacagucugguucgugcccagcauuaaagccggaaaugauaucgccaacugccuccggaaguccggcaaaaaggucauucaacugagcagaaaaaccuuugacacggaguauccgaagacaaaacuuaccgauugggacuucgugaucacaaccgauauuucugaaaugggggcuaacuuucgcgcgggacggguuaucgacccuagacgcugucugaaacccgugauccucacggauggccccgagagagugauucuggccgggccuauccccgucaccccugcuuccgccgcccagcggcgcggcagaauuggacggaauccggcucaggaagacgaucaauacguuuucagcggcgacccccugcgcaacgaugaggaccacgcccauuggacagaggcgaagaugcuccuugauaauaucuauaccccugaagggauuauccccacacuguucggaccugagagagagaagacccaggcuauugacggcgaguuucggcugagaggggagcagcgcaagacauucguggaacucaugcggagaggagaccugcccguguggcuuucucacaaagucgccagcgccggcaucuccuacaaggaucgcgaguggugcuuuaccggcgaacggaacaaucagauccuggaggaaaacauggagguggagauuuggacgagagaaggggagaagaaaaagcuccggccgaaauggcuggacgcucgcguuuaugccgauccuauggcgcugaaggacuucaaagaauuugccucuggaagaaagagcaucacacucgauauucuuaccgagaucgcuucccugcccaccuaccugucuagccgggccaagcucgcucuggacaauauugugaugcuucauacaaccgaacgcggcgggaaagccuaucaacacgcucugaacgagcucccugagucccuggaaacacugaugcucgucgcccuucugggagcgaugacggccggcaucuuccuguuuuucaugcaggggaagggaaugggcaaacucagcaugggccugaucgcuauugccguggcuucugggcuucugugggucgccgagauccagccccaguggauugccgcuuccaucauucucgaauuuuuccugauggugcugcucguuccugagcccgaaaagcaaagaaccccgcaggauaaucagcuuaucuacgugauccugacaauucugaccaucauugcgcucgucgccgcuaacgagaugggacugaucgagaaaacaaagaccgacuuuggcuucuaccaggugaaagccgaaacgaccauucuugauguugaccugcggccugccagcgcuuggacacucuaugccguggcgaccacaauccugacccccaugcugcgccauacgauugagaauacauccgccaaccucucucuugcugccaucgcuaaucaagccgcgguccugauggggcugggaaagggcuggccccuccacagaauggaucugggggugccucuucuggccaugggauguuacagccaggugaacccgaccacacucaccgcuucccugguuaugcugcucguccacuaugccaucauuggccccggccuucaggcuaaggccacccgggaagcucagaaacgcacagccgcggggaucaugaagaauccuacgguggacggaauuaccgugaucgaucuggagcccauuucuuacgacccuaaauuugagaagcaacugggccaggucaugcuccugguucuuugcguggggcagcugcuccugaugagaacaaccugggccuucugugaagugcugacacucgcuaccggacccauccuuacgcugugggagggcaacccugggcgguucuggaacacaaccaucgccgucagcaccgcuaauauuuuuagaggauccuaucuggccggcgccggccucgcguucagccugaucaaaaacgcucaaacaccgcgccgggggaccggaacaaugggcgaaacgcuuggggagaaguggaagagacagcucaauucucucgaccgcaaagaauuugaggaguacaagcgguccggcauucuggaaguggauagaaccgaggcccgcagcgcucugaaagacggcucuaagaucaaauaugccguuucccgggggacaagcaagauuagauggaucguggaacgcggaauggucaagcccaaaggcaaggugguugaucucggcugcgggcggggaggcuggucuuacuacauggccacccuuaaaaacgugacagaggucaagggguauaccaaaggaggcccugggcaugaagaacccaucccuauggcuacguacggauggaaucuggugaagcugcacagcggcguggacgucuucuauaagcccaccgagcagguugauacacuccugugugacauuggcgaauccucuagcaacccgaccaucgaggaagggagaacacuucgcgugcugaaaaugguggagccuuggcucuccagcaagcccgaauuuugcauuaaaguccugaaucccuacaugccuaccgugaucgaggagcuggaaaagcuccagcggagacauggaggcucccuuguucgcuguccccugucuagaaacagcacacacgagauguauuggguguccggggucucuggaaauauugugagcuccguuaacaccacgucuaaaaugcugcucaaucgguucacaacccgccacagaaagccuaccuacgaaaaagaugccgaccugggcgcggggacacggagcguguccacggagaccgagaagccggauaugacaaucauuggaagacggcuucaacgccugcaggaagaacauaaggaaaccuggcacuaugaccaugagaaccccuacagaacaugggccuaccacggcagcuaugaagcuccuucuaccggcuccgccagcucuauggucaauggggugguuaaacuccugacaaagcccugggauguggucccuauggugacccagcuggcuaugacggacaccacacccuuuggacagcaacgggucuucaaagagaagguggacacccgcacaccgcagccuaaacccggcacccagguugugaugacgacaaccgccaacuggcucuggacacugcuugggagaaagaagaauccucggcugugcacccgcgaggaauuuaucuccaaagucagaagcaacgcggccaucggagcuguguuccaggaggaacaaggcuggacgucugccuccgaggcugugaaugauagccgguuuugggaacucguugacaaggagcgcgcccugcaucaggaggggaaaugugaauccugcguguacaacaugaugggcaagagagagaagaaacuuggagaguucggccgggcuaaagggagccgcgccauuugguauauguggcugggagcgagauuucucgaguucgaagcccugggcuuccugaacgaggaucacugguuugggcgggaaaauucuuggagcggagucgaaggcgaggggcuccaccgccugggcuacauccuugaagacauugauaaaaaggacggagaucugaucuaugcugacgauaccgccggcugggacacaagaauuaccgaggaugaccuccugaacgaggaacuuaucacagagcagaugacaccccaucacaaaauccuggcuaaggccauuuucaaacucacauaccaaaauaaggugguuaaggugcugcggccuacccccaaaggggccgucauggauaucauuuccagaaaggaccagcgcggaucuggccagguggggacguauggacugaacacauuuaccaauauggaaguccagcucauccggcaaauggaggcggaaggcgugauuaccagagacgauaugcauaacccgaaagggcugaaggagcgcguugagaaauggcuuaaggaaugcggcguggaccggcugaaaagaauggcuaucagcggagaugacugugucgugaagccucucgaugagcgcuucuccacaucucugcuuuuucugaaugacaugggcaagguucggaaagauaucccccagugggaacccagcaagggguggaaaaacuggcaggaggugccuuucugcucccaccacuuucauaagauuuucaugaaagacggaagaucucucgucgugccgugucgcaaucaggaugaacugaucggccgggccagaauuagccaaggggccggauggucccugcgcgagaccgcuugccucggcaaggccuacgcucagauguggagccugauguacuuucaccggagagaccuucggcuggccucuauggcgaucuguuccgccgugcccacagagugguucccuacgagcagaaccacauggucuauucaugcucaccaucaguggaugaccacagaagauaugcucaagguuuggaaccgcgucuggaucgaggacaaucccaacaugaucgacaaaaccccugugcacuccugggaagauauucccuaucuggggaagcgggaggaccuuuggugcggcagccugaucggacucuccucuagagccacgugggcuaaaaauauucacaccgccaucacacaggugcgcaaccugauuggcaaggaagaguacgucgauuauaugccugcgaugagacgguacagcgcccauuuugaguccgaaggggugcuguga

SEQ ID NO: 21075 - RNA, 9867 nt, Artificial Sequence
  derived and/or modified CDS sequence (opt5) from DENV-4__KT026309__SS-prME
agcaccaucacccugcugugccugauucccacggugauggccuuccaccuuuccaccagagacggagagccucugaugaucguggcuaagcaugaacgggggagaccgcugcuguuuaagacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucagcggaccguuuucuuuauccugaugaugcuuguggcccccagcuauggcaugcgcugugucggggugggaaacagagauuucguugaaggcguguccgggggagcgugggucgaccuggugcucgagcacggcggcugcgugacaaccauggcccaggggaagccuacccuggauuuugaacugauuaagacaacggcuaaagaggucgcccuccugcggaccuacuguaucgaagcuagcauuucuaauaucacaaccgccacacgcugcccgacccaaggagagcccuaucuuaaggaggaacaggaccagcaguacauuuguagacgggauaugguugaccgcggcugggggaacggaugcggccuguucgggaaaggaggcguggugacgugcgcgaaguuuuccugucucggcaaaaucacagggaaucugguccaaaucgagaaccuugaauauaccgugguugugaccguccauaauggagauacacacgccgugggcaacgacaccagcaaucacgggguuacagcuacgauuaccccuagaucucccuccguggagguccagcugccugauuacggagaacucacacuggacugcgagccccggagcggcaucgacuucaacgagaugauucugaugaagaugaagaccaaaacauggcucgugcauaagcagugguuucuggaucuuccgcugccuuggaccacgggggccgacacccucgaaguccacuggaaucauaaagagagaauggugacauucaagguuccccacgcuaaacgccaggaugugaccguccugggcucucaagaaggagccaugcacuccgcccuugcuggcgcgacagagguggacagcggggauggaaaccauauguuugccggccaccugaaguguaaaguucggauggaaaagcucagaaucaaggggauguccuacaccaugugcucuggaaaauucagcauugacaaggagauggcugagacgcagcauggcacaaccguggucaaagugaaguaugaagggacaggcgccccuuguaaagugcccaucgagauccgcgauguuaauaaggaaaaggucgugggacggauuaucuccagcacccccuucgccgagaacaccaacucugugacaaauauugagcuggaaccuccguuuggcgacuccuacaucgucauuggggugggagauagcgcucugacgcuccacugguucagaaaaggcucuagcaucgggaagauguuugaguccaccuaucgcggagccaaacggauggcgauccugggcgaaacagcuugggacuucgggucuguuggcggacuucugaccagccucggcaaggccgugcaucaggucuuuggguccguguacacaaccauguucggaggcguuagcuggauggugcgcauucugaucgggcugcuuguccucuggauuggaacgaacucucgcaauacauccauggccaugagcugcaucgcugugggcgggauuacccuguuucugggcuucaccguucacgccgauaugggauguguggucucuugguccggcaaagagcucaagugcgggagcggaaucuuugugauugacaacgugcacacauggaccgaacaauauaaguuccagcccgaguccccugcucggcuggccucugcgauccuuaaugcccauaaagagggcgucugugggaucagaagcacaacgcgccuggaaaacguuauguggaagcagauuaccaaugagcucaacuacgugcugugggaaggaggccacgaccugacaguggucgcuggcgaugugaaagggguucuuuccaagggaaaacgggcccucgcucccccugugaaugaccugaaguauucuuggaagaccuggggcaaagccaagaucuuuacacccgagaccagaaacagcacguuccuggucgaugggccggacaccuccgaaugcccuaaugagcggcgcgcguggaacuuucucgagguggaagauuacggauucggcauguucacaaccaauauuuggaugaaauuuagagaggggagcucugaaguuugugaccaucggcugauguccgccgcuaucaaggaucagaaagccgugcacgcugacaugggauacuggauugagagcucuaagaaccaaacauggcagaucgaaaaagccucccuuaucgaggucaagaccugccuguggcccaagacacacacccucuggagcaauggcgugcuggagucucagaugcugauuccuaaagccuaugcuggccccaucagccagcauaacuacagacaaggguaugcgacgcagacagccggaccuuggcaccuuggcaagcucgaaauugauuucggggagugccccggaaccaccguuacagugcaggaagacugugaucaucgcggcccgucccugcggaccacgacagcuagcgggaaacuggucacccaguggugcuguagaucuugcacaaugccuccccuccgcuuucugggagaggacggcuguugguacggcauggagaucagaccccuuaacgaaaaggaggaaaauauggugaaaucccaagugagcgccgggcacggaaccuccgagacauucucuaugggccugcucugccugacccuguuugucgaagagugucuucggcgcagaguuacgcggaagcauaugauucucgugguggucaccacacugugcgccaucauccucgggggacucaccuggauggaucugcuucgcgcucugauuaugcucggcgacacaaugagcgggagaaugggaggccagauccaccuggccauuauggcgguguucaagauguccccuggcuauguucuggggaucuuucuucggaaacugaccucucgcgagacggcucucauggugauuggaauggccaugacaaccguccugagcaucccgcacgaccucauggaguucaucgauggcauuucccuggggcuuauccugcucaagauggugacacauuuugacaacacccagguuggaacccuggcccuggcucuuacauucauuaaaucuacgaugccccuggugauggccuggagaaccaucauggcgguccucuuuguggucacacugauuccucucugucggaccagcugccugcagaagcaaucccacuggguggagaucacagcucuuauucugggcgcccaggcccuccccguuuaccugaugacccugaugaaaggggcuagcaagcgcucuuggccucuuaaugaaggaaucauggccgugggccuggucucccuccugggcagcgcucuccugaagaacgaugugccccuugccgggccuaugguugcgggaggccugcugcucgccgcuuaugugaugucuggguccagcgccgaccugucucuugagaaagcugccaauguccagugggaugaaauggccgacaucacgggauccagccccauuaucgaggugaagcaagaugaggacggcuccuucagcauuagagauguggaagagacaaacaugaucacccugcucguuaaacuggcucucauuaccgucucugggcuguacccgcuugcgaucccugugacaaugacccugugguacauguggcaagugaagacacagcggagcggagcccugugggacguccccuccccugcugccgcccagaaagcuacgcucaccgaaggcguguauagaaucaugcaacgcggccuguuugggaagacacagguuggagugggcauucauaccgagggggucuuccacacaauguggcaugugacccggggaucuguuaucugucacgaaagcggcagacuugagcccuccugggccgaugugcgcaaugacaugauuucuuacgggggaggcuggcggcugggcgauaagugggacaaagaggaagacguccaggugcucgcgaucgagccggggaagaacccuaaacacguucagacgaagcccggacuguucaaaacccucacaggcgaaauuggggcugugacccuggauuuuaagccuggaacaagcggcucccccaucaucaauagaaaagggaaggucauuggccuuuauggaaacggcguggugaccaagucuggggacuacgucagcgccaucacacaagccgagcgcauuggagagcccgauuaugaaguugacgaggauaucuuccggaaaaagagacugacgauuauggaccugcauccuggcgcugggaaaaccaagcgcauccucccguccauugugcgggaagcccugaaaagacggcuucgcacacugauccucgcgcccaccagaguggucgcugccgagauggaagaggcccugcggggacucccuauccgcuaccagacccccgcugucaagagcgagcacacaggcagagaaauuguugaucugaugugccaugccacguuuaccacacggcuucugucuuccaccagagugccuaauuauaaccugaucgucauggacgaggcucacuucacagaucccagcucuguggccgcgcgcggguacauuuccacccggguugaaaugggcgaggccgcugccguguuuaugacggcuacaccuccgggaaccaccgaccccuucccucagagcaauucccccaucgaagauauugagagagagaucccugaacgcucuuggaacacaggcuuugacuggaucaccgacuaccaggggaagacagucugguucgugcccagcauuaaagccggaaaugauaucgccaacugccuccggaaguccggcaaaaaggucauucaacugagcagaaaaaccuuugacacggaguauccgaagacaaaacuuaccgauugggacuucgugaucacaaccgauauuucugaaaugggggcuaacuuucgcgcgggacggguuaucgacccuagacgcugucugaaacccgugauccucacggauggccccgagagagugauucuggccgggccuauccccgucaccccugcuuccgccgcccagcggcgcggcagaauuggacggaauccggcucaggaagacgaucaauacguuuucagcggcgacccccugcgcaacgaugaggaccacgcccauuggacagaggcgaagaugcuccuugauaauaucuauaccccugaagggauuauccccacacuguucggaccugagagagagaagacccaggcuauugacggcgaguuucggcugagaggggagcagcgcaagacauucguggaacucaugcggagaggagaccugcccguguggcuuucucacaaagucgccagcgccggcaucuccuacaaggaucgcgaguggugcuuuaccggcgaacggaacaaucagauccuggaggaaaacauugagguggagaucuggacgagagaaggggagaagaaaaagcuccggccgaaauggcuggacgcucgcguuuaugccgauccuauggcgcugaaggacuucaaagaauuugccucuggaagaaagagcauuacacucgauauccuuaccgagauugcuucccugcccaccuaccugucuagccgggccaagcucgcucuggacaauaucgugaugcuucauacaaccgaacgcggcgggaaagccuaucaacacgcucugaacgagcucccugagucccuggaaacacugaugcucgucgcccuucugggagcgaugacggccggcaucuuccuguuuuucaugcaggggaagggaaugggcaaacucagcaugggccugauugcuaucgccguggcuucugggcuucugugggucgccgagauucagccccaguggaucgccgcuuccauuauccucgaauuuuuccugauggugcugcucguuccugagcccgaaaagcaaagaaccccgcaggauaaucagcuuaucuacgugauucugacaauccugaccauuaucgcgcucgucgccgcuaacgagaugggacugauugagaaaacaaagaccgacuuuggcuucuaccaggugaaagccgaaacgaccauccuugauguugaccugcggccugccagcgcuuggacacucuaugccguggcgaccacaauucugacccccaugcugcgccauacgaucgagaauacauccgccaaccucucucuugcugccaucgcuaaucaagccgcgguccugauggggcugggaaagggcuggccccuccacagaauggaucugggggugccucuucuggccaugggauguuacagccaggugaacccgaccacacucaccgcuucccugguuaugcugcucguccacuaugccauuaucggccccggccuucaggcuaaggccacccgggaagcucagaaacgcacagccgcggggauuaugaagaauccuacgguggacggaaucaccgugauugaucuggagcccaucucuuacgacccuaaauuugagaagcaacugggccaggucaugcuccugguucuuugcguggggcagcugcuccugaugagaacaaccugggccuucugugaagugcugacacucgcuaccggacccauccuuacgcugugggagggcaacccugggcgguucuggaacacaaccauugccgucagcaccgcuaauaucuuuagaggauccuaucuggccggcgccggccucgcguucagccugauuaaaaacgcucaaacaccgcgccgggggaccggaacaaugggcgaaacgcuuggggagaaguggaagagacagcucaauucucucgaccgcaaagaauuugaggaguacaagcgguccggaauccuggaaguggauagaaccgaggcccgcagcgcucugaaagacggcucuaagauuaaauaugccguuucccgggggacaagcaagaucagauggaucguggaacgcggaauggucaagcccaaaggcaaggugguugaucucggcugcgggcggggaggcuggucuuacuacauggccacccuuaaaaacgugacagaggucaagggguauaccaaaggaggcccugggcaugaagaacccauuccuauggcuacguacggauggaaucuggugaagcugcacagcggcguggacgucuucuauaagcccaccgagcagguugauacacuccugugugacaucggcgaauccucuagcaacccgaccauugaggaagggagaacacuucgcgugcugaaaaugguggagccuuggcucuccagcaagcccgaauuuugcaucaaaguccugaaucccuacaugccuaccgugauugaggagcuggaaaagcuccagcggagacauggaggcucccuuguucgcuguccccugucuagaaacagcacacacgagauguauuggguguccggggucucuggaaauaucgugagcuccguuaacaccacgucuaaaaugcugcucaaucgguucacaacccgccacagaaagccuaccuacgaaaaagaugccgaccugggcgcggggacacggagcguguccacggagaccgagaagccggauaugacaauuaucggaagacggcuucaacgccugcaggaagaacauaaggaaaccuggcacuaugaccaugagaaccccuacagaacaugggccuaccacggcagcuaugaagcuccuucuaccggcuccgccagcucuauggucaauggggugguuaaacuccugacaaagcccugggauguggucccuauggugacccagcuggcuaugacggacaccacacccuuuggacagcaacgggucuucaaagagaagguggacacccgcacaccgcagccuaaacccggcacccagguugugaugacgacaaccgccaacuggcucuggacacugcuugggagaaagaagaauccucggcugugcacccgcgaggaauuuaucuccaaagucagaagcaacgcggccauuggagcuguguuccaggaggaacaaggcuggacgucugccuccgaggcugugaaugauagccgguuuugggaacucguugacaaggagcgcgcccugcaucaggaggggaaaugugaauccugcguguacaacaugaugggcaagagagagaagaaacuuggagaguucggccgggcuaaagggagccgcgccaucugguauauguggcugggagcgagauuucucgaguucgaagcccugggcuuccugaacgaggaucacugguuugggcgggaaaauucuuggagcggagucgaaggcgaggggcuccaccgccugggcuacauucuugaagacaucgauaaaaaggacggagaucugauuuaugcugacgauaccgccggcugggacacaagaaucaccgaggaugaccuccugaacgaggaacuuaucacagagcagaugacaccccaucacaaaauucuggcuaaggccaucuucaaacucacauaccaaaauaaggugguuaaggugcugcggccuacccccaaaggggccgucauggauauuaucuccagaaaggaccagcgcggaucuggccagguggggacguauggacugaacacauuuaccaauauggaaguccagcucauucggcaaauggaggcggaaggcgugaucaccagagacgauaugcauaacccgaaagggcugaaggagcgcguugagaaauggcuuaaggaaugcggcguggaccggcugaaaagaauggcuaucagcggagaugacugugucgugaagccucucgaugagcgcuucuccacaucucugcuuuuucugaaugacaugggcaagguucggaaagauauuccccagugggaacccagcaagggguggaaaaacuggcaggaggugccuuucugcucccaccacuuucauaagaucuucaugaaagacggaagaucucucgucgugccgugucgcaaucaggaugaacugauuggccgggccagaaucagccaaggggccggauggucccugcgcgagaccgcuugccucggcaaggccuacgcucagauguggagccugauguacuuucaccggagagaccuucggcuggccucuauggcgauuuguuccgccgugcccacagagugguucccuacgagcagaaccacauggucuauccaugcucaccaucaguggaugaccacagaagauaugcucaagguuuggaaccgcgucuggaucgaggacaaucccaacaugauugacaaaaccccugugcacuccugggaagauauccccuaucuggggaagcgggaggaccuuuggugcggcagccugauuggacucuccucuagagccacgugggcuaaaaauauccacaccgccauuacacaggugcgcaaccugaucggcaaggaagaguacgucgauuauaugccugcgaugagacgguacagcgcccauuuugaguccgaaggggugcuguga

SEQ ID NO: 21076 - RNA, 9867 nt, Artificial Sequence
  derived and/or modified CDS sequence (opt5) from DENV-4__KF907503__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaugaucaccccuagaucccccagcguggaggucaagcuuccugauuacggagaacugacacucgacugcgagccccggucuggcaucgacuucaacgagaugauucugaugaagaugaaaaagaaaaccuggcuggugcauaagcagugguuucucgaucugccgcuuccuuggacagccggggcugacaccuccgaaguucacuggaauuacaaagagagaauggugacguucaaggucccccaugccaaacgccaggaugugaccguucugggcagccaggaaggagccaugcacuccgcucucgcgggcgccacagagguggacucuggggauggaaaccacauguuugcuggccaucugaaguguaagguccggauggaaaaacuuagaaucaaggggaugagcuauaccaugugcuccggaaaauucagcauugacaaggagauggccgagacacaacacggcaccacgguggugaaaguuaaguacgaaggggccggcgcuccuuguaagguccccaucgagauucgcgaugugaauaaagaaaagguggucggacggaucaucucuuccacaccccuggccgagaacaccaacagcgugacaaauauugagcucgaaccuccguucggcgacucuuauaucguuauuggggugggaaacagcgcgcugacccugcauugguuuagaaaaggcuccucuaucgggaagauguucgagagcaccuaccgcggagcuaaacggauggccauucucggcgaaacagccugggauuuuggguccgucggcggacuguucacgagccuuggcaaggcugugcaccagguuuuugggucuguguauaccacaauguucggaggcgucuccuggaugaucagaauccugauuggguuucucgugcuguggaucggaaccaauagccgcaacacaucuauggccaugaccugcauugcuguuggcgggaucacgcuguuccuuggcuuuacagugcaggccgacaugggaugugucguguccuggagcggcaaggagcucaaaugcggguccggaauuuucguggucgauaauguucauaccuggaccgaacaauacaaguuucagcccgagucuccugcgcggcuggccagcgcuauccugaacgcccacaaagacggcgugugugggauuagauccacaacccgccucgagaaugugauguggaagcagaucacaaacgaacugaauuauguccuuugggagggaggccacgaccugacggugguugcuggcgaugugaaagggguccucaccaagggaaagcgggcccugacacccccugugucugaccugaaauacagcuggaagaccuggggcaaagcgaagaucuucacacccgaagccagaaacuccaccuuucuuauugaugggccggacacgagcgagugcccuaaugaacggcgcgcuuggaacucucucgagguugaggauuacggauucggcauguucaccacaaauaucuggaugaaauuuagagaaggguccagcgaggugugugaccaucggcugaugucugccgcuauuaaggaucagaaagccguccacgccgacaugggauauuggaucgaauccagcaagaaccaaaccuggcagauugagaaggcuucucugaucgaagugaaaacaugccucuggcccaagacccauacacuguggagcaauggcguucuugagucccagaugcugaucccuaaaagcuacgcgggccccuucucucagcacaacuauagacaaggguacgccacccagacggugggaccuuggcaccucggcaagcuggagauugauuuuggggaaugccccggaacaaccgucaccauccaggaggacugugaucaucgcggcccgucccugcggacaagcaccgcuuccgggaaacuugugacgcaguggugcuguagaucuugcacaaugccuccccuccgcuuccugggagaagacggcuguugguauggcauggagauuagaccccugagcgagaaggaagagaacauggugaagucccaagucaccgccgggcagggaacaucugaaaccuuuagcaugggccuccugugccuuacacuguucguugaggaaugucuccggcgcagagugacccggaaacacaugauccugguggucgugauuacgcugugcgccaucauccuugggggacucaccuggauggaucugcugcgcgcucucauuaugcugggcgacacaauguccgggagaaucggaggccagauucaucuugccaucauggcgguuuuuaagaugucuccuggcuacgugcugggggucuuccuccggaaacugaccagccgcgagacagcucugauggugauuggaauggccaugaccacgguucuuuccaucccgcacgaccugauggagcucaucgauggcauuagccuggggcucauccugcuuaagauugugacacaguuugacaauacccaagucggaacacuggcccucucucugaccuucaucagauccaccaugccccugauuauggcuuggcggacaaucauggccgugcuuuuugucgugacgcugauuccucucugucgcaccagcugccugcagaaacagucucauuggguugaaaucacagcgcucauccugggcgcucaagcccuucccguguaucugaugacccucaugaagggggccuccagacggagcuggccucugaacgagggaauuauggcugucggccuggugucucuucugggcuccgcccuccugaagaaugauguuccccucgcugggccuaugguggccggaggccugcuucuggcggccuacgucaugagcggguccagcgcugaccugucucucgaaaaagccgcuaacgugcagugggaugagauggccgacaucacaggaagcucccccauuaucgaagugaagcaggaugaggacggcucuuucagcauuagagauguugaggaaaccaauaugaucacgcugcuugucaaacuggcccucaucacaguguccgggcuguacccgcucgcuauuccugugaccaugacccugugguauauguggcaggucaagacacaacgcucuggagcgcuuugggacgugcccagcccugccgcuacccagaaagccgcccuguccgagggcguuuaccggaucaugcagagaggccuguuugggaagacacaggugggagucggcauucacauggaagggguguuccacacgauguggcauguuacccgcggaucugugaucugucacgagacaggccggcucgaacccagcugggcugaugucagaaacgacaugauuuccuaugggggaggcuggcgccugggcgauaagugggacaaagaggaggacgugcaaguucuugccaucgaaccggggaagaauccuaaacaugugcagaccaagcccggacuguucaaaacacucaccggcgagaucggggcggucacgcuggauuuuaagccuggaaccagcggcucucccauuaucaaccggaaagggaaggugauuggccucuacggaaauggcguggucacaaaguccggggacuauguuagcgcuaucacccaggccgaaagaauuggagagcccgauuacgagguggacgaagauaucuuccgcaaaaagcggcugacaauuauggaccuucacccuggcgccgggaaaaccaagagaauccugccgucuaucgugcgggaggcucugaaacgcagacuccggacacugauucuugcccccacgcgcgucguggcggcugaaauggaggaagcccugagaggacucccuauccgguaucagacccccgccguuaaguccgagcauacaggcagagagauuguggaucugaugugccacgcuaccagcaccacacgccuccuguccucuacgcgggucccuaacuacaaucuuaucgugauggacgaagcccacuuuaccgaucccagcuccguugcugccagaggguacauuagcacacgcguggagaugggcgaagcggccgcuaucuucaugaccgccacaccuccgggagcuaccgaccccuuuccucaaucuaacucccccaucgaggauauugaacgggagaucccugagagaagcuggaauacgggcuucgacuggauuacagacuaucaggggaagaccgucugguuugugcccucuaucaaagccggaaacgauauugccaauugccugcgcaagagcggcaaaaaggucauccagcugucccggaaaaccuucgacacagaauacccgaagaccaagcucacagauugggacuuugugguuaccacggauaucucugagaugggggcuaacuucagagcgggacgcgugauugacccuagacggugucugaaacccgugauccuuacagauggccccgaacgcgucauucuggccgggccuauccccguuaccccugcuagcgccgcccaaagacggggccgcauuggaagaaacccggcucaggaggacgaucaguauguguuuuccggcgacccccucaagaaugaugaagaccaugcccacuggacagaggcgaaaaugcugcuggauaacaucuacaccccugaggggauuauccccacgcucuucggaccugaacgggagaagacccaggcuaucgacggcgaauucagacuucgcggggagcaacggaaaacauuuguggagcugaugagacgcggagaccugcccgucuggcucucuuauaagguggccagcgccggcauuuccuacaaggaucgggaauggugcuucaccggcgagagaaauaaccagauccuggaagagaauauggaaguugagauuuggacacgggagggggaaaaaaagaaacuucgcccgagauggcuggacgcucggguguaugccgauccuauggcgcucaaggacuuuaaagaguucgccagcggacgcaagucuaucacccuggauauucugacagaaaucgcuucccuccccaccuaccuuagcuccagagccaagcuggcucuggacaacaucgucaugcuccauacgacagagcggggcgggcgcgccuaccagcacgcucugaaugaacuuccugagucucuggagacccucaugcugguggcccugcucggagcgaugaccgccggcauuuuucuuuucuuuaugcaggggaaaggaaucggcaagcugagcaugggccugauuaucauugcugucgccuccgggcuccuguggguggcugaaauccaaccccaguggaucgccgccucuauuauccuugaguucuuucugaugguucuccugauuccugaacccgagaaacagagaacaccgcaggauaaccaacugaucuaugugauucucaccauccuuacaauuaucggacugaucgcugcgaaugaaaugggccugauugagaagacgaaaaccgacuucggguuuuaccaggucaagacagagaccacaauccucgauguggaccugcggccugccagcgcuuggacccuuuaugccguugccacgaccauucugacacccaugcuccgccacaccaucgaaaacacauccgcuaaucugagccuggccgcgauugccaaccaggcugccgugcucaugggacuuggcaaaggguggccccugcauagaauggaucugggagucccucuccuggcuaugggcuguuacucucaggugaauccgaccacgcuuacagccucccuggugaugcucagcguucacuaugcgaucaucggccccgggcugcaagccaaggcuacccgggaggcccagaagagaacagcugccggaauuaugaaaaacccuaccgucgacggcaucaccgugauugaucuggaacccaucucuuacgacccuaaguucgagaaacagcucgggcaagugaugcuucugguccugugcgcuggacagcuccugcuuaugcgcacaacgugggccuuuugugagguucugacccucgcgacaggccccauucugacccugugggaagggaauccuggacgguucuggaacacaaccaucgccguguccacggcuaacaucuucagaggcagcuaucucgccggcgcugggcuugccuuuucucugauuaagaaugcccagacaccgcgccggggaaccggcaccacaggggagacccugggagaaaaauggaagagacagcucaacagccuggaccgcaaggaguucgaagaguacaaacgguccggcauccuugagguggauagaacagaagcgaagucugcucugaaagacgggagcaagauuaaacaugccgucucccgcggaagcuccaagauccgguggauuguggagagaggcaugguuaagcccaaaggcaagguggucgaucucgggugcggacgcggcggguggucuuacuauauggcuacgcugaaaaaugugaccgaaguuaagggauacacaaaaggcgggccuggacacgaggaacccaucccuauggccaccuauggcuggaaccuggugaagcuccauagcggcgucgacguguuuuacaagcccacagagcaaguggauacccuucugugugacauuggggaguccucuagcaauccgacgaucgaagagggacggacccugagaguccucaaaaugguugaaccuuggcuguccucuaagcccgaguucugcaucaaagugcuuaaccccuauaugccuacagugauugaagagcuggagaagcuccagcgcaaacacggcgggaaucuggucagauguccccugagccggaacuccacccacgaaauguacugggugagcggagccucuggcaauaucguuuccagcgugaacacaaccucuaagaugcuccuuaaucgcuuuacaaccagacaucggaaaccuacguaugagaaggaugucgaccugggggcuggaacaagauccgugagcaccgaaaccgagaagccggauaugacaauuaucggccggcgccugcagagacuccaggaggaacacaaagagacguggcauuacgaccaagaaaaccccuaccggaccugggccuaucacggcucuuacgaggcgccuuccacagggagcgccuccagcaugguuaauggaguggucaagcugcuuaccaaacccugggaugugauuccuaugguuacacagcuggcuaugaccgacacaacccccuucggccagcagcgcguguuuaaggaaaaagucgacacgagaaccccgcaaccuaagcccgggacacggauggugaugaccacaaccgccaacuggcucugggcucugcugggaaagaaaaagaauccucgccucugcacgagagaggaguucaucucuaaaguccggagcaacgccgcgaucggcgccguguuucaggaagagcagggguggacauccgcuucugaagccguuaaugauagccgcuucugggagcugguggacaaggaaagagcucuucaccaagagggcaaaugugaguccugcgucuauaacaugaugggaaagcgggaaaagaaacugggcgaguuugggcgcgccaagggaucuagagcuauuugguacauguggcucggcgcccgguuccuggaauuugaggcgcuuggguuccugaacgaagaucauugguucggacgcgagaauagcugguccggcguggagggggaaggccuccacagacugggauauauccuggaggaaauugacaaaaaggauggcgaccucauguacgccgaugacaccgcugggugggauacacggaucaccgaggacgaucugcagaacgaggaacuuauuacggagcagauggccccccaucacaaaauccuggcuaaggccaucuuuaagcucaccuaucagaauaaagugguuaaggugcugagaccuacaccccgcggagccgucauggacauuaucucucggaaagaucaaagaggcagcgggcaggugggaaccuacggccuuaacacauucaccaauauggaaguucagcugauucgccagauggaggcggaaggggugaucacacaagacgacaugcagaacccgaagggccucaaagagcgggucgagaaguggcugaaagaaugcggaguggauagacugaagcgcauggcuauuuccggcgacgauugugucgugaagccucucgacgagcgguuugggaccagccugcuuuuccugaaugauaugggaaaaguuagaaaggacaucccccagugggaacccucuaaaggcuggaagaacuggcaggaggugccuuuuugcucccaucacuuccacaaaaucuuuaugaaggaugggcgcagccucgucgugccgugucggaaucaagacgaacugauuggaagagcccgcaucucucagggcgccggguggucccuucgggagacggcuugccugggcaaggccuacgcucagauguggagccucauguauuuccauagacgggaucugagacuggccuccauggcgauuuguucugccguucccacagagugguuuccuaccagccgcaccacaugguccauccacgcucaucaccaguggaugaccacagaagacaugcucaaaguguggaaccgggucuggauugaggauaaucccaacaugacggacaagaccccugugcacagcugggaagacauccccuaccugggaaaaagagaggaucuuuggugcggcucucugauugggcucuccagccgcgccacaugggcuaagaauauccauaccgccaucacacaagugagaaaccugauuggaaaagaagaguauguugacuacaugccugucaugaagcgguauucugcgcccagcgaguccgaaggcgugcuuuga

SEQ ID NO: 21077 - RNA, 9867 nt, Artificial Sequence
  derived and/or modified CDS sequence (opt5) from DENV-4__AY947539__SS-prME
agcaccaugacacugcucugccugauccccacggccauggcuuuccaccuuuccaccagagacggcgagccucugaugauuguggcccggcaugaacgcgggagaccgcuccuguuuaagacaaccgagggaaucaacaaauguacacuuauugcgauggaucugggcgaaaugugcgaggacaccgucacauacgaauguccccuccugguuaauaccgagccugaggauaucgacugcugguguaaccugacgucugcuugggugauguaugggaccugcacacagagcggagaacggcgcagagagaagcgguccguggcccucaccccccacucuggcauggggcuggaaacacgcgccgagaccuggaugagcuccgagggagcuuggaaacaugcccaaagagucgaaucuuggauucuucggaauccuggcuucgcucugcucgccggcuuuauggcguacaugaucgggcagacgggaauccagcgcacaguguucuuuguucugaugaugcuuguggcccccagcuauggcaugagaugugucggggugggaaaccgggauuucguugagggcguguccgggggagcuugggucgaccuggugcucgaacacggcggcugcgugaccacaauggcccaggggaagccuacccuggauuuugagcugauuaaaaccacagcuaaggaagucgcccuccugcgcacguacuguaucgaggcgagcauuucuaauaucaccacagccaccagaugcccgacacaaggagagcccuaucuuaaggaagagcaggaccagcaguacauuugucggcgcgauguuguggacagaggcugggggaacggaugcggccuguucgggaaaggaggcguggucaccugcgcuaaguuuuccuguagcggcaaaaucacggggaaucucgugcaaauugaaaaccuggaguauacaguuguggucaccgugcauaauggagauacccacgccguuggcaacgacaucccuaaucacggggugacagcuaccaucacaccccggucuccuuccgucgaagugaagcuucccgauuacggagagcugacgcucgacugcgagccgagaagcggcauugacuucaacgaaaugauccugaugaaaaugaagaagaaaaccuggcugguccauaagcagugguuucucgaucugccucuucccugggccgccggggcugacacaucugaggugcacuggaauuacaaagaacgcaugguuaccuucaaggugccucaugcgaaacggcaggaugucacagugcugggcucccaggagggagccaugcacagcgcucucaccggcgccacggaaguugacuccggggauggaaaccacauguuugccggccaucugaaguguaaagugagaauggagaagcuucgcauuaaggggaugucuuauaccaugugcagcggaaaauucuccaucgacaaggagauggcugaaacacaacacggcaccacagucgugaaagugaaguacgagggggccggcgcgcccuguaaaguucccauugaaauccgggaugucaauaaggagaagguggugggaagaaucauuagcucuaccccuuucgcugaguauacgaacuccgucacaaacaucgaacuggagccgcccuuuggcgacagcuacauugugaucgggguuggagauucugcccucacccugcauugguuccgcaaaggcagcuccauugggaagaugcuggaaucuacauaucggggagccaaaagaauggcuauccucggcgagaccgccugggacuuugggagcgugggcggacugcuuaccucccugggcaaggcuguccaccagguguucgggagcguuuacacaacgauguuuggaggcgugucuuggaugguccgcauccucauuggguuccuggugcuguggaucggaaccaauucccggaacacaagcauggccaugaccugcauugcgguuggcgggaucacacuuuuucucggcuucaccgugcaugccgauacgggaugugcugucucuugguccggcaaagaacugaagugcgggagcggaauuuuugugaucgacaaugugcacacauggaccgagcaguauaaguuccaaccugagucccccgccagacuggcuucugccauucucaacgcgcacgaagacggcgucugugggauccgcagcaccacacggcuggagaauaucauguggaaacagauuaccaacgaacuuaauuacguucugugggagggaggccaugaucucacagugguggccggcgacgucaagggggugcuguccaaaggaaagagagcucuggccccucccguuaacgaucuuaaauacucuuggaagacguggggcaaggcuaaaaucuuuaccccggaagccaagaauagcacauuccucauugacgggccugauaccuccgagugccccaacgagcggcgcgccuggaauuuucuggaaguggaggacuauggauucggcauguucacaaccaacaucuggaugaaauuuagagaagggagcucugaggucugugaucaccggcugauguccgcugcgauuaaggaccagaaagccgugcaugcugauaugggauacuggaucgaaagcucuaagaaucagacguggcaaaucgagaaagccucccucauugagguuaagaccugccuguggccuaagacacacacccuuuggagcaacggcgugcuggaaucucagaugcucauccccaaagccuaugcuggcccuuucagccagcacaauuacagacagggguaugccacacaaaccgucggacccuggcaucugggcaagcuggagauugacuuuggggaaugcccgggaacaaccgugacgauccaggaggauugugaccaccgcggcccuucccuucggacaaccaccgcgagcgggaaacucguuacacaguggugcuguagaucuugcaccaugcccccccugcgcuuccugggagaggauggcuguugguacggcauggaaauuagaccucucuccgagaaggaagagaacauggugaaaagccaggucuccgcugggcaaggaacgucugaaacauuuagcaugggccugcuuugccugacccucuucguggaggagugucugcggcgcagagugacacggaagcauaugauccuggucguugugaccacacuuugcgccaucauucucgggggacugaccuggauggaccugcuccgcgcccugaucaugcuuggcgacacgauguccgggagaaugggaggccagauucaccuggcuaucauggccguguuuaagaugucuccgggcuauguccucgggauuuuccugcggaaacugaccagccgcgaaacagcgcuuauggugaucggaauggcuaugaccacaguucuguccaucccccaugaucucauggaguuuauugacggcaucucucuggggcucauucugcuuaagauggugacccacuucgauaacacgcaggucggaacacuggcccucagccugaccuuuaucagauccacaaugccucuggugauggccuggcggaccauuauggcuguucuuuucguggucacccugaucccccucugucgcacaagcugccugcagaaacaaucucacuggguggaaauuacggcccucauccugggcgcucaggcccuuccugucuaccugaugacccucaugaagggggcguccaaaagaagcuggccccugaaugagggaaucauggccgugggccugguuucucuucugggcuccgcucuccugaagaacgacgugccucucgccgggcccauggucgcuggaggccugcuucuggccgccuacgugaugagcgggucuuccgcugaucugagccucgaaaaggcggccaauguucagugggacgagauggcugauauuacaggauccagcccgaucauugaggugaaacaagacgaagauggcucuuuuagcauccgggacauugaggaaaccaacaugaucacacugcuugucaagcuggcccucaucaccguguccgggcuguauccucucgccauucccgugacgaugacacugugguacauguggcagguuaaaacccagagaucuggagcucuuugggaugucccuagccccgccgcggcucagaaggccacccugacagagggcguguaucgcaucaugcaacggggccuguucgggaaaacccaggugggagucggcauucauauggaagggguguuccacacaauguggcauguuacgagaggauccgugaucugucacgagaccggccgccucgagccgucuugggccgacguccggaaugauaugauuagcuacgggggaggcuggagacugggcgacaagugggacaaggaagaggaugugcagguucuugcuaucgaaccugggaaaaaccccaagcaugugcagacaaaaccuggacuguuuaagacccucacaggcgagaucggggccgucacccuggacuucaaacccggaacguccggcucucccauuaucaaucgcaaggggaaagugauuggccucuauggaaacggcguugugaccaagagcggggauuacgucuccgcgaucacacaagcugagcggaccggagaaccugacuaugagguggaugaagacauuuuuagaaagaaacgccugacaaucauggaucuucacccgggcgccgggaagaccaaacggauucugcccagcaucgugagagaggcccugaagcggcgccucagaacacugauccuugcuccuacgcgggucguugccgcugaaauggaggaggcccugcgcggacuccccauuagauaccagaccccugcggugaaaucugaacacacaggccgggagaucguggaccugaugugccaugccaccuucaccacaagacuccuguccagcacgcgcguccccaauuacaaccuuauugugauggaugaagcucacuuuaccgacccuucuuccguugccgcucggggguauaucagcacaagaguggagaugggcgaagccgccgcuauuuucaugaccgcgacaccgcccggagccaccgauccuuuuccccaguccaauucuccuaucgaggacaucgagcgcgaaauucccgagcggagcuggaacacgggcuucgacuggaucacagauuaccaggggaagaccgucugguuugugccguccauuaaggcuggaaaugacaucgccaacugccugagaaaaagcggcaagaaaguuauucaacugucucgcaagaccuucgauacagaauauccuaaaaccaagcucacagacugggauuuuguggucaccacggacaucuccgagaugggggccaauuuccgggcuggaagagugaucgauccccgcagaugucugaagcccgucauuagcacagacggcccugaacgggugauccuugccgggcccauuccuguuaccccggcgucugcugcccagcgcagaggccggaucggacgcaaccccgcccaggaggaugaccaauacguguucagcggcgauccucugaaaaacgacgaggaucaugcucacuggacagaagccaagaugcuccuggacaauauuuauacccccgaggggaucauuccuacgcuguuuggacccgaaagagagaaaaaccaggcgaucgacggcgaguuccggcucagaggggaacagcgcaagaccuuuguggagcuuaugcggagaggagaucugccggucuggcuguccuacaaaguugccucugcuggcaucagcuauaaggaccgcgaauggugcuucacaggcgagcggaauaaccagauucucgaagagaauauggagguggaaaucuggaccagagagggggaaaagaaaaagcugcggccuaaauggcuugaugcccgcguguacgcugaccccauggcccugaaggauuuuaaagaguucgcuuccggaagaaagucuauuacacucgacauccugaccgaaauugccagccugccuacauaccucuccagccgggcgaagcuugcccuggauaacaucgucaugcugcacaccacggagcgcggcgggaaagcuuaucaacaugcccucaaugagcugcccgaaucucuugagacacugaugcucguggcucugcugggagccaugaccgccggcaucuuucucuucuuuaugcaggggaagggaauuggcaaacuuuccaugggccugaucgcuauugcgguugccagcgggcugcucuggguggcugaaauccagccucaguggauugccgccuccaucauccuggaguucuuucuuaugguccugcucauucccgaaccggagaagcaaagaaccccucaggacaaccagcugaucuacgugauucugacaauccucaccauuaucggacuuauugcugccaaugagaugggccugaucgaaaaaacaaagacggauuucggguuuuaucaggucaaaaccgagacaaccauccuggacguggaucuccggcccgcgucugccuggacacuguacgcuguugccaccacgauucuuacccccaugcugcgccacacaaucgaaaacaccagcgcuaaucucucccuggccgcgauugccaaccaagcugccgugcugaugggacucggcaagggguggccucuucauagaauggaccugggagucccgcugcucgcuaugggcuguuauucucaggugaaucccacaacccugaucgccagccuuguuaugcugcucgugcacuacgcuauuaucggcccugggcugcaggccaaggcgacgcgggaggcccagaaacgcacagcugccggaaucaugaagaaccccaccgucgauggcauuacagugaucgaccuggagccuauuuccuaugaccccaaauucgaaaagcaacucgggcaggugaugcuucugguucugugcgcuggacagcuccugcuuaugagaaccaccugggccuucugugagguccugacacucgccacgggcccugugcugacccugugggaagggaauccgggacgguuuuggaacacaaccaucgcggugagcacagcuaacauuuucagaggcucuuaccucgccggcgcugggcuugccuuuucccugaucaaaaaugcccaaaccccccgccggggaacgggcacaaccggggagacccugggagaaaaguggaagagacagcucaacagccuggaucgcaaagaguucgaggaauacaagcggucuggcauccuugaggucgacagaacagaagcuaaauccgcccugaaggaugggagcaaaauuaagcaugcgguuucucgcggaagcuccaagauccgguggauuguggagagaggcauggugaaaccuaagggcaaagucguggaccucgggugcggacgcggcggguggucuuauuacauggccacccugaagaauguuacagaagugaaaggauauacgaagggcgggcccggacacgaggagccuauccccauggcuaccuacggcuggaaccuggucaagcuccacagcggcguggauguuuuuuauaaaccgacagaacagguggacacccuucugugugauauuggggaguccagcuccaauccuacaaucgaagagggacggacccugagaguccucaagaugguggaacccuggcugucuagcaaacccgaguucugcauuaaggugcuuaacccuuacaugcccacggucaucgaggaacuggagaaacuccagcgcaagcauggcgggucccugguucgguguccucugucuagaaauagcacccacgaaauguauuggguguccggagugucuggcaacaucgucagcuccgugaauacaaccagcaaaaugcuccuuaaccgcuuuacaaccagacaucggaagccgacauacgagaaggacguugaucugggggccggaacccgcucuguguccacggagacagaaaaacccgacaugaccauuaucggcagacggcugcaaagacuccaggaggaacacaaggagaccuggcacuacgaucaggaaaauccuuaucggacaugggcuuaccauggcagcuaugaggcccccucuacgggguccgcgagcucuauggucaacggagugguuaaacugcuuaccaagccuugggacgugauucccauggucacacagcuggccaugaccgacacaaccccguucggccaacagcgcguguuuaaagagaagguugauacaagaaccccucagcccaagccugggacgcggauggugaugaccacaaccgcuaauuggcucugggcccugcugggaaaaaagaaaaacccccgccucugcacaagagaagaguucaucuccaagguccggagcaaugcugccauuggcgcuguguuucaggaagagcaaggguggaccuccgccagcgaagcggucaacgacucucgcuucugggagcugguggauaaagagagagcccuucaccaggaaggcaagugugagagcugcguuuacaauaugaugggaaagcgggaaaaaaagcugggcgaguuugggcgcgcuaaaggauccagagccaucugguauauguggcucggcgcucgguuccuggaauucgaggcccuuggguuucugaacgaggaccauugguucggacgcgaaaacucuuggagcggcguggagggggaaggccuccacagacugggauacauccuggaggauauugacaagaaagauggcgaccucaucuaugccgaugacacggcggggugggauacacggauuaccgaggacgaucugcuuaaugaagagcugaucacagaacagauggcuccucaucacaagauucucgccaaggccaucuuuaaacugaccuaccaaaacaaggucgugaaagugcuucgccccacgccgaagggagcuguuauggacaucauuuccagaaaagaccagcggggcucugggcaggugggaaccuacggccugaauacauucaccaacauggagguccagcucaucagacaaauggaagccgagggggugauuacacaggaugacaugcacaauccuaagggccugaaagagcgcguugaaaaguggcugaaggagugcggaguggaucggcucaaaagaauggcuaucagcggcgacgauugugucgugaagccccuggacgaacgcuuuuccaccucucuucuguuccucaacgauauggggaaaguccggaaggacauuccccagugggagccuagcaaaggauggaagaauuggcaggaagugccguuuugcucccaucacuuccauaagaucuuuaugaaagauggcagaagccugguugugcccugucgcaaccaagacgagcuuaucgggcgggccagaauuucucagggagcgggcuggucccugcgcgagacagccugccucgggaaggcuuaugcccagauguggagccugauguacuuccaccggagagaucugcgccucgcuucuauggccaucuguuccgcggucccuaccgaaugguuucccacgagccggacaaccugguccauucacgcccaucaccaguggaugaccacagaggacaugcugaaaguguggaauagaguuuggaucgaagacaacccuaauaugaccgauaagacacccgugcauucuugggaggacauuccuuaucuuggcaaacgggaagaucuguggugcggaagccucaucggccuguccagcagagcuacgugggccaagaacauucacaccgcuaucacacaaguccgcaaucuuaucgggaaggaggaguacguggacuauaugcccgugaugaaacgguacucugccccguucgaauccgagggaguucuguga

SEQ ID NO: 21078 - RNA, 9879 nt, Artificial Sequence
  derived and/or modified CDS sequence (opt6) from DENV-1__AB608789__SS-prME
aguguaacgauguuauuaaugcuaaugccaacggcacuagccuuucauuuaacuacucgagggggagaaccacauaugauugucacaaagcaagaaagaggaaagagcuugcuauuuaaaacaagugccggugugaauaugugcacauugauagccauggaucuaggagaacuaugugaagauacaaugacuuacaaauguccgagaauaacagaagcagaaccagacgauauagauugcugguguaacgcgacugauaccugggucacauacgggacuuguagucaaacaggugaacauagacgugauaagagaucaguugcauuggccccacaugugggauugggacuagaaacccgaacagaaacauggaugucaucagaaggcgcuuggaagcaaauacaaagaguggaaacaugggcauuacgccauccagguuucacggucauugccuuguuuuuagcacaugcuauugggacaaguauaacacagaaaggaauaauauuuauauuguuaaugcuaguaacacccucaauggcuaugcgauguguggguaucggaaguagggacuuuguugaagguuuaucgggagcaacaugggucgacguaguccuugaacauggauccugcguuacuacaauggcaaaagauaaaccuacacuagauauagaguuauugaaaacggaagucaccaauccagccguacuacguaaauuauguauugaagccaaaaucuccaacacuacaaccgauuccagguguccaacccaaggugaagcaacauuagucgaagaacaggaugccaacuuuguauguagacgaaccuuuguggacagaggauggggaaaugggugugggcuuuuuggcaaggguucacucauaacaugugccaaauucaaaugcguuacaaagcuagaaggaaagauuguacaguaugaaaaucuaaaauauucagucauagugacuguacacacaggugaucaacaucaaguggguaaugagucaacagaacauggaacgacagcaacuauaacaccacaagcuccaacaagugaaauucaacuaacggacuauggugcacuuacauuagauugcaguccaaggacaggcuuagacuucaacgaaaugguucuacuaacgaugaaagaaaagaguuggcuaguucauaaacaaugguucuuagaucuaccccuuccuuggacauccggagcgucaacgucacaggaaacauggaaucgacaagaucuccuuguuacuuuuaagacugcacaugcgaagaaacaagaaguaguuguacuagguucucaagaaggugcaaugcacacggcguuaacgggugcaaccgagauucaaacauccgggaccacuacgauuuucgcaggacaucuaaaauguagacuaaaaauggauaaauugacacuaaaaggaaugucuuacgucauguguacaggcucuuuuaaacuugaaaaagaaguagcagaaacucagcauggaacuguauuaguccaaauaaaauaugaaggaacugaugcuccaugcaagaucccauuuuccacgcaggacgaaaaagguguaacacaaaacgguagguugauuacggcgaaucccauaguuacugacaaagaaaaaccuguuaacauagaagccgaaccaccauucggggagucauacauaguuauaggagccggugaaaaagcucuaaagcucucgugguucaagagaggauccuccauaggaaaaauguuugaagcgacagcuagaggagcgcgcaggauggcuaucuugggagauacggcuugggacuucgguucuauaggagggguauuuacuagcguuggaaagcugguacaucaaauauuuggaacagcguauggaguccuuuucucgggcgucucuuggacuaugaaaaucgggauuggaguguuauugaccugguuagggcuaaauucaagaucaacaagucucucuaugacuugcauagcaguaggguuaguaaccuuguacuuaggcguaauggugcaagcagauucaggaugugugaucaauuggaaaggccgcgaacuuaaauguggaucuggaauauuugugacgaacgagguacauacguggacggagcaauacaaauuccaagcggacucucccaaacgacuaucugcagccauuggaaaggcuugggaagaaggaguaugcgggauccggucagcaacaaggcuagaaaacauaauguggaaacagauaucgaaugaacuaaaucacaucuuacucgaaaaugauaugaaauucacaguuguaguaggcgauguuguuggaauacucgcccaaggcaagaagaugauaagaccacaaccaauggaauauaaauauuccuggaaaaguuggggaaaagcgaagauaauuggagccgacguucaaaacaccaccuucauaauagaugggcccaauacaccagagugcccugacgaucaaagggcauggaauauaugggagguagaagacuauggauuuggaauauucacgacgaacauuugguugaaacuaagggacucuuacacacagguaugugaccauagacuuaugucugcugcaauaaaagacucuaaggcaguacaugcugauaugggcuauuggauagaaagugagaaaaacgaaacauggaagcuagcacgugcaucuuuuauagaaguuaaaacuugcauuuggccuaagagucacacacuuuggucaaaugguguacuugaaucggaaaugauaauaccaaaaauauacgguggucccauaagccaacauaauuaucgacccggauauuucacacagacggcugggccuuggcauuugggaaaacuugaauuagacuucgauuugugcgaaggaacgacgguagucguagaugagcauugcggaaauagaggcccaucacuucgaacgacgaccguaaccggcaaaauuauacacgagugguguugucgaucauguacauugcccccauugcgauucaaaggugaagaugggugcugguacgguauggaaauaaggccgguaaaagaaaaagaagagaacuuaguaaaaucuauggucagugcagggucuggcgagguugacagcuuuucuuugggauuacucugcauguccauaaugauagaagaagucaugagaucucgguggucaagaaagauguugaugacaggaacucuugcaguauuuuugcugcugauuaugggacaauuaacauggaacgaucuaauaagguuaugcauaaugguaggugcuaaugcuucugaucguauggguaugggaacaacguaccucgcgcuuauggcaacauuuaaaaugcgaccuauguuugcaguaggcuuauuauuuaggcgguuaacauccagggaaguuuuauuacuaacaauaggacugucacucguagcaucaguagaacuacccaauucucuagaagaacuaggagacggccucgcuauggguauaaugauucucaaauugcucacagacuuucaaucccaccaacuaugggcgacauuauuaaguuuaaccuucauaaagacaaccguuagucuccacuacgcuuggaagacuauggcaauggugcucucuauaguuagcuuguuuccucuaugucuaaguaccacuucucagaaaacgaccuggcuacccguauuauuaggaaguuuaggcugcaaaccuuugaccauguuccucaucgcagaaaacaaaaucugggguagaaagucauggccauuaaacgaggguaucauggcaguagguaucguaaguauacuccugucaagucuucucaaaaacgacguacccuuagcagguccuuuaaucgcugggggcaugcuaauagcauguuacguuauaucugggucgagcgcagaccuuuccuuagaaaaagcugcggagguuucuugggaggaagaagcagagcacucaggggcuucgcauaauaucuugguagagguacaagaugauggcacaaugaaaauuaaagacgaagaaagggacgacaccuugaccauuuugcuuaaggcaacucugcuugccguaucaggugucuacccucuaagcaucccugcaacauuguuugugugguacuuuuggcagaagaagaaacaaagaaguggaguacuuugggauaccccgagcccgccugaaguugaacgagcugucuuagaugaagggauauauagaauaaugcaaagaggauuacuagggcgcucacaagucggcgucgggguauuccaggaaaaugucuuccacacgauguggcaugucacacggggcgcgguacucauguaucaagguaagagauuagaaccaagcugggcuagcgucaagaaagacuuaauuaguuacgggggcgguuggaggcuucagggaucuuggaacaccggagaagaggugcaagugaucgcaguagagccugguaaaaaucccaaaaacguccaaacagccccgggaacuuuuaaaacuccggaaggagaaguuggggcgaucgcauuggauuuuaaaccgggaacaucagggucaccaauaguaaauagagaagguaaaauaguagggcuuuaugggaacgggguaguaaccacaagcggaacguauguaucagcaaucgcacaagcuaaggcgucucaggaagguccuuuaccagaaauagaggaugagguauuccggaagcgaaauuugacgauuauggauuuacaccccggaucaggaaaaacacgucgauaccuaccagcaauagucagggaggcaaucaagagaaaauuacgcacgcuaauucuagcaccaacucguguuguagccagcgagauggccgaagcucuuaagggaaugcccauuagguaccaaacuacggcuguaaaaucagaacauacagguaaagaaauaguggacuuaaugugucaugcuacauuuaccaugaggcugcuuucaccagucagaguuccgaacuauaauaugauaauaauggacgaggcucacuuuacggacccgucgaguauugcagcuaggggguauauuucaacccgagugggcaugggugaagcggcggcgauauucaugacagcuacaccacccggaucaguugaggcguucccucaaagcaaugccguaauccaagaugaagaaagagauauaccugaaagaucauggaacucaggauacgaauggauuacagauuuuccagguaagaccguaugguuuguacccaguaucaaauccggaaaugacaucgccaauuguuugcgcaaaaacgguaaacgaguaauacaauuaucacgaaagacauucgacacagaauaucagaaaacgaaaaacaaugauugggacuacguaguuacgacggauauaagugagaugggugcuaacuuucgugcugaucgaguuauagauccaagaagauguuugaaaccuguuauucugaaagauggaccagaacgcguuaucuuggcuggcccaaugcccguuacaguugcaagugcagcacaacgccgaggacgcauaggaagaaaccauaauaaagaaggugaccaauauauuuacaugggucaacccuugaacaaugaugaggaccacgcacauuggacugaagcaaagaugcuucuagauaacauaaauacgccggaaggaauaauaccugcauuauuugaaccugaaagagaaaagucagcagcgauagauggcgaguacagguuaagaggagaagcaagaaaaacauucguggaguugaugagacgaggugauuuaccaguuugguuaucauacaaaguagccagcgaggguuuccaguauucugaucguagaugguguuuugauggagagcgaaauaaucaagugcuagaagaaaacauggacguugaaauauggacgaaggagggagaaaggaagaaauuacgaccucgaugguuagacgcuagaacguauucagauccacuugcacucagagaguucaaagaguuugcugcaggcagaaggagcgucucaggagauuugauauuggagaucggaaaacuuccgcaacaucugacucaacgggcacaaaacgcgcucgauaaucuagucauguuacauaauagugaacagggagguagggcuuauagacacgcaauggaagaacugccugauacaauugaaacauugauguugcuugcucuaauagcuguucugacaggaggcgucacauuauucuuuuuaaguggaaggggucuagguaaaaccagcauaggauugcuguguguuauggcaaguaguguucuuuuguggauggcuucaguggaaccccauuggaucgcagcaucgauaauacuugaauuuuuccuaaugguacuacuaauuccagaaccagauagacaacgaacaccucaggacaaucagcuagcauacguuguaaucggucuguuauuuaugauccuuacgguagcagcaaaugagaugggacugcuugaaacuacaaagaaagaccucggaauaggucacguugccguagaaaaccaucaucacgcuacaaugcuugauguagacuuacauccugccucagcuuggacauuguaugccguagcaacaacgauuaucacaccuaugaugcgucacacuauagaaaacacuaccgcaaauauuagccuuaccgcaaucgcaaaucaggcugcaauauuaaugggcuuagacaaaggauggccaaucucaaaaauggauauagguguacccuuauuagcacuagguugcuacagucagguaaauccucucacccuuacggccgcagugcuuauguuaguugcacauuacgccauuauuggaccagggcuacaagcaaaagcaacacgcgaagcucaaaaacgaacagcagcuggaauaaugaaaaauccaacaguagacggaauaguagcgauugaucucgacccgguaguguaugacgcaaaauucgagaaacaacuagggcaaauaaugcuucuaauucuauguacuagccaaauauuacucaugcggacuacaugggcguugugugagucuauaacguuggcuacaggcccauuaaccacauugugggagggaagcccggggaaauucuggaacaccacaauagcgguaagcauggcuaacauauuucguggaaguuaucuagcuggggcgggguuggcuuucucauuaaugaaaucauuaggagggggucguagagggacgggagcacaaggagagacccuuggagaaaaauggaagcgucaacucaaucaacucaguaaaucggaguuuaacacguacaagcguucagggauaauggaaguagaucguucggaagccaaggaaggaguaaaacguggggaaacaacaaaacacgccguuucacggggaacagcaaaauugcgaugguucguugagaggaaucugguaaagcccgaagguaaagucauagacuuaggaugcggccgcgguggauggucguacuauugugcaggccucaaaaagguaacagaagucaaggguuauaccaaagguggaccuggucaugaggaaccgauccccauggcaacauauggauggaacuuggugaaauuacacucgggcaaagacguauuuuucacaccuccagaaaagugugacaccuuacugugugauauaggggaauccucacccaauccuacgaucgaagaagggagaacucugcgaguuuugaaaaugguagaaccaugguugcgagguaaucaauuuuguauaaaaauacuuaauccuuauaugcccucaguuguagaaacccucgaacaaaugcaaaggaaacauggcgguauguugguuagaaacccguugagccgaaauucaacucaugaaauguauuggguaagcuguggcaccgggaacaucgucagugcuguaaacaugacaucuagaauguuauuaaauagauuuacaauggcgcacagaaaaccaacuuaugaacgcgaugucgaucuaggggccggaacgcgccacguggcuguugagccagaaguggccaauuuagacauaauuggccaacgcauugagaauaucaaacacgaacauaaguccacauggcauuaugaugaagauaaucccuauaaaacaugggcauaucauggaucauacgaagugaaaccauccgguucagcaucaagcaugguuaauggagugguaaaauuguuaaccaaaccaugggacguuaucccuaugguuacacagauugcgaugaccgauacaacaccguucggacaacagaggguuuucaaagaaaaaguagacacccggacgccuaaagcaaaaagaggaacugcacaaauaauggaagugacagcgaggugguuaugggguuucuuaaguagaaacaaaaagccuaggauauguacaagggaggaguucacacgaaaaguacgguccaaugcagcuaucggagcaguguuuguagaugaaaaucaauggaacucugcuaaagaagcaguagaagacgaacgcuuuugggaucuaguacacagagagcgagaacuacauaaacaagggaaaugugcuacauguguauacaacaugaugggaaaacgggagaaaaagcuaggugaguucgguaaagcacccgaaaguagggcaaucugguacauguggcuuggcgcaagauuccuagaguucgaagcacucggauuuaugaaugaagaccauugguucuccagagaaaacagcuuaagcggcguagaaggagagggacuacacaaauuagguuacaucuuacgagauauaagcaaaauaccugguggcaauauguaugcagacgacacugcaggcugggauaccaggauaacagaagaugaucuacaaaacgaagccaagauuacggauauuauggagccagaacacgcucuccuagcaaccucaauauucaaacucacauaucaaaacaaaguggugagagugcaaagacccgcgaaaaacggaacaguaauggauguaauaucgagacgagaccagcgcgggagcgggcaaguagguaccuaugggcuuaacacauuuacaaacauggaagcacaacuuauucgacagauggaaagcgaaggcauuuucuccucuucugagcuagaaacacccaaucuugcagaaagaguacuagacuggcuugggaaguacggagucgagagauugaaaagaauggccauaucuggugacgauugcguaguaaaaccuauugaugaccgauuugcaacagcauugacugcgcucaaugacguuggaaaggucagaaaagacaucccacaaugggaacccucgaagggauggaacgauuggcaacagguacccuuuugcucgcaucacuuccaucagcuaauuaugaaagaugggcgagaaauagucgucccaugucgcaaucaagacgagcuaguugggagggcacgagugagccaaggcgccggcuggucucuccgugaaacagccuguuuggguaaaaguuaugcacagauguggcaacugauguacuuucauagacgggauuugagacuagcugcaaacgcgaucuguucagcuguuccaguagauuggguucccacuucuagaaccacuuggucaauucaugcucaucaccaauggaugacgaccgaagauauguugaguguuuggaacagaguuuggauugaagagaauccguggauggaggacaaaacacaugucucaucguggggagauguuccauaccuaggaaaaagggaagaucaguggugcggauccuugauaggauugacagcucgagcaacaugggccacgaauauucaaguagcaauaaaccaggucaggcguuugauugguaaugaaaauuacuuagauuauaugacuucuaugaaacgauuuaagaaugaaucugacccagaaggagcacucugguaa

SEQ ID NO: 21079 - RNA, 9879 nt, Artificial Sequence
  derived and/or modified CDS sequence (opt6) from DENV-1__AB608788__SS-prME
ucaguaacgauguuguuaauguuauugccaacagucuuagcauuucauuuaacuacucguggaggagaaccacacaugauaguaacgaaacaagaacgcgguaaaagucuacuauucaaaacguccgcuggcguaaauaugugcacauugauagcuauggaccugggugaauugugugaagauacuaugacuuacaaaugcccuagaauaacagaagcagaaccugacgauguugacuguugguguaaugcaacagacacgugggugacguacggaaccuguagucaaacaggcgaacacagaagagacaaaaggagcguagcgcuagcaccacacgugggacuaggacuagaaacacggacggaaacauggaugucuagugaaggagccuggaaacaaauacaacggguagaaacuugggcuuuacgccauccuggauuuacaguaauugcuuuguuccucgcgcaugcaauaggaacaaguauuacgcagaaagguauaauuuuuauauuacuaauguuaguuacaccgagcauggcaaugagauguguuggaauaggaaauagagauuuuguugaaggacugucuggagcuacuuggguugacguugucuuggaacacgggagcugcguaaccaccauggcuaaagacaaaccuacuuuagauauagaacuacuaaaaacagaagucaccaauccagcaguguuaaggaaauuaugcauagaagcaaaaauuucaaauaccaccacggauucacgcugcccuacucagggugaagcaacgcuagucgaggaacaggaugcaaauuucguaugucgucguacuuuuguagaccggggauggggcaauggcugcggguuauuuggaaaaggaagucuaauaacgugugccaaauucaaauguguaacgaaacuugaaggaaaaaucguucaguaugaaaaucucaaauauucaguuauagugaccguccacacaggugaucaacaccaaguugggaacgagaguacagaacacgggacaacagcuacgaucacaccacaggcgccaacaucagaaauacaguuaacugauuauggcgcucucacacuagauuguucgccacgcacaggccuugauuuuaaugaaaugguacuacugacaaugaaagagaaaaguugguugguucauaaacagugguucuuggacuugccacuuccguggaccucuggggcuacuaccagucaagaaacuuggaacagacaagaucucuuaguuacuuuuaaaacagcacacgcuaagaaacaagaagugguuguucuagguucacaagaaggcgcuaugcacacagcauuaacaggggcuacggaaauacaaacaagugguacaacaacuauuuucgcagggcauuuaaaauguagacuaaaaauggauaaauuaaccuugaaaggaaugucguauguaauguguacaggcucauuuaaacuagaaaaagaaguagcagagacacaacacgguacaguuuuaguacaaguaaaauacgaagggaccgacgccccgugcaaaauaccguucucuacucaagaugaaaaagguguuacucaaaacggaaggguaauaaccgcaaauccuauaguaacugacaaagagaaaccagucaacaucgaagcugaacccccuuuuggugaaaguuacauaguaguaggcgcaggcgaaaaggcacuaaaacugaguugguuuaagaaagguucuacuauaggaaaaauguucgaggccacagcgcgcggugcucgacggauggcuauacugggcgauaccgcuugggauuucgguaguauaggaggcgucuucacaagcgucggaaaauuaguucaucaaauauuuggaacugccuacgggguauuauuuagugguguaaguuggaccaugaaaauagguauagggguacucuugacgugguuaggccuuaauucacgaagcacuagcuuaagcaugacguguauagcagugggccuaguuacccuuuacuuaggagugaugguccaagcagauagcggcuacgucauuaacuggaaggggagagaacuuaaaugcgggaguggcauuuuuguuacaaaugagguccauaccuggacugagcaguacaaauuccaagcugacucgcccaaaagacuaucugcggcuauaggaaaggccugggaagaaggaguguguggcauucgauccgcaacucgacuugaaaauauaauguggaaacaaauuucgaaugaacuuaaucacauacuccucgaaaaugauaugaaauuuacaguagucguaggugacguaucaggaauccuggcgcaggguaagaaaaugauuagaccacaacccauggaacauaaauacagcuggaaaaguugggguaaggcgaaaauaauaggugcagauguccaaaauucaacauuuauaauugauggaccaaacacgccagaauguccggaugaucaacgugcauggaacauaugggaaguggaagacuauggguucggaaucuuuacuaccaauauuuggcuaaaauuaagagacucauauacccaggucugcgaucaucgcuuaaugagugcggcaauaaaagacaguaaagcaguucaugcggauaugggauacuggauagagucagaaaagaacgaaacuuggaaacuugcucgggcaucguucaucgaaguaaaaacauguguguggccaaaaagccauacucuuuggucuaaugguguauuagaaucugaaaugauaaucccaaaaauauacgggggcccaauaucacagcacaacuaccguccuggauacuucacacaaacuucggguccauggcaucugggaaaacuagaacucgacuuugaccuaugugaaggaaccaccguaguaguugaugagcacuguggaaaucgcggcccgucacuaaggacaacaacaguuacuggcaaaauuauacaugaauggugcuguagaucauguacauugccaccucugcgguuuaagggagaagacgguugcugguauggcauggaaauucgcccaguaaaagaaaaagaagaaaaucuagugaaaaguauggucagugcaggaaguggagagguugauucuuuuucucucggucuguuaugcauuucuaucaugauugaggaggucaugcgaucucguuggagccggaaaauguuaaugaccgggacuuuagcaguauuucuacuacucauaaugggacaauuaacauggaacgaucuuauaagguuaugcauuaugguuggagccaaugcauccgaccgaaugggaaugggaacaacuuacuuggcacuuauggcuaccuuuaaaaugagaccaauguucgcaguaggauuacucuucagacgauugacaucacgugaagucuuacuauuaacuauaggcuuaagccuaguugcaucuguagaacuucccaacucuuuagaggaacuaggagauggauuagcaaugggaauaaugauacugaagcuacucaccgauuuccaaagucaucaguuaugggcagcccuauugucccuaacguucauaaagacaacauuuucucuacauuaugcguggaaaacuauggccaugguacuaagcauuguuuccuuauucccgcucugucuaagcacaaccagucaaaagacuacuugguuaccgguacuucuagguucgcuuggcugcaaacccuuaacgauguuucuaauagcagaaaauaaaauauggggacguaaauccuggccucucaaugaaggaauaauggccguuggaauaguuucgauacuucuuaguaguuuacucaaaaacgacguuccacuagcgggaccauuaauagcugggggaaugcuaauugcauguuacgucauaagcgguucuucggcggaucuaaguuuggaaaaagcagccgaaguaagcugggaagaggaagcagaacauucgggcgcaucacauaauauccuaguugagguacaagaugacggaacaaugaagauuaaagaugaagaacgugacgacacacuuacgauauuacucaaggcaacgcuccuugcagucucaggaguauauccucuguccauccccgcgacccuauuuguuugguauuucuggcagaagaagaaacaacgaagcggggucuuaugggacaccccaucgccucccgaaguugaacgcgccguauuagaugauggaauauacagaauuaugcaaagaggauuauuagguagaucucaaguuggggucggaguuuuucaagaaaauguauuucauacaauguggcauguaacaaggggagcgguacugauguaucaaggaaagcgccuggaacccucaugggccagcguaaagaaagauuuaaucucauacgguggcggcuggcgacuucaagguaguuggaacacaggggaagaaguucagguuauugcaguugaaccugguaaaaaucccaaaaauguucaaacggcaccgggaacuuuuaaaaccccugagggagagguaggagcuauagcucuggacuucaaaccagguacaagcgggagucccaucguuaauagggaggggaaaauagucgggcuauaugguaacggcguuguuacaacaagcgguacauacguaagugcaauugcacaggcuaaagcuagucaggaaggaccccuuccagaaauagaagaugaaguuuuuaggaaaaggaauuuaacaauaauggauuuacacccgggaagcggaaaaaccagacgauauuuaccagcaaucguuagagaagcaauaaaacgcaaacuacgaacauugauccuagcaccuacaaggguaguugccagugagauggcagaagcacugaaagguaugccaauccgauaucaaacgacggccgugaaaagcgaacacacuggaaaagagauaguagauuugaugugccacgcaacguucacuaugagacucuugagucccguaagggugcccaacuauaauaugauuauuauggacgaggcacacuuuaccgacccaaguagcaucgcagcgagaggguacauuagcacuaggguugguaugggggaagcagcagcuaucuuuaugacagcaacaccaccuggaagcguagaagcauucccacaaucgaaugccguaauacaagacgaagaaagggauauaccagaaaggucuuggaauagcgguuaugauuggauuacggauuucccagggaagacagucugguuugugccaucuaucaaaucaggaaaugacauagcgaauugccuaaggaaaaauggaaaaagaguaauacaacuaucccgaaagacauuugacacugaauaucagaaaacuaaaaauaacgacugggauuauguagugacaacugauauauccgagaugggagcuaacuucagagcugauagaguaauagauccgcgaagaugucucaagccgguaauacuaaaagauggaccugagcgaguaauauuggcuggaccaaugccugugacagucgcgagugcugcgcagcguaggggucgaauaggccguaaucaaaauaaggagggcgaucaauauauauacaugggacaaccucuaaacaaugacgaagaucacgcucauuggaccgaagccaaaauguuauuagauaauauaaacacacccgagggaauaauaccagcacuuuuugaaccagaacgugaaaagucugcagcuauugacggggaauauagacucagaggugaagcccgcaaaacauucguugaauugaugcgacggggagauuuaccaguuuggcuaaguuacaagguagcaagugaggguuuucaguacagugaucguagauggugcuuugacggugaacgcaauaaucaaguuuuagaagaaaacauggacguagaaaucuggaccaaagaaggagaacguaaaaaguugcgaccacgaugguuagacgcaagaacauauagcgauccacuugcacuacgcgaguucaaggaguucgcggccgggcgccgaucagugucaggggaucucauacuagaaauaggaaaacuaccucaacaccuaacgcagagggcacaaaacgcccucgauaaccucguuauguuacacaauucagaacaaggaggacgagcauacagacaugcaauggaagaacuacccgauacaauugaaacauuaaugcuucuagcuuuaauagcaguacuuacggguggcguaacucuauucuuucuaaguggaagaggauuaggaaaaacgucaauuggucuguuguguguuauggcaucuagcguacuguuauggauggcgucuguugagccccacuggauagcugcgagcauaauauuagaauuuuuccuaaugguucuuuugauaccugaaccagauagacaaaggacuccccaagauaaucaauuggcauauguagugaucggacuucuuuuuaugaucuugacgguagcggcuaaugaaauggguuuacuagaaacaacuaagaaagacuuggggaucggacacguagccguagaaaaucaccaccaugcaacaaugcuugauguagauuugcauccagcuucugcuuggaccuuauaugcaguagcuaccacaauaaucaccccaaugaugagacauacuauagaaaauacuaccgcuaacauaucccugaccgccaucgccaaccaagcggcaauauuaauggguuuagacaaaggguggccuauaucuaaaauggacauagggguaccccuauuggcacuaggauguuauagccagguaaaucccuuaacuuuaaccgcggcgguauuaauguuaguagcccacuacgccauuauagguccuggccuucaagcuaaagcgacgagagaagcccagaaaagaaccgcggcuggcauaaugaaaaacccaacaguagauggaauuguagccauagauuuggauccggucguguaugacgcuaaguuugaaaagcaauugggccagauuauguuguuaauucuauguacuucucagauuuuauuaaugcgaaccaccugggcacuaugugagucaauaacucuagccacaggaccauuaacaacgcuaugggagggaagcccagguaaauuuuggaacaccacaauugcaguaucaauggcaaacaucuuccgggggaguuauuuagcaggagcaggacuugccuuuagccuaaugaaaucucuaggaggggguaggagaggaacgggggcgcaaggggaaacgcuaggggagaaguggaagcgacaacuaaaucaacuaagcaaaagcgaguuuaacacuuacaaacggagcggaaucauagaaguggacaggucggaagccaaggaaggauugaaacguggugaaacaacuaaacaugcagucaguagaggcacggcaaaauuaagaugguucguggaacgaaauuuaguuaagcccgagggaaaagucauagaucuagggugcggaagaggugguuggagcuauuacugcgcuggucuuaagaaaguaacagaaguaaagggguacacaaaagguggagcgggacacgaagaacccauaccgauggcaacuuaugguuggaaucugguuaaauuauacagugguaaagauguauucuuuacuccuccugaaaaaugugauacucuucuuugugacauuggagaaaguucgcccaauccaacgaucgaggaaggcagaacuuuaaggguacucaaaaugguagaaccuuggcuucgaggaaaucaauuuugcauaaaaauccugaaccccuauaugccgucaguaguggagacgcuagaacaaaugcagaggaagcauggggguaugcuagucaggaauccacuuucaagaaacaguacacaugagauguauuggguaaguugcgguacuggcaauauaguaagcgcgguaaauaugacaagccgaauguuacucaacagauuuacaauggcacaccgcaagccgaccuacgaacgugauguagauuuaggggcaggaaccagacauguugccguggagccggaagucgcaaauuuagacauuauaggacaaagaauagaaaacaucaagcaugaacacaaaucuacauggcauuaugaugaagauaauccuuacaagacaugggcuuaccauggcucguaugagguuaagccgagcgguagcgcaucaucaaugguaaacgguguugugcgucuacucacgaaaccaugggauguuaucccaaugguuacccaaauagcaaugacagauacaaccccauuuggacaacaacgaguauuuaaagagaaaguagacacacguacgccaaaagcuaagcaaggcacagcucaggucauggaaguaacugcgagguggcucuggggcuuuuugaguaggaauaagaaaccaagaauauguacucgagaagaguucacgagaaaggugaggagcaaugcagcaauuggagccguuuucguggacgaaaaccaauggaacucugcaaaggaggcaguggaagacgagagauucugggacuuaguacacagagaaagagaauuacauaaacaagguaaaugugcuacuugcgucuauaacaugaugggaaagagggagaaaaaguuaggagaguucgguaaggcaaaagguuccagggcuauuugguauauguggcuaggagcucguuuucuagaguucgaggcacuugguuuuaugaacgaagaucacugguucucaagagaaaauagucuaaguggagucgaaggagaagguuugcaucggcucggauacauacucagagauauuucaaaaauaccuggaggaaacauguaugcugaugauacagcaggaugggauaccaggauaacugaagacgaucuucaaaaugaagcaaaaauaacggacauuauggaaccugagcaugcgcuguuggcaacgucaauauuuaaauuaacuuaucaaaacaaaguugucagaguccagagaccagccaaaaaugguacaguaauggacgugaucucgaggagagaucaaagaggauccggacaaguaggcacauacgguuugaacacauuuacgaauauggaagcccaacuaauaagacagauggaaucagaagggauauuuagcccaagcgagcucgagacaccgaaucuugcagaacgaguuuuagauuggcuugaaaaauacggaguugagagacuuaagagaauggccauauccggagaugauuguguugucaaaccuauugaugacagauucgcaacugcuuuaacagccuugaacgauaugggaaaaguacguaaggacaucccucagugggaaccaaguaaagguuggaaugauuggcaacaagucccguucugcucgcaucauuuccaccaauuaauaaugaaagauggaagagaaaucgucguaccuuguagaaaccaagacgaguuaguggggagagcacgagucucacagggagcagguuggucauuacgggaaacggcauguuuagggaaaagcuacgcgcaaauguggcaguuaauguauuuucaccgccgagacuuacgacuagcagcuaacgcgaucuguucggcuguaccuguagauuggguucccaccagccgaacuacuuggucaauucaugcucaucaucaauggaugacgacagagaauauguuaucgguauggaauagaguauggauugaagagaauccauggauggaagauaagacgcauguauccagcugggaggauguaccauaccuagggaaacgagaggaucaaugguguggaucucuaauuggcuuaacagcgagagcaacaugggcuacaaauauucagguggcuaucaaccaagugaggcgacuaauaggaaaugaaaacuaccuagauuacaugacaaguaugaagagguucaaaaaugacucugauccugaaggcgcuuuaugguaa

SEQ ID NO: 21080 - RNA, 9879 nt, Artificial Sequence
  derived and/or modified CDS sequence (opt6) from DENV-1__AB608786__SS-prME
agcguuacgauguuauugaugcucaugccuacagcacuagcauuucaucugacaaccagaggaggggaaccucacaugaucgucucaaaacaggaaagaggaaaauccuuacucuucaaaacaucugcugguguaaauaugugcacauuaauugcaauggauuugggagaauuaugugaagauacaaugaccuacaaguguccaagaauaacggaaaccgaacccgacgacguggacugcugguguaaugcaacagacaccuggguuacauauggaacauguagucaaacaggagaacacaggcgagauaaaagguccguugcauuagcuccacacguuggacuaggucucgaaacaagaacagaaacuuggauguccucggaaggagccuggaaacaaauucaaagaguugagacuugggcccucaggcacccaggauuuaccguuaucgcguuauuucuagcccacguaauaggaacgaguauuacccaaaagggaauaauauucaucuuacuaaugcuuguaacucccagucuagcgaugagguguguaggaaucggaucuagggauuucgucgagggauugucuggagcgaccuggguugacguaguacuagaacacgguucaugugucacgacgauggcgaaggauaagccuacucuggauauugaauuauuaaaaacugagguaaccaauccggccguucuaagaaagcucugcauagaagccaaaauaaguaauacuacaacugacucaagaugucccacucaaggggaggccacguuggucgaggagcaagacgcgaauuuuguuuguagaagaacauucguggacaggggaugggguaauggcugcggacuauuuggcaaggguucccuuauuacaugugcuaaauuuaagugcguuacaaaacucgaaggaaaaauaguucaguacgaaaaccucaaauacucagucauagucacagugcacacaggugaucaacaucaaguagguaacgaaaguacagaacauggaaccaccgcgacaaucacuccucaagcaccaacaacagaaauucaacucacugauuauggugccuugacuuuagacugcucaccaagaacuggucuagauuucaaugagaugguuuugcuaacaaugaaggagaaaagcugguugguccacaaacaaugguuuuuagaucuaccccuuccauggaccagcggggcuucgacuucacaggaaacuuggaacagacaggauuuacucgugacauuuaagaccgcgcacgccaagaaacaagaagugguaguauugggcagucaggaaggagcgaugcacaccgcucuaacaggcgcaaccgaaauacaaacaaguggcaccacuacaauauuugcagggcacuuaaagugcagguugaagauggauaagcucacacuaaaaggaaugucauacgucauguguacugguuccuucaaauuagaaaaggaaguggcugaaacacaacacggcacaguauugguccaaauuaaauacgaaggcacugaugcaccaugcaaaauacccuuuucaacacaagacgaaaaaggcguaacacaaaacggacgauuaauaacggcaaacccaaucguuaccgacaaagaaaaaccuguaaauauugaggccgagccgcccuucggagagucguacauuauuauaggugcgggugaaaaggcauuaaagcucaguugguuuaagaaaggaaguucuauaggaaaaauguucgaagccacugcuagaggggcaaggcggauggcgauauuaggagauacggcuugggacuuugggaguauuggaggaguauuuacuuccgucgguaaguugguccaucaaauuuuuggaacugcguacgggguucuauuuucaggugucucauggaccaugaagauagguauaggaguauuauuaacuuggcucggcuuaaauaguagaaguacgagcuuauccaugaccugcaucgcaguaggccuugucacacuguacuugggaguuaugguucaagcagacuccgggugcguaaucaauuggaaggguagagagcugaagugugguaguggcauauuugucacgaacgagguucauacauggacggaacaguauaaauuucaggccgauaguccgaaacgcuuaucugcagccauaggcaaagcgugggaagaagguguuuguggcauucguucagcuacucgacuagagaauauaauguggaagcaaauaaguaacgaacucaaccauauacuauuagagaacgauaugaaguuuaccguaguaguuggagacguugcaggcaucuuagcgcaagguaagaaaaugauuaggccacagccaauggaauacaaauauuccuggaagucaugggguaaagcgaaaauaauuggagcggacguacaaaacacaacuuucauuaucgaugggcccaauaccccugaaugcccugaugaucaaagggcuuggaacauaugggaagucgaagauuauggcuucgguaucuuuacuacuaauaucuggcuuaaacuacgcgauucuuauacucaagucugugaucaucggcuuaugagugcugcuauaaaagacaguaaagcaguucacgccgauaugggcuauuggauagaaucagagaaaaaugaaacuuggaagcuagcacgggcgagcuucauugaagugaaaacgugcauuuggccaaaaagucacacucuuuggagcaaugggguacuugagucagaaaugauuaucccaaaaauauauggcgggccaauuucucaacacaauuauaggccaggauacuucacccaaaccgcugguccauggcaccuggguaaacuugaacuagauuuugaucugugcgaagggaccacaguagucgucgacgagcauugugguaauagagggccaaguuuaaggacgacaacagucaccggaaaaauuauacaugaauggugcuguagaaguuguacccuuccacccuuaagauuuaggggugaagacggauguugguauggcauggaaauaaggccugucaaagaaaaagaggaaaacuuaguaaaaucaauggucucagcagggucaggcgaagucgauuccuuuucguugggguuguugugcauaagcaucaugauagaagaaguuaugaggagcagauggagucggaaaaugcuaaugacggguacacucgccguguucuuucuacucauaauggggcaguugacuuggaacgauuuaauacgacugugcauaaugguaggugcaaaugcaagcgauagaaugggaaugggaaccacguaccucgcacuaauggcuaccuuuaagaugagaccaauguuugccguugguuuacucuuuagaagacucacuucuagagaaguauuacuauuaacaauaggccuuaguuugguggcgucaguagaacuaccaaauaguuuagaagaacucggagauggucuagcuauggggauaaugauuuugaaauuacuaacggacuuucaaucacaucaauuaugggcaaccuuacucucgcuaacguuuauaaaaacuacauuuucauuacauuaugcuuggaagacgauggcaaugguauugagcauaguuucucuuuucccauuauguuuaucaacaaccucccaaaagacuacuugguugcccguauuacuaggaucacuuggauguaaaccccuuacaauguuccuaauagcagaaaauaaaaucuggggacggaaaucauggcccuuaaaugaaggaaucauggcggugggcauaguaaguauauugcucucuucacuucuaaagaaugacguuccacuagccggccccuuaauagccgguggaauguuaaucgccuguuaugugauuuccggaucuagcgccgaccucagccuagaaaaagcagccgaaguuucaugggaggaggaagcugaacauucaggggcgucucauaauaucuuaguugaaguacaggaugaugguacaaugaaaauuaaggacgaagaacgcgacgacacacuaacaauauuacuaaaagcaacacucuuagccgugucaggcguuuauccuuuaaguauaccugcaaccuuguucgucugguacuucuggcagaagaagaaacagcgcucugguguauuaugggauacgccgucgccaccagaaguugaaagagcuguauuagacgauggcaucuauagaaucaugcaaagaggcuuacuaggacgcagccaaguaggugucggaguguuccaagagaacguguuucauacaauguggcacguaacuagaggugcaguacuuauguaccaagguaaacgacuagaaccuucaugggcuucaguuaagaaagaccuuaucucauauggcggaggguggagacuucaaggaucuuggaauacaggagaagaaguucagguaaucgccguagaacccggcaaaaaucccaaaaauguccagacagcgcccggaaccuuuaaaacuccagagggagaaguuggggcaauugcacuggauuucaaaccuggaacgagcgggucacccauaguuaauagggaaggaaaaaucgucggguuauaugguaacggaguaguaacaaccagcggcacauacguuagcgcgauagcucaagcaaaagcaucacaagaagguccucuaccggaaaucgaagacgagguauucagaaaacgaaaucuaacaaucauggaucugcacccaggauccgguaaaacuagacgguaucuaccugcgaucguacgcgaagcuauuaaacggaaacuucggacacugauucuagcaccaacgcgggugguggcaagcgaaauggcugaagcauuaaaaggaaugccuauaagauaccaaacaacagccguaaaaagugagcauaccggcaaagaaaucguugauuugaugugccaugcaacauuuacuaugaggcuacuaucuccggucaggguaccaaacuacaacaugauuaucauggaugaagcccauuuuaccgauccuaguuccauugcagcgagaggauauauaucgacgcguguagggaugggagaagcagcggccauauuuaugacagcgacgccuccuggcagcguggaggcauuuccucaaucuaaugcgguuauccaagaugaggaacgagacauaccggagagaucauggaacagcggauacgaauggauaacugacuuuccuggaaagacgguuugguuugucccguccauuaaaagugguaacgauaucgcgaauugccugagaaagaacgguaaacgaguaauacaacucagucgaaaaacauuugacacggaguaucagaaaacuaaaaauaacgacugggauuacgucguuaccacagacaucagcgaaaugggcgcaaacuuccgcgcugacagggugauagacccaaggcgguguuuaaagccaguuauauuaaaagaugguccagaacggguaauauuagccgguccgaugccugucacaguugcaucggcagcgcaaaggagaggaaggauagggcguaaccacaacaaagagggagaccaauacauauauauggggcaacccuuaaauaaugaugaagaucaugcacacuggacagaagcgaagauguuacuggauaauauaaacacaccugaagggauaauuccagcucuuuuugaacccgaaagagagaaaagugcugcaauagacggugaauaucgauugagaggagaagccagaaaaacauucguugaacuaaugcgacgcggggaucucccaguauggcuaagcuacaaaguagcuagugaagguuuucaauacagugaccguaggugguguuucgauggugagagaaauaaucaaguacucgaggaaaacauggauguagaaauauggacuaaagaaggcgaaaggaagaaacuucgccccagguggcuagaugcaagaacauauucggauccauuagcucuaagagaguuuaaagaauuugccgcuggucgaagaucaguuucgggugacuugauauuagaaauagggaaauugccccaacacuuaacacaacgagcccaaaaugcacuagauaacuugguuaugcuucacaauucagaacaaggugggagagcauaccgacaugcuauggaagaauuacccgauacaaucgaaacacuuaugcuuuuagcgcuaauagcuguucuaacgggagggguuacauuguucuuuuuaagugggcgcggcuuaggcaaaaccucuauaggccuguugugcgucauggcgucuucugugcuacuuuggauggcaaguguugaaccgcauuggauagcagcuagcaucaucuuagaauuuuucuuaaugguucuauugauuccggaaccagaccgccagcggaccccucaagauaaucaacucgcuuacguaguuauaggauuacuguuuaugaucuuaacuguagcugcaaacgagauggguuuguuagaaaccacuaagaaagaucucggaauaggccauguagcuguugaaaaucaccaccaugccgcaaugcuugaugucgaccugcaucccgcuagcgcauggacucuuuaugcaguagcaaccaccauaauuacgcccaugaugagacauacuauugaaaauacuacugcuaacaucucccuaacugcaauagcaaaucaagcagcaaucuuaaugggacucgauaaaggcuggcccauuagcaaaauggauauagguguuccgcucuuagcgcuaggaugcuauucgcaagugaauccauugaccuugacagcggcaguucuaauguugguagcacacuaugcaauaauaggcccuggccuacaggcuaaagcaacaagagaggcacaaaaacgaacugcggcgggaauaaugaaaaacccuacuguagaugguauaguagcaauagaucuggauccuguaguguaugacgcaaaauuugaaaaacaacuuggacagauaaugcuauuaaucuuaugcacuucacagaucuuacuaaugcgaacaacuugggcacuuugugaaucaauaacucuugccacgggaccauuaacgacacucugggagggcucaccaggaaaguucuggaauacaacaauugccgucaguauggcaaacauauuccgagguucauaccuagcaggcgcaggacuggcauuuucucugaugaaaucacuagguggagggagacgagggacgggagcucagggagaaacuuuaggcgaaaaguggaaacgacaacuaaaucaauugucaaagucagaauuuaauacguauaaaggcagcggaauaauggaaguagaccguucagaagcaaaagagggacuaaaaagaggcgagacaacaaagcaugcuguaaguagaggaaccgcaaaacuaagaugguuugucgaacguaauuuggugaagccugaaggaaaaguaauagauuuaggaugcgguagaggcggauggaguuauuauugcgcugguuugaagaaaguuacggaagugaaaggauacacuaaaggagggccaggacaugaggaaccaauuccgauggcgacauacggguggaaccuaguaaaauuacacaguggaaaagauguauucuuuaucccaccagaaaaaugcgacacuuuguuaugcgauauaggagaaagcagcccgaauccuacaauagaagaaggaagaacuuuacgaguguugaagaugguagaaccgugguuaagaggcaaccaauucugcauaaaaauccugaacccuuacaugcccucuguggucgagacacucgaacaaaugcagcgcaaacauggcgggauguuaguuaggaacccacuaucacgcaauagcacgcacgaaauguacuggguaucgugcgguacaggaaauauaguuagugcuguuaauaugaccucaaggaugcucuuaaaucgauuuacaauggcacaucgaaaaccuacguacgaaagagaugucgauuugggcgcuggaacacgacauguggcuguagaaccggaaguggcaaaucuugauauaauaggccaacgaaucgaaaauaucaaacaugaacauaaaucgaccuggcauuacgacgaagacaauccauauaaaacuugggcauaucacgguuccuaugaaguaaaaccauccgguagcgcaaguucaauggucaacggaguaguaaaauuauuaaccaaaccuugggacguaauaccaaugguuacccagauagcgaugacagauacgacgccauucggucagcaaagagucuuuaaagaaaaagucgauacccgcacaccgaaggcgaaaaggggaacagcacaaauaauggaaguuacagcgaaaugguuauggggauucuugucacgaaauaaaaagccuagaaucuguacuagggaagaauuuacucguaaaguacgaaguaacgcggcuauuggggccguguuuguugaugaaaaccaauggaacucagcgaaggaagcaguagaagacgaacgguucugggaucuuguucaccgggaaagggaacuacacaagcaaggaaaaugcgcgacauguguguauaauaugauggguaaaagagagaagaaacuaggagaauuuggaaaagcuaaaggaucuagagccauuugguauaugugguuaggagccagauuucucgaguuugaagcauugggauucaugaacgaggaccauugguuuucacgcgaaaauagcuuaucuggaguggaaggugagggguugcauaaacuagguuauauucucagggacauuaguaagaucccuggaggaaauauguaugcugacgauacagccggaugggauacaaggauaacagaagaugaucuucaaaaugaagccaaaauaacugacaucauggaaccugaacacgcuuuguuagcuaaaaguauuuuuaaacuaacguaccaaaacaaaguaguaagagugcagagaccugcgaagaauggcacggugauggauguaauuucgagaagagaccaacgagguagcggccaaguugguacauacgggcuuaacacauuuaccaacauggaggcccaacuaauccggcaaauggaaucagaaggaauauuuucuccuuccgaauuagaaacgccuaauuuggcugaaagaguccuugauugguuggaaaaguacgguguagagcgacuuaagcgcauggcuauaucaggagaugacugcguggucaaaccaauagacgaucgauucgcaaccgcucuuaccgcucuuaaugauaugggcaaaguaagaaaagacauaccucagugggagccuaguaaaggauggaaugauuggcagcaagucccguucuguagucaccauuuccaccaacuaaucaugaaagacgggcgugaaauagucguaccgugucgaaaucaggacgaacucguagggcgagcucgaguaucacagggugcgggauggucuuuaagagaaacagcaugucuaggaaaaucauaugcacagauguggcaacugauguacuuucauagaagagauuuaagauuagcugcuaaugcaauaugcagcgcuguccccgucgacuggguacccacgucccgcacgacauggagcauccacgcccaccaucaauggaugacuaccgaagauaugcuuuccguguggaauagaguauggauagaggagaaccccuggauggaggauaaaacgcauauuaguuccuggggagaugucccuuauuuaggaaaacgagaagaucaaugguguggcucauuaauaggcuuaacagcuagagcuacgugggccaccaacauucaaguagcaauuaaucaaguacgcagauuaauaggaaacgaaaacuaucuagauuauaugacgucaaugaaaagauuuaaaaacgaaucagaucccgaaggagcguuaugguaa

SEQ ID NO: 21081 - RNA, 9879 nt, Artificial Sequence
  derived and/or modified CDS sequence (opt6) from DENV-1__AB608787__SS-prME
aguguaaccaugcuauuaaugcugaugccgacagcauuagcuuuccaucucaccacacggggaggagaaccgcauaugauaguuagcaaacaagaaagaggaaaaucacuacuuuucaaaacaucagcuggugucaacaugugcacuuuaaucgcaauggacuuaggagaauuaugcgaagauacuaugacauauaaauguccuagaauuacagaagcagaacccgaugauguagauugcuggugcaaugccacugacacuugggucacguacggaaccugcucccaaacaggagaacaucgaagagacaaacgguccguagcucucgcuccucauguuggacuugggcuagaaacgcguacagaaacauggaugaguagugagggagcauggaaacaaauccaaagaguagaaaccugggcauugcgccauccaggauuuacagugauagcucuguuuuuagcucaugcgauaggaacuagcauaacgcaaaaaggcauaauauuuauuuuacucauguuaguuacuccuucaauggcaaugagaugcguugggauaggauccagagauuuuguagaaggauugucaggagcuacuuggguugauguuguauuagaacacgguaguuguguaaccacuauggccaaagacaaaccuacacuagauauagaacuuuuaaaaacugaggugaccaauccggcgguauuacguaaacuuugcauagaagcaaaaauaucuaacacaacuaccgacagucguuguccaacucaaggcgaagcaacccugguagaagaacaagaugcgaauuucguaugccgacguaccuucguugauagaggcuggggaaauggcugcggucuauuugguaaaggaucauugcuuaccugugcaaaauucaaaugcguuacuaaacuugaaggaaaaauuguacaauacgaaaauuuaaaauauuccguaauagugacggugcauacaggagaucagcaucagguagguaaugaaaguacagaacacgguacaacggcaacaauaacuccucaagcaccuacuacagagauacaacuaaccgacuauggugcgcucacacuagauugcuccccacggacaggcuuggacuuuaaugaaaugguauuauuaacaaugaaagaaaaaucauggcugguccacaaacagugguuuuuagaccuacccuuaccuuggacaaguggcgcauccacgagccaagaaaccuggaaucgacaggaccuccuaguaacauuuaaaacugcccacgccaagaaacaagaaguuguaguauuaggaagccaagaaggcgcuaugcauacagcgcugacaggcgcaaccgaaauucagacaucaggcacaacgacuauauucgccggacauuuaaaaugucgguuaaaaauggacaaacuaacucucaaagguaugucauauguaauguguacugguagcuuuaaacuggaaaaagaaguugcagagacgcaacacggaacgguacuuguucaaauaaaauacgaaggaacagaugcaccauguaaaauaccauucucaacucaggacgaaaaaggugucacucaaaacggucgauuaauaacagcaaaccccaucguuacagauaaagaaaaaccaguaaacauugaagcagaacccccuuucggcgagaguuauauaguaauaggugccggggaaaaagcguugaagcucuccugguuuaaaaagggcucaucaauugggaagauguucgaagcuacugcccgaggcgcgaggagaauggcaauacuaggugacaccgcgugggauuucggaaguaucggcgggguuuucaccucagucgggaaacucguccaucaaauauucgguacugcauacgggguacuauucagugguguaagcuggacuaugaaaauagggauaggaguacuccuuacaugguugggcuuaaacucacggaguacuucauuaucuaugaccuguauagcugucgggcuaguaacccuauauuuagguguuaugguucaggcagauucugguuguguaaucaacuggaaggggagagaacuaaaauguggaucugggauuuucguuacaaacgaaguucauaccuggacugaacaauauaaguuccaagccgacaguccaaaacgauugucagcggcaaucggaaaggccugggaagaaggagucugcgguauaagaagcgcuacgagauuagagaacaucauguggaaacagauaagcaaugaacucaaucauauacuccuagagaaugauaugaaauucacaguaguaguuggagacguagccggaauacuagcucaaggcaagaaaaugauacggccacaaccaauggaacauaaauauucuuggaaaagcuggggcaaagcgaaaauaauaggagcagauguacaaaauucgaccuucauaauagauggaccuaacacccccgaaugcccggaugaccagagagcuuggaauaucugggagguagaggacuauggauucggaauauuuacaacuaacaucugguuaaaauuacgugauagcuacacucaagugugugaucacagacucaugagugcugccauaaaagacaguaaggcuguacaugcugauaugggauacuggauagagucagagaaaaacgaaacauggaaguuagccagagccaguuuuauugaaguaaagacuuguauuuggccaaagucucauacgcuauggaguaaugguguucuagaaucggaaaugauuauccccaaaauauacgguggaccgauuucucaacacaauuaccgaccugguuauuucacgcaaacagcaggaccguggcacuuaggaaaacuggaacuagacuucgauuuaugugagggaacgaccguagugguugacgagcauuguggaaaccgaggaccuagcuugcgcacuacaacggugacugggaaaauuguucacgaauggugcuguagaucuugcacgcucccgccccucagguucaggggagaggauggguguugguacgguauggaaauuagaccugucaaagaaaaagaagaaaauuuaguaaaaagcaugguauccgcagggucuggugagguagacagcuuuagucuagggcuguugugcauuucaauaauuauugaagaagugaugcgaagccgauggauucgaaaaauguuaaugacuggaacacuagggguuuucuuccuacuuauaaugggucagcuuacguggaacgauuuaauacguuugugcauaaugguaggggcaaaugcaucggacaggauggguauggguacuacuuaucucgcacuaauggcuacauuuaaaaugagaccaauguuugcaguaggucuccuguuuagacgauuaaccuccagggaaguccuguuauuaacaauagggcuaucacuuguagcaucagucgagcuuccuaacucauuggaagaacuaggggacgguuuagcaaugggaauaaugauacugaagcuacuaacugacuuucaaucccaucagcuaugggccacacuauuaucauuaacuuuuauaaagacuacuuuuagucuacacuaugcguggaaaaccauggcaaugguauugucaaucgucucucuguucccacuauguuuaucaaccacgucgcagaaaacgacauggcuacccguauuauuaggaucucuaggguguaaaccauuaacaauguuccugauugcagaaaacaagaucugggguagaaagucauggccauuaaaugaggguauuauggccguagguauuguaaguauucuauugucaucacugcuuaaaaacgacgucccguuagcaggcccguuaaucgccggggguauguuaaucgcauguuacguaauuaguggaucaagugccgaccucagucuagaaaaagcggcagaaguaucgugggaggaggaagcagaacauuccggggcuucacauaauaucuuaguggaaguacaagacgacggaacuaugaaaauaaaggaugaggaaagagaugauacacuaacgauuuuacugaaagcaacucuauuagcuguuuccggcguuuacccacuaagcaucccagccacuuuauuuguaugguacuuuuggcagaaaaagaaacaaagaagcggaguucugugggacacaccaucuccuccugaggucgaacgcgcugugcuagaugacggcauuuaucgcauaaugcaaagagguuugcuaggaagaagucaggugggcguugguguguuccaggagaacguauuucauaccauguggcauguaaccagaggugcagucuuaauguaccaggggaaaagguuagaaccaucaugggcuucagucaagaaagacuuaauaaguuacggaggaggauggagauuacaaggaaguuggaauacaggcgaagaaguccaaguuauagccguagaaccaggcaaaaacccuaaaaauguacagacggccccaggcacuuuuaagaccccagagggcgagguaggcgcaauugcacuagacuuuaaacccggaacaucaggguccccuauugucaacagggaaggcaaaaucgugggacuauacgggaacggcguagucacaacaucugguacauacguaucugcaauagcucaagcgaaagccagccaagaagggccacuacccgaaauagaagaugaaguguuucgaaagaggaauuuaacaauaauggacuuacacccaggaaguggcaaaacgagaagauaccuaccagcuauuguaagagaagcuaucaaacguaaacuccgaacucuuauauuagcaccgacaagagugguugcgagcgagauggcagaagcauugaagggcaugccaauaagauaccaaacaacugccgucaaaucagaacacaccggcaaggaaaucguggacuuaaugugccacgccacuuuuacgaugcgacuauugucaccaguaagaguuccaaauuacaacaugauuauuauggacgaagcacauuuuacagaccccucaucaaucgcggccagaggcuauauaaguacucgagucgguaugggugaagccgcggccauauucaugacggcaacaccacccggcucaguugaagccuuuccucaaucgaacgcugugauucaggaugaagagagggacauaccugaaagaucguggaauagcggcuacgaauggauaacagauuucccagguaagacugucugguucgugccauccauuaaagcaggaaacgacaucgcaaacugucuaaggaaaaauggaaagcguguuauucagcuuagccguaagaccuucgauacggaauaucagaaaacuaaaaacaacgauugggauuacguaguaacuacugauauaucagaaaugggugccaauuuuagagcagauaggguuaucgacccgcgcagaugcuuaaagccaguaauucugaaagauggaccagaaagagugauacucgcuggaccuaugccaguuaccguugccucugcggcgcaaagacgcggccgaauaggucggaaccacaauaaagaaggcgaucaauacaucuacaugggacagccucuaaacaacgacgaagaccaugcccacuggacugaagcaaaaaugcuccuagauaacauuaauacaccagaaggcauaauaccagcacucuucgaaccagaaagagagaaaagugcugcaauagacggagaauaccgccuaagaggagaggcaagaaaaacuuuuguugaauugaugagaagaggggaucuaccuguauggcugaguuacaaaguugcuagcgagggauuccaauauagcgauaggcguugguguuucgacggagaaagaaauaaccaagucuuagaggaaaacauggacgucgagauuuggacgaaagaaggugagcgcaagaaauuaagacccagaugguuagacgcucguacuuauuccgauccacuagcucuccgagaauuuaaagaauuugcagcagggcgucgaucuguaucaggagaccugauucuagaaaucggcaaacucccacaacaccugacgcaacgagcacagaacgcauuggacaauuuaguuaugcuacauaauagcgaacaaggaggcagagcauauagacacgcaauggaagaacucccagacaccauugagacccuuaugcuacuugcucuaaucgcuguauuaaccggugggguuacuuuauucuuccugucgggcaaagggcuagggaaaacaagcauagguuuauugugcgugauggcaucaaguguauuauuauggauggcaucaguagaaccccacuggauagccgcgucuauaauucuagaguucuuucucaugguucuacugauacccgaaccagacaggcaaagaacaccacaagacaaucaauuggcauacguaguaaucggacuguuguuuaugauucuuacagucgcugcaaaugaaaugggcuuauuagaaacaaccaagaaagaccuugggauaggccacgucgcuguagaaaaucaccaucacgcagcuaugcuagacguagauuugcaccccgcaagugccuggacccuuuacgcuguagcaacuaccauaauuacacccaugaugagacauacaauagaaaauacgacugcgaacaucucucuaacggccauugcgaaccaagccgcgauccuaaugggcuuagacaaaggguggccgauauccaaaauggacauagggguaccuuugcuugcucuagggugcuauagucaaguaaaucccuuaacguuaacagcagcgguauuaaugcuuguagcacacuacgcuauuauagguccaggguuacaagcaaaggcuacccgagaagcccagaaaagaaccgccgcaggcauaaugaaaaacccgacuguagauggcauaguugcaauugaccuagauccaguugucuaugacgcaaaauucgaaaaacaacuggggcaaaucaugcuauuaauauuauguacaagucaaauacuucucaugcgaacaacuugggcauuaugugaaucaauuaccuuagcaacaggaccuuuaacaacacuaugggaagguuccccaggaaaauucuggaauacaacaaucgccgucagcauggccaauaucuuccguggaagcuaccuagcaggagcgggacucgccuucuccuuaaugaaaagccuuggcggagguaggcgaggaacaggagcacagggugagacgcuaggugaaaaguggaagagacaacuaaaucagcucaguaaaagcgaguucaauacauacaagggaucugguaucauggagguggauagaagcgaggccaaagaaggccugaaacguggggagacgacuaagcacgccguaagucguggaacugcaaaauuaagaugguuuguugaaaggaaucuugucaaaccagaaggaaaaguaaucgaucugggauguggaaggggcgguuggucauacuauugcgcaggacucaagaaaguaacugaagugaaaggauauacgaagggagggccaggccaugaagaaccaauuccaauggcuacauacggguggaaucucguaaagcuacauucaggaaaggauguauucuuuauuccaccugaaaaaugcgauaccuuacuaugugauauaggagaaaguagcccuaauccaaccauugaagaaggccgaacucuaagagucuuaaaaaugguagaaccauggcugaaaggcaaccaguucugcauaaaaauauuaaacccauacaugccuucaguuguagagacauuggagcagaugcaacgaaaacauggagguauguuaguucgaaauccguuaagccgaaacuccacacaugagauguauugggucucuuguggaacgggaaauauaguaagugcggugaacaugacaucgcgaaugcuacuaaauagauucaccauggcccacagaaaaccaaccuacgagcgugacguagaccuuggagcaggcacaaggcauguggcuguagaaccugaaguagcaaacuuagacauaauaggucaacgcaucgaaaauauuaagcaugaacacaagagcacuuggcauuacgacgaagauaacccauauaagacuugggcguaucacggauccuaugaagucaaacccucugggucugcaucaagcaugguaaauggagucgugaaacugcuaacaaaaccgugggaugucaucccaaugguuacucagauugccaugaccgauacaacaccguuuggacaacagaggguguuuaaggaaaagguugauaccagaaccccaaaagcgaaaagagggacugcacaaauuauggaagugacagccagauggcuuuggagcuuuuugagucggaacaagaaacccagaauaugcacaagggaagaauuuacccgaaaaguucgaaguaacgcugcuauaggagccguauuuguagaugaaaaccaauggaauagugcaaaagaagccguugaggacgaacgcuuuugggaccuaguacauagagaaagggagcuacauaaacagggcaagugugcuacauguguguauaauaugaugggcaaacgagagaagaaauuaggggaguuuggaaaagcaaaaggaaguagggccauaugguauaugugguugggggcaagauuccuugaauuugaagcgcucgguuuuaugaacgaagaucauugguucagucgugaaaauucucuuaguggaguagagggugaaggacuucauaagcucggauauauauugcgcgauauaucaaaaauaccggguggaaauauguaugcugaugacacggcggguugggauacacguauaacggaagacgacuuacaaaacgaagcgaaaauaaccgauaucauggaaccagaacaugcccuacuagcaaagucuauuuuuaaguuaacauaucaaaauaagguugugaggguucagcgacccgcuaagaacgggacagugauggacguuauuucaagaagagaucagcgcgguaguggccaaguugggacguauggucuaaauacguucacaaauauggaagcccaauuaauacgacaaauggaauccgaaggcaucuuuucaccuucggaacuagagacuccaaauuuggcggaaagagucuuagacuggcuggaaaaauauggaguugagcgucuaaaaagaauggcgauaucaggagacgauuguguaguaaaaccaauagacgacagguucgcaaccgcacucaccgcacuaaacgauauggguaaaguaagaaaagacauuccacaaugggaaccuagcaaaggauggaaugacuggcaacagguuccuuucuguagucaucacuuucaucaauuaauaaugaaagacggaagagaaauaguggugccguguagaaaucaggaugagcuaguaggacgggcccgaguaucacaaggggcuggauggucauuacgagaaacugcuugcuuagggaaaucguaugcucaaauguggcaauuaauguauuuucaucgccgcgaccugcgucucgcagccaacgcuauuugcagugcuguaccuguagacugggucccaaccagucguacaacgugguccauacaugcccaucaccaauggaugacaacugaagauaugcuauccguauggaaucgagucuggauugaggaaaacccauggauggaagacaaaacacacauuucaucuugggaagacgucccuuauuuagguaaacgagaggaucaaugguguggcagcuuaaucggauuaacagcucgacccaccugggcaaccaauauucaaguagcuauaaaucaaguuaggagguuaauuggcaacgagaacuaucuagauuacaugacuagcaugaaacgcuucaaaaaugaaucagaaccugagggugcacuuugguag

SEQ ID NO: 21082 - RNA, 9879 nt, Artificial Sequence
  derived and/or modified CDS sequence (opt6) from DENV-1__HE795086__SS-prME
ucuguuacuaugcuauugaugcuuaugccaacugcauuagcuuuucaucuaaccacaagagggggagaaccacauaugauuguguccaaacaagaacgagggaaaagucuauuauuuaaaacaucagcuggaguuaacaugugcacacuaauugcaauggaucugggugaguucugcgaagauacaaugacguauaaauguccucguaucacagaagccgaaccugacgauguggacugcuggugcaaugcaacugauacuugggugaccuacgguacuuguucccaaacgggagaacaccguagagauaaaagaagcguugcauuagcaccgcacguagggcuaggauuagaaacacgaacagaaacauggaugaguagugaaggugcguggaaacaaauacagagaguugaaacaugggcccucagacaccccggguuuacaguuauagcuuuguuucuagcacaugcgaucgguacaaguaucacccaaaaaggcaucauauuuauauugcuaaugcugguuacaccuagcauggcaaugcgcugcguuggaauagguucaagagauuuuguagaaggauuaucaggagcaacuuggguagauguuguacuagaacauggaaguugcguuacuacaauggcaaaagauaaaccaacguuagauaucgaauuacuaaaaacagaaguaaccaauccugcaguacuucguaaacucugcauugaagccaaaaucucaaacacuacaacagauagcagaugcccaacccagggcgaagcaacacugguggaagaacaggaugcuaacuucgucugccgccguacauucguagauagagggugggguaauggaugugguuuauucgguaaagguaguuugaucacaugugcaaaauuuaaaugcguaacuaaacuggaaggcaaaauuguucaauacgaaaauuugaaauacagugugauugucacgguacacacaggcgaucaacaucaagugggcaaugaaucaacagaacacggcacaacugccacaauaacaccgcaagcgcccucaacagaaauucagcugacugauuacggcgcacucacgcuagauuguaguccuaggacgggccuagauuuuaacgaaaugguucuacucacaaugaaagaaaaaucauggcuuguccauaaacaaugguuucucgacuuaccccuccccuggacaagcggggcaagcaccucucaagaaacuuggaauagaaaagaccuccuaguaacguuuaaaacugcucaugcuaaaaagcaagaaguuguaguauuagggucucaagaaggagcuaugcacacugcauuaacgggagcaacggagauacagacaagcggaacuaccacaauauuugcagggcaucuuaaaugucguuuaaaaauggauaaguuaacacuuaaagguaugagcuaugucauguguacagggucauuuaaacuugaaaaagaaguagccgaaacucaacacggaacgguauugguucaaaucaaguaugaaggaacagaugcaccuugcaaaauaccauuuaguacccaggacgaaaaagggguaacgcagaacgguagauuaauaacugcaaaucccauuguaaccgauaaagaaaaaccgguaaacaucgaggcugaacccccguucggagagaguuacauaguaauuggagccggugaaaaagcucuuaaacucucaugguucaagaaagguaguucuauaggcaaaauguuugaagcuacggcacguggcgcucggcgaauggcaauauuaggugacacggcaugggacuucggcucuauaggagggguuuucacuucgguagggaaacucguacaucaaaucuuuggaacggcauauggcgucuuguuuucaggaguuaguuggacaaugaagauaggaauagguguacuguuaacguggcuuggguuaaauucaagaucaaccaguuuauccaugacuuguaucgcgguggguuuaguuacuuuguaucuagggguaaugguacaagcagacucgggauguguaauaaauuggaagggcagggaguuaaaaugugguagcgguauauuugucacuaacgaaguccacacauggacugagcaguacaaguuccaggcagauucaccuaaacgauuaagcgcagcgauaggaaaagccugggaggaagguguaugcggaguaagaucugcuacucgccucgaaaauaucauguggaaacagaucaguaacgaauuaaaccauauuuugcuugagaacgauaugaaauuuacaguagucguaggugacguugcuggaauccuagcacaaggcaagaaaaugauaagaccccaaccuauggaauauaaguacuccuggaaaaguuggggcaaagccaagauuauaggugcagacguacagaacaccacauucaucauagaugguccgaacacacccgaauguccugaugaucagagagcauggaacauaugggaaguggaagacuauggauuuggaaucuucacaacaaauauuugguuaaaacuucgagacucauauacucaaguaugcgaucaucgauugaugucugcggcuauuaaagauucuaaagccguccacgcugauaugggauauuggauagaaagugagaaaaaugagacauggaaauuagcacgugcaucauuuauugagguuaagacauguauuuggccgaaaucgcacacuuuauggaguaacggagugcuggaaucggagaugauuauccccaaaauuuaugggggaccgauaucccaacauaacuauagaccgggguacuuuacgcaaacugcugguccuuggcacuuagguaaacuagagcuggauuuugaccuuugugaaggaacaacaguuguuguggacgaacacugcgggaauaggggaccaucucuuaggacuacaacgguaacaggaaagauaauacacgaauggugcuguagaaguuguacccuaccaccacuucgauuuaagggugaagauggcugcugguacggcauggagaucaggccaguaaaagaaaaagaagaaaacuuaguuaaaucaaugguuagugcgggaucuggugagguugacucuuucucucucggccuauuauguauaucaauaaugauagaggaagugaugcgcaguagguggucucgcaaaauguuaaugacaggaacgcucgcaguuuucuuucuacuuauaauggggcagcucacauggaacgacuuaauaagacuaugcauaaugguuggcgccaacgcgagcgaucgcaugggcaugggaacuaccuauuuagcuuugauggcaacauuuaaaaugcgcccaauguuugccgucggucuucuauuucgacgacuuaccucaagagagguauuacuucuuacuauaggacuuagucuagucgcgucagucgaauugccuaacucccuggaagaauuaggcgauggacuagcaaugggcauaaugauucuaaaguugcuaacagauuuccaaucgcaucaacuuugggcaacuuuacuaucuuugacuuuuauaaaaaccacuuucucucuacacuaugcauggaaaaccauggccauggucuugaguaucguaucccuauucccucuauguuugucaaccacaagucagaaaacuacgugguugccaguccuucuaggaucacuuggcugcaagccacuuacaauguuccuaauagcagaaaauaaaauuugggguagaaaauccuggccgcugaaugagggcaucauggcaguaggcaucguaucgauauuguuaagcucuuuacucaagaacgaugucccuuuagccggaccacuuauugcuggugguaugcuuaucgcgugcuacguuauaagcgguuccagcgcagacuuaucacuagaaaaggcagcagagguuagcugggaagaagaggcagaacauucuggcgcaucccauaacauauugguagagguacaagacgacgguacuaugaaaauuaaagacgaagaacgagaugauacccucacuauucuuuuaaaggcgacguuauuagcgguaucaggaguauauccccuaucgauaccugcgacacuauuuguaugguauuuuuggcaaaagaagaaacaaagaucaggagucuuaugggauacuccgaguccaccugaaguugaacgagcaguauuggacgacgguauauaucgaauuaugcaaagaggccuauuagguagaagccaaguuggaguaggagucuuccaagaaaacgucuuccacacgauguggcauguaacacgaggugccguccuaauguaucagggaaagcgccuagaaccaucuugggcauccguuaaaaaggaucugauuucguauggaggaggauggagguuacaggggaguuggaauacaggagaggagguacaagugauagccguggaaccagggaagaauccuaaaaauguacaaacugcaccgggaacguucaaaaccagugaaggugagguuggcgcaauugcccuugacuuuaagcccggaacuuccggguccccgaucguaaacagagaagggaaaauaguaggucuauauggaaauggaguagucacaacuucaggcacguacguaagcgccaucgcgcaggcaaaagcaucucaggacgguccucucccagaaaucgaagacgaaguguuucgaaaacggaaucuuacaauaauggaucuacauccuggaagugguaaaaccagacgauauuuaccugcuaucguucgugaggcaauuaaaaggaaacuacgaaccuugauacuugcacccacaaggguaguagcaagugagauggcagaagcacugaagggcaugccuauaagguaucagacaacagcagugaagucugaacauacggguaaggagauaguagaucuaaugugccacgcaaccuucacuaugcgucuccuuagcccuguccgaguuccaaauuauaauaugauaauuauggaugaagcacacuuuacagacccuucaucuauugcggcaagaggguacaucucaacucgcgugggcaugggagaagcggcugcaauauucaugacugccacacccccaggcucuguggaagcauuuccccaaagcaacgcuguuauccaagacgaagaaagagauaucccagagagaucauggaauaguggauacgaauggauaacagacuuuccugguaaaacuguuugguuuguuccuucuauaaaaucggggaacgacauagccaauugucuuaggaagaacggaaaaagagucauacaguuaagucgcaaaacauucgauacugaauaucaaaagacgaaaaacaaugauugggacuacguggucacuacagacauaagcgaaaugggugcaaauuuuagagcagauagaguaauagacccacggaggugccuaaagccaguaauacuaaaggacgggccggaaagaguaauucuugcagguccuaugccaguaacuguagccagugcugcacagagacgagggcguauaggcaggaaccauaacaaagaaggagaucaauacauuuacaugggacagccgcuuaacaaugacgaagaucaugcacauuggacggaagcaaagaugcuauuggauaacauuaauaccccagaagggauaauaccagcauuguuugaaccggaacgggagaaaagugccgcaauagacggugaguaccgacuaagaggugaagcgaggaaaacauuuguagaacuuaugagacgaggggauuuaccagucugguugagcuacaaagucgccucugagggauuucaauacucugaucgaaggugguguuucgacggcgagaggaauaaccaagucuuggaagaaaauauggauguagaaaucuggacaaaagaaggagaacguaagaaauuaagaccacgauggcuagacgcucgcacauauucagacccuuuggcccuaagagaauuuaaagaguuugcagcaggccgcagaagcguaucuggggaccuaauuuuagaaauagguaaguuaccccagcaccucacucagcgcgcucaaaacgcuuuagacaauuuaguuaugcuucauaauucugaacaaggagggcgugcauacaggcacgcuauggaggaauuacccgacaccauugagacccuaaugcuuuuggcauuaaucgcgguauuaaccgguggugucacauuguuuuucuugaguggaagaggccugggaaaaacaagcauuggacuccucuguguaauggcuuccaguguacuuuuauggauggcaagcgucgagccgcauuggauugcugcaucaaucauuuuagaguucuucuuaauggucuuacuaauuccagagccugaccgacagcgcaccccucaggacaaccaauuagcauacguugugauaggacuguuguuuaugauucucacagucgcggcgaaugagaugggcuugcuugaaacuaccaagaaagacuuaggaauuggucacguugcagucgaaaaucaucaccacgcugcaauguuagauguagaucuacaucccgccucggcuuggacacucuacgcaguagccaccacaauaauaacaccuaugaugaggcauacgauugagaauacaacggccaacauuagcuuaacagcaauugccaaucaagcugcuauucuuaugggauuagauaaagguuggccgauaagcaaaauggauauagggguuccacuucuagcucuaggguguuauucacaaguuaacccauuaacccuuacagcagccguacuuauguuaguugcucauuaugccauaauaggucccggauuacaagcuaaggcaacgcgugaagcacagaaaagaacagcugcggguauaaugaaaaacccaaccguagauggcauaguggcaauagauuuagacccaguaguguacgaugcgaaauuugaaaaacaacuaggacaaauaauguuauuaauacuuuguacaucacaaauauuguuaaugagaacaacaugggcccuaugcgaaaguauaacauuagccacaggaccccuuacuacacuaugggaaggaaguccggguaaauucuggaauacuaccauagccguaucgauggcgaauauauuucgggguucguauuuagcaggggcaggacuagcuuuuucucuaaugaaaucuuuaggcggaggacggagggguacaggagcccagggagaaacucugggugaaaaauggaaaaggcaacuaaaucaacuaagcaaauccgaguuuaauacauacaaaagaagugggauuauggaggucgaucgcagugaagcuaaagaaggacuaaagcgcggagaaacaacaaaacaugccguaucaagaggaacagcaaaauugaggugguuuguagaaagaaaucucgugaaacccgaaggaaaagucauagauuuaggcugugguaggggagguuggucuuacuauugugcuggacucaagaaaguuacggaaguaaaagguuauacgaaagguggaccuggacaugaagaaccgauaccaauggcaaccuacgguuggaacuuagucaaacuucacucaggaaaggacgucuucuucauaccaccugaaaaaugugauacacuacugugugauaucggcgaaucaucucccaacccaacuauagaagaagguagaacacuaagaguucugaagaugguagaaccaugguuacgaggcaaucaauuuuguauaaaaauucuaaauccauauaugccaaguguaguggaaacucuugaacagaugcaacgaaaacacggaggaauguuggugcguaauccucuguccagaaauucaacgcacgaaauguacuggguaagcugcgguacaggaaauaucguauccgccguaaacaugacgucacgaaugcuacuuaaccgauuuacuauggcgcaucguaaaccuacauaugaaagggacguagaucucggagcagggacccgccacguugcuguagaaccugagguugcuaaccuagacaucauuggucagcguauugaaaacauaaaauaugagcauaaauccacauggcauuaugaugaagauaacccauauaagacaugggcuuaccaugguucauaugaaguaaaaccuucagggagugcgucuuccaugguaaauggagugguuaaacuacugacaaaacccugggauguuauacccaugguaacacagauagcaaugacagauacgacgccauucggacaacaacgaguauucaaagaaaaaguggauacuagaacaccaaaagcgaaaagaggaaccgcacaaauaauggaaguaacggccaaauggcuaugggguuucuugagucguaauaagaaacccagaauauguaccagagaagaguucacuaggaaaguccgaucaaaugcagcuauaggcgcaguuuuugucgaugaaaaccaauggaacagugcuaaggaagcaguagaagaugaaagauucugggaccuaguccauagagagcgugaauugcauaagcaaggaaaaugcgcgacauguguauacaacaugaugggcaaacgagagaagaaacucggggaguucggaaaagccaaagggucacgagcaauaugguauauguggcugggggcaagauuucuagaguucgaagccuuggguuuuaugaacgaagaucacugguuuucgagagaaaauagucuaaguggaguagaaggagaaggguuacacaaauuagguuauauacuacgagacauuagcaaaauuccaggggguaauauguaugcagaugauacagcuggcugggacacaaggauaacagaggacgaccuacagaaugaagcgaaaauuaccgauauaauggaacccgaacacgcacuccuugccaaaagcauauuuaaacucacauaccaaaacaaaguuguacgcguacaacgcccugcuaagaauggaacaguaauggacgucauuucaagacgugaccaaagggggucgggacagguagggacuuacggguuaaacacauucacaaacauggaggcacaacuuauccggcagauggagucugaggguauauuuucacccucagagcuugaaacuccuaaccucgcuggaaggguguuagauuggcuugaaaagcacggcgucgaaaggcuaaaacguauggccauuaguggugacgacuguguggugaaaccaauugacgaccguuuugcuacugcacuuaccgcccugaacgauauggguaaagugagaaaagauaucccccaaugggaaccgucaaaagguuggaaugauuggcaacagguaccauucuguagucaucauuuucaccaacuuauuaugaaggacgggagggagauugucgugccguguagaaaccaagacgagcuaguaggccgagcaaggguuucacaaggagcaggguggucacuacgugagacugccugccuaggcaaaucauacgcucaaauguggcaacucauguauuuucaccguagagauuuaagauuagcugcgaaugcaauuugcagugcgguuccugucgauuggguuccgacuucgagaacaacauggucaauacaugcucaccaccaauggaugacuaccgaggacaugcuuagcguguggaacagaguguggauugaagagaaucccuggauggaagacaaaacccauauaaguagcugggaagauguaccauaucugggaaaaagggaggaucaauggugugggucacuuauaggucucaccgcaagagcaacaugggcaacuaacauucaaguugcaauaaaucagguccgacgacuaauugggaaugaaaacuacuuggauuauaugaccucaaugaaaagguuuaaaaaugaguccgauccagagggugcuuuaugguaa

SEQ ID NO: 21083 - RNA, 9879 nt, Artificial Sequence
  derived and/or modified CDS sequence (opt6) from DENV-1__AB189120__SS-prME
ucuguaacuauguuacugaugcuauuaccuacaguacucacauuucaccucacuaccagaggcggagagccgcacaugaucguuucgaaacaggaaagaggcaaaucacuacuauuuaagacuucggccggcguaaacaugugcacuuuaaucgcuauggauuuaggcgagcugugcgacgacaccaugacuuauaaauguccuagaauuacagaaacagaaccggacgacguugacugcugguguaacgcuacagaaacguggguaacauacggcaccuguagucaaacuggcgagcaccgcagagacaaacgaucaguagcacuagcgccucauguaggccuagguuuagaaacacgaacugagacuuggaugucuuccgaaggcgcuuggagacaaauccagaagguugagacaugggcucuucgacauccugguuucacuguuauagcauuauuuuuggcacacgccaucggcacuucgaucacccaaaaaggaauaauuuuuaucuuauugauguuggugacgccaucaauggcaaugcguuguguugguauugguaacagagauuucguugaaggacuauccggagcaacguggguugauguaguuuuagaacauggaucaugugugacaaccauggccaaggacaaaccaacauuagacauagaacuauugaaaacagaagucacaaauccggcagugcuacgaaaguuaugcauugaggcaaagauauccaacacaacaacugacaguagauguccaacucaaggagaagcuacgcuggucgaagagcaggacgcaaauuuuguguguaggagaacuuuuguugacagagguugggguaaugggugcggguuguuugguaaaggaaguuuaauaacaugcgcgaaauucaagugcgugacaaagcuagaagggaaaauaguucaauaugaaaaccuaaaguauaguguaauagugacagugcacacaggggaucaacaucaaguaggaaacgaaacgacagagcacggaacgauugcgacaauaacuccucaggcuccaacaagugaaauucagcuuaccgacuauggggcgcuuacauuagauuguaguccacgaaccggucuggacuucaacgagaugguuuuacuuacaaugaaagaaaaaucauggcuaguucacaaacaaugguuucuagacuuaccauugccauggacgagcggggcgucgacgucccaagaaacguggaauagacaagaucuacugguaacauucaaaaccgcacacgcuaagaaacaagaagcagugguacuuggcucccaggaaggugcaaugcacacagcuuuaacgggcgcaacagagauacaaacgagcgggacuacgacuauauucgcuggacaucugaaaugccguuuaaaaauggacaaacuaaccuuaaagggaaucagcuacgucauguguacagggucauuuaaacuagaaaaagaaguggcugaaacgcaacaugggacaguacucguacaagucaaauaugaagguacagaugcaccauguaagauaccauuuagcucacaggaugaaaagggcguaacacaaaauggacguuuggugacggcuaacccuauagugacugacaaggagaaaccaguuaauauugaggcagagccccccuuuggugaaucauauauagucguuggggcaggcgaaaaagcguuaaaauuaaguugguuuaagaaaggcucgucgaucggaaaaauguuugaagcuaccgcuagaggugccagaaggauggcgauauugggagauacagcaugggacuucgggaguauugguggaguguuuacuagcguaggaaaacuaguucaucagauuuuugguacagcuuaugguguucuauuuucuggaguaucauggacgaugaagauugguaucggaaucuuauuaacuuggcuaggacugaacaguagaucuacuagucuaucuaugacauguaucgccguuggaaugguaaccuuauaucucgguguaaugguucaggcagauucaggcugcguuauuaauuggaaagggagggaacuuaagugcggaucggguauuuucguuacuaacgaaguccauacauggacugaacaauauaaguuucaagcagauucucccaagcguuuauccgccgcgauugguaaagcuugggaggaaggaguuuguggcauccggagugcaacaagguuagaaaacauuauguggaagcaaauuaguaaugagcuaaaucauauuuuauuagaaaaugauaugaaauucacaguaguagucggugacguuagcggcauacuagcacaaggaaaaaaaacaauucggccacaaccaauggaacauaaauauucguggaagucaugggguaaagccaaaauaauaggagccgacguacaaaauacuacauuuauuaucgacgggccaaacacgccggaguguccagaugaucaaagggcguggaacauaugggaaguagaggauuacggauuuggcauauuuacaacgaauauuuggcucaaguuacgugauagcuauacccaagugugugaucacagauuaaugagcgcagcaauaaaagacucaaaagccguccaugcugauaugggguauuggauagaaagcgaaaaaaaugaaaccuggaaauuggccagagcaucauucauagaagucaagacaugcguuuggccaaaaucucauacacuuuggagcaacggagucuuggaauccgaaaugauaauaccuaagauauauggaggaccgauaucacaacauaauuauagacccgguuauuucacccaaaccgcuggcccauggcaucuagguaaacuagagcuagacuucgauuugugugaagguacaaccguaguuguagacgaacacuguggaaaccgugggccuucucuccgaacaacgacaguaacaggaaaaauaauacaugagugguguugcaggucauguacauuacccccacucagauuuaaaggcgaagacgguugcugguauggaauggaaauaagaccaguuaaggagaaggaagagaauuuaguaaagucaaugguuucagcagggucaggcgaaguagauagcuucucacuaggucuguuauguauaucaauaaugauagaagaaguaaugagauccagguggucccguaaaauguugaugacagguacucugguuguuuuucuauuauugacauuaggucaacuuacauggaaugaucuuauccggcuauguaucaugguuggagcuaaugcaagugacaacauggguaugggaacgacuuauuuagcuuugauggcgacguuucggaugcgaccgauguucgcaguaggacuguuguuucgaaggcucacaucuagagaagucuuguuacugacgguaggauugagccuaguugcaagugucgaacugccaaauucgcuagaggaguuaggggacggacuugcaaugggcauuaugauacuuaaauugcucacggauuuccagagccaucaauuaugggcgacguugcuaucuuuaacauuugucaaaacgacgcugucccuccacuaugcguggaagacgauggcaaugaucuugucaauaguaucucuccucccuuuaugcuuaagcacaacgagucaaaagacgacgugguuaccuguucuccuagguucauuagguugcaaaccgcuuacuauguuucuuauaacagaaaauaagaucuggggacgaaaaagcuggccucuaaaugaaggcaucauggcuguagguauaguuagcaucuuacuaucaucucuauugaagaacgacguaccccuagcagguccuuugauugccggcgguauguugauagcauguuacguuauaagugguagcucugcagauuuaaguuuagagaaggcggcgaagguaucaugggaagaagaagccgaacauucaggcgcaucgcauaauauacuuguagaaauacaagacgauggaacaaugaaaaucaaggacgaggaaagggacgauacaauuaccauacuauuaaaagccacccuacuggcuauaucaggaguguaccccaugucaauaccagcuacauuguuuguaugguauuucuggcagaaaaaaaaacaacgcucggguguauuaugggauacaccuucaccucccgaagucgaaaaagcaguuuuagacgacgggauuuacagaauuuugcaaagaggguuacuaggcaggagccaagugggcgucgguguguuccaggaaggaguuuuccacacaauguggcacguaacccgcggcgcgguauuaauguaucagggcaagcgcuuagaaccaucaugggcaagcgugaaaaaggaucuaauuaguuacggaggugguuggagguuucagggauccuggaauacgggugaagaaguacaaguaauugccguugaaccugguaagaauccaaaaaauguucaaaccgcuccugggacauuuaaaacaucagaaggagaaguaggugcuauugcgcuagauuucaaaccuggcacaagugggaguccuauagugaaccgagaagguaaaauaguuggccuguaugggaacgguguaguaacuaccagcggcacauacguaucggccauagcgcaagcaaaagcaagccaagaggguccuuuaccugaaauagaagacgaaguguuuagaaaaagaaauuugacaauuauggacuuacacccagguucuggcaaaacuaggcgguauuuaccugcuaucguaagagaggcuauuaaaagaaaauuaagaaccuugguucucgccccaacgcgugucgucgcaucugaaauggcggaagcgcuaaaagggaugcccaucagauaucaaacaacagcuguaaaaagcgaacacacaggaaaggaaauuguugaccuuaugugucacgcuacauuuacaaugaggcucuuaucaccagucagaguaccaaauuauaacaugauaauaauggacgaggcacauuucacugacccagccucuaucgcagcaagaggauauaucucaacaagaguaggaaugggagaggcagcagcaauuuuuaugacugccacaccaccaggcucaguggaagcuuuuccacaaucaaaugcugugauucaggaugaagaaaaagacauaccagaacgaaguuggaacucgggcuacgacuggauuacugauuuuccgggcaaaacuguuugguucguuccgucuauuaaaucggguaacgauauagcgaacugcuuaagaaaaaauggaaaaagagugauacaauuaucgaggaagacauuugacacagaauaucaaaaaacuaaaaacaaugauugggauuacguaguuacaacggauauaucggaaaugggagcaaauuuucgagcugacaggguaaucgacccuaggcgaugccuaaaaccgguuauacuuaaagauggaccggagcgagugauacuagcagguccaaugcccguaaccguggcuucggcggcccaaagacgaggucgaaucggaagaaaucaaaauaaagagggagaccaguacaucuauaugggucaaccauuaaauaaugacgaggaucacgcccauuggacugaagccaaaauguugcucgauaauaucaacacuccagaagguauuauuccggcccuuuucgaacccgaaagggaaaaaagugcagcaauagacggcgaauaucggcuccgaggagaagcaagaaaaacauucgucgaacugaugagaaggggcgauuugccgguuuggcuaucuuacaagguggccucagaaggauuucaguacuccgauaggcgcuggugcuucgauggggagcguaacaaccaaguuuuagaagaaaauauggacguagaaauauggaccaaagaaggggaaagaaaaaaauuacgacccagaugguuggaugcucguacguacucagacccauuagcacugagagaauuuaaagaauucgcugcgggccggagaucuguuucaggugaucucauauuagaaauaggcaaacuuccgcaacaucucacgcaacgggcccagaaugcauuagauaauuugguuauguuacauaauucugagcaaggagggaaggcauauagacaugcaauggaggaauugccagauacaauugagaccaucauguuauuagcccuaauagccguuuuaacuggcgggguaacccuauuuuucuuaaguggaagaggauuagggaagacaucuauagggcucuuauguguaauguccuccucagcguuauuauggauggcaucaguggaaccucauuggauugcagcaaguaucauuuuagaauucuuucuaaugguacuccuaauaccagaaccagacaggcaaaggacaccacaagacaaccaauuagccuacguaguuauaggucugcuguucaugauauuaacagucgcagcaaaugagaugggucuucuagagacaacgaaaaaagauuuaggcaucggccacgcagcugcggaaaaucaucaucaugccgccaugcuugaugucgaccuucauccugcaagcgccuggacucucuacgcaguggcuacuacgaucauuacuccaaugaugagacauacaauugaaaauacaaccgcaaacauuucccugacugcaauugccaaccaagcagcaauccuaaugggacuagauaaaggauggcccauuucgaaaauggacauuggaguaccuuugcuugcuuugggaugcuauagucaagugaauccguuaacgcucacagcagcagucuugaugcucgucgcucacuacgcuauaaucggcccgggacuccaagcaaaagccacucgcgaagcgcagaaaagaacugccgcuggaauaaugaaaaacccgaccguagauggaaucguugccauagauuuagauccuguaguauaugaugcaaaauuugaaaaacaauuaggucaaauuauguuacuuauuuuguguacgagucaaaucuuauugaugcgaaccacaugggcccuaugcgagucaauaacacucgccacuggaccgcugacuacuuugugggaagguuccccagguaaauuuuggaacacuacgaucgcugugagcauggcaaauauauuucgcgguucuuacuuggcuggugcaggguuagcuuuuuccuugaugaaaaguuuaggcgguggccgaagagggacuggggcccaaggggaaacacugggagagaaguggaagcgacaacuaaaccagcuaucaaaaucagaguuuaacacuuauaaaagaucaggcauaaucgagguggacaggucggaagcaaaagaagguuuaaaacggggggaaacaacgaaacaugccgucucgcgaggcacugcaaaguuacgcugguuuguugaaaggaauuugguaaaaccagaaggaaaaguuauagacuuaggcugugggagggguggauggagcuauuauugugcgggacucaagaaaguaaccgaaguaaaagguuacacgaaaggagguccaggucacgaagaaccaauuccaauggcaaccuacgguuggaauuuaguuaagcuccauaguggaaaagauguuuucuuuauuccuccagaaaaaugugauacucuacuaugugauauaggagaaaguucgcccaauccaacaauagaagaagggagaacucugcggguacuuaaaaugguagagccuugguuaagagggaaccaauuuugcauaaaaauuuugaauccuuacaugccgaguguaguagaaacauuggaacaaaugcaaagaaaacacgggggaaugcucgugcguaauccauuaagcagaaauaguacacaugaaauguacugggugagcuguggaaccggaaauauaguaucggcuguaaacaugacuucuagaauguuacuaaacagauucacaauggcucaucgcaaaccaacuuacgagcgcgaugucgaucuaggagccggcacgcgccacguugcaguagaaccagagguagcaaaucuagacauuauaggacaaagaauugaaaacauuaaaaaugaacacaagucaacguggcauuacgaugaagacaauccuuacaagacuugggcauaucacggaagcuacgaaguaaaaccuucuggcucagccaguaguaugguuaauggaguugucagacuauuaacaaaaccgugggacguaauacccaugguuacacagauagcaaugacugauacuacuccuuuuggucagcaaaggguuuucaaagaaaaagucgauacgagaacuccaaaggcuaaacgugggacagcccagauaauggaggucacagccaaauggcuauggggauuccuaucaagaaacaagaaaccucguauaugcacuagggaagaauucacuagaaaaguacguuccaaugcggcaauaggugcaguauucguugaugaaaaccaguggaacucggcgaaggaggcaguagaggaugaaagauuuugggauuuagugcgcagagaaagagaguugcauaaacagggaaaaugugcaacguguguauauaauaugaugggaaaaagagaaaaaaaauuaggcgaauucgggaaagcaaaaggcucuagagcgauaugguacauguggcuaggugcaagauuuuuagaauucgaagcauuaggauucaugaaugaagaucauugguucucacgagagaauaguuugagcgggguugaaggugaaggucuucauaagcugggauauauacuaagagacauauccaaaaucccuggugggaauauguacgcggacgacacagcggguugggauacucguauuacagaggaugaccuacaaaacgaagcaaaaauuaccgacauaauggagccagaacaugcacuauuagcaaccucuauuuuuaagcucacguaccaaaauaaagugguuagaguacaaagaccggcaaaaaaugggacaguaauggacguaauuaguagaagggaucaaagagguucaggucaagugggcacuuacggucuaaauacuuucacuaauauggaagcucaguuaauucgacaaauggaaagugaagggauuuucucacccucugaacuagagacacccaaccuagcaggaagaguucuagauuggcucgaaaaacauggaacugagcgauuacgacgaauggccaucucaggggaugacuguguagugaaacccauagaugacagguucgcuacugcauuaacagcauuaaacgauaugggcaaaauaaggaaagacaucccacagugggagccauccaaagguuggaaugacuggcagcaaguaccauucuguucgcaucauuuucaucaauugauaaugaaagauggcagagagauagucgucccaugucggaaucaagaugaacuugucggaagggcaagaguaucccaaggugcuggcuggagucugcgagaaacggcuuguuuaggaaagucuuacgcacaaauguggcaacuuauguacuuucauagaagagacuuaagacuugcagcgaacgcaaucugcucagcggugccagucgacuggguaccaaccuccagaacaaccuggucaauucacgcacaccaucaauggaugacgacggaagacauguuaaguguauggaacagaguauggauagaagaaaauccauggauggaagauaaaacucacguaaguucaugggaagacgucccauaucuuggaaagagggaagaucaguggugcgguagcuuaaucggauuaaccgcgagagcaacaugggcaacgaacauucaaguugcaauaaaccaaguuagacgucuaauaggcaaugaaaauuauuuggacuauaugacuucaaugaaacgauucaaaaaugagucagauccggaaggugcgcugugguga

SEQ ID NO: 21084 - RNA, 9879 nt, Artificial Sequence
  derived and/or modified CDS sequence (opt6) from DENV-1__AB189121__SS-prME
aguguuacgauguuguuuaugcuauuaccgacggcccuagcuuuucauuugacaacucgcgguggagaaccgcauaugaucguuuccaaacaagaaagaggcaaaucuuuacuauuuaaaacaagugccggcgugaauaugugcaccuugauugcaauggaucuaggagaacugugugaagauacaaugacuuacaaaugccccagaauuacagaaacugagccugaugauguagauugcuggugcaacgccaccgaaacauggguuaccuaugguacguguucccaaacaggugaacaucgccgcgauaaaagaucaguagcacuagcaccacauguuggccucggccucgaaacaagaacggagacauggaugucgucugaaggugcuuggaggcaaauacaaaaaguagaaacuugggcuuugagacacccaggcuuuacaguaauggccuuauuucuagcucacgcuaucgguacaucuauaacacaaaaagggaucauauuuauacuacuuauguuaguuaccccuagcauggcgaugcgaugcguaggaaucgggaauagagauuuugucgaaggacuaucuggggcaaccuggguugauguagucuuagaacauggcuccuguguaacaacgauggcuaaagacaaaccaacauuggauauugagcuguugaaaacagaagugacaaauccugccguccuaagaaaauugugcauugaagccaaaaucucaaacacaacgaccgauucaagauguccuacacaaggcgaagcaaccuuaguugaggaacaggauaccaacuucguuugucgacguacauucguagauagaggaugggguaauggauguggucuuuuuggaaaagguucgcucauaaccugcgcuaaauuuaaaugugugaccaaauuagaaggaaagauuguacaauacgaaaauuuaaaguauaguguaauugugacuguucauacaggugaucaacaucaaguagggaaugagacuaccgaacacggcacaacagcgauaauuacgccucaagcaccgacaagcgaaauacagcuaacugauuauggagccuugacacuagauuguucaccacguacuggucuagauuucaacgaaaugguguuacuaaccaugaaggagaaaucgugguugguucauaaacaaugguuccucgaccuaccacuaccguggacaucaggagcuagcaccagucaggagacauggaacagacaagacuuacuggugacauuuaaaacagcgcaugcaaagaaacaggaggucgucguguuagguagucaagaaggcgccaugcauaccgcguuaacgggcgcaacagagauacaaaccagcgguaccacaacaaucuuugcgggucaccuaaaaugccgauuaaaaauggauaaacuaacucucaaaggagucagcuauguaauguguaccggguccuuuaaacuugaaaaggaaguggcagaaacgcaacauggcaccguauuagugcaaguaaaguaugaaggaacagaugcaccuuguaaaaucccguuuucgagucaagaugaaaaaggaguaauccaaaacggaagauugauuacagcaaauccaauagucacagauaaagaaaaaccgguuaauauugaagcggagccaccuuuuggagagaguuacauuguaguaggggcuggcgaaaaggcccuuaaacuaucaugguucaaaaagggaagcucaaucggaaaaauguucgaagcaacagcacgaggggcacguagaauggcuauauuaggagauacagccugggacuuuggcaguauaggagguguuuuuacaagcguuggaaaguugguacaucaaauauuugggacugcguacgggguccuauuuucuggaguaagcuggacgaugaaaauaggaauugggauauuacuaaccuggcuagggcugaacagucggucuacaucgcuaaguaugacauguauugcgguuggcaugguuacgcuauaccugggcguaaugguacaagcagacucgggcugugucauaaauuggaaggggagggaauuaaaaugcggcucagguauuuucguuacaaaugagguucauacauggaccgaacaguacaaauuccaggcagauucuccaaagagguuaucggcagcgauagguaaagccugggaagaaggugugugugguauaaggagugcaacacgccuagaaaacaucauguggaaacaaauuucgaaugaauuaaaucacauuuuacucgaaaaugauaugaaguuuaccguaguuguuggagacguguccgguauacucgcacagggaaagaagaugauccggccgcaaccaauggaacauaaguacucuuggaaaagcuggggaaaggccaaaaucauaggagcagacgugcaaaauauuacauuuauaauagauggaccgaacacauccgaaugccccgauaaccagcgcgcauggaauauaugggaaguagaagauuauggauucgguauauuuacaacaaacaucugguuaaaacuuagagauuccuauacacaaguuugcgaucacagacuaaugagcgcagcgauaaaggacuccaaagcaguacaugcagauaugggcuauuggaucgaaagcgaaaagaacgagacauggaaacucgcaagagcaucauucauugaaguuaaaacguguauuuggccuaagucacauacauuauggagcaauggaguguuagaaagcgaaaugauaaucccuaaaauuuauggaggaccaguaagccaacacaacuauagaccuggguauuuuacgcaaaccgcgggaccauggcauuuggggaaauuggaacuggauuuugauuuaugugaagguacuacgguaguaguugaugaaaauugcgguaacaggggaccuucguuaagaacaacaacaguaaccggaaaaacgauacaugaguggugcugccguaguuguacuuuaccaccgcuucgauucaagggagaggaugguugcugguauggaauggaaaucaggccggugaaggagaaagaagaaaauuugguuaaaaguauggucucagcgggaucaggugagguugauaguuuuucacucggcuuauuauguauaucuauaaugaucgaagaaguuaugagaucuagauggaguagaaaaaugcuuaugacaggaacgcuagcaguauucuugcucuuaacuaugggacaacuuacauggaaugauuugauacgacuuugcaucauggucggugcaaaugcgucugauaugauggguauggguacuaccuaucucgcuuuaauggcaacauuccguaugcggccaauguucgccguuggauuacuguuuaggagacuaacaucacgugaaguacuuuuguugacgguagguuugucucucguugcaaguguggaauuaccgaacucguuggaagaacuaggugacgggcuggcaaugggaauaaugaugcuaaaacucuugacagauuuucaaccccaccaacuaugggcgacucuucuaucauuaacuuucgucaaaacaacauuuaguuuacacuacgcguggaaaacaauggcaaugauucucaguauaguaucucuguuaccacuauguuugagcacgacaucccagaaaacuacauggcuucccguauuauuagggagucuaggguguaagccauuaacgauguuacuuauaacagaaaacaaaaucuggggcagacggaguuggccccuaaaugaaggaauaauggcgauaggaaucgucucuauauuacuuaguagccuacucaaaaaugacguaccacuugcaggcccacuaaucgcgggaggaauguuaauagccugcuauguuauuuccggcaguuccgccgauuuaucauuagaaaaggcugcagaagucucuugggaagacgaagcagagcauuccggagcgagucacaacauauuaguggaaguacaagaugacggaacaaugaaaauaaaagacgaagaacgcgacgacacacugacaauauuacuuaaggcuacacuauuagccauuagcgggguuuauccgaugaguauaccggcaacucuguucgucugguauuucuggcagaagaagaaacagagaaguggaguucucugggauacaccgaguccuccggaaguagaaagagcaguuuuagauaauggaauauauagaauauugcaaagaggacuucucggacgcucacagguuggcgucggcgucuuucaagaaggaguguuucauacgauguggcaugucacaagaggagcagucuuaauguaucaaggcaaacgacuagagccuucaugggcuagcguuaaaagggauuuaauuucauauggcgguggauggagguuccaaggaagcuggaauacuggugaagaaguacaaguuauagcaguugagccagggaaaaaccccaagaaugugcaaacaacgccuggaacauuuaaaacaccagagggagaagugggagcuauugcuuuagauuuuaaaccaggaacgucaggaucaccaauuguuaaucgagaggguaaaauagucggauuguauggcaauggcguaguuacaaccucagguaccuacguaucugcaaucgcacaggcuaaggcuucacaggaaggcccccuacccgaaaucgaagaugagguauuucgaaaaagaaauuuaacaauaauggauuugcauccgggaucggguaaaacgcggagauaucuaccggcaaucguacgagaagcaauaaaaagaaaacuacgaacgcuaguguuagcuccaacaagaguuguugccagugaaauggcagaggcuuuaaaagguaugccaauuagguaucagacaacagcuguaaagagcgaacacacggguaaagaaauagucgacuugaugugccaugcgacauuuacaaugagauuacugucccccguaaggguuccaaacuauaauaugauuaucauggaugaagcccauuuuacagacccggccuccauagcagcccgaggcuauauaagcacucgagucggaaugggagaggcagcggcaauauucaugacagccacuccucccggcucaguggaagccuucccccaaucgaacgcgguaauacaagacgaagaacgugacauucccgaaagaucauggaauagcgguuaugaauggauuaccgauuucccaggcaaaaccgugugguuugugccgagcauaaaaucaggaaaugacauugcaaauuguuuacggaaaaauggcaaaagaguuguacaauuaagcaggaaaacauucgauacagaguaucagaaaacuaagaauaacgauugggacuaugugguaacuacugauauuucugaaaugggagcaaacuuucgugcagaucgggucauagauccuagaagaugcuuaaaacccguuauauuaaaagauggaccagagcguguaauccuggccggcccuaugccgguaacgguagcuuccgcagcacaacgcaggggaagaaucgggagaaacccaaauaaagaaggugaucaauaugucuauauggggcaaccauuaaacaacgacgaagaucaugcacacuggacagaggcgaaaauguuguuggauaauauaaauacaccugaagguauaauaccagcacuauuugaacccgagagagaaaagagcgccgcuauagauggagaauaucgacuacgaggagaagcaaggaaaacguucguugaguuaaugcgccgaggagaucuuccaguuuggcuaaguuauaagguagcaucggaaggcuuucaauauagcgaucgaagauggugcuuugauggugaacgaaauaaucaagucuuagaagagaauauggacguugaaaucuggaccaaggaaggagagcggaagaaacuaagaccaagaugguuagacgcgagaaccuacagugacccacucgccuuaagggaguuuaaagaauuugcugcaggacgaagaucgguuucaggugaucuaauauuggaaauugguaaacuaccgcaacaccugacucaaaaagcacagaacgcuuuagauaauuuaguaaugcuccauaacucugaacaagggggaaaagcguaccgacaugcaauggaagaguugccugacacaauugagacauuaauguuauuggcauuaauugcagucuuaacuggaggcguuacauuguucuuuuuaagcggacgaggacuugguaaaacgucaauuggauugcuaugcguuauggcgaguagcgcacuucuauggauggcgagcgucgaaccccacuggauugcggccagcauaauuuuggaauuuuucuuaaugguguuacuuauuccggagccagauagacagcgaacaccgcaagacaaccaacuagcguauguaguuauaggauuacuauuuaugauacuaaccguagcagccaaugaaaugggauuauuagagacgacuaagaaggaucucggaauuggacacgccgcagcggaaaaccaccaccaugcagcaaugcuggacguggauuuacauccagccucagcauggacccuauacgcgguagcaacaacaauuauaacuccgaugaugagacauacaauagagaauacgacggcaaauauuaguuuaacagcuauagcaaaccaggcugcuauacucauggggcuggauaaaggauggccgauuaguaagauggacauaggaguucccuuauuagcucuaggcugcuacucucaaguuaacccacuaacacucacagcggcuguguuaauguugguggcacauuacgcaauaaucggacccggucuacaagcgaaagcaacuagagaagcccagaaaaggacagcagcaggaauuaugaaaaacccuacaguagaugggauaguggcaauagaucuugacccaguuguauaugaugcaaaauuugaaaagcaguugggccaaauuauguuguuaauucuauguacaucacaaauauugcuaaugcguacaacaugggcccuaugugagucaauaacgcuggcgacugggccauugacuacauuaugggaagggucuccugguaaauuuuggaacacuacuauagcuguaucaauggcaaauauauuuaggggaagcuaucuagcuggagccgguuuggcguuuucacucaugaaguccuuagguggcgguagaagggggacuggcgcgcaaggagaaacacuuggagaaaaauggaagcggcaacuuaaucaacucuccaagucagaauuuaauauauauaaaagauccggaaucauagaaguggaccgaucagaagcaaaagaaggauuaaaaagaggagagacuacgaagcaugccguuucgagggggacggccaaauuaagaugguuuguugaacgaaacuuagugaaaccagaaggaaaagucauagaccuaggauguggacgagguggauggaguuauuauugcgcgggacucaagaaagucacugaaguuaaaggcuacacaaaagguggacccggccacgaggaaccuauaccuauggcaaccuauggauggaaucucguuaaauuacacucggggaaagauguauucuucacuccacccgagaaaugcgauacacuauuaugcgauaucggggaaagcagucccaacccaaccauagaagaggggcgaacacuacgugugcuuaagaugguggaaccauggcugaggggcaaccaauuuugcauaaaaauccuuaacccuuacaugcccucgguaguugagacacuggagaaaaugcaaagaaaacaugggggcauguuagugaggaaucccuuaucuagaaauaguacacaugaaauguauuggguaucauguggaaccggaaauauagucagcgcuguaaacaugacaagcagaaugcuccuaaacagauucacuauggcgcauagaaaaccaacuuaugaaagagacguagauuuaggagcuggcacacggcacguagcuguagagccagagguagccaacuuagauauaauuggucaacguauugaaaacauuaaaaaugaacauaaaagcacguggcacuaugaugaagauaauccguauaaaacaugggcauaccacggcuccuaugaagucaaaccuucuggaagcgcaucaagcaugguaaauggagugguucgucuuuuaacaaagcccugggaugugauuccuaugguaacacaaauagcaaugaccgacacaacaccguuuggacaacaaagaguauuuaaggaaaagguggacacccgaacuccuaaggccaaaaggggaacugcccaaauaauggagguaacagcccgaugguuauggggauuccugaguagaaacaagaaaccacguauauguacaagggaagaguucacacgcaaaguuagaaguaaugcagcaauuggggcgguguuuguagacgagaaucaguggaauagcgccaaagaggcaguggaagacgaacgcuucugggauuugguacaucgagagagagaguuacauaagcaagggaagugcgccacgugugucuauaauaugaugggaaaacgugaaaagaaauuaggagaguuuggaaaggcuaaagguucaagggccauaugguauauguggcuaggugcgagauucuuggaauuugaagcacuugguuucaugaaugaggaccauugguucaguagagaaaacagccuaucgggcguggagggugaaggccuacauaaguugggguauauauugcgagauauaagcaaaauaccugguggaaacauguacgcagaugacacagcagggugggacacccgaauaacagaagacgaccuucaaaaugaagcaaaaaucacugacauaauggaaccggaacacgcucuguuagcuacuucuauauuuaaguuaacguaucagaauaagguaguuagaguucaaagacccgcgaagaacggaaccguaauggauguaauuucaaggagagaucaaagagggaguggacaagucggaacuuauggacuuaacacguuuacaaacauggaagcacaacuuauccgacaaauggagucugagggaauauuuuccccaucagagcuagaaaccccaaaccuggcugagaggguauuugauuggcuagaaaaacaugggauugagcgcuuaaaacgaauggcuaucucuggugaugacugcguuguuaagccaaucgaugauagauuugcaaccgcauuaacagcacuaaacgauaugggaaaaguaaggaaagacauuccacaaugggaaccaucaaaagguuggaacgauuggcagcaaguuccauuuugcagucaucauuuccaccaacuaaucaugaaagaugguagagaaaucguagucccaugccgaaaccaggaugaacuugugggacgagcacgcguaucccaaggagcgggcuggucacuacgugaaacagcauguuugggaaaaagcuaugcacaaauguggcaguuaauguauuuucauaggcgagauuugcgacuagccgcaaaugcaauuuguagugccguucccguggauugggucccaacgaguaggacgacuuggaguauacaugcgcaucaccaauggaugacaacagaagauauguugucaguauggaauaggguauggauugaagaaaacccguggauggaagacaaaacucaugucucaaguugggaagacguaccuuauuuaggaaaacgagaagaucaaugguguggauccuuaauaggucuaaccgcucgagcaacuugggccacuaacauucaagucgcaaucaaucaaguuagaagauuaauaggaaaugagaacuaucuagauuauaugacaaguaugaaaagguuuaaaaaugagagugauccugaaggcgccuugugguag

SEQ ID NO: 21085 - RNA, 9879 nt, Artificial Sequence
  derived and/or modified CDS sequence (opt6) from DENV-1__AB195673__SS-prME
agugucaccauguuacuuauguuacuuccuacugcacuuacuuuccauuuaacgacuaggggaggagaaccccacaugauuguagggaaacaagaaagagguaagagcuugcuauuuaaaaccucagcaggagugaacaugugcacuuuaauagcaauggauuuaggggaacuaugcgaugauacuaugaccuacaaaugcccucgcauaacagaaaccgaacccgaugacguugacuguugguguaacgcaacugaaacauggguuacuuacgggacauguucgcaaacgggcgaacacaggcgcgauaaacgaucuguggcuuuagcaccacaugucgguuuaggauuagaaacacggacagaaacuuggaugagcucagaaggggcauggagacaaauacaaaaaguugaaaccugggcguugaggcaccccggauuuacaguaauagcgcuauuccuggcgcaugugauugguacuucaaucacacaaaaaggaauaauauucauacugcuaaugcuaguaaccccaagcauggcuaugcgaugcguaggaauagguaauagagauuucgucgaaggauugagcggagcuacuuggguggauguaguauuggaacacgguucuuguguaacaacgauggcaaaagauaaaccgacgcuagacauugaauuacucaaaacugaaguaacaaauccagcuguacuacguaaauuaugcauagaagcuaaaauuucaaacacuaccacagacaguagauguccaacacaaggagaagcgacauuaguagaagaacaagauaccaacuuuguuuguagaagaacauucguggaucgaggaugggguaaugggugcggacuauucggaaaaggaucacugauaacaugugcgaaauucaaauguguuacgaaacuagaaggaaaaauugugcaauaugaaaaccuuaaauauucaguaauugucacgguucauacuggggaucaacaccaaguugguaaugaaacaacagaacacggaacgauagcaacgauaacuccacaggcgccaacaagugaaauccaauuaacggacuauggagcauuaacauuggauuguucuccaagaacaggucuagacuucaacgaaauggucuuauuaacaaugaaggaaaaaucauggcuaguucauaaacaaugguuucuagacuugccgcuacccuggacgagcggcgcgucaacuucacaagagacauggaauagacaagauuuauuaguuacuuuuaagaccgcucacgcaaagaaacaagaaguaguugucuuagggucccaagaaggagcuaugcacacagcauugaccggagcuacagaaauucagacaagugguaccacaacaauauuugcaggucaccuaaaaugcagguuaaaaauggauaaacuuacguuaaaaggaauuaguuacguuauguguacagguagcuucaaauuagaaaaagagguagcggagacacaacacggaacagucuugguccaaguuaaauaugaagggacggaugcaccauguaaaauaccguuuucaagccaggaugagaaagguguaacacagaacgguagacucgucacugcaaauccaauuguaacggacaaagaaaaaccgguaaacauagaggcagaaccacccuuuggagaaucauauaucguagucggugccggugaaaaggcuuugaagcucagcugguuuaagaaaggaucaucgauaggcaaaauguuugaagcaacagcaaggggagcgcgaaggauggcaauacuuggcgauacagcaugggacuuugggucuauuggcgguguauucacgucaguggggaaguuaguccaucaaauuuucgguacagcuuauggaguacuauuuucuggaguuucguggacuaugaaaauaggaauuggaauuuuacuaacauggcucggucuaaacucucguucgacaucuuugagcaugacuuguauagcugucggacuaaucaccuuauaccuagguguaaugguacaggcagauucaggauguguuauuaacuggaaaggucgagagcuuaaauguggcagcgguauauuuguaacaaacgaaguucauacuuggacagaacaguauaaauuucaggccgacaguccaaaaagacuuuccgcagcaauaggcaaggcuugggaagaaggcguuugcggaauuagaucagcaacuaggcuugagaauaucauguggaaacagauaaguaaugaauugaaucacaucuuauuagagaaugacaugaaauucaccguaguugucggcgacgucagcgguauacuugcacaaggcaagaaaucgauaagaccucaaccaauggagcauaaauauucauggaaaucauggggaaaagcaaagauaaucggagcggaugugcagaacaccacuuuuaucauugacgguccaaauacacccgaaugcccagaugaccagagggcauggaacauaugggaggucgaggauuauggguuuggaauuuucacuaccaacauauggcuaaaacuaagagacucauauacgcaaguaugcgaucaucgacucaugagugccgcaauaaaagacagcaaagccguucacgcugacaugggauauuggauugagucagagaaaaaugaaaccuggaaauuggcucgagccagcuuuauugaagugaaaacguguauuuggccuaaaucgcacacacuauggucaaaugguguacuggagucugaaaugauaauuccaaagauauacgguggcccuaucucacagcacaauuaccggccaggguauuuuacacaaacugcgggaccauggcaccuuggaaaacuggagcuugauuucgaccuaugugaggggaccacuguugugguugacgaacacuguggaaauagaggcccaucccugagaacuacaacagugaccggcaaaauaauacacgaauggugcugucgaucauguacucuaccaccauuacgcuucaaaggugaagauggauguugguaugguauggagauaaggccaguaaaagaaaaagaagagaaucucgugaaaucaaugguaucagcuggcagcggagaggucgauaguuucucauugggucucuuauguauuagcauuaugaucgaagaagugaugagaucucgauggagcaggaaaaugcuuaugacuggaacucuggcgguguuuuugcuguuaacuauggggcaacucacuuggaacgaucucauaagauugugcaucaugguaggcgcuaacgcauccgauaauauggggaugggaacaaccuauuuggcuuuaauggccacauucaggaugcgaccgauguucgcagucggacuuuuguuuagaagguuaacuucaagagaggugcuucuacuaaccguuggcuuauccuugguagcuagcguggaacuuccaaacucacuggaagaacuaggagacgguuuagcaauggguauaaugauacugaaauugcucacagacuuucagucacaccaauugugggccacgcuacuuucccuaaccuuugugaagaccacauuuucacuacauuacgccuggaagacuauggcaaugauucuuaguauaguuuccuuauuuccauuaugccuuucaacgacgagucagaaaacaacguggcuuccgguccuucugggcucguuagguuguaaaccuuuaacuauguuucucauaacugaaaacaagaucuggggacgaaaaucauggccgcuaaaugagggaauaauggcaguagggauaguaaguauacuuuuaaguagccugcucaaaaacgauguaccuuuagcugggccuuuaauugcuggcggcaugcuaauagcauguuauguaauuucuggcagcagugcugaccuaagccuggaaaaagcugcggaaguaucuugggaagaggaggcagagcauuccggagccagucauaauauauuggucgaaauacaagacgacggaacuaugaaaauaaaagacgaggaaagagacgauaccauaaccauucucuugaaggcuacccuauuagcuauuaguggagucuacccaaugucaaucccagcaaccuuauuugugugguauuuuuggcagaagaagaaacaaagaucgggaguccugugggacaccccuucuccuccagaggucgagagagcuguucuugacgauggaaucuaccgaauacuucaacgaggauugcuuggucguagucagguagggguaggaguguuccaagaagggguauuucauacuauguggcauguuaccagaggagcgguacucauguaucaggguaaaagacuggaaccaagcugggcaucgguaaagaaagaucuaauaucauauggugguggcuggagguuucaggguucauggaacaccggagaagaaguucaaguaauagcuguugagccgggcaaaaauccgaaaaacgugcagacugcaccuggaaccuucaaaacgagcgaaggagagguaggggcaaucgcccuugauuuuaaaccagguacaaguggaagcccuaucguuaacagggaaggcaaaaucguugguuuauaugggaauggcguugucacaacaagcggcaccuauguguccgccauugcgcaagcuaaagcaucccaagaaggaccacuuccugaaauagaagacgaaguuuucagaaaaagaaaccuaacuauaauggauuugcauccagggaguggaaaaacccgucgcuaucuaccagccauuguacgagaagcaauuaaacguaaacuacgaacccuuguacuugcccccacaagaguaguagcuagugaaauggcggaggcucuaaaaggcaugccuauucgcuaucaaacaacugcggugaaaucugaacauacagggagggaaauaguagaccuuaugugucaugcuacauuuacaaugcgguugcugucccccgucagaguuccuaacuacaauaugauaauuauggacgaagcucauuuuacagauccggccaguauagcagcaagaggauacaucagcacccggguaggcaugggagaggcagcagcaauuuucaugacagcuaccccaccaggaucuguagaggcuuuuccacagucuaacgcugugauucaagaugaagaaaaagauaucccagaacgaaguuggaacucaggcuacgauuggauaacagauuuuccagguaaaaccgugugguucguacccagcauaaaaaguggaaaugauauagcuaauugucuuagaaagaauggcaaaagagugauacaguuaaguagaaaaaccuuugauaccgaguaccagaaaacuaagaacaaugauugggauuacguaguaacaaccgauauauccgagaugggagcuaauuucagagcagaucgaguaauagaccccaggcgaugcuuaaaaccuguaauacugaaagacggacccgaaagaguaauucuugcuggacccaugccagucacgguagcaagcgcagcucagaggcguggucgaauaggaaggaaucaaaacaaagaaggugaccaauauaucuauaugggacaaccacuaaacaaugacgaagaucaugcucacuggacagaagcaaaaauguuacuagacaauauaaauacaccugaagguauuauuccagcauuguuugaaccugaaagagaaaagagugccgcaauagacggagaguaucgauugcgaggcgaagcacgaaaaacauuuguagaauuaaugcgucgcggugaucugcccguaugguuaaguuauaagguagcaagcgaaggcuuucaauacucugauagaagaugguguuuugacggagagaggaacaaccaaguauuagaagaaaauauggauguugagauauggacuaaggaaggugaaagaaagaaacuacggccaagguggcuagacgccagaacuuauagugauccguuagcacuuagggaguuuaaagaguucgcagcagguagacgauccgucucaggugacuuaauauuagaaauagggaaacuuccgcaacaucugacacaacgagcucaaaaugcgcuagauaaucugguaauguuacauaauucggaacaaggagguaaggcuuauagacacgcaauggaggaauuaccagacacgauagaaacacuuaugcuguuggccuuaaucgcaguuuugacaggagguguuacuuuauuuuuccugaguggacgugguuuaggcaaaacauccauaggauuauugugugucaugaguuccuccgcauuacuauggauggcuagcguggaaccgcauuggauagcagcaagcauuauacuagaauuuuucuuaaugguacucuugauucccgagccagacagacagagaacaccucaggacaaucaguuggccuauguaguaauaggauugcuauucaugauacuaacuguagcggcgaaugaaauggguuuacuagaaacgacuaaaaaggacuuagguauuggacaugcggcagcugaaaaucaccaccaugcggcaaugcuugacguugaccuacauccagcuucggcuuggacauuauaugcuguagcuacgacaauaaucacuccaaugaugcgacacaccauagaaaauaccacugcuaauauuagccugacagccauagcuaaucaagcagcgauccucaugggacuugauaaagguuggccuauaaguaagauggacauaggaguaccacuccuagcauuagguuguuacucgcaaguuaacccgcuaacauuaaccgcggccguucucauguuggucgcgcauuacgcuaucauaggaccugguuuacaagcuaaggcaacucgugaagcgcaaaagaggaccgcagcagguaucaugaaaaacccuaccguugauggaaucguggcuauagaucuggacccaguuguauaugacgcaaaauuugaaaaacaauuaggacaaauuaugcuauugauacuuuguacaucacaaauacucuuaaugagaacaaccugggcucucugcgaaucuauaaccuuggcuacggggccauugacaacacuaugggaggggucccccggaaaguuuuggaauacuacuauagccgucagcauggccaauauauuuagagguaguuaucuugccggggcaggucuagcuuuuuccuugaugaaaucacuuggcggaggcagacgggguacaggagcucaaggagagacgcucggugaaaaguggaaacgccaacuaaaucagcuguccaaaucagaguucaauauuuacaagaggagugggauaguagaaguggacagaagcgaagccaaagagggacuaaagcguggugagacaauaaaacacgccguuucucgagguacagcaaaguugcgaugguucguagaaagaaaccuaguaaagccugaggguaaaguaauagauuuggguuguggaagagguggguggucuuauuauugcgccggguuaaagaagguaacagaagugaaaggauacaccaagggaggacccgggcaugaagaaccuauucccauggcaacuuauggguggaaucuuguaaaguuauauagugguaaagaugucuucuucauaccacccgaaaaaugugauacauuauugugugacauuggugaaucaucgcccaacccuacaauugaagaagggagaaccuugcgcgugcuaaaaaugguagagccaugguuaagagguaaucaauucuguauaaaaauucuaaacccguauaugccgucuguaguagagacacucgaacaaaugcaaagaaagcacgguggaauguuaguacggaauccguuaagcaggaacucuacucaugaaauguauuggguuucaugugggacugggaauauaguauccgcugugaauaugacaagcagaauguuguuaaacagauucacaauggcucacaggaaacccacauaugaaagagauguugaucucggagcuggaacaagacacguagcagucgaacccgaaguugcaaaucucgauauaauuggacaaagaaucgaaaacauaaagaaugaacauaaaagcacguggcauuaugacgaagacaauccguacaaaacuugggcauaccauggaucguaugaaguuaaacccucaggcucagcaucaucuaugguaaaugguguuguaagguuguuaacaaaacccugggaugucaucccaauggugacgcaaauugccaugacugacacuacaccguuuggucagcaaagagucuucaaagaaaaaguugacacacggacuccaaaagcaaagagggggaccgcacaaauuauggaagugacggcuaaguggcuauggggauuuuuaaguagaaauaagaaacccagaauuugcacaagagaggaguucacucguaaggucagaaguaaugcagcaauaggagcuguuuuuguggaugaaaaucaauggaacucugcaaaagaagcugucgaagaugaaagauucugggaucuaguuagaagagaacgagaauuacacaaacaaggcaaaugugcgacaugcguuuauaauaugaugggaaaaagggaaaagaaacuaggcgaguucgguaaagcgaagggaucgagagcaauaugguauauguggcuuggggcccgauuucucgaguucgaagcucuugguuuuaugaaugaagaucauugguuuagcagggaaaauucucugucuggaguggagggcgaagguuuacacaaacucggauacauccuccgugauauuaguaaaaucccagggggaaauauguacgcagacgauacagccgguugggacacacguauuacugaagaugaccuccaaaaugaggcaaaaauuacggacauaauggaaccagaacaugcucuccucgcgacgucaauauuuaaacuaaccuaucaaaauaagguagucaggguacagcguccggccaaaaaugggacagucauggacgugauuuccagaagagaucagagaggcagcggacaaguaggaaccuauggacucaauacuuuuacuaauaugggcgcccaacuaauucgccaaauggaaucagaagguauauucucccccagcgaacuggaaacgccuaauuuagccggacgagucuuggauuggcuugaaaaacauggaauugagagacuacgccgaauggcuauuaguggggaugauuguguagucaaaccaauagaugaccgauuugcaacagcguuaacugcacuaaacgacaugggaaaaguccgcaaagauauuccucagugggaaccuucgaaaggcuggaacgauuggcaacaaguccccuucugcucucaccacuuucaucagcugauaaugaaagacggaagagagauagucguaccuuguagaaaucaagacgagcuagucggcagagcaaggguaucucaaggcgccggcuggagucucagagaaacggcauguuuagggaaaagcuaugcacagauguggcaacuuauguauuuucaccgcagagauuuaagguuagcagcaaaugcaaucugcucagccguaccuguugauuggguuccaaccagucgaaccaccuggaguauucaugcucaucaucaauggaugaccacugaagacaugcugucgguauggaauagagucuggauagaagaaaauccuuggauggaagacaaaacucacgugucaucaugggaagauguaccauacuugggcaaacgggaagaucaaugguguggcagcuugauagguuuaacagcacgugccacgugggccacgaacauucagguggcuauuaaucaaguccgaagguugaucggaaacgaaaacuauuuagacuauaugacaagcaugaaaagauuuaaaaaugaaucugauccggaaggugcacugugguaa

SEQ ID NO: 21086 - RNA, 9879 nt, Artificial Sequence
  derived and/or modified CDS sequence (opt6) from DENV-1__AB204803__SS-prME
ucaguuacuauguuacucaugcuauuacccacgguacuaacguuucaucucaccacuagggguggggaaccucauaugauuguaaguaaacaagaaagagguaaaucacuccucuuuaagaccuccgcagggguuaauauguguacgcugauagcaauggacuuaggugaacucugcgaagauacuaugacguauaaaugucccaggauaacugagacugagccugaugaugucgacuguuggugcaaugcaaccgagacguggguaacuuauggaacuugcucccaaacuggagaacauaggcgggacaagcgaagcguggcauuggcuccacauguaggacucggacuagaaacgagaacggaaacauggaugucgucugagggggcuuggaagcaaauacaaaaaguagaaacaugggcgcuaaggcauccgggauucaccguuauugcucucuuccuugcacacgccaucggaacaaguauuacgcaaaagggaaucauuuuuauauuacugaugcuaguaacacccucuauggcgaugcgauguguaggaauaggaaaucgagauuuuguagaaggacuauccggggcaacuugggucgacguaguacuagaacauggcucguguguuacaacaauggcaaaggauaaaccgacacuagauauagaacuacuuaaaacagaagucacaaacccagcuguauuacgcaaguuauguaucgaggcuaaaauaagcaacacaacaacggauucacguuguccgacucaaggugaggcuacucucguggaagaacaagauacaaacuucguaugccgaagaaccuucguugauagaggauggggaaacgguuguggccuuuuugguaaaggcagcuuaauaaccuguguuaaauuuaagugcguaaccaaauuagaaggaaaaauagugcaauaugaaaaccuuaaauauagcgucaucgucacuguacacacaggagaucaacaccaaguagggaaugaaacgacagagcaugggaccauagcgacaauuaccccucaagcaccaaccucggagauacaacuuacagacuauggagcauuaacacuagauugcucgccaaggacagguuuagacuucaaugaaaugguauuacuaaccaugaaagagaaaaguugguuagugcacaagcaaugguuccuugaucuuccucucccuuggacaaguggagccaguaccucccaagaaacauggaaccgucaagacuuguuaguuacauuuaagacugcucaugccaagaaacaagaaguagugguacuugguucacaagagggcgcgaugcauacggcuuugacgggugcgacugaaauccagacgucgggcacaacaaccauauuugcuggucaccuaaaaugucgacuaaaaauggauaaacuaacacucaaaggcacauccuauguaaugugcacagguccuuuuaaacuggaaaaggagguagcugaaacgcaacacgggacuguuuugguucaaguaaaauaugaaggaacagaugcaccaugcaaaauaccguuuaguucucaagaugaaaaggguguaacacaaaaugggagguugaucacggccaacccaauaguuacugacaaagaaaaacccauaaauauugaggcugaaccgccguuuggugaaucguacauuguaguggguguuggagaaaaggcucuaaaacuuucaugguuuaagaaaggcucaucuaucggcaaaauguucgaagcuacggcaaggggugcucgaaggauggccauauuaggagauacugcaugggauuucgggucuauaggugggguauucacaaguaugggaaaacucguacaucaaauauuuggcaccgcauacggaguuuuauuuucuggagucucguggacaaugaagauuggcaucgguauacuguugacuuggcucggacucaauucaagaucgacaucccugaguaugacgugcauagcaguaggaaugguaacauuauacuuaggugucaugguacaagcagacagcggaugugucauaaacuggaaaggaagagaacuaaaauguggcaguggaauauuuguuacaaaugagguucauacauggacagaacaguauaaauuucaagcggauagucccaagagauugagcgcggcuaucgggaaagcaugggaagagggaguaugcgguauaaggucagcgacccgucuggagaauaucauguggaagcaaauuucgaaugaacuuaaccauauuuuacuagagaacgauaugaaauuuacagucguaguuggagauguaucaggaauuuuagcccaaggcaagaaaaugauacggccacaaccaauggagcacaaauacucuuggaaaucgugggggaaagcgaaaauuauaggagcugauguacaaaacacuaccuuuauaaucgaugggccaaacacaccagaauguucagaugaucagcgugcauggaauauuugggaaguggaagacuacggauuuggcauauuuacaacuaacauuugguuaaaauuacgggacaguuauacacaaguaugcgaucaccgauuaauguccgcggccauaaaggacucaagagcaguacaugcggauaugggauauuggaucgagucagagaagaaugaaacauggaaacuugcccgugcuucauuuauugaaguuaaaacaugcauauggccuaaaagccacacguuauggucgaauggcguguuagaaucagagaugauuauccccaagauauacggcgguccaauuucucaacacaacuaccguccggguuacuucacccaaaccgccggaccauggcaccugggaaaguuagaguuggauuucgaucuuugugaagguacuacaguaguuguugacgagcaaugcggaaacagggggccgagucuacgaacuacaacaguaacugggaaaauaauacaugaaugguguuguagguccugcacgcuuccacccuuaagguucaaaggugaagauggguguugguacggaauggaaauaagacccgucaaagaaaaagaagagaaccuaguaaaaucaaugguaagugcugggucgggagaaguugauucauucucgcuaggguuacuaugcaucaguauaaugauagaggaagugaugcguucucguuggucaagaaaaaugcuuaugacggguaccuuggcuguauucuuacugcuaacaaugggacaacugacuuggaaugacuugauacgguuauguauuauggugggagcuaacgcuucagauaaaauggggaugggaaccaccuauuuagcucuaauggcuacguuucgaaugcgaccaauguuugcaguaggauuacuguuuagagggcuaacaaguagagaaguacuguuacugaccgucggacuaucguuggucgcuucaguugagcuaccuaauucauuagaggaacuuggcgauggcuuggcgaugggaauaaugaugcugaaguuauuaacagauuuucagucacaccaacugugggcaacguuauugagccuaacauuugucaaaacaacuuucucccuacauuacgcuuggaaaacuauggccaugacacuuagcauaguaucacuuuuuccuuuauguuuaucaaccacaagucagaaaacuaccuggcuaccagugcuauuagggucguuaggauguaaaccacuuacaauguuucuuaucacugagaauaagauuuggggacguaaaucauggccucucaacgaaggaauaauggcagucggaaucguaucuauauuacugucaucucuacucaaaaaugauguuccucuagccggcccuuugaucgccggagguaugcugauagcgugcuacguaauaaguggcucuagcgcagaucucagccucgaaaaagcggcagaaguaagcugggaagaagaagcagaacauucuggggccagucacaacauauugguagaaguacaagacgacggaacaaugaaaaucaaagacgaggagagagacgauaccauaaccauauuguuaaaggcuacauuauuggccaucagcggcguauacccuaugucaauaccagcaacuuuauuugucugguauuuuuggcagaaaaagaaacaaagaucagguguauugugggacacgccaucaccaccagaaguagaaagagcaguucuugaugacggaauauaucgaauauugcaacggggacuauugggccgcucacagguuggcguaggaguauuccaagaaggagucuuccacacaauguggcaugucacccguggagcaguauuaauguaccagggaaaaagacuagagcccucaugggcaagugucaagaaagaucucauuaguuacggaggaggauggagauuucaaggcaguuggaacaccggcgaagagguacaagugaucgcgguagaaccaggcaaaaaccccaaaaauguucagaccgcaccugggacguuuaaaacaucggagggugaaguaggcgcgauagcauuagacuucaaaccugggacaucuggaucaccuauaguuaauagagaagggaaaauaguaggacuuuauggaaaugguguagugaccacauccggaacuuacgugucagcaauagcacaagcaaaagcaucgcaggaagggccucuacccgagaucgaagaugaaguauuuagaaaaaggaaccuuacaauaauggauuuacauccgggaucuggaaaaacuagacguuaccuaccagccaucguaagagaagcaauaaaaaggaaauuaagaacucuaguauuagcgccaacuagaguuguugccucugaaauggccgaagcccuuaaagguaugccgauaagauaccaaacuaccgcggucaaaagcgaacacacgggaaaagaaauuguagaccuaaugugucaugccacguuuacuaugcgacuauuaucuccuguccgagucccuaauuauaauaugauaaucauggaugaggcacauuucacggauccagcaucaauagcggcaagagguuauauaagcacacgaguagggaugggagaggcagcagccaucuucaugacagcuaccccaccuggaucaguugaggccuuuccacaaucaaaugcugucauucaagaugaagaaaaagauauaccugaaagaaguuggaacucaggguacgacuggauuaccgauuuccccggaaaaacagucugguuuguaccauccauuaaaagcggaaaugauauagccaauugucuuagaaagaauggaaagagagugauucaauuaagucgaaaaacauucgacacagaguaccagaaaacuaagaauaaugauugggauuacguaguuacuacggauauaucggagaugggggcaaacuucagggccgacagggucauagacccaaggagaugccuuaaaccuguuauacuaaaggaugguccagagcgcguaauauuagcuggaccuaugccaguaacgguugcgucagcagcccagaggcggggucgaaucggcaggaaucaaaacaaagaaggagaucaguauauauacaugggucaaccucucaauaaugaugaagaucaugcgcauuggacggaagcaaaaauguuauuagacaacauaaauacacccgaagggauaauuccggccuuauuugaaccagagagagagaaaagugcagcaaucgauggagaauauagacuuagaggggaagcaagaaaaaccuucguugaauugaugagacgaggggaccuaccaguauggcuauccuauaaaguugcaucggaaggauuccaguauuccgaccgaaggugguguuuugacggggagcgcaacaaccaagucuuagaggaaaacauggacgucgagauuuggacgaaggaaggcgagcggaagaaacugcguccucgauggcuggacgccagaacauauuccgacccucuugcgcugagagaauuuaaagaauuugcggccggacggagguccgugaguggagaccuaauuuuagaaauaggaaaauugccccaacacuuaacacaaaaagcacagacggcgcuagacaaucuuguuaugcuccacaauagugaacaaggugguaaggcguaucgucacgcuauggaagaacuuccagauacaauagaaacacucaugcuccuugcgcucauagcaguuuugacaggaggcguuacauuauucuuucucaguggcaaaggccuaggaaagacaaguaucggacugcugugugucauguccucgagcgcuuuacuguggauggcaucaguugaaccccauuggauagcagcgucuauaauacuugaguucuuuuugaugguacugcuaauaccagaaccugaccgacagagaacaccccaagauaaucaauuggcauauguuguaauaggauuacuauuuaugauucuuacugucgcugcaaacgaaaugggucuccuagaaacuacgaagaaagaucuaggcaucggacacgcagcagcagaaaaucaucaucaugcagcaauguuagaugucgaccuccauccugcgagugccuggacgcuauaugcaguugcaaccacaauaauaacaccuaugaugcgucauacgauagagaauacuacagcuaauauuucgcuaaccgcaauagcgaaucaagcagcaauucuaaugggauuagauaaggguuggccuauaaguaaaauggauauuggaguuccuuuguuagcgcuaggaugcuacagccaagucaauccguuaacauugacggcggcaguccucaugcuaguggcucacuacgcaauuauagguccggggcuacaggcgaaagcuacucgugaagcccagaaaaggacugcugccggaauaaugaaaaauccaacuguugauggaaucguugcuaucgaucuugacccaguagucuaugaugcuaaguucgaaaaacaauuaggucaaauaauguuacucaucuuaugcacuucucagauacucuuaaugcggaccaccugggcucuuugcgagaguaucacccuggcuacugguccauuaacuacauuaugggaagggucaccgggaaaguucuggaacacaacuauagcaguaucuauggcuaacauuuucagaggaagcuaccuagcaggggcaggccuggcauuuaguuuaaugaaaucauuagggggcggaaggcggggaaccggugcccaaggagagacauuaggagagaaauggaagagacaguugaaucagcuuaguaaaucagaauuuaauacuuacaaaagaucggggauuauggaaguagauagaagugaagcaaaggaggguuugaaaaggggagaaacgaccaaacaugcaguaagcagagguacagcaaaacucaggugguuuguagaaaggaauuuaguaaaaccggaagguaaaguuauagaucugggcugugggagaggcggauggucauauuacugcgcgggacucaagaaagucacagaaguaaaaggcuauacaaaaggagggccuggacaugaagaaccgauaccuauggcgacguauggauggaaucuaguaaaacugcacagcgggaaagacguauucuuuauuccuccggagaagugugauacuuuauuaugcgauauaggugaaagcucuccuaacccaacgauagaagaaggucgcacauuacggguacucaaaaugguagagcccuggcuucgcggaaaccaguuuuguaucaagauccuuaauccuuacaugccaucaguuguagaaacauuagaacagaugcaacgaaagcaugguggcaugcuaguaaggaacccacuuucaagaaauucgacgcacgaaauguauuggguaucuugugguaccgguaacaucgucagcgcaguaaauaugacuucuagaaugcugcuuaauagauuuaccauggcgcauaggaaaccaacauacgaaagagacgucgaucuuggagcuggaacaagacauguagcagucgaacccgaaguugcaaaccuugacauaauaggccagcgaauagagaauauaaagaaugagcauaaguccacuuggcacuaugacgaggacaacccuuacaaaacuugggcauaucacgguuccuacgaaguaagacccaguggaagugcauccucaauggugaauggaguuguacgacucuugacaaaaccaugggacguaauaccaaugguuacacaaauagcuaugacugauacuacgccguucggacaacaaagaguguucaaagaaaaagucgauacucggaccccuaaagcuaaaagggguacugcgcagauuauggaaguuacagcaaaaugguuguggggauuucuuucaaggaacaaaaagccacgcauauguacacgagaagaauuuaccagaaagguaagaucaaacgcagccauaggcgcaguauuugucgaugaaaaucaauggaacagcgccaaagaagcaguagaggacgaacgauuuugggaucuagugcacagagaaagggaauugcauaaacaaggaaaaugcgcaacaugcguauacaauaugauggguaaacgugagaagaaacugggcgaguuuggaaaagccaaagggucacgugcaauuugguacaugugguuaggggcaagauuucucgaauuugaagcauuaggcuuuaugaaugaagaucauugguuuucucgugagaacucacuaucgggaguggaaggggaaggacuacauaaacuaggauacaucuugagggauauuuccaaaauaccgggaggaaauauguacgccgaugauacagccggaugggauacucgcauaacugaggaugaucugcaaaaugaagcuaaaaucacugauaucauggaacccgaacaugcacuauuagcuacaucaaucuuuaaacugaccuaucagaauaaagugguaaggguucagagaccggcuaaaagcgguacuguaauggaugugauaagucggagagaccaaagagguucaggacaaguuggcacuuacggauuaaacacuuuuacgaacauggaagcccaauuaauaagacaaauggaaucggaaggaauuuucagcccaagugaacuugaaacacccaaccuugcuggcagaguauuagauuggcucgaaaaacauggaauagagagacuaaagcgaauggcaauaucuggugaugauugcguuguaaaaccaauagacgauagguucgcaacggcauuaacagcuuugaacgauaugggcaagguaaggaaagacaucccacaaugggaaccgaguaaaggauggaacgauuggcaacaaguaccguuuugcucacaccacuuucaucaauuaauuaugaaagacggaagggaaaucguaguuccuugccgaucucaggaugaguugguaggaagggcaagaguaucccagggagcaggauggagucugagagaaacugcuugucuaggaaaaucauacgcucaaauguggcaauuaauguacuuccaucgaagagaucuaaggcucgcggcgaacgcaauauguucagcuguaccaguugauuggguaccgacaagucggaccacaugguccauucaugcgcaucaucaauggaugacgacugaagauauguugucaguguggaauagaguuuggauugaagagaauccuuggauggaagauaaaacacacguaucuagcugggaggacguacccuaucuuggaaaaagggaggaucaauggugugggucauuaauaggacuaacggcaagggcgacgugggcaacgaacauacaggucgccauaaaucagguaagaaggcuaauugggaaugaaaauuaucuugacuauaugacaucuaugaaaagguucaaaaaugaauccgacccagaaggagcccuaugguaa

SEQ ID NO: 21087 - RNA, 9879 nt, Artificial Sequence
  derived and/or modified CDS sequence (opt6) from DENV-1__LC016760__SS-prME
aguguaacuaugcuuuuaauguuaaugccgacugcuuuagcauuucaucuuacaacacguggaggugaaccucauaugauuguuucuaaacaagaaaggggaaaaucauuauuauuuaaaacgagugcuggggugaacaugugcacauuaauagcaauggaucugggagaacuaugcgaagauacuaugacuuauaaaugcccuagaauaacugaagcugaaccggaugauguagauuguuggugcaaugcuacagacacaugggucacuuacggaacuugcagucaaacaggagaacaccgccgggauaaacgcucgguagcauuagcuccacauguaggacuaggacuagaaaccagaacagagacuuggaugucaucggaaggagcauggaaacaaauacagagaguagaaacgugggcuuuacgacauccgggauuuacaguaauagccuuguuucuugcacaugcaauagguacuagcaucacucaaaaaggaauuauuuucauacuccugauguugguuacaccaagcauggccaugaggugugucggaaucggaaguagagauuuuguggaaggacuaucaggagccacuugggucgacguuguucucgaacauggauccugugucacaacaauggcaaaagacaaaccaacauuagacaucgagcuacuaaaaacagaaguaacuaacccagccgucuugaggaaauuauguauagaggcaaaaauuucuaacacaacaacugauaguagaugcccaacgcaaggugaagcaacuuugguagaagaacaagacgcaaacuuuguauguagaagaaccuuuguagacagggguuggggaaaugggugcgggcuauucggaaaggguagcuugauaaccugugcuaaauuuaaguguguaacaaaauuggaaggaaaaaucguccaauaugaaaaccugaaauacucuguaauaguuacaguacacacgggcgaucaacaucaaguaggaaaugagucuaccgaacaugguaccacagccacgauaaccccucaagcaccaacaacugaaauacaauuaacagauuauggcgcguuaacgcuggauuguaguccucgaaccggauuagauuuuaaugaaaugguccuacuaacaaugaaagaaaagagcugguuaguacauaaacaaugguuuuuggaucuaccauuaccuuggaccaguggggcgucgacaucccaggagacguggaauaggcaagacuugcuaguuacuuuuaagacagcacacgcuaagaaacaagaagucgugguuuuaggaucacaagaaggagcaaugcauacagcucuuaccggagcgacagaaauacagacaucaggcacaacaacgauuuucgcaggucaccuuaaauguagacucaaaauggauaaacucacacuaaaagguaugucauacguaauguguacggguagcuuuaagcuagaaaaagaaguagcugaaacacagcacggaacaguccucgugcaaaucaaauaugagggaacagaugcaccauguaagauaccauuuaguacacaagaugaaaaggguguuacgcagaauggcagauuaauaacugcaaaucccauugucacagacaaagaaaaaccgguaaauaucgaggcugaaccgccauuuggagaaucuuacauaguaauaggugcuggugagaaggcacuuaaacuuucuugguucaagaaagggaguagcauagggaaaauguuugaggcaacagcaagaggcgcacgacgaauggcuauccucggugacacugcaugggacuucggaucaauuggggguguguucacgagcguagggaaauuaguacaccagauauucggaacagcguauggaguccuuuucucagguguaucguggacuaugaaaauaggaaucgguguacucuuaacgugguugggccugaacucgcgaagcacaucguugucuaugacauguaucgcuguaggucuaguuacguuauauuuaggcguaaugguucaagcagacuccggcugcguaauaaacuggaaaggaagagaauuaaaaugcgggagcggcauauuuguuaccaacgaaguacauacauggacagaacaguauaaguuccaggcugauucaccaaaaagacuaucagccgccauagguaaggcaugggaggaaggaguauguggaauaaggagugcgacgagacuagaaaauauaauguggaaacagauaucuaaugagcugaaccauauacuauuagaaaaugauaugaaauucaccgucguuguaggagauguugcuggaauuuuggcccaagguaaaaagaugauucguccacagccaauggagcauaaauacagcuggaaaucauggggcaaggcuaagauuaucggagcagauguacaaaauacaacuuuuaucauugauggaccaaauacucccgagugccccgaugaucaaagagcuuggaacauaugggaaguagaagauuaugguuuuggaauauucacuacgaacauauggcucaaauuaagggauucguauacacaagucugugaucauaggcuaaugucggcugcgaucaaagauagcaaagcaguucacgccgacaugggcuauuggaucgaaagcgagaaaaaugaaacuuggaaacuugcgcgggcauccuuuauugagguaaaaacauguauuuggccgaaaucacacacuuuauggaguaacggaguccuagagucggaaaugauaaucccgaaaauuuauggcggaccgauuucacaacauaacuauaggcccgguuacuucacccaaacugcggggccuuggcauuuaggaaaacuugaacuugacuucgaccuaugcgagggaacaacaguaguaguggacgaacacuguggaaauagagggccaucucuucgaacuaccacaguaacuggcaaaauaauacaugagugguguuguagaucauguacacuaccaccauugcguuauagaggggaggauggguguugguacggcauggagauucgaccggucaaggaaaaagaagaaaauuuaguaaagaguaugguuucggccggaaguggcgaaguagacucauuuucacuaggacuuuuguguauauccauuaugauugaagaagugaugcgaucaagauggucaagaaaaaugcuaaugaccgggaccuuagcgguguuuuuccuauuaauuaugggacaacuaacauggaaugacuuaauaagacuuuguauaaugguaggagcaaaugcauccgauagaaugggcaugggaaccacauacuuagcuuuaauggcgaccuucaaaaugcgaccaauguucgcuguuggacuacuuuuucgccguuugacuagccgagaaguucuuuuacugacaauaggucugucccuugucgccucuguagaacucccaaauaguuuggaagaacuaggagacgguuuggcaaugggaauuaugaucuuaaaguuacucacagauuuccagucacaccaacuaugggcaacucuuuugucucucacauucauaaaaacaacauucucccuacacuacgcuuggaaaacaauagcuaugguauuaagcauuguuucuuuauuuccucuuugucucaguacuacaagucagaaaacuacuugguuaccaguguuauugggaaguuuaggaugcaagccuuuaacuauguuccuaaucgccgaaaacaaaauaugggggcguaaaucauggccacucaaugaagggaucauggcaguagguaucgucagcaucuugcuuucauccuuacucaaaaaugaugucccguuggcgggaccuuuaauagcuggcgguaugcuaauagcauguuacgugauaaguggaaguagugcugaucuaucuuuagaaaaagcggcagaaguaucaugggaagaagaggcagaacacucuggagccucccauaauauccuugucgaaguccaagaugacgggacuaugaaaauaaaagacgaggaaagggaugauacuuuaacaauauuauuaaaggcuacucuauuggcgguaucgggaguuuauccgcucucuaucccagcaacacucuucguaugguauuucuggcagaagaagaaacaaagaucaggcguacuuugggauacaccuagcccuccagaaguggaaagagcuguacuugaugacggaauauaucggauaaugcaacguggucucuuaggaagaucacagguuggagucggaguguuccaagaaaaugucuuucauacuauguggcacguaacgaggggagcuguuuuaauguaucaaggcaaacgauuggagccgucuugggcaucaguaaagaaagauuugauaaguuacggaggagguuggcgccugcaagguagcuggaacaccggggaagaagugcaaguuauugcugucgaaccaggcaaaaaucccaaaaauguccaaacagcuccugggacguuuaaaacaccggaaggagaaguaggugcaauagcacucgauuuuaaaccagguacgucaggaucaccaauaguaaacagagaaggcaaaauaguaggauuauacgguaauggcguaguuacaacuuccggaacauacguuagcgcuauugcgcaagcaaaagcaucacaggaagggccuuugccggagauagaggacgaaguuuucaggaaacgaaaccucacgaucauggacuuacaucccggcuccggaaagacaagaagguaucuucccgcuauaguucgggaagcaauaaagcguaaacucagaaccuuaauccuagcucccacgagaguaguagccuccgaaauggcagaggcucuaaaaggcaugccgauuagauaucagacaacagcugugaaaagcgagcacacaggcaaagaaaucguagaccuaaugugccacgcgacauuuacgaugagguuguugucaccggugagaguaccgaauuauaauaugauaauaauggacgaagcacacuucacugauccaucuuccaucgcagcuaggggcuacauaucuacucgugucgggaugggagaagcugcagcgauuuuuaugacugcaaccccuccuggaucaguugaggcauuuccccaauccaacgcgguuauccaagaugaagaaagggacauaccggagcgaaguuggaacucagguuacgaguggaucacagacuucccgggaaaaacgguaugguuugucccaaguaucaagucagggaaugauauugcaaauugccuccgaaagaacgguaaacgaguaauacaacuaucccgcaaaacauuugacaccgaguaccagaaaacuaaaaacaacgacugggacuauguggugacaacagauauaagcgagaugggcgccaauuuucgugcagaccgaguuauugacccuagaagaugccuuaagcccguaauuuuaaaggauggcccugaaaggguuauuuuagcagggccaaugccaguaacaguagcaucagcugcgcaaaggcgcggaaggauaggccgaaaucacaacaaggaaggugaucaguacaucuacauggggcagccccuaaacaaugaugaagaccacgcucacuggacagaagcuaaaauguuacuugacaauauuaauacaccugaggggaucauaccagcccucuuugaaccagaaagagaaaagagugcagcgaucgauggggaguauagguuacgcggagaggcucguaaaacuuuuguggaacugaugcguagaggagaccucccugucuggcugucauacaagguagcaagcgaaggguuucaauauucagauaggagguggugcuuugauggcgaacgaaacaaccaaguuuuagaggagaauauggacguagaaaucuggaccaaagaaggcgagcgaaagaaauuaaggccacgguggcuagaugcuaggacauacucggacccacuagcucuaagagaauuuaaagaguucgcagcuggaagacgaucuguaucaggugacuugaucuuggaaauaggcaaauuaccacagcaccucacucaaagggcccaaaaugcucuugauaauuuaguaaugcuucauaauagugaacaagguggcagagcauacagacaugccauggaagaguuaccagacacaauagaaacauuaaugcuuuuggcauuaaucgcuguacuaacuggaggaguaacauuauucuuucuuucaggaaaaggcuuaggaaaaacuagcauuggcuuguuguguguaauggcuucaucaguauuguuauggauggcaucggucgagccacauuggauugcagcaaguauaauauuggaguucuuuuuaaugguauuguuaaucccugaaccagacagacaaagaacaccgcaagauaaucaacuagcguauguaguuauuggauuguuauuuaugauauuaacgguggccgcaaaugaaauggguuuacuugaaaccacgaaaaaggacuuaggaaucgggcacguggcaguagagaaucaccaccacgcugccaugcucgauguagaccuacacccagcaagugcauggacauuauacgcugucgcgacaacaauaauuacacccaugaugagacacaccauagaaaauacuacagcaaacauuagucuuacagccaucgcaaaucaagcggcuauucugaugggccuagauaaagguuggcccauaucaaaaauggacauugguguaccccuuuuagcccucggguguuacucacaaguuaacccguuaacacucacggcugccguauuaauguuagucgcacauuaugcaauuauaggaccaggguuacaagcuaaagcaacccgagaagcccagaagcggacagcagcaggaauaaugaaaaaucccacgguggacgguaucgucgcuauugaucuagauccuguagucuacgacgcaaaauuugagaaacagcuaggacaaauaauguuacucauacuuugcacaucccaaaucuuacuuaugaggacaaccugggcacugugcgaaaguauaacauuggccacaggaccacucacaacucuuugggaagguagcccagguaaguucuggaauacuacaauugcgguaagcauggcuaacauuuucaggggaaguuaucucgccggugcaggguuagcauuuaguuuaaugaaaagucuaggcggugggcgaagggguaccggcgcacaaggcgaaacuuuaggagaaaaauggaagagacagcugaaucaacuaucuaaaucugaguuuaauacuuacaagcguagcggaaucauggagguagacaggagcgaggccaaagaaggucuuaaacggggagagacaacgaaacaugcuguaucucgaggaacagcaaaauugcggugguucguugaacgaaaucuaguuaagccagaaggaaaagugauagaucucggaugcggacguggaggauggagcuauuauugugcuggccuaaagaaagugacagagguuaaaggcuacacaaaagguggcccaggucacgaagaaccagucccaauggcgacauauggguggaauuugguaaaauuacacuccgggaaggacguuuucuuuauuccaccugaaaaaugcgauacucuucuaugcgauaucggagaaucuuccccaaacccgacaauugaggagggcagaacucugagagucuuaaaaaugguagaaccauggcuacgcggaaaucaguuuuguauuaagaucuuaaauccauauaugccuucuguagucgaaacucuagaacaaaugcaaagaaaacacggaggaaugcugguacguaacccccucucucgaaacagcacucacgaaauguauuggguaucaugugguacuggaaacaucgugagugcuauaaauaugacaagcagaaugcuacuuaaccgauucacgauggcccauagaaaaccuacuuaugaaagagauguagaccuaggugcgggaacccgacaugucgcuguagaaccugagguagcuaaucuagacauuauaggucaaagaauagaaaacauaaaaugugaacauaaaucuacauggcauuacgacgaggauaauccuuauaaaacaugggcuuaucauggaagcuacgaagucaaacccagugguucagccucuaguaugguuaauggaguaguaaaacuacugacuaaacccugggauguuauacccaugguaacacagauagcgaugacggauacuacaccuuucgggcaacaaagaguauuuaaagaaaaaguggacacacggacaccuaaagcaaaacgcgguacggcucagauuauggaaguaaccgccagaugguuauggggauucuuaucgagaaacaagaaaccgaggaucuguacgagagaagaauuuacgaggaaaguaagaucuaacgccgcuaucggcgcaguuuuuguggacgaaaaccaauggaacucagcaaaagaagcuguagaggacgaacguuucugggaucuaguacauagagaaagagaauugcacaaacaaggaaaaugcgcaaccuguguuuacaacaugaugggaaagagggaaaagaagcuaggagaguucggcaaggcaaagggcaguagagccauuugguacauguggcuuggggcucgcuucuuagaguucgaggcguuaggauuuaugaaugaggaccauugguuuagcagagaaaauuccuuaucaggaguagagggugaaggacuucauaaacuaggcuauauucuuagggacauaucgaaaauuaguggaggaaacauguaugcagacgauacugcaggcugggacacgagaaucacagaagacgaucugcaaaaugaggcaaaaauaacagaaaucauggagccggaacacgcucaguuggcaaaagcaauuuucaaacuuacauaucaaaacaaagucguaaggguacaacggccagccaaaaauggcacaguaauggacguaauaucaagacgcgaucaaaggggaucgggccaagucggaacguaugguuuaaauacauuuacaaacauggaagcucaauuaaucaggcaaauggaaagcgaaggaauauuuaguccuucugaauuagaaaccccgaauuuagcagaacgugucuuagauuggcuagagaaauacggagucgaaagauuaaaaagaauggcgauuaguggggacgauugcguuguaaaaccaauugacgaucgauuugcuacagcuuugacagcccuaaacgacaugggaaaaguccguaaagauauuccucaaugggaaccaaguaagggcuggaacgauuggcaacaaguucccuucuguagucaccacuuccaccaauugauaaugaaagacggacgugaaauaguaguaccaugcagaaaccaagacgaacuuguuggucgagccagagugucacagggagcaggauggucauugcgcgaaacggcaugucuugggaaaagcuaugcgcaaauguggcagcugauguacuuucauagaagggaccucaggcuggcugcuaacgcuauauguucggcuguaccuguagacugggugcccacaagccggacuacguggaguauccaugcgcaccaucaauggaugaccaccgaagacaugcuaucuguauggaacagagucuggaucgaagaaaauccauggaugaaagauaagacacacaucaguucuugggaagauguaccuuauuuaggaaaaagagaagaccaauggugcggaucacucauaggacuaacggcucgagcaacuugggcaacuaauauucaaguagccauaaaccagguccgccggcugauuggaaaugaaaauuaucuagacuauaugacauccaugaaaagauucaaaaaugaaucagauccugaaggcgcauuaugguag

SEQ ID NO: 21088 - RNA, 9879 nt, Artificial Sequence
  derived and/or modified CDS sequence (opt6) from DENV-1__LC128301__SS-prME
aguguaacaaugcuuuuaaugcuacuaccuacagcuuuagcguuccauuugacaacacggggaggugaaccgcauaugauaguuucaaaacaagaacgagguaaaagucuuuuauuuaaaacgucggcagggguuaauauguguacauugauagcaauggacuugggggaauuaugugaagauacgaugacauacaaauguccuagaauaacggaaacagaacccgaugauguagacuguugguguaaugccacggaaacuuggguaacuuacggaacauguucacaaacaggugaacauagacgcgauaaacgcagcguagcucuggcuccucauguaggauugggauuagaaacaagaacugaaacauggaugagcucagaaggagcauggagacagauacagaaaguugaaacgugggcauuaagacauccgggcuuuacgguaauagcguuauuccucgcgcacgcgauugguacuagcaucacucagaaaggcauaauauucauauuacuaauguugguaaccccuaguauggcuaugagaugcgugggaauagggaauagagauuucguggaaggcuugaguggugcuacauggguugauguaguucuagaacacggcaguugcguaacuaccauggcaaaagauaaaccuacacuagauauugaacuauuaaaaacugaagucacaaacccagcaguucucagaaaauuaugcauugaagcuaaaauaucuaauacaacaacagauucuagaugcccgacgcagggcgaagcaacuuuagucgaggagcaagacacaaauuuugugugccgaagaacguuuguggacagaggauggggaaacgguugcgguuuauucggcaaaggcucacugauaacuugcgcuaaauucaaauguguaacuaaacuugaagguaaaauuguacaguaugaaaaucuaaaauacaguguuauuguaacgguccauacaggugaucaacaccaagucggaaaugaaacaacagaacacggaacgacugcgacaaucacuccacaagcaccgacgucggaaauucaacuuacagauuauggagcacuuacauuagauuguucaccucggacaggacucgacuucaaugaaaugguucuauuaacgaugaaagaaaaaucaugguuagugcauaaacaaugguuuuuagaccuuccccucccguggacauccggugccucgaccucgcaagaaaccuggaauaggcaagaucuccuggugaccuucaaaaccgcucacgccaagaaacaagaggugguugucuuaggaucucaagaaggggcuaugcacacagcuuugacaggugccaccgagauucaaacuucaggcacaacuacuauuuuugcagggcacuugaagugccgauuaaaaauggacaaguugacacucaaaggaguuucauaugugauguguacugguucauuuaaacuagaaaaagaaguugccgaaacucaacacgguacuguauuaguucaaguaaaguacgaagguacagaugcaccuuguaaaauccccuucucaucucaagacgagaaagggguaacacaaaauggacgguugaucacggccaacccaauugucacugacaaagagaagccaguuaauauagaagccgagccaccauuuggugaaaguuaccuaguaguuggagccggugaaaaggcucugaaacuuaguugguuuaagaaaggaucgagcaucgggaaaauguucgaagcaaccgcaagaggugccagaaggauggcaauuuugggagauacagcuugggauuucgguuccauaggcgguguauuuaccucaguggguaaauuaauucaccagauuuuugguacggcauauggaguucucuuuucaggagugaguuggacuaugaaaauuggaauaggcauucuauuaacguggcuaggccugaauagcagaagcaccaguuuaaguaugacauguauagcaguugguauggucacccuuuauuugggaguaaugguacaggcugauucaggguguguaauaaauuggaaaggcagagaauuaaaauguggcucggguauauuugucacaaacgaaguucauacguggacagagcaauacaaauuucaagcagauucgccuaagcgucucucagccgcaauuggaaaggccugggaagagggagugugcggaauaagaagcgcgaccagauuagaaaauauaauguggaaacaaauauccaaugaacuuaaucacauauugcucgaaaacgauaugaaauuuaccguaguagugggggauguaaacgguauauuagcacaagguaagaaaaugauucgaccccaaccaauggagcauaaauauucguggaaaagcugggguaaggcaaaaguuauaggugcugaugugcagaauacaaccuucauaaucgacggcccuaacacuccugaauguccugaugaucaacgagccuggaauauaugggaggucgaagacuacggauuugggauauuuacgacaaacaucuggcuuaaauugagagauaguuauacgcaaguaugugaucaccgccuaaugagugccgcgauaaaagacagcaaggccguacacgcagacaugggauauuggauagaaucagaaaagaaugaaacguggaaauuaacaagagccucauucauagaaguaaaaacaugcauuuggccgaaaucucauacuuuauggucaaaugguguauuggaaucugagaugauaauaccuaaaacguaugguggcccaaucucccaacauaauuaucgucccggcuauuuuacucaaacagccgggcccuggcauuuggguaagcucgaguuagacuucggacucugcgaagguacuacaguggucguagaugaacauugcggaaacagaggaccaucguuacgaaccaccaccguuaccggcaaaauaauacacgaaugguguugccgaaguugcaccuugccgccgcugcgauucaaaggagaggacggauguugguacgguauggaaauucggccaguuaaagaaaaagaagaaaaccucguuagauccaugguguccgccggaucgggcgaaguggauagcuuuucacucggauuacuauguauauccaucaugauagaggagguaaugcgaucaagguggagcagaaagauguuaaugacgggaacguuagccguguuuuuauugcuaauaaugggucaauuaacauggaacgauuuaauucgacugugcauaaugguaggggcgaaugcgagugacaaaaugggaauggggaccaccuauuuagcucuaauggcaacuuucaggaugagaccgauguucgcuguaggauuacuauuuaggagauugacaaguagggaaguucuucuucuaacggugggguuaucacucguagcauccguagaauuacccaauucacuagaagaacucggugacggguuggcuaugggaauuaugaugcuaaaacuuuugacagacuuucaaucacaucaguuaugggcagccuuauuaaguuugaccuucguaaaaacaacauucagucuucauuacgcguggaaaacaauggcuaugauauuaucuauuauuucgcuauuuccacuauguaugucaacaacgucccaaaagaccacuuggcugccugugcuguuagguucauuaggaugcaagccacugacuauguucuugauuacagagaauaaaauauggggaagaaaguccuggccauuaaaugaagguauuauggccguugguauaguaucgauucuacuuucuucauuacucaaaaacgaugucccacuugccggcccacugauugcaggaggaauguuaaucgcaugcuaugucauaagcgguucgucagcagauuuaucauuggaaaaagcagccgaagucucuugggaagaagaagcagaacauucaggagcgagccauaacauccuaguggaggugcaagaugacggaacaaugaaaauuaaagaugaagaacgcgaugauacauugacgaucuuauuaaaagcgacgcugcuugcaauaucuggcguauacccgauguccauaccugcaacgcuauuugucugguauuuuuggcaaaagaagaaacaacgaucaggcguauugugggacacaccaaguccuccagaaguggaaagagccguauuggacgacggaauauauagaauuuuacagcguggauuacuaggaaaaucccaggugggagugggaguauuucaagaaggcgucuuccauacaauguggcacguuacucgcggugcgguacuaauguaccaaggaaaaagacucgaaccaaguugggcuucagucaagaaagaucugauaucauacggaggaggauggcguuuccaaggcucuuggaauacuggugaagaaguacaaguaauagcaguagaaccuggcaagaauccaaagaacguacagacagcgcccggcaccuucaagaccccagagggcgagguaggugcaauagcccuugacuuuaaaccgggcacgagcggaagccccauuguuaaucgggagggaaaaaucgugggacuauauggaaauggcgucguuacgacaucgggaacauaugucucugcgauagcucaagcuaaggcuucccaagaggguccgcuccccgaaauagaggaugaggucuuuagaaagcgaaauuuaacuauuauggacuuacaucccggaucgggaaaaacacggcgauacuuaccagcaauagugcgagaggcgauuaaacguaaguugcgaacgcuggugcucgccccaacucgaguaguggccucagaaauggcagaagcucugaaaggcaugcccauaagauaccaaacaacugcaguuaagagugaacauacagggaaggaaauuguagacuuaaugugccaugcaacauucacaaugaggcuauuauccccugugcgcgugccaaauuauaacaugauaaucauggacgaagcccauuuuacagaucccgcuucaaucgcagcgcgaggauacauaucaaccagagucgggaugggagaagccgcagcaauauuuaugacugcaaccccaccugggucaauggaggcuuuuccacaguccaaugcagcaauacaagaugaagaacgagauauuccagagcgcuccuggaauagcggauaugauuggaucacugauuuucccgggaaaacagucugguuugucccuucaaucaaaucgggaaaugauauagcaaacugcuuaaggaagaaugggaaacgaguaguacaacugagccgaaagacauuugauacagaauaucaaaagaccaaaaauaaugacugggauuauguagugacgacagauaucagugaaaugggcgcuaacuuuagagcagaccgaguaauugacccgagaaggugcuuaaaaccaguuauauugaaagacggaccagaaagagugauccuggcgggaccuaugccuguaacuguagcaucagcugcacaacggagagggagaauuggacguaaccagaacaaggagggugaccaguacauuuauaugggccagccauuaaacaacgaugaagaucacgcacacuggacagaagcuaagauguuguuagauaauaucaauacaccugaaggaauaauaccugcucuuuucgaaccugagcgagagaaaagugcagcaauagacggggaauauagacuacguggugaagccagaaaaacauucguugaguuaaugagaagaggagaucuaccuguguggcuauccuacaagguagccucagaaggguuucaauacucagacaggagaugguguuuugauggagaaaggaacaaucaaguucuagaagaaaauauggacguugaaaucuggacgaaagaaggagaacgcaagaaauugcgacccagguggcuugaugcacgaacauauucagauccgcuagcguugcgggaauuuaaagaauuugcagccggaaggcgaucgguaucgggggauuugauauuagaaauaggcaaacuuccccagcaccugacgcagcgcgcacaaaaugcauuagauaauuuggugaugcuccauaauucagagcaaggaggcaaggcuuaccgucaugcaauggaagaacuccccgauacaauugagacucuaauguuacuagcacuuauugccguuuuaacgggaggugugacauuguuuuuccugagugggcgugguuuaggaaaaaccucaauagguuuacucugugugauggcaucaagcgcguuacuguggauggcaucgguagaaccacauuggauugcagcuagcauaauuuuggaguucuuuuuaaugguacuauuaauuccggaaccagaucgacaaagaacaccacaagauaaccaauuagcauaugugguaauagggcuguuauuuaugauacuuacugucgcggcgaacgaaaugggucucuuagaaacaacaaagaaagauuuaggaauuggacacgucgcggcagagucccaucaccacgcagcgaugcuugauguagaccuacacccagcaucugcauggacguuauacgcaguggccacuacaauaauaacgccaaugaugcggcauacaauagaaaacacaacugcaaauauaagccuaacugcuauagcuaaucaagccgcgauuuuaauggggcuagacaaaggcuggccgauuagcaaaauggacauaggugugccucuacuagcuuuggguugcuauucucaaguuaacccacuuacauuaacugccgcuguauugaugcuugucgcacauuacgcuaucauaggcccuggucuucaagcaaaagcuacccgggaagcacaaaagcgaacggcugccggaauaaugaaaaauccuacaguagauggcauaguugcuauagaucuagacccaguaguauaugaugcuaaguuugaaaaacaguuagggcaaaucaugcuacugauccuuugcacaagccaaauacuucuuaugaggacuacuugggcacuuugugaaucgaucacacuagcaacuggaccacuuacaacuuuaugggaagggaguccggguaaauuuuggaauacaacgauagcaguuucaauggcuaacaucuuucgaggcucauauuuggcuggagcagggcuugcauuuucuuuaaugaaaucacuuggcggaggcaggagaggcacaggagcucagggggaaacucuaggugaaaaauggaaacgucaacuuaaccaguuaagcaagagugaauuuaacacuuauaaaaggucgggaaucauggaaguggaccgaucugaggcgaaggaagguuugaaacgaggggaaacgaccaaacaugcagucagucgagguacagcaaagcuacgcugguucguagaaagaaaccuuguaaagccugagggaaaaguuauagacuuggggugcggucgcggagguuggaguuauuacugugcuggacucaagaaaguuacggaagucaagggcuauacgaaaggagguccuggacacgaagaacccaucccaauggcgaccuacggauggaacuuagugaaacuauauuccgggaaagauguguucuuuaccccuccugaaaaaugcgauacacucuugugcgauaucggcgaaucaucaccaaacccgacgaucgaagaaggaagaacccuucgaguacucaagaugguugaaccaugguugaggggaaaccaguucugcaucaaaguacucaauccuuauaugccuuccguuguagaaacgcuagaacaaaugcagagaaaacacgggggaauguuaguuagaaacccguuaaguagaaauucaacacaugaaauguauuggguaaguugcggcacgggaaacauagucucggccguaaauaugacaagucgaauguuauuaaaucgguuuacuaugacacauagaaagcccacauacgagaaagauguggaucugggggcagguaccaggcauguugccgucgaaccagaaguagcgaauuuggauauaauaggucaaagaauagagaauaucaaaaaugaacacaaaagcaccuggcauuacgaugaagauaauccauauaaaacaugggcuuaucacgguagcuaugaagucaaaccaucgggaagugcgucuaguaugguaaacggcguaguaaggcuacucacuaaaccaugggacgucauuccaaugguuacacaaauagcaaugacugauacaaccccguuuggucaacaaagaguguuuaaagagaaagucgauacccguacaccuaaggcuaaaagaggaacagcucagauuauggaaguuacugcacgauggcuauggggauuucuaucucgaaauaagaaaccucguauaugcacuagagaagaauuuacaagaaaaguacggucaaaugcagcaaucggagcaguuuuuguagacgaaaaucaguggaacucagcaaaagaggccguggaggacgaacgauuuugggaucuaguccauagagaacgcgaacugcacaaacaggggaagugugcaaccugcguuuauaauaugauggggaaacgagaaaagaaacuaggagaauuugggaaggccaaagguucuagagcaauuugguacaugugguuaggagcaagauucuuagaguucgaagcucuaggauucaugaaugaggaccauugguucucuagggaaaauucacuaucaggaguugaaggagaaggccuacacaaauuagguuauauacuuagggauauuucuaaaauuccaggcgggaacauguacgcagacgauacggcugguugggacacucguaucacggaagaugaucugcaaaaugaagcaaaaauaaccgacauaauggaacccgaacaugcucuacuagcaacuucuauauucaaauuaacauaccagaauaaaguagugagaguucaaaggccugcgaagaacggaacugucauggauguaaucucaagaagggaucaacgagggagcggucaaguaggaacauauggucuaaauacuuucacuaauauggaagcgcaacuaauacgacaaauggaaucugagggcauuuuccuuccgucagaacuagaaacaccaaacuuagccgaacgggugcucgacuggcuagaaaaacacggcacugagcgauuaaagaggauggcaaucucaggcgaugauuguguuguaaaaccaauugacgacagauuugccacagcauuaacggcccuaaacgauaugggaaagguacggaaagauaucccucaaugggaaccgucaaaaggauggaaugauuggcagcaagucccguuuugcucucaucacuuucaucaauuaauaaugaaagauggaagagaaauuguggucccauguagaaaccaagacgagcuagugggccgcgcaagaguaucacagggagcuggauggaguuugcgagaaacugcuugucuaggcaagucuuaugcccaaauguggcaacucauguacuuccacaggcgggaccuucgauuagcggccaacgcaauaugcagcgcagugccaguggauuggguacccaccucaagaaccacauggaguauucaugcucaccaccaauggaugacaacagaagacaugcuauccguuuggaauaggguauggauugaagaaaacccauggauggaagauaaaacgcaugucucuuccugggaagacgugccuuauuuagggaaacgagaagaccaaugguguggcucgcuuauaggauuaacagcuagagccaccugggcaacaaacauucaaguggccaucaaucagguacgaagacuuauagguaaugaaaacuaucuugauuauaugacauccaugaagagauuuaaaaacgaaagcgauccugagggagcacucugguag

SEQ ID NO: 21089 - RNA, 9879 nt, Artificial Sequence
  derived and/or modified CDS sequence (opt6) from DENV-1__LC011945__SS-prME
ucaguaacuauguuacuaauguuaaugccaacugcauuagcguuucacuuaacuacucgaggaggggaaccgcauaugauagugaguaaacaagaaaggggcaaaucuuuauuauuuaaaaccucagcuggcguaaauaugugcacucuaauagcaauggaccuaggugaauuaugcgaagacacaaugacguauaaauguccuagaaucacggaggcagaacccgaugauguagacuguuggugcaaugcgacagacaccuggguaacuuacgguacguguagucaaacaggagagcacaggagagauaagaggucuguggccuuggcgccucacguuggcuugggccuggaaacgcguacggagacuuggauguccucugaaggagcauggaagcaaauucaaagagucgaaacaugggcgcuaaggcauccaggauucaccguuauagcacuauuucuggcucaugcuauugggacuagcauaacacaaaaaggaaucauuuuuauuuuacuaauguugguuacacccucaauggcaaugcguuguguaggaaucggaagcagagauuuuguugagggguuaucuggagcaacuuggguggauguuguguuggaacaugggucaugcgucacgaccauggcgaaagauaaaccgacacucgacauagagcugcuuaaaacagaaguaacaaaucccgcuguauugaggaaacuuuguauagaagcaaaaauaaguaauacaacuacugauucacgaugcccuacucaaggcgaggcaaccuuaguugaagaacaagaugcuaauuucgucugccgaagaacauuuguugaccguggauggggaaauggauguggccuuuuuggcaaaggauccuuaauaacaugcgcuaaguucaaaugugugaccaagcuagaagguaaaauaguccaguacgaaaauuuaaaguauaguguaauagugacaguacauacuggcgaucaacaccagguugggaaugaaaguacagaacauggaacuacugcuacaaucacaccacaggcaccuacaaccgaaauacagcuuacugauuauggugcgcuuacccuggauugcucuccuagaacgggucucgauuucaaugaaaugguacuacuuacuaugaaggagaaaagcuggcucgugcauaaacaaugguuucuagacuuaccucugccauggacaaguggugcgagcacgucgcaagaaacguggaaccgccaggaucuccuugucacuuuuaaaacugcucacgccaagaagcaagaagucguuguccuaggaucacaagagggagccaugcacacugcauugacaggcgcuacagaaauucagacaaguggaacgacaacuauauucgcugggcaucuaaaaugucgcuugaaaauggauaaacuuacauuaaaggguaugaguuacguuaugugcaccgguucauuuaaguuagagaaagaagucgcugagacacagcaugguacaguguugguacaaauaaaauaugaaggaacggacgcuccuugcaaaauccccuuuucgacucaggacgaaaaagggguaacucaaaauggacgucucaucaccgccaaucccauaguuacagauaaagagaaacccguuaauaucgaagcggaaccaccauuuggugaaagcuauaucgugauaggugccggagaaaaagcucuaaaacucagcugguuuaagaagggcucaucaauaggaaaaauguucgaagcgacggcaagaggagcucgaagaauggcaauacuuggugacacugcaugggauuucgguaguaucggcgguguguucacuuccguaggaaaguugguucaccaaauauuuggcaccgcauauggaguuuuauucucagguguuucauggacgaugaagauugguaucggaguauuacuuacaugguuaggauugaauagucguagcacuucacuaaguaugacaugcauugcgguuggucuaguuacacuauauuuggguguuaugguacaagcagacagcggaugcguaauaaauuggaaaggccgagaauugaaaugugguagugguaucuucguaacuaacgaaguccauacauggacugagcaauauaaauuucaggcugauucaccaaaacgacuauccgccgcgauuggaaaggcgugggaggaaggagucuguggaauuaggucggcuacuagauuagaaaacaucauguggaagcaaauuucaaacgaauuaaaccauauuuugcuggaaaaugauaugaaauuuacugucguugugggggacguugcaggaauacuagcacaaggcaagaaaaugauacggccacaaccgauggagcauaaauacucuuggaaaagcugggguaaagcaaaaauaauuggcgcagacguucaaaauacaacuuucauaauagauggaccaaauacucccgaauguccugaugaccaaagagcguggaauauaugggaaguugaggauuauggguucggcauuuuuacaacaaauauauggcugaaacuaagagauucauacacccaggugugugaucacagguuaaugucggcugcuaucaaagacucuaaagcaguccacgcagauaugggauacuggaucgagucagagaaaaaugaaacguggaaauuagcccgagcguccuuuauagaaguuaaaacguguaucuggccuaaaucgcauacucuguggucuaacggagucuuggaaucugaaaugaucauaccaaaaauauacggaggcccgauaucgcaacauaauuacagaccaggauauuucacucaaacugcuggacccuggcaccuagggaaauuagaguuagauuuugauuuaugcgaaggaacaaccguuguaguagacgagcauuguggcaaccguggaccaaguuuacgcacaacgaccgucacgggaaaaauuauacacgagugguguugcaggagcuguacucugccuccauuaagauacaggggagaagacggauguugguacggaauggagauuagaccuguaaaagagaaagaggagaauuuagugaaaagcauggucagcgcaggaaguggagaaguugauucuuucaguuuggguuugcuauguauaucaauaaugauagaggaggucaugagaucucgauggucacgaaagauguugaugacugguaccuuagcgguuuucuuucugcuuaucaugggacaacuuacguggaaugaccuaauuagauugugcauuaugguuggagcaaacgccucggaccgaauggggaugggaaccacauacuuggcccucauggcaacguucaaaaugaggccuauguucgcuguaggccuauuauuucgacgacucaccucaagagaaguccuucuauugaccaucgggcuaagccuuguggcguccguagaguugccgaauagucuagaagaauuaggugacggacuugcaaugggaaucaugauucuaaaacuauugacugauuuccaaucacaucaacuaugggcaacucucuugagccuuacguuuauaaagaccacauucuccuugcauuacgcguggaaaacaaucgcuaugguucuuuccauaguaucacuguuucccuuauguuuauccacuacuucucagaaaacgacguggcuccccguucuucuaggaagccugggaugcaaacccuuaacaauguuucuaauagcagagaacaaaaucuggggaagaaaaucauggccccuaaaugaggguauaauggcaguagggauaguuucaauccuauugucauccuugcuuaagaacgacguuccauuagcuggaccucuaaucgcgggagggauguuaauagcuuguuauguuauuucgggcagcucagcggauuuaagccuugaaaaagcagcagaaguuaguugggaagaggaggcagagcauucaggggcaucucacaauauuuuagucgaaguucaggaugauggaacaaugaaaaucaaagaugaagaaagagacgauacacuuacuauauuacuaaaagcaacacuucuagcaguuucugguguauauccacucucaaucccugccaccuuguucguuugguauuuuuggcagaagaagaaacaaagaucagguguucugugggauacuccgagcccgccugaaguagaaagagcaguacuagaugaugggauuuaucgcauuaugcagagagguuuacucggcagaucacaagucggagucgggguauuucaggagaacguuuuucauacaauguggcaugugacgagaggugcaguacuuauguaucaagggaaaagacuggaaccgaguugggcgucgguaaagaaagacuuaaucaguuacggagggggauggagauuacaagguucauggaauaccggagaagaaguacaaguaaucgcuguagagccagguaaaaacccuaaaaauguacaaacugccccuggaacuuuuaaaacacccgaaggagaggucggcgcaauugcacuagauuuuaaaccagguacaagcggcucaccaaucguaaauagagaaggaaaaaucguuggauuauauggaaacggugugguuacuacgucaggcacauauguuucugcgaucgcccaagcaaaggcuagccaagaaggaccucuuccagagauagaagacgaaguauuuagaaagagaaaucuuacaauaauggauuuacauccugguucuggaaagacuagacguuacuuacccgcaauuguuagggaagccaucaaacgaaaauuacguacuuuaauacuggcaccgacuagagucgucgcaucugaaauggccgaagcccucaaaggcaugccgaucagauaucagacuacggcaguuaaaagugaacauacaggcaaagaaauugucgaucuaaugugccacgcgacauucacgaugcgucuccuaaguccaguccggguucccaauuacaauaugauaaucauggacgaggcgcauuucaccgauccaucaagcauugcugcucguggcuacaucuccaccagaguggguaugggagaggcugcugcaauuuucaugacagcaacuccaccggguuccguggaagcauuuccacaaucaaaugcaguaauucaagacgaggaaagggacauuccggaaagaagcuggaauagcggauaugaauggaucacagauuuuccggguaagaccgugugguucgugcccuccauaaaaucaggcaacgauauagcgaauugcuuacguaagaauggcaaacguguuauacaauuaagccgcaagacuuucgacacagaauaucagaaaaccaagaauaaugacugggauuaugugguuacuacagacaucucggagaugggugccaauuuccgagcugaccguguaauagauccaaggagaugcuuaaagccaguaaucuuaaaagauggaucggaaagagucauuuuagcggguccgaugccaguuaccguagcgagcgcagcgcagagaagaggaagaauugggcgaaaucauaacaaagaaggagaucaauacauauauaugggucaaccauuaaacaaugacgaagaccaugcccacuggacugaagccaaaaugcuauuagauaacauaaauacgccagaaggcauuauuccugcauuguuugaaccagaaagagagaaaagugcugcuaucgauggugaauaucgguuacggggcgaagcacgaaaaaccuuuguggagcuuaugagaaggggagaccucccgguaugguugucauacaagguugcuucagaagguuuccaauauagcgauagaagauggugcuuugauggugaacgaaauaaccagguauuagaggaaaacauggaugucgaaauuuggacaaaagaaggggaacgaaagaaacuuaggcccaggugguuggaugcaagaaccuacuccgauccucuggcacugcgggaauuuaaagaauuugcggcaggucgcagaucgguaucgggcgauuugauacuugaaaucgggaaacuuccccaacauuugacucaacgcgcucaaaacgcucuggauaaccugguuauguuacauaauucagaacaaggcgguagagcguaccgucacgcgauggaagaauugccagacacaaucgaaacucugaugcuuuuggcgcugauagcuguuuuaaccggagguguaacucuauuuuucuuaaguggcaaaggauuggggaaaacaucaaucggucuauuaugugugauggcauccaguguacugcuuuggauggcaucuguagagccucacuggauagcugcgaguauuauacuugaguucuuuuugauggucuuauuaauaccggaaccugauagacaacgcacaccucaagacaaccagcucgcguauguaguuauaggacucuuauucaugauauuaacgguagcagcgaaugaaaugggauuauuagaaacaacuaaaaaggaucuagguauaggacauguugcuguggagaaucaccaucaugcugcuaugcuggauguagauuuacaucccgcuucugcauggacgcuauaugcugucgcuacgaccauaauaacacccaugaugcgacauaccauugaaaacacaacagcgaauauuucuuuaacagcaauagcaaaucaagcagcuauacuaaugggguuagauaagggauggccgauaucaaaaauggacauagguguuccauuacucgcauugggcuguuauucacaagucaacccacuuacuuugacagcggcgguacuaauguuaguugcgcauuaugcaauaaucggacccggauuacaagcaaaagcaacgcgugaggcccagaaacgaacagcggcugggauuaugaaaaauccuacggucgaugggauaguagcuauagaccuugauccaguuguguaugaugcuaaauucgagaaacaguuaggacaaauuauguuauuaauacuuugcaccagccaaauacuacuaaugagaacaacuugggcauuaugcgaauccauuacccucgcaacggguccuuuaacaacucuaugggaaggcagcccugguaaauuuuggaauacgacgauugcuguaucaauggcuaauauauuucgcggcucuuauuuagcaggagcaggguuggcauuuucauugaugaagaguuuaggugguggaagacgggguacuggcgcgcaaggugaaacacuuggagaaaaauggaagcggcaacuaaaccaguuaucaaagucagaauuuaauacguauaaaagaaguggcaucauggaaguagaucgaagcgaagccaaagaagguuugaaaagaggagaaacuacaaaacaugcaguaagccguggcacagccaaauuaagaugguuuguggagagaaaccuuguaaaaccugaaggaaagguaaucgauuugggcugcgggagaggagguuggucauacuauugugccggccucaaaaagguaacagaaguaaaagguuauacaaaagggggcccaggacaugaggaaccuguaccaauggcgacguacggauggaaucuuguuaaauuacauagugggaaagacguauucuuuauaccaccagaaaagugugacacauuacugugugacauuggggagaguucaccgaacccgacgauagaggaaggacgaacauuaaggguacucaagaugguggaaccaugguugagagggaaccaguucuguauaaaaaucuuaaauccauacaugccaagcguuguggaaacacuugaacaaaugcaacguaaacauggcgggaugcuaguccguaauccacucagcagaaauucgacgcaugaaauguauuggguaucuugcggaacagguaauauaguaagcgcaauuaacaugaccucacgaaugcucuuaaaccgauuuacaauggcgcauagaaagccaacguacgaaagggauguagauuuaggugcaggaacgagacauguagcaguagagcccgaaguggcaaaccuggauauaauaggacaacgcaucgaaaacauuaaaugcgagcacaaaucaacguggcacuaugaugaggacaauccuuacaaaaccugggccuaucauggaucuuaugaggugaaaccaagcggaucggccagcucuauggucaaugggguagugaaacuacucacaaaaccgugggauguaaucccuaugguaacacagauugcuaugaccgacacaacgccguucggucaacaacggguauuuaaagagaaaguugauacccgcacaccaaaagccaaaagaggaacagcacaaauaauggaaguuacugcaaggugguuauggggguuucuuucucguaacaagaaaccacggauuugcacaagagaagaguuuacuagaaagguaagaucaaacgccgcaauaggcgcuguuuucgucgaugaaaaccaauggaacucugcaaaagaagcaguagaagacgaacguuuuugggauuugguucaucgggaaagagagcuacauaagcaagggaagugcgccacuuguguuuacaacaugauggguaaaagagagaaaaaguuaggcgaauuuggcaaagcaaaagguagucgcgccauaugguacaugugguuaggagcuagauuucuagaguucgaagcguuggguuucaugaaugaagaucacugguucagucgagaaaauucacuaagcgggguagaaggcgaaggcuuacauaaacuagguuauauauuacgagacauaagcaaaauuucggguggaaauauguaugcugacgauacagcugggugggacacgaggauaacugaggaugaucuacaaaacgaagcaaaaauuacagagauaauggaaccagaacaugcgcaacuugcuaaagcaauuuuuaaacuuaccuaucagaacaaaguggugagaguacaacgaccugcgaagaacggaaccguaauggauguuauuucucgaagggaucaacguggcucgggucaagucggaacauauggacuuaacacguuuacuaauauggaggcgcaacucaucaggcaaauggaaucugaaggaauauucuccccuagcgaacucgaaacacccaaucuagcggaaagaguguuagauugguuagagaaguacggcgucgaacgacuuaaacgaauggcaauaucgggcgacgauugcgugguaaaacccauagaugaucgcuuugcaaccgcccuuaccgcauugaaugacaugggaaaagucagaaaagauauaccucaaugggaaccgucaaaaggauggaacgacuggcaacaaguaccauucugcagccaucacuuucaucaauuaauaaugaaggauggcagagaaauuguaguacccugccgaaaucaagacgaauuaguaggacgagcucgaguuagucagggagcuggauggagccuucgcgaaacagcuugccuagggaaaucuuacgcacaaauguggcaauugauguauuuucacaggagggaccuuaggcuagcugccaacgcaauuuguucagcagucccggucgacugggucccaacaaguagaacgacguggucaauacaugcacaucaccaauggaugaccacagaagacauguuaucggucuggaaccggguauggauugaggagaaccccuggaugaaagauaaaacacacauaucaucaugggaagaugucccauaucuuggaaaaagggaggaucaauggugugguucacuaauaggacuaacugcuagagccacaugggcuacuaauauacaaguagccauaaaucaaguacgcagguuaaucgguaacgaaaacuaucuugauuacaugacauccaugaaacgauucaagaaugaaucagacccggaaggagccuuaugguaa

SEQ ID NO: 21090 - RNA, 9879 nt, Artificial Sequence
  derived and/or modified CDS sequence (opt6) from DENV-1__LC011949__SS-prME
ucagugacuaugcuguuaaugcuuguacccacugcccuugcguuucaucuuacaacuagaggaggggaaccgcauaugauaguuucaaaacaagaacggggaaagagcuuguuauuuaaaacauccgcaggagucaauaugugcacucucauugcuauggaucuuggagaguugugcgaagacacuaugacauauaagugucccaggaucacggaagcugaaccagaugacguggacugcugguguaaugccacagacacuuggguuacauacgguacaugcagucaaacaggagaacacagacgcgauaagagaucaguagcucuagcuccucaugugggguuaggucuagaaacuagaacagaaacauggaugucaucugagggagcauggaaacaaauacaaagagucgaaacuugggcgcuacgccauccaggauuuacagugauagcgcuauuucuugcacaugcuauuggaacaaguauuacccaaaaaggaauaauuuuuauauugcucauguuaguuacgccaaguauggcaaugagauguguuggaauuggaucacgugacuuuguggaaggucuaucgggagcuaccuggguggauguuguucuggagcacggaaguugcguaacaacaauggcaaaagacaaaccuacgcuagauauagaacucuugaaaacggaaguuacuaaucccgccguacuucguaaauuauguaucgaagccaaaauaucaaacaccacaacagauagucgguguccaacacaaggcgaagcaacucucguugaggaacaagacgcuaacuuuguauguagacgaacuuuugucgacagagguuggggaaacggcuguggccucuucggcaaaggaucucugauaacgugugcuaaauucaaauguguuacgaaauuagaaggaaaaauuguacaauaugaaaauuuaaaauacucuguuauaguaacaguacauacaggggaucaacaccaaguggguaacgaaagcacagaacacggaacgacagcuacuauaacuccgcaagcgccaacaaccgaaauucaauuaacugauuacggugcccugacgcuagacugcucuccgcgcacaggauuagacuuuaacgaaaugguucuacuuacgaugaaagaaaaaucgugguuggugcauaaacaaugguucuuagacuugccguuaccuuggacaucuggagccaguacaagucaagaaaccuggaaccgccaagaucucuuggucacauucaaaacggcacaugccaagaaacaagaggucguaguuuuaggaagccaagaaggcgcaaugcauacggcucuaacaggggcaacagagauucaaacaagcggcacaacaaccauauucgcaggacauuugaaauguagguuaaaaauggauaaauuaacacuuaaagguacuucguauguaauguguacugggagcuuuaaacuugagaaagagguagcugaaacucaacaugguacgguguugguacaaauaaaauaugaaggcacugaugcacccuguaaaauucccuuuuccacacaagaugagaaaggcguuacacagaauggacgcuuaauaacugcaaauccaauaguuacagacaaagaaaaaccggucaauauugaagcagaaccaccauucggagaaucauacauagugauuggagcaggcgaaaaagcucugaaauuaucaugguuuaagaaagguucuucaauuggaaaaauguuugaggcuacagcaagaggggccagaaggauggcaauacuuggggacacagcaugggauuucgggaguauuggaggaguuuuuacuucuguagggaaguuagugcaucaaauuuuugguacagcuuaugguguguuauuuucagguguuucauggaccaugaagaucgggauaggaguguuacugacaugguugggucugaauaguagaaguaccucuuuauccaugacuuguauugccguaggccucgucacauuauaccuaggaguaaugguucaagcagauacuggcugugucauaaacuggaaaggacgcgaauuaaagugcgggucuggaauuuucgucacaaacgagguucauacguggacugagcaauauaaauuccaggccgacucaccuaaaagacugagugcugcgauagggaaggccugggaagaaggcguaugcggaauaagauccgccacacggcuugaaaauauuauguggaaacaaauuucaaaugaauuaaaucauaucuuauuagaaaaugacaugaaguucacuguuguagugggcgacgucgcaggaauauuggcacaagguaagaaaaugauuagaccgcagccaauggaguauaaauacuccuggaaaucauggggaaaggccaaaaucauaggggcagauguucaaaacaccacuuuuauuauagacgggccuaacaccccggagugcccagaugaccaaagggcuuggaauauuugggaaguagaggauuacggauuuggaaucuuuacaacaaauauuugguuaaaacugagagauaguuacacccaagugugcgaccaccgcuuaaugagcgcugcaaucaaggauucaaaggcgguccaugcagacaugggguacuggauugagucugagaaaaacgaaacauggaaacucgcgcgagcgagcuucauagaagucaaaacaugcauuuggccaaaaucacacacacuauggucaaaugggguucuugaaucagaaaugauaauuccaaaaauuuacgguggaccgauuucccagcauaacuacagacccggauauuuuacucaaaccgcaggaccauggcauuuggguaagcuagaacuagauuuugaucucugugaagggacgaccguaguaguagacgaacacuguggaaaucgagguccaucucuaagaaccacuacagucacagguaagauaauacacgaaugguguuguagaucaugcacuuuaccgccgcuaagauuuaggggugaagaugguugcugguacggaauggaaauaagaccagucaaagagaaagaagaaaaucuaguuaagagcaugguaagugcaggaucuggugaggucgauaguuuuaguuugggacucuugugcaucucaauaaugauugaagaaguaaugcgaaguagauggagucgcaaaaugcugaugacaggaaccuuagccguauucuuucuucucaucauggggcaacuuacuuggaacgaccucauaagacugugcauuauggucggggcgaaugcuagcgaucgaaugggaaugggcacaacauaccuugcguuaauggcgacguuuaaaaugcgccccauguuugcaguaggccuacuauucagacgguuaacgucaagggagguuuuauuacuaacuauaggguugucccucguagccagcguagagcuaccuaauagucuugaggaauuaggagaugguuuagccaugggaauuaugauuuugaaguuacuaacggacuuccaaagccaucaacuaugggcgacauuauuaagccuaacguuuauaaaaaccacauucagccuucauuacgcuuggaaaacaauggcaaugguauuaaguaucguaucgcuguucccccuuugucugucuacaacaucacagaagaccacuugguugccgguuuuauuaggaagucucggguguaaaccauugaccauguuucugauagcggaaaauaaaauauggggaaggaaaucauggcccuuaaaugaagguauaauggcggugggaauaguaagcauacuucuaucuucacugcugaaaaacgacguaccguuagcuggaccacucauagccggugguauguuaauugcauguuacguaauaucuggcucaucagccgaccuaagucuagagaaagccgcagaggugucaugggaggaagaagcugagcacucaggugcaagccauaauauuuuaguggaaguucaagacgauggaacuaugaagauaaaagacgaagaaagagaugauaccuuaacaauacuacuaaaggcaacucuauuggcagugagugguguuuauccauuauccauaccagcaacauuauucgugugguacuuuuggcagaaaaagaaacagagaagcggaguuuugugggauacacccaguccaccagaaguagaaagagcagugcuugacgacggaauauaccgaauuaugcagcgcggucuucucggccggucacaaguagggguagggguuuuucaagaaaauguuuuucauaccauguggcacguaaccagaggagcaguauugauguaucaagguaaacgccuugaaccgaguugggcaaguguuaagaaagauuuaauuuccuacggcggcggauggcgacuacaaggaaguuggaacacgggugaagaagugcaaguaaucgcggucgagccuggcaaaaacccuaaaaauguacagacggcuccagguacauuuaagacgccagagggggaaguaggcgcgaucgcccuagacuucaaaccaggaacgucggguucuccaaucguaaaucgagaggguaagauagucggccuauaugggaaugguguuguaacgacguccgggacauaugucagugcuauugcgcaggcgaaagcaagucaggaagguccucuacccgaaauagaggacgaaguguucaaaaagcgaaaucuuaccaucauggauuuacacccagggucagguaaaacgaggagauaccuaccugcuauaguuagagaggcuauaaaaagaaaacuaagaacauuaauuuuagcaccaacuagggucguagcauccgaaauggcggaggcacucaaggguaugccaaucagauaucagacaacagcuguuaaaucugaacacacuggcaaagagauaguggauuugaugugucacgcuacauuuacuaugagauuauuaagcccagugcgugugccaaauuauaacaugauaauuauggacgaggcacauuucacggacccaagcucaauagcagcucgaggguacauuucaacacgggucggcaugggagaagcagcagccauauuuaugacugcaacaccuccuggaagcguggaggcuuuuccccagucgaaugccgucauucaagaugaagaaagagacauaccagaaagaaguuggaacucgggauacgaauggauuaccgauuucccugggaaaacaguaugguucgugcccuccauuaaguccggaaaugauauugcgaacugcuuacguaagaacggaaagagaguuauacaauugagcaggaaaacguuugauacggaguaucagaaaaccaaaaauaaugacugggacuacguaguuacgaccgacauaucggaaaugggagcaaacuucagagccgauaggguuauagauccgcgacgaugcuuaaaaccuguaauacuuaaggauggaccagaaaggguuauauuggcuggaccaaugccggugacaguugcaucggccgcacaaagacgcggacgcauaggaagaaaccauaauaaggaaggugaucaguauauauauaugggacaaccauuaaauaacgaugaagaucacgcccauuggacagaggcuaaaaugcuauuagauaauauuaauacuccagagggaauaauaccagcucuauucgaaccagaacgagaaaaaucugcagccauagacggggaauaucgguuaagaggagaagcucgaaagacauuuguagaguuaaugagacgaggugaccuuccgguauggcuaucguacaagguagcaucugaaggcuuccaauauagugacagacgcuggugcuuugacggggaaaggaauaaucaaguauuagaagaaaauauggauguggagauauggacuaaagaaggcgagcggaagaaacuacgcccgcgauggcuagaugcuagaacauauucagacccgcuagcccuuagggaauuuaaggaauuugcugcaggaaggcgaucaauuaguggagaccuuauacuugaaauagggaaacuaccacagcaucuaacgcagagagcgcaaaacgcacuagauaacuuaguaaugcugcauaauucggaacaaggagggcgggcauacagacacgcuauggaagaacucccggauacaaucgagacacuaaugcuauuagcccuaauagccgucuuaacgggagguguaacuuuguucuucuuaucugguaggggauugggcaaaacaaguauuggauuacuauguguaauggcgucaucgguacuccucuggauggcauccguagaaccccacuggaucgccgcaucgaucauauuagaguucuuuuugaugguguuacuaauaccagaaccugaucgacaaagaaccccacaagauaaucaauuggcguacgugguaauuggacuguuauucaugauauugacaguagcggcaaaugaaaugggguuauuagaaacuaccaaaaaggauuuaggaaucgggcauguagcgguagaaaaucaucaucaugccgcuaugcuugauguugacuuacauccggcuagcgcauggacucuauaugcaguugcaacuacaaucauuacaccaaugaugagacauacgaucgagaacaccacagcaaacaucucuuuaacagcaauagcgaaucaggccgcaauauugaugggguuggacaaaggauggccaauuagcaaaauggauauagguguaccauuguuggcauugggauguuacucgcaaguuaacccucuaacguugacagcggccguccugaugcuugucgcucauuacgcgauuauaggaccgggauugcaagcaaaagcaaccagagaagcgcagaaaaggacggcugcgggaaucaugaaaaauccuaccguugaugggauugucgcaauugacuuagacccugugguauaugaugccaaauuugagaaacaacuuggacagauaauguuauuaauacuauguacaucacaaaucuuguuaaugagaacaacgugggcucugugugaaaguauuacgcucgcaacaggaccgcuuacaacacucugggagggaagcccagguaaauucuggaauacuacaauagcaguaagcauggcuaacauuuucagggggaguuaucuagccggugcgggguuagcauucucacuaaugaaaucauuagggggaggucgucgagggacaggugcucaaggggaaacuuuaggcgaaaaauggaaacgucagcuaaaucaacuuucuaaaucagaauuuaacacauauaaaaggucuggcauuauggaaguugacaggagugaagcuaaagaaggacuaaaacgaggugaaacgacgaagcacgcaguaagucggggaaccgcuaaauuaagaugguuuguagagcgaaaccuagucaagccggagggaaaagucauagaucuggguugcggaagaggaggguggaguuauuauugugcgggacuuaagaaggugacugaagugaaaggauauacgaaaggcgguccaggacaugaggaaccuauacccauggccacauauggauggaauuuaguuaaauuacauucagguaaagauguauucuucaucccucccgaaaaaugcgauacucuccugugcgacauuggugaaaguucgccaaacccaaccauagaggagggaagaacauugagaguccucaagauggucgagcccugguuaagaggaaaucaguuuuguauuaagauucugaaucccuacaugccaaguguagucgaaacucuagaacagaugcaacggaagcauggcgguaugcucgugagaaacccccuaucucguaauucaacucaugaaauguauuggguaagcuguggcacuggaaauauaguaucugcaguuaacaugacaucacgaaugcuucuaaauagauucacgauggcucaucguaaaccaacuuacgaaagggauguugaccuaggagcuggcacucggcauguugcuguagaaccagaaguugcgaaccuggacaucauaggccaaagaauagaaaacauaaaacaugaacauaaaucgacauggcauuacgaugaagacaauccuuauaagacaugggcauaucacgguaguuaugagguaaagccgagcggaagugcaucuucgauggugaauggcguuguaaaauuguuaacuaaaccgugggaugugauaccgaugguuacacagauagcaaugacggacaccacucccuucggacaacaaagaguauucaaagagaaaguagauacucgcacaccuaaagccaaacgaggaacugcccagauaauggaaguuacugccagauggcuauggggguucuuaucacgcaacaagaaaccacgaauauguacacgagaagaauuuacaagaaaagucaggucaaaugccgccauaggugcuguauucguugacgaaaaccaauggaauagcgcaaaagaagccguugaagaugaacguuuuugggauuuaguucacagagaaagagaauuacacaaacaagguaagugugcaacauguguuuacaacaugaugggcaaaagagagaagaaauuaggggaauuugguaaggcaaaaggaagcagggcaaucugguacauguggcuaggcgcaagauuuuuagaguucgaagcacuuggauuuaugaaugaagaucauugguuuucgcgggaaaauagucuauccgguguugaaggcgagggccuacauaaauuggguuacauauuaagagauauaaguaaaauaccgggagguaacauguacgcggacgauacagcaggcugggauaccaggauaacggaagaugauuugcaaaaugaagcaaaaauuacagacauuauggaaccagaacacgcauugcucgcgaaagcgaucuuuaaacucacauaucaaaacaaagucguacgcguacaaagaccugcgaaaaacgggacagucauggauguaauuucccguagagaucaaagaggaaguggucaaguagguacauauggacuaaacacuuuuacuaacauggaagcgcaauuaauuaggcaaauggagucagaaggaauauuuuuaccaucagaguuagaaacuccaaaccucgcagaaagaguuuuagauuggcuagagaaauauggugucgaaagauugaaacguauggcaauaaguggcgaugauuguguuguuaagcccauagaugaucgauuugcuacagcacuuacagcccuaaaugauauggguaaaguuaggaaagacaucccacagugggaaccaucaaaaggauggaacgauuggcaacagguaccguucuguucgcaccauuuccaccagcuuauaaugaaagaugguagagaaaucguuguaccuuguaggaaccaagacgaauuagucggcagagcccgaguaucucagggagccggauggucacuucgcgagacagcuuguuuagguaaaagcuaugcacaaauguggcaauuaauguacuuucauagaagggauuuacgauuagccgcgaaugcuauauguagugcuguuccuguagauugggugccuaccaguagaacuacuuggucaauucaugcacaccaccaauggaugacgacggaggacaugcuaucagucuggaauagaguuuggauagaagaaaacccguggauggaagacaagacccauauuucuucuugggaagacguuccauaucuaggcaagcgagaggaucaauggugcgguaguuuaauaggucuaacugcgagagccaccugggccacaaauauacaaguagcaaucaaccagguuagacgauuaauagguaacgaaaacuaucuagauuauaugacuucaaugaaaagguucaaaaaugaaagugauccagaaggagcauuaugguaa

SEQ ID NO: 21091 - RNA, 9879 nt, Artificial Sequence
  derived and/or modified CDS sequence (opt6) from DENV-1__HM469966__SS-prME
agcguuacuaugcuacugaugcugaugccgacagcacucgcauuucauuugaccacuagggguggggaaccacacaugauaguuaguaaacaagaacguggaaaaucuuugcuauuuaaaacaucagcuggugugaauauguguacucuaauagcuauggaccuuggggaacuaugugaagacacaaugacauauaaauguccaagaauaaccgaagcagaaccagaugauguagacugcugguguaaugcuacagauaccuggguuacauaugguacaugcucacaaacuggagaacaucggagagauaaacgcucaguugcucuagcuccacacguuggccuaggacuagaaacuaggacugaaacauggauguccucagaaggagcauggaaacaaauacaaagggucgaaaccugggcgcuaaggcaucccgguuuuacugugauugcauuauuuuuggcucacgcuauagguacaucaauaacucaaaaaggaauaauuuuuauauuacuaaugcuagugacccccucuauggccaugagaugcguggggauugguucaagagauuuuguggagggccuguccggugccacuuggguggaugugguauuagaacaugguucaugcgucacuaccauggcaaaagacaaaccaacacuggauaucgagcuucugaaaacagaaguaaccaauccagcuguacuacgaaaauuaugcauagaagcaaaaauaagcaacacaacuacugacagucgaugcccaacccaaggagaagcgacuuugguagaggaacaagaugcuaacuuuguaugcagaagaaccuucguagacagaggaugggggaauggcugcggacuuuucgggaaagggagcuuaaugacuugcgcaaaauucaaaugcguuacaaaguuagaaggaaaaauaguccaauaugagaacuuaaaauacuccguaauaguuacaguucauaccggagaucaacaccaaguaggaaaugaaagcacagaacauggaacuacugcaacaaucacuccacaagcucccacgacugagauacaguugaccgacuauggagcguugacucuugacugcucaccaagaacagguuuggauuuuaaugaaaugguauuacugacaaugaaagaaaaguccugguuaguacacaaacaaugguuccuggaucuacccuuaccauggacgucaggugccucaacaucacaagaaacauggaaucgucaagaucuguugguaacuuucaaaaccgcgcacgcgaagaaacaagaaguaguuguguuagggagccaggaaggcgcuaugcauacugcacuaacaggugcaacagaaauucaaacaaguggaaccacaacaauauucgccgggcaccuuaaauguagacuaaaaauggauaaacuuacacucaagggaaugucauaugucauguguacuggaucauucaaauuggagaaagagguagcggagacacaacaugguacaguguuaguccagauuaaguacgaaggaacagacgcaccuuguaaaauacccuucaguacucaggaugaaaaaggcgugacacaaaauggucgguuaauaaccgcgaauccgaucgucacggauaaagaaaaaccaguaaauauagaggcugaaccuccauuuggagaaucuuauauaguuauaggugccggugaaaaggcguugaaacugagcugguuuaagaaagguucaaguaucgguaaaauguucgaagcaaccgcaagaggggcgcgccgaauggccaucuuaggcgacacagcaugggacuuuggaucuauaggaggugucuuuacgucaguaggaaaauuaguacaucagauauucggcaccgcguaugguguuuuauucucaggaguuaguuggacgaugaaaauuggaauaggaguauuauugacauggcucggccuuaacucuagaucaacuucguuaaguaugaccugcaucgcuguaggguuaguuacucucuaucuuggaguuaugguucaagcagauaguggaugugucauuaauuggaaggggcgggagcuaaaaugcgggucuggaauauucguuacaaacgagguacacacauggacagaacaauauaaauuucaagcagacucaccaaaaagauuaucugcggcuaucgguaaggcuugggaggagggcgucuguggaaucagaagcgcgacaaggcuagaaaauaucauguggaaacaaauuaguaaugaauuaaaccauauucuauuagaaaacgauaugaaguucacugugguggucggcgauguugcugguauacuugcacaagggaagaaaaugauuagaccccaacccauggaauauaaguauucauggaaaucuuggggcaaggcaaaaauaauaggagccgacgugcaaaacacaacauuuauaaucgacgguccaaacacuccagaauguccagaugaccagcgagccuggaacaucugggaaguagaagauuaugguuuugguauauucacuacaaacaucugguuaaaauuaagagauaguuauacgcaagugugugaucaccguuuaaugagugcagcaaucaaagauucaaaagcgguacaugcagauaugggguacuggauagaaagugagaaaaaugagaccuggaaguuagcucgcgccagcuuuauugaagugaaaaccuguauauggccaaaaagccauacguuauggaguaaugguguuuuagaaagcgaaaugauuaucccgaaaauauacggagguccgauaucacaacauaacuaucguccuggcuauuucacacaaacugcuggucccuggcacuuaggcaaguuggaacuagauuucgaucuaugugaagguacgacuguaguaguagaugaacacuguggaaaucguggaccguccuuaagaacuacaacgguaacagguaaaauaauucacgaauggugcugucgaagcugcacacuuccaccccugagauuccgcggugaggacggauguugguacggaauggagauaaggccaguaaaagaaaaggaagaaaacuuaguaaagaguauggucagcgcggggaguggggaaguagacucauucucauugggauuauuauguauuucgaucaugauagaagaaguaaugcgaagucgauggagucguaagaugcucaugacgggaacuuuagcaguauucuuucuguugauaaugggucaauuaacguggaaugauuuaauccguuuguguauaauggugggcgcuaacgccuccgauagaaugggcauggguacgacguacuuagcgcuaauggccacguucaaaaugcgaccaauguucgcaguaggccuucuauucagacgacuaaccaguagagaaguacuacuguugacgaucggucugaguuuggucgcgaguguagaauuacccaauucgcucgaagaguugggugaugggcuugcuauggguauaaugauauuaaaacuacugacagauuuccagucacaccaacugugggcuacucuauuaaguuugacuuucauaaaaacaacauucagccuucacuacgcauggaaaacaauggccaugguccucaguaucgucagccuuuuuccacuuugucuuaguacgacuucgcagaaaacaacuugguuaccaguucuauuagguucguuggguuguaagcccuugacgauguuucuaaucgcagagaauaagauauggggaagaaaaucguggcccuuaaacgaaggaaucauggcaguaggaauaguguccaucuuauuaagcucgcugcucaaaaaugacguaccccuagccggaccacuaauagccggugguauguuaauugcauguuauguaauaucgggaucgucagcagauuuaagucuggaaaaagcugcggaaguuucaugggaagaagaagcugaacauucuggagccagucauaacaucuuaguagaggugcaggaugacggaaccaugaaaauuaaggaugaagaaagagaugacacauuaacgaucuuauuaaaggcuacucuacucgcagucucuggaguauacccgcuuagcauuccugccacuuuauuuguaugguacuucuggcaaaagaaaaagcagcguucggguguuuuaugggauacacccaguccacccgaaguggagagagcagucuuagacgaugguauuuacagaauuaugcaaagagggcuacuaggccgaucacaaguaggcgugggaguguuucaagaaaaugucuuccacacgauguggcacguaacgagaggagcaguauuaauguaccaagguaagcguuuagaaccaucuugggcaagcguuaaaaaggacuuaaucaguuauggaggcggguggagauugcaaggcucuuggaauacaggugaagaaguacaaguaauagcagucgaaccagguaagaaucccaaaaauguacaaaccgcgccaggcacguuuaaaacacccgaaggugaaguuggagcuauagcucuugacuucaaaccugggacaucagguuccccuauugugaaucgagaagguaaaauugucgggcucuauggaaacggaguaguaacuacuucagguacauacguaucggcgauagcacaagcaaaagcuagucaagaagggccccuaccagaaaucgaagaugaaguauuccgaaagagaaauuuaacuaucauggauuugcauccaggaucuggaaaaacucgucgguacuuaccugcgauaguacgugaagccauuaaacgaaaacuaagaacacuaauacuggcacccacccgcguuguggcauccgaaauggcagaagcucugaaaggaaugccuaucagauaucaaacaacggcaguuaaauccgaacauaccggaaaagagaucguggaccuuaugugucacgcgaccuucaccaugcgcuuacuaucaccugugcgaguuccaaauuacaauaugauuauuauggacgaggcucacuucacugauccuucuucaauugcugcaagaggauauauuucuacgagaguaggcaugggagaagcugcggcaauauuuaugacugcaacgccgccuggcuccguagaagcauucccacaaucaaaugcagugauccaagacgaagaacgagauauccccgaaagaucauggaauagcggcuacgacuggauaacugauuucccggggaaaacuguaugguucguaccuuccaucaagucgggcaacgauaucgcuaacugccugagaaagaacggaaaacggguaauucaacucagccguaagaccuucgacacagaauaccagaaaacuaaaaacaaugacugggacuacguaguaaccaccgacauaucugagaugggcgcuaacuuucgagcugacagaguaauugauccacgucgauguuuaaaaccgguuauuuuaaaggauggaccggaaagagucgugcuugcgggaccuaugccagugacagucgccagugcagcacaacggagagguagaauuggaagaaaucauaauaaggaaggggaucaauauauauauaugggacaaccguuaaacaaugacgaggaucacgcgcauuggaccgaagcuaagaugcuucuggacaauauaaauacgccagaagggauuaucccagcccuauuugaaccagaacgagaaaaaucugcugcaauagacggagaguacagauuacgaggagaggcucguaaaacauucguugaauuaaugcguagaggggauuuaccuguguggcuuaguuauaaaguagcaagugaagguuuucaauauucugaccgacgguggugcuuugauggugagagaaauaaccaaguauuagaagaaaauauggauguagagauauggacaaaggaaggcgaacggaagaaacucagaccucgaugguuagaugcuagaaccuauagugacccguuagccuuacgggaguuuaaagaguuugcugcaggcagaagaucgguguccggagaucuaauuuuagaaaucggcaaguuaccgcaacauuugacgcaaagagcacagaacgcauuggacaaccugguaauguuacauaauagugaacagggaggcagagcauauagacaugcaauggaagaauugccggacacaauagagacgcuuaugcuauuggcguugauugcuguucuaacaggcggcguaacauuguucuucuuaucgggcagaggacuugguaaaaccucuauugggcuauuaugcgugauggcuucgagcgugcuacuauggauagcaaguguagaaccacacuggaucgcugcgucaauuauucuagaguucuuucuaauggucuugcucauaccagaacccgauaggcaaagaacaccccaggauaaucaauuagcuuaugucguaauagguuuauuguucaugauauuaacgguagcagcaaaugaaauggggcuucuugaaacaaccaagaaagacuuggggauugggcacguagcugucgaaaaccaucaucaugcggcuauauuggauguugauuuacauccagcaagugcauggacauuauaugcaguugcaaccaccauaauaacuccuaugaugagacauaccauagaaaacacuacggcgaacaucaguuuaacugcuauugcaaaucaagcagcgauacuaaugggcuuagacaaaggcuggccaauaucaaagauggauauuggagugccauugcuggcgcuugguuguuacucacaaguaaauccgcuuacacuuacugcugccguacugauguuaguagcccacuaugcaauuaucgguccuggauuacaggcgaaagcuacgagagaggcccaaaaacguacggcggcggguauaaugaagaauccaacuguagaugggaucguugcaauugaccuggaucccguaguauaugacgccaaguucgaaaagcaauugggacaaauuaugcuauugauuuuauguacgucccaaauuuugcugaugagaacaacuugggcguuaugugagucaauuacacuagcuacugguccauuaacaacauuauggaaaggaucaccaggaaaauuuuggaauacaacaauagcuguaaguauggcuaacauuuuucggggauccuauuuggcuggagcaggcuuagcauucucauugaugaagucucuaggaggaggacgaagagguacuggagcucaaggagagacucuuggagagaaauggaaaagacaauuaaaccagcuaaguaaaagugaguucaacacauauaagcgaucuggaauaauggaagucgaccgcagugaggcuaaagagggucuaaaacgcggagaaacuaccaaacaugccguuucccgagggaccgcaaaacuccguugguuuguagagagaaauuuggucaaaccagaaggaaagguuauagacuugggcugcgggcgggguggauggucguacuacugcgccggccuaaagaaagucacggaaguuaaaggauacacaaaaggagguccuggacacgaggaaccuauucccauggcuaccuacgguuggaaccuaguuaaacuauacucuggcaaagaugucuucuucauuccgccagagaaaugugauacgcuucuaugugauauuggagaaaguagccccaacccaacaauugaagagggaagaacccugagaguucuuaagaugguagagccguggcuucgaggaaaucaguucugcauaaaaauccucaacccguauaugccaaguguuguggaaacuuuggaacaaaugcagagaaaacaugguggcauguuaguaaggaacccgcuauccaggaacucuacacaugaaauguacuggguauccuguggaacuggcaacauaguaagugcaguuaauaugaccucgcguauguuauuaaaccgauuuacgauggcacaucguaagccaacauaugagcgggauguugauuuaggcgcuggaacccgucauguggccguugaaccugaaguagcuaaucuagauauaauuggucaaagaaucgagaacauuaaacacgaacacaaaaguacauggcauuaugacgaagauaauccguacaaaacuugggcauaccacggaaguuaugaagugaaaccuucagguucagcauccaguaugguuaauggugugguuaaacuuuuaacaaaacccugggaugucaucccaaugguaacucagauagccaugacagacacaacgccuuucggucaacaaaggguauucaaagagaaagucgacacacggacuccuaaagcaaaaaggggcacugcucaaauaauggaagucacugcuagauggcuauggggguuccuaucucgaaauaagaaaccgagaauuuguacgagagaagaauuuacuagaaaagugaggucaaacgccgcaauuggugcaguauuugucgacgaaaaucaauggaacucggcuaaggaagcuguggaagaugaacguuuuugggauuuaguccauagggaacgggaauuacauaaacaaggcaaaugugcaacuuguguauauaauaugauggguaaaagagagaagaaauuaggagaauuuggaaaagcuaaggguucgagagcuauaugguacaugugguuaggugcacgauucuuagaauuugaggcucuaggguucaugaaugaagaccauugguucucccgagaaaacuccuugagcggcguggagggagaaggacuacauaaacuuggauauaucuuacgagauauaagcaaaauuccaggaggaaauauguacgcugaugacaccgccggcugggauacaaggauuaccgaagacgauuugcaaaaugaagcaaagauuacagauauuauggaacccgaacaugcucugcuagcaaaagcaauauuuaagcuaaccuaucaaaauaaaguuguccggguacagcggccugcuaaaaacggaacagucauggauguaauuucacgcagggaucaaagagguucaggccaaguaggcacauacggacucaacacauucaccaacauggaggcacaacugauacgacaaauggaaucggaggggauauuuagucccagcgaauuagaaacuccuaacuuggcugaaagggucuuagauugguuagaaaaauauggaguggagcgauuaaagagaauggcgaucucgggggacgacuguguaguuaaaccaauagaugauagauucgcaacagccuuaacagcguugaaugauaugggaaaaguacggaaagauauaccgcagugggaaccgucgaagggauggaaugauuggcaacaagucccauuuuguucacaccauuuucaccaacuuauaaugaaagacggacgugaaauuguuguuccaugcagaaaucaagacgaacugguaggacgugcaagagucagccaaggagccggguggagucuucgagaaacagcuugucuuggaaaauccuaugcgcaaauguggcaacuaauguauuuccaccguagggaccucagacuugcagccaaugcgaucuguucagcuguacccguugacuggguuccuaccucaagaacaacauggagcauccaugcucaccaucaauggaugacuacagaagauauguuaucugucuggaauagaguauggauugaggaaaauccauggauggaagauaaaacacauaucaguucgugggaggaugugccauaccuagggaaacgagaagaccaaugguguggaucucuaauuggauuaacagcaagagccacgugggccacaaacauucagguggcaauaaaucagguacggagauuaauaggaaacgagaacuaccuugauuauaugaccucuaugaagcgcuucaaaaaugaaagcgauccagaaggugcacucugguaa

SEQ ID NO: 21092 - RNA, 9879 nt, Artificial Sequence
  derived and/or modified CDS sequence (opt6) from DENV-1__JX669462__SS-prME
aguguuacgauguuauugaugcuacucccgacagcauuggcauuucauuuaacgacgagagguggagaaccccacaugaucguaucgaaacaagaacgggguaaaucgcucuuauuuaaaacauccgcaggagucaacaugugcacuuuaauagcaauggaucugggagaacuuugugaagauacaaugacauacaaauguccgaggaucacugaagcagaacccgacgacguagauuguuggugcaaugcaacagacacauggguaacauacgguacuugcucacaaacaggugaacaucguagggaaaaacguucaguagcguuagcgccccauguuggauuagggcuagaaacacguacagaaacuuggaugucaucagaaggagcauggcgccaaauacaaagaguugagaccugggcacuuaggcacccaggauucaccguaauagcuuucuuccuagcgcaugcuauuggaacaaguauaacgcaaaaaggaauaauauuuauacuuuuaauguuagugacaccgucaauggcuaugcguugcguaggcauagggaauagagacuucgucgaaggauuaucuggagcaaccuggguagacguaguuuuggaacauggauccugugugaccacgauggccaaaaacaaaccuaccuuagauaucgaauuguuaaaaacugaagucacuaauccagcaguccugagaaaacuuugcaucgaagcaaaaauaaguaauacuacaacggacucacggugccccacccaaggagaagcaacgcuagucgaagaacaagacgcuaacuucgugugcaggagaacguucguagauagagguugggguaacggcugcggucuauucgguaaagggagcuuguuaacgugcgccaaauuuaaauguguuaccaaacuugaaggaaaaaucguucaauaugaaaaccuaaaauauuccguaaucgucacaguacacacaggagaucaacaucaaguaggcaaugagacuacagaacacggaacaauagcuacaauuacaccacaagcaccaacaucagaaauacaacuaacugacuacggugcauugacccucgauugcucuccgagaacgggauuagauuuuaaugaaaugguacuucuaacaaugaaagaaaaaucguggcuagugcauaaacaaugguuucuugauuuaccccuaccauggacaucaggcgcuucaacaucacaagaaacauggaauagacaggaucuacucguuacuuucaaaacagcacaugcgaagaaacaggaagucguuguacuaggaucccaagagggagcgaugcacacagcauugaccggcgcaacggagauacagacaagcgggacaacaacuaucuuugcuggccaucugaaaugucgauuaaaaauggacaaacuaacacuuaaagguaugucauauguaauguguacagguaguuuuaaauuagaaaaagaaguggcagaaacgcaacauggaacaguucuaguccaagugaaauacgaagguacugaugccccaugcaaaauaccguuuucaacucaggacgagaaaggaguaacccagaauggaagacuaauaacagcgaacccaauaguuacggacaaagaaaaaccggucaacaucgaaacagaaccaccauuuggagaaagcuacauagugguaggggcgggggaaaaagccuuaaaacucaguugguucaaaagggguuccucgauaggaaaaauguucgaggccacagcacgaggugcucgucgcauggccaucuuaggcgauaccgcaugggauuucggaaguauaggcggaguuuuuacaucuguggggaaauugguucaucaaguuuuugguacugcuuauggggucuuauuuucuggagucaguuggacaaugaaaauaggaauaggaauauugcugacaugguuaggauugaacucacggaguacuagccuuaguaugacuugcauugcaguaggcauggucaccuuauaucuuggaguaaugguacaagcagacuccgguuguguaaucaauuggaaggguagagaauuaaaaugugggucuggaauauucgucacaaaugaaguacauacguggacagagcaguacaaguuccaagccgacaguccuaagcgacucucugcugcgauagguaaggcuugggaagagggaguaugcggaaucaggucagcaacuagguuggaaaacauaauguggaaacagauauccaacgaguugaaccauauuuuauuggaaaacgauaugaaauucacggugguagugggcgaugcaaacgggauucucgcacaagguaaaaagaugaucagaccgcaacccauggaacacaaauauaguuggaagucuuggggaaaagcaaagauaauuggugccgacauacagaauacaacguucauuauagauggaccugauaccccggaaugcccagauggccagcgcgcguggaacauuugggaggucgaagauuauggauuuggcguguuuacuacuaauauaugguuaaaauuacgagauuccuauacucaaaugugcgaccaucgucuaaugagugccgcaaucaaggauucaaaagcaguacaugcugauaugggguauuggauugaaagugaaaagaaugaaacuuggaaacucgcacgagcuuccuucauugaagugaaaaccuguacauggccaaaaagucauaccuuguggaguaacggagucuuagagagcgaaaugauuaucccuaagauauucggaggcccaauaagccaacauaacuacaggccuggcuacuucacucagacagcaggccccuggcacuuggggaaguuagaguuagacuuugacuuaugugaaggaacaacaguaguuguggacgagcacugcgggaacagaggcccuagccuacggacaacaacgguaacuggaaaaauuauccaugaaugguguuguaggucauguacccuaccaccacuccgauuuagaggagaggacggcugcugguauggcauggaaauuaggccaguaaaagaaaaggaggagaacuuggucaggaguaugguuagcgcugguaguggagagguugacagcuucucucuuggaauccuaugcgugaguauuaugauagaagagguaaugcguucgcgcuggagcagaaagaugcuaaugacaggaacccuagcaguguuucuucuauuaauuaugggacaauuaacauggaaugaucuaauacgguuauguauaaugguuggagcgaaugcuucggacagaauggguauggguacaacguauuuggcuuuaauggcuacguuaaaaaugaggccuauguuugcaguaggguuauuauuuagacgccucacaucaagagaaguccuucuucuuacuaucggauuaucucuuguugccaguguagagcuuccuaauucauuagaagaauugggagacggauuagcgaugggaauuaugauguuaaaacuucuaacagaguuucaaccacaucaacuuuggacgacccuacuuucacuaacuuuuguuaaaacuacuuuaagucuugauuacgcauggaaaaccacagcuaugguucuaucaauagucucguuauucccgcuaugucuuucaacgacaucccagaaaaccacuuggcucccaguccuacuuggauccuuugguuguaaaccauuaacaauguuccuuaucacugaaaauaaaauuugggguagaaaaaguuggccacuaaacgaaggcauaauggcaauuggaauaguuucuauacuacuaucgucacuccuuaaaaacgacguuccacuagcugguccauugauugcgggugguaugcuaauagcaugcuaugucaucucgggaagcuccgcagaccucucccuagagaaagccgccgaagucucgugggaacaagaagcugagcacucaggcgccucacauaacauauuagucgaaguccaggacgaugggaccaugaagaucaaagacgaagagagagaugauacauuaacaauauuacuaaaggcaacauuacuagccguaucugguguguauccaaugucaaucccagcgacuuuauuugugugguauuuuuggcagaagaagaaacaaagaaguggcguccuaugggauacaccaaguccacccgagguagaacgagcaguauuagacgacgggauauauaggauauuacagagaggguuacucgguagaucccaagucggaguaggaguauuucaagacggaguauuucacacuauguggcauguaacaaggggagcuguucuaauguaucaaggaaaaagacuggaaccguccugggcaucagucaagaaagacuuaauuagcuauggagguggguggcgauuucagggaucuuggaauacaggagaagaaguacaaguaauagccguugaaccggguaaaaacccgaaaaacguacaaacaacgccagguacauuuaagaccccugagggcgaagucggagcgauagcauuggacuucaaacccgguaccucugggaguccgauuguaaaucgagaaggaaaaauaguugggcucuauggaaacggaguuguuacuaccucaggaaccuacguuagugcaauagcacaagcaaaagcuagucaagaaggaccacucccggagauugaagaugaaguuuucaagaaaaggaaucucacaauaauggaucuccauccugggucagggaaaacuagacguuaucuaccagcuauaguaagagaagcgauaaaacgaaagcuaagaacgcugauacuagcuccaacgagaguaguggcaagugaaauggccgaggcauuaaaaggcaugccgauaagauaccaaaccacagcagucaagagugaacauaccggacgagaaauaguagaucugaugugucaugcgacauucacuaugagauuguuauccccaguccgaguacccaauuauaauaugauaauuauggacgaagcucacuuuaccgauccagcuagcaucgcagcuagagguuacauuagcacucgcguuggaaugggugaggcugccgcgauauuuaugacagcuacuccuccaggaucaguugaggcguucccucaaucaaaugcaguuauacaagaugaagaacgugacauacccgagcguagcuggaacucagguuaugauuggauuacugauuucccgggcaaaacaguuugguuuguacccaguauuaaaucuggcaacgauauagcaaauugcuugcguaaaaacggcaaaaggguuauucaacuuaguaggaaaaccuucgacacagaauaccagaaaacaaagaauaacgauugggauuauguaguaacaaccgacauaagugaaaugggcgcuaauuuucgagcagauaggguaaucgauccaaggagaugucugaagccagugauucuaaaggauggacccgaaaggguuauacuagccggaccaaugccgguuacgguugcauccgcagcacagagacgaggaagaauugggagaaaucaaaauaaggaaggagaccaauauguguacaugggacaaccccuaaacaacgaugaagaccacgcccauuggacugaagcaaagaugcuucuugacaauaucaacacuccugagggaauaauccccgcauuauucgaaccugaacgcgaaaagagcgccgccaucgacggagaguaucguuugagaggcgaagcgcgaaaaacauuuguagaguugaugagaagaggagaccuuccaguuuggcuaucuuauaaaguagcauccgaaggcuuucaguauucagacagacgaugguguuucgauggggaacguaauaaucagguccuagaagaaaacauggauguugaaauauggacgaaagaaggagaacgcaaaaaguuacgaccgagaugguuagaugcccgaacauacagcgauccccuagcguugagggaauuuaaagaauuugcugcaggacguaggucugucucuggggaccugauauuggaaauugguaaauuaccgcaacaucucacgcuuagagcacaaaaugcuuuagacaaucucguaauguuacauaauucagaacagggagguaaggcuuacaggcaugcgauggaagaacuuccugauacgauagagacacucauguuauuggcacugauagcaguucucacuggggguguaacacuauuuuuccuaagugguaagggccuaggcaaaacuagcauugguuuacugugugucacggcaucguccgcuuuguuauggauggcaucuguugaaccgcauuggauagcagcaucaauaauauuagaauuuuuccuaauggugcuacucauuccggaaccagaucgucagagaacaccucaagauaaucaacuggcauauguaguaauuggacuacuauuuaugauacugacugucgcugcaaaugaaaugggacuucuagaaacgaccaagaaagacuuggguauagguuacguagcugccgaaaaccaucaacacgcuacaauguuagacgucgauuuacauccugccagugccuggaccuuguacgcuguagcuacaacgguaauaacaccaaugaugagacauacgauugaaaauaccacggcaaauauaucacucacugccauagcaaaccaggccgcuauacucaugggacuggauaagggguggccaauaucaaaaauggacauaggagugccauuguuagcucuaggauguuacagucaagucaacccacuaacacuaaccgcagcgguacucaugcugguugcacauuaugcaauaaucggaccuggucugcaagcaaaagcuaccagggaagcucaaaaacggacugcugcaggcaucaugaaaaaccccacagucgauggaaucguagcaauagaucucgaccccguaguauacgacgccaaauuugaaaaacaauuagggcaaauaaugcuuuugauauuguguaccagucaaauccuauuaaugcgcacgaccugggcucuaugugaaaguauaacauuagcaaccggcccuuuaaccacacucugggaagggagcccaggaaaauuuuggaauacuacuauugcugugaguauggcgaacaucuuuagggguucauaccuagccggcgcagggcuagcauucaguuuaaugaagucuuugggaggagguagacgaggaacaggagcacagggugaaaccuuaggcgagaaguggaaacggcaguuaaaucaguugaguaaaucggaguucaauacguacaagaggaguggaauaauggagguagauagaagcgaagcaaaagagggauuaaaacgaggcgaaacaacaaaacaugcuguaucuagggguacagcuaaguuaaggugguucguugaacggaaucuaguuaagccggaaggaaaaguaauugaucuagguugcggacgugggggauggucauauuauugcgcaggucuuaagaaaguaacagaaguuaaagguuacacaaaaggcgguccaggacaugaggaacccauaccaauggccacguacggcuggaaccugguaaagcuacacaguggaaaagauguguucuucaugccuccagaaaagugcgacacgcuuuuaugugauauuggagaaaguucaccaaauccgaccaucgaagaaggcaggacucuucgcguauuaaagaugguagagccauggcugaggggaaaucaauucugcauuaagaucuuaaacccuuacaugccgaguguggucgaaacucucgaacagaugcagaggaagcacggaggaauguuaguaagaaacccuuuaagccgaaauaguacccacgaaauguacugggucagcugugggacugguaauaucguaagugcagugaacaugacaagccgaaugcucuugaaucgauuuacuauggcucauagaaaaccgaccuaugaacgagacguugaucugggagcaggcacacgccauguagcagucgaaccagagguagccaaucuggauaucauuggucaaagaauagagaauaucaaaaacgaacauaaaucgacauggcauuaugacgaagauaauccauauaaaacgugggcauaccacggcaguuacgagguaaaaccaagcggaagugcgucuucuauggugaauggaguaguacgacuauuaacaaaaccaugggauguaauaccuauggucacacaaauugcaaugacggacacuacaccuuucggacaacagcgugucuucaaagaaaagguggacaccagaaccccacgagcuaaacgugggaccacacaaauaauggaagucacggcuaaaugguugugggguuuucuaagucggaacaagaaaccaagaaucuguacuagagaagaguucacaagaaaaguuagaagcaacgcugcuauaggggcggucuucguagaugaaaaucaauggaauagugcaaaagaagcaguugaagaugaacguuucugggaccuaguucacagagaacgcgaacuacauaaacaaggaaaaugcgcuacgugugucuacaauaugauggggaaaagagagaagaaauuaggugaguucgggaaagccaagggaucaagagcuauaugguacauguggcuuggcgcacgauuuuuagaguucgaagccuugggauuuaugaacgaagaccauugguuuucuagagagaacucacuaucuggaguggaaggugaaggacuacacaaguuaggauauauccuacgagacauuucgaaaauuccaggaggcaauauguacgcagacgacacugcugguugggacacgaggauuacagaagaugacuuacaaaacgaagcaaaaaucacugauauuauggaaccagaacacgcacuuuuagcuacaucgauuuuuaaauuaacauaccaaaauaagguaguacguguacaaagaccggccaaaaacggcacgguaauggacguaauuagcaggagggaucaaagggguaguggacaaguuggaaccuauggacuuaauacauuuacaaacauggagguccaacucauccgccagauggaaucugaaggaauuuucuuaccuagugaacuagaaaccccuaaccuagcagagagagcucucgauuggcuggaaaagcauggcgccgaacgcuuaaagcggauggcuauuucuggagaugacuguguuguuaaaccuauagaugacagauucgcgaccgcauuaaccgcucucaacgauauggguaaaguccgaaaagauauaccacaaugggaaccuagcaaaggcuggaacgauuggcaacaaguacccuuuugcagucaccauuuccaccaacuaauaaugaaagauggaagagaaauuguugucccaugucggaaucaggaugaacucguaggcagagcgagagugagucagggagccggguggucuuuaagagaaaccgcuugccuaggaaaaucauaugcucaaauguggcaacugauguauuuccacaggcgagaucuccgccuugcugcgaacgcuaucugcagugcgguacccguagauugggucccugcuucacggacgacauggaguauacacgcccaccaccaguggaugacaacugaggauauguugucagucuggaacagaguuuggauugaagaaaauccauggauggaagauaaaacucacguaucaucgugggaagaagucccauaccuagguaaaagggaggaucaaugguguggcagcuuaauugguuugacagcuagagcgacaugggccacuaacauacaaguggccauaaaccaaguaagacgacuaauagguaacgaaaauuaucuagauuauaugacuucaaugaaaagauucaagaacgaaucagauccagagggugcacucugguaa

SEQ ID NO: 21093 - RNA, 9879 nt, Artificial Sequence
  derived and/or modified CDS sequence (opt6) from DENV-1__JX669463__SS-prME
aguguuacaauguuauuaaugcuauuaccuacugcacuggcauuccaucuaacuacacgcggaggagaaccacauaugauaguaucgaaacaagaaaggggaaaaagucuauuguucaaaacaucugcugguguaaacauguguacauuaauugcuauggauuugggagaacuaugcgaagacaccaugacuuacaaaugucccaggauaacggaagcagaaccagaugauguagauugcugguguaacgccacugacacguggguaacauauggcacuuguagccaaacuggcgaacauaggagagagaaacgaucuguugcucucgccccucauguaggacucggauuagaaacccgcaccgaaaccuggaugaguagcgaaggcgcauggagacaaauccaaaggguagaaacuugggcucugagacacccuggauuuacagucauagcuuucuuccuggcucaugcaaucggcacuucaaucacacagaaaggaauuauuuucaucuuacucauguuaguuacuccaagcauggcuaugaggugcguagguauuggcaauagggacuucguagaaggcuuaucaggcgccacguggguagauguaguucuggaacacggaaguugugucacaacgauggccaaaaacaaaccgacccuagauauagaauugcuaaaaacagaaguuacaaauccugccgugcugagaaaauuauguauugaagccaaaaucucaaacacgacaaccgacucccgcuguccaacacaaggugaagcuacauuaguggaagaacaagacgcuaauuucguuuguagacgaacauuugucgacagggggugggguaaugggugugggcucuuuggaaaagggagucuccuaacgugcgcgaaauucaaauguguuaccaaacucgaaggcaaaaucguacaauaugaaaaucuuaaauauucuguaauaguuacaguccauacuggggaucaacaccaaguugggaaugaaacuacagagcaugguaccauagcaacgauaacuccgcaagcuccgacuagcgaaauacaacuaacugacuacggagcacuuacacuagacuguuccccaaggacaggauuagauuucaaugaaaugguauugcuaacuaugaaagagaaaucuuggcuuguacauaagcaaugguuucuugacuugccacuccccuggacaucgggcgccucaaccucucaagagacuuggaacagacaagaucuucuaguaacguuuaagacagcucaugccaagaaacaagaggucguggucuuaggaucgcaagaaggagcaaugcacacugcuuuaacaggagccacagaaauccaaacaagcggcacaacuacgauauuugcaggacaucuaaaaugcaggcuuaaaauggacaaacuaacauuaaaaggaaugaguuaugugaugugcacagggaguuuuaaauuagaaaaagaaguggcugaaacgcagcacggaaccguauugguucaaguaaaguaugaagggacagaugcccccugcaaaauaccauucucaacucaagacgaaaaaggcguaacacaaaauggaagauuaauaacagcuaauccaauagugaccgacaaggaaaaacccguuaauauagaaacugaacccccguuuggagaaaguuauauaguaguaggagcuggagaaaaggcuuuaaaauugagcugguuuaaaagagguaguucgauaggaaaaauguucgaagcaacugcacgaggugccaggaggauggcgauuuugggagauacggccugggacuucggaagcauaggcgggguauuuacgagugucgguaaauuaguacaccaagucuucggcacagccuauggagugcuauucagcggaguuucuuggacaaugaaaauaggaauagggauauuauuaacuugguuagggcucaacucgcggaguacuucuuuaagcaugacguguauugcgguaggaaugguaacguuguaccucggaguaauggugcaggcugauagcgggugcgucauaaauuggaaaggcagggaacucaaaugcggaucgggaaucuuuguaacuaaugagguucauaccuggacagaacaauauaaauuucaagcugacucuccaaaacgcuuaagugcagcuauagguaaggcgugggaagaggguguaugugguauuagaucugcgacucgucuagaaaauauuauguggaaacaaauaaguaaugaacuaaaccauauacuacuagaaaacgacaugaaauuuaccgucguagugggggaugcaaaugggauucuagcacaaggcaagaaaaugauacgaccccaaccaauggaacauaaauacucguggaaauccuggggaaaagccaaaauaauaggugcagauauccagaauaccacguucauaauagauggcccggacacaccagaaugcccugauggccaaagagcauggaauauaugggaaguggaagauuacggcuucggaguuuuuacgaccaauauuugguuaaaauuaagagauucuuacacgcagaugugcgaucacagacucauguccgcagccauuaaggacaguaaagcaguucacgcagauauggguuauuggauagaauccgagaaaaaugagacauggaaacuugcgagggcgaguuuuaucgaagucaaaacuuguacuuggccuaaaucacauacacuaugguccaauggugucuuagagucagaaaugauaauuccaaaaauauucggagggccuaucucgcaacauaauuacagaccagguuacuucacacaaacagcagguccuuggcaccuagguaaacuagaacuugauuuugauuuaugugagggcacgacgguugugguggaugaacauugugggaaucgagguccgucuuugagaaccacuacuguaacugguaaaauaauccaugaaugguguugucguagcugcacucucccuccucugcgguuccguggggaagauggauguugguaugggauggaaauaaggccaguaaaagagaaagaagaaaaucuuguaagaagcauggucucagcaggcucaggugagguagacaguuuuaguuuaggcauacugugcguaucgauuaugauagaagagguaaugagaucaagauggucgagaaaaauguuaaugacagguacccucgcgguauuuuugcuucuaauaaugggacaacuuacuuggaacgaccuaauacgauuaugcauuauggucggugcgaaugccagugaccggaugggcaugggcacgaccuauuuggcguugauggccacacugaaaaugcgacccauguuugccguaggguuacuauucagacgauuaacaucgagagaaguucuacuauuaacaauugggcuuucccugguagcaagcgucgagcuaccaaacuccuuggaagaauuaggggauggauuagccauggguauuaugaugcuuaaacuacuaacggaauuucaaccacaucaacuauggacaacccuauugagucucacuuuugugaaaacaacucuaucacuagauuaugcauggaaaaccacugccaugguuuuaucaauagugucuuuguuuccccugugucuuaguacaacgucacagaaaacuacauggcuuccaguucuccugggaucauuuggauguaaaccucucacuauguuuuuaauaacagaaaauaagauuuggggcaggaaaucauggccuuuaaaugaagggaucauggcaauaggaauuguaucgauucucuuaucgucccuacugaaaaaugacguaccucuugcaggcccauuaauagcuggaggaauguuaaucgccugcuauguaaucagugggucaucagcugacuuaucguuggaaaaggcugcugaaguaucgugggagcaagaagccgagcauagcggggcuucucauaauauauugguugagguucaagacgauggcacaaugaagauuaaggacgaagaaagagacgauacacuuacaauucuacuaaaggcaacucugcuggccguuucgggcguauacccuaugagcauaccagccacacuguuuguaugguacuuuuggcaaaagaagaaacagcggucagguguacucugggauacaccuucgccuccagaaguagaaagagcagucuuagaugacgguauauaccguauacuucaaaggggacugcuuggacgcucacaaguaggcguggggguuuuucaagacggaguguuucacacuauguggcacgugacgagaggggcaguacuaauguaucagggaaagagacuugaaccaaguugggcgagcgucaagaaggaucugauaagcuacgguggugguuggagauuucaaggaagcuggaauacaggagaggaaguacaaguuauagccgucgaacccggcaaaaauccuaaaaacguucaaacaacgccagguacuuuuaaaacuccugaaggagaaguaggagccauugcguuagacuucaaaccagguaccaguggaucaccuauugucaacagagaaggaaaaauagucggcuuauacggaaacgggguaguuacaacaagcggaacuuauguuagcgcaauagcucaagccaaagcaucucaggaagggcccuuaccugagaucgaagaugaaguauucaaaaagcgaaaucucaccauaauggaccuccacccugguaguggcaaaaccagaagauaucuaccagcaaucguacgcgaagcgauaaaaaggaaacuccguaccuuaauauuggcgcccacuagagugguagccagcgaaauggcagaagcccuaaaagguaugccgauuagauaucaaacaacagcggucaaaagcgaacauacaggacgcgaaauaguagacuugaugugccaugccacuuuuacaaugcgacuucuauccccgguuagaguuccuaauuacaauaugauuauuauggacgaggcgcauuuuaccgauccagcaucaauugcagccagaggauacauaucuacaagaguaggcaugggugaagcagccgccaucuuuaugacagccacuccuccagggucgguggaagcauucccucagucaaaugccguaauucaggaugaagaaagagauauaccggagcgaucauggaacucgggguaugacuggauaacugauuuuccagggaagacgguaugguucguaccuucaauaaaaagugguaaugacauagccaacuguuuaaggaaaaauggaaaaagaguuauccaacugaguagaaagacguuugauacugaauaucagaagacaaagaacaaugauugggauuacgugguaacgaccgauauaucugaaaugggcgcgaacuuccgggccgauagagugaucgauccuagaagaugcuugaaaccgguaauauuaaaggaugggccagaaagggucauauuggcaggaccaaugccagucacaguugcaucugcagcucaaagacgaggaagaauagggcgcaaucagaauaaagaaggugaucaauacaucuauaugggacagccuuuaaacaacgaugaggaccaugcgcauuggacggaagcuaaaauguuauuggauaacaucaacaccccagaggggaucauucccgcguuauucgaaccggagagagagaaauccgcagcaauagauggagaauauagacuacgaggcgaagccaggaaaaccuuuguugaacuaaugcgacgcggagaucuaccgguuuggcugucguacaaaguagccagcgagggcuuucaauauagcgaccgacggugguguuuugauggagaaaggaacaaccaaguguuagaagaaaauauggaugucgagauauggacuaaagaaggggagcgcaagaaacuacguccacgguggcuagacgcacggacauacagcgauccauuagcauuacgagaauuuaaggaauuugcggcgggcagaagaucaguuagcggcgacuuaauauuggaaauugguaaacuaccacaacauuugacuuugagggcacagaacgcauuagauaaccucguuaugcuacauaauucagaacaaggagggaaagcguauagacaugcaauggaagaauuacccgacaccauagagacacuaaugcuuuuagcacugauagcaguauugacgggaggaguuacucuguucuuuuugagcgggaaaggcuugggaaaaacaaguauaggucugcucugugucacagcgucuucggccuuguuauggauggccuccgucgaaccacacuggaucgcagcaaguauuauuuuagaguucuuucuuauggucuuguuaauaccggaaccggauagacaaagaaccccucaggacaaucaauuggccuauguuguuauuggacuucuauuuaugauauuaaccguagcagcaaaugaaaugggauuacuagagacuaccaagaaagauuuaggaauaggauauguagcagcugaaaaucaucagcaugccacaauguuagacguagaccuccauccagcuagcgcguggacacuguacgcuguggcaacaacaguaauuacgccaaugaugagacauacaauagaaaacaccacugcuaacaucagccuaacggcaaucgccaaccaggccgccauccucaugggacuagauaaaggauggccgauaagcaaaauggacauaggcgugccucucuuagcuuugggauguuacucgcagguaaauccgcuuaccuugacagcggcuguuuugauguuaguagcacauuacgcaauaauagguccugguuugcaagcgaaagcaacccgugaagcgcaaaaacgaaccgcagcgggaauaaugaaaaauccuacagucgauggaauaguugcuauagauuuagaucccguaguuuaugaugcgaaauuugaaaaacaauuaggccaaauaaugcuacuaauuuuauguacuucacaaauacucuugaugcgaaccacgugggcacuaugugaaaguauaacucuagcuacagguccacuaaccacauugugggaaggcucacccggaaaguucuggaauaccaccauagcaguaaguauggcgaacauauuuagggguucauacuuagcgggcgccggucuugccuuuagccuaaugaaaucucuuggagggggacgacggggaaccggagcacaaggcgaaacgcuuggagaaaaauggaaaagacaacuaaaccagcuuuccaaaagcgaauuuaauacauacaaaagaucagguaucauggaaguagauagaucagaagccaaggaaggcuugaagcguggggaaacgaccaaacaugcagucaguaggggaacugccaaacuacgaugguucguagaaaggaaccuuguuaaacccgaaggaaagguaauagauuuggguugcgguagaggagguuggucuuauuacugugcuggauugaagaaaguaaccgaggucaaaggauauacaaaaggaggaccgggucaugaagaaccgauuccaauggcuacauacgguuggaaccuagugaaauuacauucaggcaaagacguauuuuucaugccaccggaaaaaugugauacgcugcuaugugauauuggcgaaucgucuccuaauccaaccaucgaagaaggccgcacgcucagaguccucaaaaugguagaaccauggcugcggggaaaucaauucugcauuaagauacugaauccauauaugccgagugugguagagacguuagagcaaaugcaaagaaaacacgguggcauguugguuagaaauccguuaagucgcaauagcacacacgaaauguacuggguaucuugcgguacaggaaacaucguguccgcaguuaacaugacaagcaggauguuacuaaauagauuuacgauggcacacagaaagccaacauacgaacgugauguggauuuaggggcuggaaccaggcacguggcuguagagccagaagucgcuaaccuugauauaaucggccaacgaaucgaaaauaucaaaaaugaacacaaauccaccuggcacuacgacgaggauaaccccuacaaaacaugggcuuaccaugguucuuaugaagucaagccguccggcagcgcaucaagcaugguaaauggcguaguaagacuucuuacaaaaccuugggaugucauaccaaugguaacacaaauugcuaugacugauacgaccccuuuuggacagcagcguguuuuuaaggagaagguugacacuagaacuccaagggccaagcgagguacuacacagauuauggaaguaaccgcaaagugguuauggggcuuuuuaagcagaaauaaaaagccuagaaucugcacccgugaggaauuuacccggaaagugagaagcaacgcagcaauuggugcuguauuuguggaugagaaccaguggaacucugcuaaggaagccguugaggaugaaagauucugggauuugguucaccgugagcgagaacuacacaaacaagggaagugcgccacauguguuuauaacaugauggggaaacgagagaagaaacuaggcgaauuuggaaaagcuaaagguucacgcgccauaugguauauguggcuuggagcgagauuccuagaauuugaagcucucggauuuaugaaugaagaucacugguucaguagagaaaauucacugagcgguguggaaggugaaggccuacacaaauuagguuacauacuucgagacauaucgaaaauucccgggggaaauauguaugccgaugauaccgcaggcugggacacuagaauaacagaagaugaucuucaaaaugaagcuaaaaucaccgacauuauggagcccgagcaugcauuauuagcuacuucgauuuucaaacugacauaucaaaacaaaguaguaagaguacaaagaccggcuaaaaacgggacugucauggauguaauaagcagaagagaucaacguggcucaggccaggucggaaccuacgggcuaaauacauuuacaaauauggaaguccagcucauacgacaaauggaaucagaaggcauauuuuuaccgagugaauuagaaacgccaaacuuagcagaacgggcauuggacugguuagagaagcauggugcugagcguuugaaaagaauggcaauuagcggagaugauuguguugucaaaccuauagacgaucgcuuugcgacagcacuaacagcucuuaaugauauggguaaaguuagaaaagauauuccccaaugggagcccucaaaagguuggaacgacuggcaacagguucccuuuuguagccaucauuuucaccaauuaauaaugaaagacgguagggaaauaguagucccuuguagaaaucaagaugaguuaguggggcgggcaagagugucucaaggagcaggcuggaguuugcgagagacagcuugccuaggcaagucauaugcacaaauguggcaacuaauguauuuucaucggcgcgaucugcggcuagcugcaaacgcgauauguagugcagucccagucgauugggucccugcguccagaacaacauggucgauacacgcccaccaucaauggaugacuacagaagacaugcugagcguguggaaucgaguauggauagaggaaaacccguggauggaagacaaaacacacgucucaaguugggaagagguuccauaucuagguaaaagagaggaccaauggugcggcucucuuauaggacuaacagcacgcgcuaccugggcaacaaauauucaaguagcaaucaaucagguaagacguuugauagguaaugagaacuaccuagacuauaugaccucaaugaaaagauuuaagaaugaaucugauccugagggagcucuaugguga

SEQ ID NO: 21094 - RNA, 9879 nt, Artificial Sequence
  derived and/or modified CDS sequence (opt6) from DENV-1__JX669464__SS-prME
agcgugacaauguuauuaauguuauuaccaacagcgcuagcauuccaccucacuacgaggggaggagaaccacauaugauuguuucaaaacaagagagagggaaaucauugcuuuuuaaaacaucugugggaguuaauauguguacauuaauagcgauggacuuaggugagcuuugugaagacacaaugacuuauaaauguccgagaauaacagaagcugaaccggacgauguagauuguugguguaaugcaacagauacaugggucacauauggaacauguucacaaacgggagaacacagacgcgacaaacgcucaguugcguuagcaccucacguuggauuaggacuugaaacaagaacggaaaccuggaugucgucagaaggagcuuggaaacaaauacaaaaaguugaaacgugggcauugaggcauccaggauucacaguuauagcacuuuuucuggcacaugcuaucgguaccucaauaacucagaaaggaauaauauucauuuuguuaauguuagucaccccuucgauggccaugcguugugucggaaucgguaacagagauuucgucgaaggguuaucaggagcaacguggguagacguuguacuugaacaugggaguugugucacaacaauggccaaaaauaaaccuacuuuagacauugaguuguuaaaaaccgaaguuacuaauccagccgucuugagaaaacugugcauugaggcuaaaauuuccaauacgacaacagacagucgauguccaacacaaggagaagcaacauugguggaagaacaagaugcuaauuuugucuguaggaggacuuuugucgacagggggugggggaauggcugugggcucuuuggaaaaggaucgcugcuuacuugugcgaaauuuaaaugugucacaaaacuagaagggaaaauaguucaauaugaaaauuuaaaguacucgguuauaguuacaguacacacuggcgaucaacaucaaguagguaaugaaacaacugaacacgguacgauagcaacuauaacuccccaggcaccuacaagugaaauucagcuaacugauuauggagccuuaacacucgacugcuccccaagaacaggucuugauuuuaacgaaaugguguuacuaacuaugaaagagaaaucauggcuaguucacaaacaaugguuccuagaucuaccauuacccuggacuucaggggcuucaacaucucaggaaaccuggaauagacaggauuuacuugugacguuuaagaccgcacaugcuaagaagcaagaaguagucguauuaggcagccaagaaggugcaaugcauacagcacucacaggugcaacggagauucaaaccagugguacaacgaccaucuuugcaggacaucuaaaaugccgccucaagauggacaaauuaacacuaaaaggaaugucguacguuauguguacaggaaguuucaaacuugagaaagagguggcagaaacacaacaugguacaguacucguccaaguuaaauacgaaggaacugaugcaccuuguaaaauaccguuuuuaacucaagaugagaaaggaguaacucagaauggacgucugauuacagcuaacccgauuguaaccgacaaggaaaagccaguuaauauagaaacagaaccuccuuuuggggagaguuauaucgugguaggcgcuggagagaaagcgcugaagcuaucgugguuuaaaaagggaaguucaauaggaaaaauguucgaagccaccgcaagaggagcacgcaggauggcaaucuuaggggacacagcaugggacuuugggucaauuggcgguuuauuuacaagugucggaaagcuaauacaucaaguauuuggaacugcauacgguguauuguuuucaggggucaguuggacaaugaaaauaggcauugguauauuacuaacaugguugggccuuaauaguagaagcacaucauugaguaugacauguauugcaguaggaaugguaacauuauaccuuggggugaugguccaagcugauucagguugcguaauuaauuggaaaggcagagaauuaaagugcgggaguggcauauuuguuacaaacgaagugcacaccuggacggaacaauauaaguuccaagcggauucaccgaaacguuuaucagcggcgaucggaaaagcgugggaagaagggguuugugguauaagaucggcaacaagacuggaaaacauuauguggaaacaaauaucgaaugaauuaaauuacauuuuauuggaaaacgauaugaaguucacaguaguuguuggagacguaaaugguauauuagcucaaggcaagaaaaugauaagaccacaacccauggaacauaaguauagcuggaaaucauggggaaaagcuaaaaucaucggcgccgauauucaaaacaccacauuuauaauugaugguccggauacgccggagugcccagaugaucaacgggcuuggaauauuugggaaguagaagauuauggcuuuggaauauucacgacaaacauauggcuuaaacuccgggauagucauacacagaugugugaucacaggcuaauguccgccgcuauaaaagacagcaaagcuguacaugcugauaugggauacuggaucgaaucagagaagaaugaaacauggaaacuugcgcgagcgucauuuauugagguaaaaacauguauauggccgaaaucgcauacuuuauggucaaacggggugcuggaaucggagaugguaauaccaaaaauauauggaggcccaaucagucagcauaacuacagaccaggguauuucacgcaaacugcagguccauggcaucucgguaaacuggaauuggacuucgacuuaugugagggcacgacuguagucguggaugaacauugcggguaccgaggucccaguuuacgaacaaccacagugacaggaaaaauuauucaugaaugguguugccgaucuuguacuuuacccccauugagguuccguggugaagacgguuguugguacgguauggaaauacgcccgguaaaagagaaagaggaaaaucuuguuagaucgaugguuucugccggaucaggagaaauggauaguuucucacuaggaauauuauguguaucuaucuuaaucgaagaaguaaugagaucacgcuggucucguaaaauguugaugacagguacucuggcaguauuuuuguuauuaauaaugggacaacuaacauggaacgacuuaauacgauuguguauaaugguaggagcuaaugcgucagaccgaauggguaugggaacgacguaucucgcguuaauggccaccuuuaaaaugcguccuauguucgcuguggggcucuuguuucgccgauuaacgucuagagaaguguuacugcugacgguaggucuaucuuuaguugcaucaguagaauuaccuaauucacuugaagaacuaggagacggcuuagcgaugggcauaaugaugcucaaauuacugacagacuuccagccacaccagcuuuggacaacccuacucucacuaacguuuauuaggacaagccuuagcuuagacuaugccuggaagaccauggcaauggcgcuauccauuguaucacuauuuccauugugcuugagcacaacuucacagaaaacuacuuggcuacccguucuauuaggcagcuuugggugcaaaccccuaacuauguuucuaaucacagaaaauaaaauuugggggcgaaagucauggccuauaaaugagggaauuauggcuguugguauuguuucuaucuuauugaguucauuacucaaaaacgauguaccguuggcggggccauuaauagcaggagggaugcuaaucgcuugcuacguaaucucaggauccucagcagacuuaagccuagaaaaggccgcugaaguauccugggaggaggaagccgaacauucggggacaucccacaacauucuggucgaaguccaagaugacgguacaaugaaaauuaaagaugaagaaagagaugauacccucacaauucuccuaaaagccacacuuuuagcaguaucaggaguuuacccuaugucaauaccggcgacauuauuuguuugguauuuuuggcaaaagaagaaacaacgcagcgguguucuuugggauaccccuagcccgccggaaguugaaagagcaguauuggaugacgguauauauaggauucuucaaagagggcucuuagguagaucgcagguuggcguaggggucuuccaagauggggucuuucauacaauguggcacgucaccagaggcgcagucuuaauguaucaaggcaaaagacuagaaccaaguugggccucggugaagaaagauuuaaucuccuacggcggggguuggcgguuccaaggaucuuggaauacgggagaagaaguacaaguaauugcgguagagccagguaaaaacccuaaaaauguccagacuacuccaggaacauuuaaaauuccagagggcgaagugggagcaauagcucuagacuucaaaccggguacaucaggaaguccuauaguaaaucgagaaggaaaaauuguaggauuguacggaaauggaguuguaacaacuucuggaacguauguauccgccauagcucaagccaaggcaacccaggaaggaccuuuaccagaaauugaggaugaaguauuuaagaaaagaaaccugacgaucauggaucuacacccagguagcggaaaaacgaggagauacuuaccugcgauuguccgagaagcgauaaaaagaaaguuaaggacucucauauuggcgccuacacguguugucgccagcgaaauggcagaagcccuuaaaggaaugcccauuagguaucaaacaacagccgugaaaucagagcacacugggcgggagauuguugaucuuaugugucaugcaacguuuacuaugagauuacugagucccguacggguaccuaauuacaauaugauuauaauggaugaagcacauuuuacggacccggccagcauagcagcgaggggguacauaucaacaaggguuggaaugggcgaagcggcagcuauauuuaugacugcaacaccucccggauccgucgaggcguucccccaaucaaacgcaguaauacaagaugaagagagagauauaccagagcgaucauggaacagugguuacgauuggaucacugacuuucccgggaagaccguaugguuugucccauccauaaaaagugguaaugauaucgcaaauugucuccggaaaaacgggaaaaggguaauccaauugagucgcaaaaccuucgacaccgaauaucagaaaaccaaaaacaaugauugggauuauguuguuacgacagauauuagcgaaaugggggcuaacuuccgcgcggacagagugauagauccaaggagaugucuuaaaccuguuauucugaaagagggcccggaaagaguaauucuagcagguccaaugccgguuacagucgcaucagcggcacaaagaagggguaggauagggagaaaucaaaauaaagaaggagaucaauauaucuacaugggacagccauugaacaaugaugaagaucaugcccauuggacagaagcuaagaugcuuuuagauaacaucaacacaccagaagguauaauuccugcuuuauuugaacccgaaagggaaaaaucggcugcaaucgauggagaauacagacuaagaggagaagccaggaaaaccuucguggaguuaaugagaagaggcgaucugccagucugguugucguauaaaguagcuucugaggguuuccaguacuccgauagaagguggugcuuugacggcgagcgaaauaaccaaguacuagaggagaauauggauguugagaucuggaccaaagaaggagaacgcaagaaacuccgcccgagaugguuagaugccagaacauacucggauccacuggcacuacgagaauuuaaagaauuugcugcaggacgcaggagcguaucgggagaucuuauauuagagaucggaaaauugccgcagcauuugacccuuagagcccagaacgcacuugauaacuuaguaauguugcacaacucugagcaaggaggaaaagcguauagacaugcgauggaggagcucccggauaccauagaaacccucauguuauuagcacugaucgcuguacuuaccgggggaguaacccuauucuuucugucgggaaaaggauuagggaaaacaaguauuggauuauugugcgucauggcgaguagugcacuuuuauggauggccuccguugaaccgcacuggauugcagccucaauaauccuagaguuuuucuuaaugguccugcuaauacccgaacccgaccgacaaagaacgccgcaagacaaccaacuggcauacgucguuauugguuugcuauucaugauauuaacaguagcagcuaacgagauggggcuccucgagacaacaaagaaagauuugggaauuggucauguugcagucgaaaaucaucaccacgcgacaauguuggacgucgaucugagaccagcgagcgcauggacgcuauacgcgguagcgacuacagucauaacaccaaugaugcgacacaccaucgaaaauacaacagcaaauaucaguuuaacagcaauagccaaucaagcagccauauugauggguuuggauaaaggauggccuauaaguaaaauggauaucggaguuccguuauuagcccugggaugcuacucacaaguaaauccauuaacucucacugcagcaguauuaaugcuagucgcacauuaugcaauuaucgggccaggguuacaagcaaaagcuacucgagaagcucaaaagcgaaccgcagcugguauaaugaaaaauccuaccguggaugguauaguaacgauugaucuggauccagugguguaugaugcgaaguucgaaaaacaguugggucagauaaugcuauuaaucuuaugcaccucacaaauuuuacuaaugagaacaacgugggcacugugugagagcaucacucuagcaacaggcccacugaccacgcucugggaaggaaguccgggcaaguuuuggaacaccacaauagcgguuaguauggccaacauauucagagguucuuaccuggcaggcgcaggacuugcuuuuucauuaaugaagucacuagggggugggagacgagggacuggagcacagggagaaacacuaggagaaaaguggaaaagacagcuaaaccaacuuucuaagagugaauuuaacacauacaagaaaucagggauuauggaaguugaccgcucggaggccaaagaaggacuaaaaagaggagaaacaacaaaacacgcggucagucgaggaacagccaaauuacggugguuuguugaaagaaacuuaguaaaaccugagggcaaaguuaucgauuuaggauguggucgaggcggguggaguuauuauugcgcaggauuaaagaaaguuacggaaguaaaaggcuauacaaaagggggacccggucaugaagaaccaauaccuauggcuaccuauggauggaaucuaguuaagcuacacagugguaaagauguauucuuuacaccuccggaaaaaugugauacucugcuuugcgacaucggagaauccucaccaaauccaacgaucgaggaaggccguacuuuaaggguguuaaaaaugguagaaccaugguuacgugguaaccaauucuguauaaaaauacucaauccguacaugccaucuguuguagaaacacuugagcaaaugcaacggaaacauggaggcauguuaguaagaaauccucuuaguaggaacaguacccacgaaauguauuggguaaguuguggaacaggcaauauaguaagcgccguuaauaugacuucucguauguuguuaaacagauucaccauggcgcaccgaaaaccaacauacgaaagggauguagaccuaggagccggaacaagacauguugcaguggaacccgaagucgcaaacuuagauauaauuggccaaagaauugaaaacauuaaaaaugaacacaaaaguaccuggcauuaugaugaagauaauccguacaaaacgugggcguaucacggaucuuacgaaguaaaaccaagugguucagccagcucuauggucaacggcguugucagauuguuaacaaagccgugggaugugaucccaaugguuacucaaauagccaugaccgacacuacaccauucggccaacaaagaguauucaaagaaaagguggacacgcgaacaccgagagcgaagagagggaccgcucagauuauggaaguuacugcaaaguggcuauggggguuucugucacgaaauaaaaagccgcguauuuguacacgagaagaauuuacuaggaaaguccgaucuaaugcagcaauuggagcgguauucgucgacgaaaaccaguggaacucagcaaaagaggcaguugaagaugaacguuuuugggaccuaguucaccgcgaaagagaacuucacaagcaaggaaaaugugccacuugugucuacaauaugauggggaaaagagagaagaaacuuggcgaauuugguaaagccaaagggucacgugcaauaugguauauguggcugggggcccgauuccuugaauuugaagcauuaggauuuaugaaugaggaucauugguuuucacgugaaaauagccugucagguguugaaggagaagggcuacauaaauuaggcuacauacuucgagacauaaguaagauuccagguggcaacauguaugcggaugauacugcgggaugggauacuaggaucacggaagaugaccuucaaaaugaagcgaagauaacagauaucauggagccagagcacgcgcuuuuagcaacaaguaucuucaaauuaaccuaucagaauaaagugguaagaguccagagaccagcaaagucagggacaguuauggacgugauaagucgacgggaucaaagagggucagggcaaguuggaacauacggucuaaauacauucacuaauauggagguacaacuaauaagacaaauggaaucugaaggaaucuucuuaccuagugaacuagaaacgccaaaucuagcgaaaaaggucuuagauuggcuugaaaaacacggagccgaaagacugaagagaauggcuaucaguggcgacgacugugugguaaaaccaauugacgaucgguuugcuacagcacuaacagcuuugaacgauauggggaaggucagaaaagacauaccccagugggagccaucaaaagguuggaacgauuggcagcaaguaccauuuuguucacaucauuuucaucaauuaauuaugaaagacgguagggaaauagugguaccguguagaaaccaggaugaauuaguaggcagagcaagggucucacaaggcgcaggauggagccuucgggaaaccgcuugucucgggaaaucauacgcucaaauguggcaacuaauguauuuccaccgacgggaucuucgcuuagcagcaaaugcuaucugcagugcaguaccaguagauugggucccgacgaguaggacaacauggucaauucacgcucaucaucaguggaugacuacugaagauauguuaaguguauggaauagggucuggauugaagaaaacccauggauggaagacaaaacacauguuuccagcugggaagaggugccuuauuuggguaagcgagaagaccaauggugugggucacuaauaggacugacggcacgagcgaccugggccacaaauauacaaguagcaauuaaucaaguaagaaggcuaauugguaaugaaaauuauuuagauuacaugacaucuaugaagagauucaaaaaugaaucagauccugagggcgcauuaugguaa

SEQ ID NO: 21095 - RNA, 9879 nt, Artificial Sequence
  derived and/or modified CDS sequence (opt6) from DENV-1__JX669465__SS-prME
aguguuacaauguuauugauguuacuuccaacugcacuagcauuucaucuaacuacacgaggcggugaaccacacaugauaguuaguaaacaggaacgagggaaaucccuacuuuuuaaaacuucaguagggguaaacaugugcacucuuauagcaauggauuugggagaauuaugugaagauacuaugacauauaaaugucccagaauaaccgaagccgagccagacgaugucgauuguuggugcaaugcaacggauacuugggugacauacggcacauguagccaaacgggugaacaccguagagauaaaaggagcguugccuuagcaccacauguaggccucggacuagagacaagaacagaaacuuggaugucgagugagggggcuuggaaacaaauucaaaaaguggaaacaugggcacuuagacauccaggauuuacaguaauugcuuuauuuuuggcacaugcuaucggaacaaguauaacucaaaaaggaaucauauucauacuacuuauguuagucacuccaucaauggcaaugaggugcguuggaauuggaaaucgugauuuuguugagggacugagcggagccaccuggguggacgucguucucgagcauggcucgugugucacaacuauggccaaaaauaaacccacgcuagacaucgaauugcuuaaaacggaaguaacaaauccagcaguauuacgaaaacuaugcaucgaagcuaaaauaucaaauaccacaacggacucgaggugcccaacccagggagaagcaacucuuguagaggagcaggaugcgaacuuugucugcagaagaacauuugucgauagggguuggggaaauggaugcggcuuauuuggaaaaggaucccuacuuacuugugcaaaauuuaaaugugugacuaaauuggagggcaaaauuguacaguacgagaaucuaaaauacucgguaauaguaacuguccacaccggugaucaacaccaaguugggaacgaaacuacggaacacggcaccauugcgacuaucacgccucaagcccccacaagugaaauacaacuuacagauuauggagcauugacucuggauuguucaccacggacaggucuagauuuuaaugaaaugguacugcuaacaaugaaagaaaaaucauggcuagugcauaaacagugguuuuuagaucuuccgcucccauggaccucaggcgcaagcaccucacaagaaacauggaauagacaggauuuacuuguaaccuucaaaacagcgcaugccaagaaacaagaaguugucguauuaggaagucaagaaggagccaugcacacugcgcugacaggcgcuacagaaauacaaaccucgggcacuacaacuauauuugcaggccacuuaaaauguagacugaaaauggacaaacuaacacuuaaaggaaugaguuacgucauguguacugggagcuucaaacuagagaaagaaguugccgaaacacaacauggaacuguauugguacaaguaaaauacgaaggcacagaugcgccguguaaaauaccguuuuugacacaggacgaaaaagguguaacacaaaauggacgauuaauaaccgcuaacccgauaguuacagauaaagaaaaaccuguuaacauagaaacggagccgccuuuuggugaaagcuauaucgucguuggagcuggugaaaaagcacuuaaauuaucaugguuuaagaaagguuccucaauaggaaaaauguuugaagcuaccgcaaggggcgccagaagaauggccauacuuggagacacagcgugggauuucggaagcauaggcggacuauuuacuuccguuggcaaacuuauucaucaaguauuuggaacagcguauggcguuuuguuuucggggguauccuggaccaugaaaauagguaucggaauauugcucacuuggcugggauuaaauucaagaaguacaucauuaaguaugacguguauagcaguuggaauggugacgcuauaccuaggaguaaugguacaagcugauucaggaugcguaauaaacuggaaaggccgagaacuaaaaugcggaagcggaauuuuuguaaccaaugaaguacauacauggacggaacaguacaaauuccaggcagauucgccaaaaagacuaagugcagcaauugguaaggccugggaagaaggcguguguggaauacgaagugccacucgucuagaaaacauaauguggaaacagaucucaaacgagcuuaauuacauacuuuuagaaaaugacaugaaauucacuguaguaguaggcgaugugaaugguauacuagcgcaagggaagaaaaugaucagaccucagccuauggaacacaaauacucuuggaaaaguuggggaaaggccaagauaaucggugcagacacccagaauacaacauucauaaucgaugggccagauacaccagaauguccugaugaucaacgagcuuggaacauaugggaaguagaggauuacggguuuggcauuuuuacaacaaauauaugguuaaaguuaagagauagccauacgcagaugugugaucacagacuaaugagugccgcuauuaaagauucuaaagcaguucaugccgauaugggauauuggauagagagugagaaaaacgaaacauggaagcuggcaagagccucauuuaucgaaguaaaaacauguauuuggccaaaaucucauacguuguggucaaaugggguucucgaaagugagauggucauaccaaagaccuacggugguccaauuucgcaacacaacuacagaccugguuacuuuacacagacugcagguccuuggcaucuagguaaacuugaacuagacuuugauuuaugcgaagggaccaccguagucguagacgaacacuguggcuaucgcggaccuaguuuaaggacaacaacaguuacgggaaagauuauacaugaaugguguuguaggucauguacuuuacccccucuucguuuucgcggggaagacggaugcugguaugguauggagauuaggccaguuaaggaaaaggaagagaaucuaguucgcucgaugguauccgcagguucaggugaaauggacagcuuuucauuagggauuuuauguguaaguaucuuaauugaagaaguuaugagaagucguuggucacgcaaaauguugaugacgggaacccuugcugucuucuuacuauuaauuaugggacagcugacauggaaugaccuuauacgucuaugcauuauggugggcgcaaacgcaagcgaccgaaugggaauggguaccacauaccuugcccuuauggcuaccuuuaagaugagaccuauguucgcgguggguuuacuguuucgacgguuaacgucuagagaaguguuacuacuaacugucggauugagccuagucgcaucaguagaguugccuaacuccuuagaagaauuaggcgauggauuagcaauggguaucaugauguuaaagcucuuaacagauuuucaaccucaucaauuauggacuacgcucuuaucucucacuuuuauccgaacaagccuuagccuagauuaugcuuggaaaacgauggccauggcucuaaguaucguaucauuauucccauuaugccuaucuacuacgucgcagaagaccaccuggcuaccuguauuacuugguagcuuugguugcaagccuuugacgauguuccugauuacggaaaacaaaauaugggguagaaaaucuuggccaauaaacgaggguauaauggcaguggguaucguaucaauacugcucucuagucucuugaaaaaugacguaccacuagcugggccccuaauagcgggagggauguuaauagcguguuacguaauaaguggcagcagugcugaccuuuccuuagaaaaagcggcggaggugucaugggaagaggaggcggaacacucagggacgucacauaacauccugguagaaguucaggaugaugguacaaugaagauaaaagaugaagaaagagacgauacauuaacaauacucuuaaaagcgacucuacuugccguuagugguguuuauccuaugucaauaccugccacucuuuucgugugguauuuuuggcagaagaagaaacaaaggagugguguuuuaugggacacuccuaguccaccugaaguagaaagagcaguuuuagacgacgguauauacaggauauugcaaagagguuuauuggguagaagucaaguuggcguagggguauuccaagauggaguuuuucauacgauguggcacgugacgagaggagcuguuuugauguaccaaggcaagagauuagagccaagcugggcaucagucaagaaagauuuaauaucauauggaggcggcuggagguuucaagguuccuggaauacaggcgaagaaguucaaguuauugcgguugaaccugggaaaaaucccaagaacguucagacuaccccgggaacauuuaaaaccccagaaggagaaguuggagcaaucgcacuggacuucaaaccaggcacaucaggaaguccuauaguaaacagagaggggaagauaguaggucuauauggaaauggaguaguuacaacaucuggcacguauguauccgcuauagcacaagcaaaagccacccaagaagggcccuuaccagaaauugaagaugaaguauuuaagaaacgaaauuuaacaauaauggaucuacauccugguaguggaaagacgagacguuaccuaccagcgaucgugagagaagccauaaaacgaaaguuacgaacacuuauacuugcccccacaaggguagucgcaucagagauggccgaagccuuaaaagguaugccgauacgauaucagaccacagcuguaaaaucugaacauacaggaagagaaaucguagaccucaugugccacgccacguuuacgaugcgacuacuuucccccguaaggguccccaauuauaauaugauuaucauggaugaagcacacuucacagaucccgccuccauagccgcucgaggguauauuaguacucgaguagggaugggagaagcugcugcgauuuuuaugacagcaaccccacccggaucugucgaggccuucccccagucuaacgcuguaauucaagaugaagaacgagacaucccagagcguaguuggaacuccggauacgauuggauaacggauuuucccggaaaaacugucugguuuguuccuagcauaaaaucagguaacgauauagcuaauugccuccgcaagaauggaaaacgaguuauucaauuaaguagaaaaacuuuugauacugaauaucaaaagacuaaaaauaaugacugggauuauguugucaccacagacauuucugaaaugggcgccaauuuuagagcagaccgcguuaucgauccacgacgaugucuuaaaccagugauauuaaaagaaggaccagagagggugauauuagccgggccgaugccagucacgguagccucagcggcgcaaaggcgaggucgaaucggccgaaaucaaaacaaagagggugaccaguauauuuauaugggccaaccacugaauaacgacgaggaucaugcacacuggacggaagcuaagaugcucuuagacaauauuaauacuccagaagguauuaucccugcguuguucgaaccggaaagagagaaaagcgccgcuauagauggugaguaucguuuacgaggugaagcuaggaaaacuuucguagaauuaaugagaagaggagaccucccuguuuggcucaguuauaaaguugccagugaaggauuucaauauagugaucgaaggugguguuuugauggugaaaggaauaaucaaguuuuagaggaaaauauggaugucgagaucuggaccaaggaaggagaaagaaagaaauugcguccacgauggcuugacgccagaacguauucagauccuuuagcucugcgagaauuuaaagaauuugcagcugggagacgaucugugucuggagaucuuauucuugaaauuggaaaacuaccucaacacuuaacucugcgagcacaaaaugcuuuagauaacuuagugaugcugcacaauagugaacaaggaggaaaagcauauagacaugcaauggaggaauugccagauacaaucgaaacacuaauguuauuggcccuaauagcaguacuaacuggaggaguaacucucuucuuucugucuggaaagggucugggaaaaacuucaauaggguuacuaugugugauggcuucaagcgcauugcuauggauggcuucagucgaaccccauuggaucgccgcuuccauaauccuggaguucuuccugauggucuuacugauacccgaaccugaucggcaaagaaccccucaggauaaucaauuagcauacguaguuaucggcuuacuauuuaugaucuugaccgucgccgcuaacgaaauggguuuacuugaaacaaccaagaaagaccuaggcauugggcauguggcagucgagaaccaccaccaugcaacaaugcuagaugucgauuugagaccagccagcgcuuggacucuuuaugcaguagcaacaacuguaauuacaccaaugaugaggcacacaauagaaaacacaaccgcaaacaucucgcugacagcaaucgcaaaucaagcugccauauuaaugggguuagauaagggauggccaaucucaaaaauggauauaggcgucccucuacuugcauuggguuguuacucgcaaguuaacccgcuuacccuaacagcagcaguauugaugcucguggcccacuacgcaauaaucgggccaggauuacaggcuaaagcaacgcgagaagcucaaaaacgaacugcugccggcauaaugaagaauccuacugucgaugggauugugacaaucgauuuagauccaguuguauacgacgcaaaguucgaaaaacaacuagggcaaauaauguuguuaauacugugcacuagccaaauccuauuaaugaggacuacgugggcauuaugcgaaucuauaacauuggccacuggcccgcuaaccacucucugggaaggaucgccugggaaauuuuggaacacaacgauagccguauccauggcaaauauauuuaggggaagcuauuuggcaggagccggucuagcguuuaguuuaaugaaaagucuagguggaggcagacgaggcacgggcgcacagggggagacuuuaggagaaaaauggaaacgccagcugaaccagcuaagcaaaucagaguuuaacacuuauaagaaaucaggcauuauggaaguagaucgaagcgaggcaaaagaaggccucaaacggggagaaacgacaaaacaugcagugucacgcgguacagcaaaacuucggugguuuguagaaagaaaucuagucaaaccagaagguaaaguuauugacuuaggguguggacggggagguuggucguauuauugugcaggguugaagaaagucacugaaguuaaaggauauacaaagggagguccuggacacgaggagccaauuccuauggcaacuuacggauggaaucuaguaaaacuacauagcgggaaagacguguucuuuacgccgcccgaaaaaugcgacacuuuauuaugcgauauaggggaauccucucccaauccaacaauagaagaaggacgcacauugcgcguauuaaaaaugguagaacccugguuacgugguaaucaauucuguauuaaaauauuaaacccauauaugccuagcgugguggaaacacuugaacagaugcaaaggaagcauggagguauguugguucggaacccguuaucgcgcaauagcacgcaugaaauguauuggguuucgugcgguacuggaaauaucguuucagcagucaacaugacuucacgaaugcuccuaaauagguucacaauggcacaucguaaaccaaccuaugagagagacgucgauuuaggagcggguacgagacaugucgccguagaacccgaggucgcaaauuuagauauuauuggacaaagaauugagaacaucaaaaaugaacacaagaguacauggcauuacgaugaagacaauccguauaagacaugggcuuaucauggaagcuacgaagugaaaccaucugguagcgcaagcucaauggucaacggaguaguccgguuacuuacaaagccgugggacgucauaccaaugguaacucagauagcgaugacagauacaaccccuuuuggucaacaaaggguguucaaagaaaaagucgacacgaggacucccagggcuaaaagggggacagcacaaauuauggaaguaacagcuaaaugguuguggggauuccucuccaggaauaagaaaccacgcaucuguacacgagaggaauuuacuagaaaagugaggucgaaugccgcgauuggagcugucuuugucgacgagaaccaauggaacagugcuaaagaagccgucgaagacgaaagauuuugggaucuggugcauagggaacgugaguuacacaaacaagguaaaugugcaacuugcguuuacaauaugauggguaagagagagaagaaacugggagaguucgguaaagcgaaagguaguagagcuaucugguauauguggcugggagcacgcuucuuagaguucgaagcacuaggguucaugaaugaagaucacugguucucuagagaaaacaguuuauccggaguagaaggugagggcuuacacaaauuaggcuacauucugcgcgacauuuccaagauaccaggcgguaauauguacgcugaugacacagccggaugggauacacgcauaaccgaagaugaucuacaaaaugaagcuaaaauaacagauaucauggaaccggaacacgcucuguuagccacgucuauauucaaauuaacauaucagaauaaaguaguaaggguacaacgacccgcaaaaucugguacagucauggauguuauaagccgacgggaucaacgaggaagcggacaaguaggcacauacgguuugaauaccuucacgaauauggaggugcaacuuauccgacaaauggaaagcgagggaauauuuagccccucagaacuagagacacccaaucuagcgaagaaaguuuuagacugguuagagaaacacggugcagagagacuuaaacgcauggcaauuagcggagacgauugcguagugaagccaauugacgaucgauucgcuacggcgcuaacagcacuaaaugauaugggaaaaauacgaaaagauauuccacaaugggaaccguccaaaggcuggaacgauuggcaacaaguuccguucugcagucaucacuuccaccaacuaauuaugaaggauggacgagaaauaguaguaccgugcagaaaccaagaugagcuaguugguagagcaagagugagucaaggagccgguuggucauugcgcgaaacugcuugucuaggaaagucuuacgcucaaauguggcaacucauguauuuucaccgccgagauuuacguuuagcagcgaacgcaaucuguucagcagugccaguggauugggugccaacaucucggacaacuuggaguauacacgcacaucaucaguggaugacaacagaagacaugcuaucaguauggaaucgaguauggauagaagagaacccauggauggaagacaagacgcauguaagcagcugggaagaggucccguaccuaggaaagagggaggaucaauggugcggcagucuaauaggucucacagccagggcaacaugggcaacaaauauccaaguugcuauuaaccaagucagaagacucauaggaaaugagaauuaucuggauuauaugacaaguaugaaacgauuuaaaaaugagucagacccggaaggagcccugugguaa

SEQ ID NO: 21096 - RNA, 9879 nt, Artificial Sequence
  derived and/or modified CDS sequence (opt6) from DENV-1__JX669466__SS-prME
agcguaacuaugcuacuaaugcuuuuaccuacagcacuugcauuucauuugaccacacgaggaggugaaccucauaugauaguuaguaaacaagaaagaggaaagagcuuguuguucaaaacuucagcagggguuaacauguguacauugauugccauggaucugggugaacucugugaagauacaaugacauauaaauguccacguauaacugaagcggaaccggacgacguagacugcugguguaacgcgacagacacaugggugacuuaugguacuugcagccaaacaggagaacaccgaagagagaaacguuccguugcuuuagcuccucaugucggccucggacuugaaacucgcacagaaaccuggaugucgagugaaggggcauggagacaaauucaacgcguagaaacuugggcucucagacauccuggauucacagucauagcauucuuccuugcacaugccauaggaacaaguauuacacaaaaaggaauuaucuucauacuuuuaaugcuagugacaccgucuauggccaugagaugcgucgggauuggaaauagagacuucguagaagguuuaucaggggccacauggguggauguaguauuggaacaugggucuuguguuacaacgauggcuaaaaacaaaccuacacuagauauagaacuacuaaaaacagagguaacaaacccugccguguuaaggaaauuauguaucgaggccaaaauaucuaacacaaccacagauuccaggugcccuacucaaggggaagcaacgcugguagaagaacaagaugcaaauuucgucugucgaaggacauucguagacagaggcugggggaacggaugcggacuauuuggaaaagggucauuacuaaccugugcaaaauuuaaaugugugaccaaauuagaaggcaaaauaguacaguacgaaaaccuaaaauacagugucauaguaacaguacauacuggugaucaacaccaagucggaaacgaaacuacggaacaugguacaauagcaacaauuacaccacaagcaccaacaucagaaauacaacuuaccgauuauggcgcucugacucuggauuguucgccuaggacaggauuagauuucaacgagaugguucugcucacgaugaaagagaaaaguuggcuagugcauaaacagugguuucuggaucugccauuaccuuggacgucgggggcaaguacaucacaagaaacuuggaauaggcaggauuuauuaguuacuuucaaaacagcucaugcaaagaaacaagaggugguaguauugggaagccaggagggcgcgaugcauaccgcacuuacuggagcgacagaaauacaaaccucaggaacuacuacaauauucgcuggacauuugaaaugucgccucaaaauggacaaacugacgcuaaaaggaaugucauaugugaugugcacagguucauuuaaacuggagaaagaaguagcugaaacacaacaugggacaauccuaguucagguuaaauacgagggaaccgaugcgccauguaaaauaccauuuagcacacaagacgagaaggguguaacacaaaacggacgacugaucacugcgaaucccauagugacagauaaagaaaagccuguuaacauugagaccgagcccccauucggggagaguuauaucguggugggagcaggagaaaaggcuuuaaaguuaaguugguuuaaaagaggcucaagcaucgggaaaauguuugaggcgacagcaagaggagccaggaggauggccauauuaggugauaccgcaugggauuucggcucgauaggaggagucuucacaucugugggaaaguuagugcaccaagucuuuggaacugcuuacggaguacuuuuuagcggagucaguuggacuaugaagauaggaaucggcauauuauuaacguggcuaggauuaaauucccggagcacuucauuaagcaugaccugcauagcugucggaaugguuacuuuauaccucgggguuaugguccaggcagaucuaggaugcguuauaaauuggaaagggagggagcuaaaaugcggaucaggaauauuuguuaccaacgagguacauacauggacagagcaauauaaauuucaagccgacucuccuaaaagauuauccgcagcaauuggaaaagcaugggaagaaggaguuuguggaauccgaucugcuaccaggcuugagaauaucauguggaagcaaauaucaaaugaacuuaaucauauucuucuugagaaugauaugaaauuuacgguagugguaggagaugcaaacgguauccucgcccaaggaaagaaaaugauucgcccacaaccaauggaacauaaauauucuuggaaaaguugggguaaagcgaaaauuauaggagcugauauacagaauaccacguucauuaucgacgguccagacacaccagaaugcccugacggucaacgagcuuggaauauaugggagguggaagacuacggauuugggguuuuuaccacgaacauaugguuaaaauuaagagacucuuacacacagaugugcgaucaucgucuuaugucagcagcaauaaaggauucaaaagcaguucaugcugacauggguuauuggaucgaaucagaaaagaacgaaacguggaaacuagcacgagcuucauucauagaggucaagacauguacuuggccuaaaucucauacacuauggagcaauggcguauuagagucugagaugauaauacccaaaauuuucggcggaccuauuagccaacacaacuaccgaccaggauacuuuacucaaacggcagggccauggcaucuaggaaaauuagaauuggauuuugauuugugcgaaggcacaaccguaguaguugaugaacacugcgguaaccguggccccagucuaaggacaacgacaguaacaggcaagauaauacaugaauggugcugucguucauguacacuacccccacuuagauuuagaggugaagaugguuguugguacgguauggaaauucgcccaguuaaggaaaaagaagagaaccugguacggucgaugguaucggcagguucaggagaagucgauuccuucucccucggaauacuuugcguuagcauaaugauugaagaagucaugcguucccgauggucucgaaaaaugcuuaugacugggacucucgcgguauuuuuacuuuugauaaugggacaguugaccuggaaugauuuaauaagacuauguauaaugguuggggccaaugcaucugacaggauggguauggggacgacauaucuagcucuaauggcaacauuuaagaugagacccauguuugccguugguuugcuuuuucguagauuaaccucucgagaaguacuacuccuuacgauaggacuaucauuaguagcuucggucgaauuaccaaauucccuggaggaacuuggagacggacuagcaaugggcauuaugaugcugaaacuauuaacugaauuucaaccucaucaauuauggacgacgcuauuaucacugacauuuguaaaaacaacccuaucuuuagauuaugcuuggaagacaacagccaugguauugucuauaguuucucuguucccguuaugucucaguacgacaucccagaaaacgaccuggcugccaguauuauuaggaucuuuugguugcaagccgcuaacaauguuucuuauaaccgagaauaaaauauggggcaggaaaucauggccccucaacgaaggaauuauggcuauaggcaucgugucaauauuacuauccucacugcuaaagaaugacgucccacuugccggcccuuuaaucgcaggaggcauguuaauagcauguuaugucauaaguggcucaagugcugacuugagcuuagaaaaagcagcggaaguuucaugggaacaagaagccgaacauucgggagcgagccacaauauauuagucgagguacaggacgauggaacuaugaaaauaaaagaugaagaaagagaugacacauuaacuaucuugcuaaaagcaacucuacuagcaguaucugguguguaucccaugucuauucccgcaacacuguucguaugguacuuuuggcagaaaaagaaacaaaggagugguguauuaugggauacaccgagucccccugaaguggaacgggcaguacuagacgacgguauuuacagaauuuuacaacgaggucuccucggcagaucgcagguugguguagguguauuucaggauggcguguuucauacuauguggcacguaacuagaggcgcuguacuaauguaucaaggcaaaagacuagaaccaucaugggcuucggucaagaaagauuuaauuagcuaugggggaggauggagauuucaagggucauggaauacaggagaagaagugcagguuauagcaguggaaccugggaaaaaccccaaaaacguccaaacaacccccggcaccuucaaaacaccagaaggugagguaggggcuauugccuuagauuucaaaccaggcaccagugguucuccaaucguaaaccgagaaggaaaaaucguaggcuuauacggaaauggcguagucacaacguccggcacuuacgugucagcaauagcacaagcaaaagcaucccaagaggggccccuaccagagauugaggacgaagucuuuaaaaagagaaauuugacuauuauggaccugcacccuggaagcggaaaaacacggcguuauuuaccagcuauugugagagaggcgauuaagagaaaacuucgcacucuaauauuggcuccuacaagaguaguagcaucggaaauggcagaagcauugaaggggaugccuauaagauaccagacuacagccgucaagucagaacacacaggucgugaaauaguagaccuaaugugccaugccacuuuuacgaugcgucuucuaucaccaguaagggucccaaauuauaauaugauaauuauggacgaggcucauuuuacugacccugcaucgauagcagcuagaggauauaucucaacucgugugggcaugggagaagccgcugcgauuuuuaugacggcgaccccacccggaucaguagaagccuuuccacaaaguaacgcagugauacaggaugaagaacgugauaucccggaacgaaguuggaacaguggguacgacuggauaaccgauuuuccaggaaaaaccgugugguuugugcccaguauuaaaagcgggaacgacauagcuaauugucuucgcaaaaaugguaaacggguaauacaauuaucaaggaaaacauuugauacagaauaucagaaaaccaaaaauaaugacugggacuacguuguuacgacagauauuucagaaaugggugcgaauuuuagggcggaccguguaauagacccacggagaugucuuaaaccuguaauacuaaaagauggaccggaaagagugauucuggcaggaccaaugccaguaacaguggccuccgcggcccagagacggggaaggauuggaaggaaccaaaauaaagaaggggaccaguauguguauaugggacaaccacuuaacaaugaugaagaucaugcucauuggacagaagcgaagaugcugcucgauaacauaaacacgccagaggggauaauuccggcccuauuugaaccagaaagagaaaaaucagcagcuauagacggagaguaccgacuuagaggugaagcucguaagacuuucgucgaacuaaugcgaagaggggaucuucccguauggcuuucuuauaaaguugcaucagagggcuuucaauauucugacagaagaugguguuuugacggcgaacgaaacaaucaaguuuuggaagagaauauggauguagagauauggacaaaggaaggugaaaggaagaaacugagaccccguuggcuagacgcgagaacauauucggacccucucgccuuacgagaauuuaaagaauuugcagcugguagacggaguguaaguggugaucuaauucuggaaauagguaaacucccacagcaccucacgcuccgagcacaaaaugcacuagacaacuuaguuaugcuacauaacucagaacaaggcggaaaggcauaccggcaugcgauggaagaacuuccagauacaauagaaacacuuauguuacuagccuugauagcuguguugacuggagggguaacacucuucuuucuaagcggaaaaggacuagggaagacuagcauuggcuuauuauguguaacugcgaguagugcuuuacuuuggauggcaagcguugagccacacuggauagcagcuucuaucaucuuggaguucuuuuugaugguguuguuaauaccggaacccgauagacagcgcacgccacaagacaaucaauuagcauacguaguaauaggauugcuauucaugauuuuaacaguagcugcaaaugagaugggacuauuagagacaacuaagaaagaucuaggaauaggguauguggccgcagaaaaccaucaacaugcaaccauguuggauguagacuuacauccagccuccgccuggacacuauacgcaguugccaccacaguaauuacaccuaugaugaggcacaccauagaaaacacuacagcaaauauaucauugacagcgaucgcuaaucaagccgcaauuuuaauggggcuugacaaggguuggcccauuucaaaaauggacauaggaguuccacuauuagccuuaggauguuauucacaaguaaacccccuuacucuuaccgccgcagugcuuaugcuagucgcacauuacgcaauaauagguccuggccuucaagcgaaggcaaccagagaagcgcaaaagaggacggcagcagguauuaugaaaaauccuacaguugacggaauaguagcaaucgaucuggacccuguaguauaugacgcaaaguucgaaaaacagcucggucaaaucauguuguuaauauuguguaccagucaaauauugcuaaugcgaacaacaugggcacucugugaauccauaaccuuagcgacaggaccguuaacgacucugugggaaggaagcccgggaaaauucuggaacacuacuauagcagucuccauggcgaauauauuuagaggcucuuaccuggcuggggcagguuuagcauuuucuuuaaugaaaagucuaggagguggaagacgagguacgggugcacagggcgaaacauuaggagaaaaauggaaaagacagcugaaucaacuaucaaaaagcgaauuuaacacuuauaagagaagugggaucauggaaguagaccgcagugaagccaaagagggguugaaaagaggagaaacaacaaaacaugcaguaucacguggaacagcuaaguugagaugguuuguagagagaaacuuaguaaagccugaaggcaaagugauugaucuaggcugcggucgaggcggauggucauacuacugugcuggucuaaagaaagucacagaaguaaaggguuacacaaaagguggccccggacaugaggaaccgauucccauggcuacguacgguuggaauuuagugaaacuacauuccgguaaagacguguuuuucaugccacccgaaaagugugacacacuacuaugugacaucggagaaaguucaccgaauccuacgauugaagaagguagaacccuaagaguuuuaaaaaugguagaacccugguugagggguaaccaguuuugcaucaaaauacucaauccuuauaugccgucagucgucgaaacgcuagaacaaaugcagagaaaacauggugggauguugguaaggaauccccuuagcaggaauagcacacacgaaauguauuggguuaguuguggcacagggaauauagucucagcugucaauaugaccucaagaauguuacuaaacagguucacuauggcacauagaaaaccuaccuacgagcgugacguagaucuuggagcgggaacuaggcauguugcuguagagccugagguggccaaucuugauauaauaggacaaaggauagagaacaucaaaaaugaacacaaauccacuuggcauuaugacgaagacaaucccuacaaaacuugggcauaccaugguucguaugaagucaaaccaaguggcuccgcgaguucaauggugaauggaguuguacguuuguuaacaaaacccugggacguaauaccaaugguuacgcagauagcgaugaccgauacaacuccauucggccaacagagaguuuucaaagaaaaaguggacacaagaacaccuagagcuaaaagggguacuacccagauaauggaaguuaccgccaaauggcuauggggauuuuuaucucggaacaagaaaccuagaauuuguacacgcgaggaauuuacgaggaaagugaggucaaacgcagcuauuggagcaguguucgucgaugaaaaccaauggaacucugcuaaagaggccguagaagaugaacguuucugggauuugguucauagggaacgcgaguuacacaagcaagguaaaugugcuacaugcguauacaauaugaugggaaaacgugaaaagaagcuaggagaauuugguaaagcaaaaggauccagggcuaucugguauauguggcuuggcgcacgauuucuagaguucgaggcacuaggauuuaugaaugaagaccauugguucagucgcgaaaauucacuaagcggcguugaaggugaaggauuacacaaauugggauauauacuacgcgauauaucgaaaauuccuggagguaauauguaugcggacgacacagcggguugggacacacgaauuaccgaagaugacuuacaaaacgaagcaaaaauaacagacauaauggaaccugagcaugcauuauuagcaacaucuauuuuuaaacuaacuuaucaaaacaaaguaguuagaguccaaagaccagccaaaaaugguacuguaauggaugugaucucgcgaagagaucagagggguagcggacagguuggcacuuacggguuaaauaccuuuaccaacauggagguacaguuaaucagacagauggaaagcgaaggcauauuucugccaucagaauuggagaccccuaaucuagcagaaagggcacuugacugguuggagaaacacggcgccgaaagauugaagaggauggcgauaucuggugacgauugugugguaaagccuauagaugauagguuugcuacugcuuuaacggcacuaaacgauauggguaaaguacgcaaagacauuccccagugggaaccaucgaaagguuggaacgauuggcaacaggucccauuuuguucccaccauuuucaucaauuaauaaugaaggacggcagagaaaucguugucccgugccgaaaucaggaugaguugguuggacgggcuagaguaagccagggagcgggcuggucauugagggagacagcuugccucggaaagucguacgcucaaauguggcaacuuauguacuuucaucgaagggaccugagauuggcugcuaaugcuaucuguucagcagucccuguggacuggguaccagcuagucggacuacuuggucaauacacgcacaccaccaguggaugacaacugaggauauguuaaguguauggaauaggguguggauagaagaaaaucccuggauggaagacaaaacgcauguuucgagcugggaggaaguaccguauuuagggaagcgcgaggaucaaugguguggaucucuaauaggucucacugcgagagcgacaugggcuaccaauauacaaguggcuauaaaccaaguuaggagguuaaucgguaaugaaaacuaccucgauuauaugacaucaaugaagagauucaaaaaugaaagugacccagagggcgcauuaugguaa

SEQ ID NO: 21097 - RNA, 9879 nt, Artificial Sequence
  derived and/or modified CDS sequence (opt6) from DENV-1__JX669467__SS-prME
ucugucacaauguuacuaaugcuauuacccacagcucuagcauuucaucuuacaacacggggaggggaaccacauaugauagucucaaaacaagaaagagguaaaucacuacucuuuaaaacaucugccgguguuaauauguguacccucauagcaauggaucugggggaauuaugugaagacacaaugacuuauaaauguccaaggauuacugaagcagaaccugacgaugucgacuguugguguaaugcuaccgauacguggguuacguacgguacuuguucucagacaggagaacauagacgugacaaaaggaguguggcauuagcaccacacgugggucugggauuggaaaccaggacagagacauggaugucauccgaaggagcuuggaaacagauacagaaaguugaaacuugggcuuuaaggcacccuggauucaccguuauugcauuauuuuuagcacaugcgaucgggacgucaaucacacaaaaaggcauuaucuuuauuuuauuaauguugguuacaccgaguauggcgaugaggugcgucggaauaggaaacagagauuuuguagaagggcuaucaggagcaacaugggucgacguaguucuagaacacggauccugcgugacaacuauggccaaaaauaaaccaacguuagacauugaacuacuaaaaaccgaaguaaccaauccagcaguccuacguaaacuuuguauugaagccaaaauuuccaacacuacuacagauucgagaugucccacacagggugaagcaaccuuaguggaagaacaagacgcaaacuucguauguagaagaacauucgucgaucgggguugggguaacggguguggccuauuuggcaaagguucccuacuaacaugugcuaaauucaaauguguuacgaaauuggaaggcaaaauuguucaauaugaaaacuuaaaauacucgguaaucgucacaguccauacaggcgaucagcaccaaguuggaaaugaaacgaccgaacaugguacaauagcgacgauaacaccacaggcuccuacauccgaaauccaacucacagauuauggcgcauuaaccuuagauugcaguccaaggacgggucuugauuuuaaugaaauggugcuacuuacuaugaaagagaaaaguugguuaguacauaaacaaugguucuuagacuugcccuuaccguggacaucaggagccuccaccagccaggaaaccuggaauaggcaagaccuauuaguaaccuucaaaaccgcccacgccaagaaacaagaagucguggucuuagggagucaagaaggggcgaugcauacagcacuuacuggggccacagaaauacaaacuucuggaacaacaacaauuuuugccggucaccugaaaugccggcucaaaauggacaaauuaacucugaaaggcacuuccuaugucauguguacgggcucuuuuaaauuagaaaaagaaguagcggaaacucaacacggaacaguacucguccagguuaaauacgaaggaacagaugcaccgugcaaaauuccauucagcacacaagacgaaaaagguguuacccaaaauggaagacuaauaacggccaauccaauagucacggacaaggaaaaacccgucaauauugaaacagaaccucccuucggagaaaguuauauuguagugggugcuggcgaaaaagcauuaaaauuguccugguucaaaaagggaaguaguauugguaagauguuugaagccacggcaagaggagcccgaagaauggcaauauugggcgacacagccugggauuucgguagcauuggaggaguguuuaccagcguugguaaauugguccaccaaguauuugguacugcguacgguguccuauuuucaggagucaguuggacaaugaaaauaggaauuggaauccuuuuaacauggcugggacuaaauaguagaaguacuagccuuucgaugacguguaucgcaguuggcaugguaacacuauaccugggaguaaugguacaggcagauaguggguguguuaucaauuggaagggacgugaauuaaaauguggcaguggaauuuuuguuacaaacgaaguacacacauggaccgaacaauauaaauuccaggcugacucaccaaaacggcuuucugcagccauuggcagagcuugggaagaaggagucugcggaauaagaucggcaacgagguuggaaaacauuauguggaagcaaauuagcaaugaacuaaaucacaucuuauuggaaaaugauauaaaauucacaguuguaguuggcaaugcaaacgguauauuagcccaaggaaagaaaaugauaagaccccaaccgauggaacauaaauauuccuggaaaucguggggaaaagccaaaaucaucggcgcagauauacaaaauacaacuuucauaauagacggaccagauacaccagaaugcccugacgaacaaagagcuuggaacaucugggaaguagaagauuauggauucggaauauucacuacuaacauauggcuaaaacugcgggauucguacacucagaugugugaccaucgacugauguccgcagcaauuaaggauuccaaagcuguucacgcggauaugggauacuggauugaauccgaaaagaacgaaacuuggaaauuagcuagagccuccuucauugaaguuaaaacaugcauauggccaaaaagccacacucuauggucaaauggaguucuugaaucagaaaugauuauaccaaaaauguacggcggacccaucucgcagcauaacuaccgccccgguuauuucacacaaacagccgguccauggcaccuugguaaauuggaacuugauuuugaccuuugugagggaacaacagucguuguggacgagcauugcggaucgagagggccuagccuacguacuacuacugugaccgguaagauuauacacgaauggugcugucgaucgugcacacuuccaccgcuacgcuucagaggagaagaugggugcugguacggcauggaaauaagaccaguuaaagaaaaggaagaaaauuuaguucguucuaugguuuccgcgggaucgggcgagguugauaguuuuucacuaggaaucuuaugugugaguaucaugauugaagaaguaaugcgaagucgauggagucgaaaaauguuaaugacugggacauuagcaguauucuuauugcuaauuaugggacagcuuacauggaaugaccuuaucaggcuaugcaucaugguuggagcuaaugcaagcgacaaaaugggaauggggacaacauaccucgcguuaauggcuacauucaaaaugagaccaauguucgccguuggccuuuuguuucgaagguuaacuucuagagaaguacuccuauuaacaauaggauugagucugguagcgucaguugaacuuccaaacucucuagaagaacucggggauggacuagcuaugggcauaaugaugcuuaaacuuuugacagaauuucagccacaucaacuauggacgacuuuauuaucacucaccuucauaaagacaacauuauccuuagauuacgcauggaagacgaccgccacuguacuguccauagugucauuauucccauuguguuuaagcacuacuucacagaagacaaccugguugccgguuuuacuagguaguuucggauguaaaccucuaacaauguucuuaaucacagagaacgaaauauggggcagaaagucauggccucuuaacgaaggaauuauggcaaucgggaucguaucgauuuuauuaucaucauugcugaaaaacgacguacccuuagcaggaccucugauagcuggggguauguuaaucgcguguuacguaauaucaggcuccagcgccgaucuaucauuggagaaagccgcugaagucucaugggaggaagaagccgaacauucugggacuucucacaacauucucguugaaguacaagacgauggaaccaugaaaauuaaagaugaagaacgagaugauacgcucacaauauuauuaaaagcaacccuucuagcuguuaguggagucuauccaaugucuauccccgcaacccuuuuuguuugguauuuuuggcaaaagaagaaacaaaggucaggugugcuuugggacacaccaagucccccagaaguagaaagagccguccuagacgacggaauauaccgaauacuccaaagaggauuauugggaaggagccaaguaggggucggcguauuccaagauggaguuuuucauaccauguggcacguaacgagaggcgcuguauugauguaucaaggaaaacgucuggaaccuagcugggcuagcgucaaaaaggaucugauuucuuacgguggagguuggagauuucaaggaagcuggaauacaggggaagaaguacaaguaauagcuguggaaccagguaagaaccccaaaaaugugcaaaccacaccugguacuuuuaagacacccgaaggugaaguuggugcaauugccuuggacuucaagccuggaacaagugggaguccuauugugaaucgcgagggcaaaauaguaggauuguauggaaaugggguuguaacaacaucuggaacuuaugucagugcuauagcacaggcaaaggccucucaagaaggcccgcuaccugaaauugaagaugaagucuuuaagaaaagaaauuugacaauaauggauuugcauccgggcaguggaaaaacacgacgguauuuaccggcuaucguacgagaagcaauaaaacguaaacuaagaacacucauacuagccccgacacguguaguagcaucagaaauggcagaagcucuaaaaggcaugcccaucagguaucaaaccacggcuguaaaaucugaacauacaggaagagaaauaguagaccuaaugugccaugcaacauuuacaaugcggcuucuuucaccagugagagucccaaauuauaacaugauaauaauggaugaagcccacuuuaccgauccagccaguauugcggcucgcggauauauaucuacuagggucgguaugggggaagcagcagcuaucuucaugaccgcuacaccucccggcaguguagaggcuuuuccucaaagcaacgcgguaauacaggaugaagaacgagauaucccggaacguagcuggaauagcggauaugauuggauuacggauuuucccgguaaaacgguaugguucgucccaucaauuaaaaguggaaaugauauagcgaacugucuuagaaagaacgguaagagaguaauacaacuaucuagaaaaacguuugauacagaguaccagaagaccaaaaauaaugauugggacuacguagugacgacugacaucuccgaaaugggcgccaacuuuagagcugauagaguaauugacccacgaagaugccuaaaaccaguuauucuuaaggauggaccagagcgggucauuuuagcaggcccaaugccggucaccguggcuagugccgcacaacgaaggggucgaauaggaagaaaucagaacaaagagggcgaucaguauguguauaugggucaacccuugaacaacgaugaggaccaugcccacuggacagaagcaaaaaugcuguuagacaacauaaauacacccgaagggauaauacccgcguuauuugagccagaacgagagaaaagugccgcgauagacggggaauacagauuacgaggcgaagcacgaaaaacuuuuguagaacucaugagacgaggagaucuuccaguaugguuaaguuauaaaguagcaucggaaggguuucaauacagcgauagaagguggugcuucgauggagaaagaaauaaccaaguauuggaggagaacauggauguugaaauauggacuaaggaaggagaaagaaagaaacuucgcccaagguggcuugacgccagaacguauuccgauccucuagcccuucgugaguuuaaggaguuugcagcaggacgucguucagugucaggagacuuaauucuagaaauagguaaauuaccgcaacaccuaacgcuacgagcacaaaaugcucuugauaauuuaguuaugcuacauaauucugaacaaggggguaaggcuuacagacaugcuauggaggaguuaccggauaccauagaaacacuuauguuacuugcacuaauagcaguccuaacaggugguguaacguuauuuuuccuaaguggaaaaggacuaggaaaaacuuccauuggcuugcuauguguaacggcaucaucugcauuguuauggauggcauccguugaaccacacuggauugccgccaguaucauauuagaguuuuuccucaugguguuauugaucccagaacccgaccgacaaagaacaccccaagacaaucaacuugcguacguuguaauaggauuacuauuuaugauccuuacgguagcagcaaaugaaaugggucuauuggaaacaacaaagaaagaccuagguaucggacauguugcagcagaaaaccaccaacacgcaacuauguuagauguagaccuucaucccgcgagcgcuuggacuuuauaugcuguugccacaacugucauuacuccgaugaugagacauacgaucgagaauaccacugccaacauaagccugacugcuauagcuaaucaagcagcuaucuugaugggauuagacaagggauggcccaucagcaagauggauuuaggagucccccuguuagcccuugguuguuacagccaggucaacccccuaacauuaacggcagcuguacugaugcucguagcgcauuaugcuaucaucggaccaggauuacaggcaaaagcaacaagagaagcucagaaaagaacagcagcagguauuaugaagaauccuaccguagaugguauuguagcgauugaucuagacccgguagucuaugacgcuaaauucgaaaaacaguugggacaaauaauguuacuuauauugugcacaucccaaaucuuacucaugagaacuacaugggcacucugugagucaauaacacuggcaaccggaccauuaacuacccuuugggaaggcagcccuggaaaauucuggaauaccacaauugcaguaucaauggcgaauauauuccgcgggaguuaucuggcuggagccggacuagccuucucacuuaugaaaagucugggcgggggcagacgggggaccggcgcacaaggugaaacucucggagagaaguggaaacgacaacuaaaucaauuaucgaaaucugaguucaacacuuacaaaagaucugggauaauggaggucgauagaucagaagccaaagaaggucucaaaagaggagagacgacaaaacaugcggucucacgagggacugcuaaacugagaugguucgucgaaaggaaucuaguaaaaccggaggguaaaguaauugauuuggguuguggaagaggaggcuggucauauuacugugcuggucuaaagaaaguaacggagguaaaaggguauaccaaaggaggaccaggccaugaagaaccgauaccuauggcuacauacgguuggaacuugguuaaacuacacaguggaaaggaugucuucuucaugccgccugagaaaugugauacccuuuuaugugauauuggugaaagcucaccaaaucccacgaucgaagaaggucgaacucuuaggguacuuaagaugguugaaccaugguuaagagguaaccaauucuguauaaagauacucaauccauauaugccgucgguugucgaaacacuugagcagaugcaacgaaaacacggaggaaugcucguaagaaacccucuaaguagaaauuccacucacgaaauguauugggugaguugcggcacaggaaauaucgugagugccguaaauaugaccucacggauguuguuaaauagguuuacuauggcacauaggaagccaacuuaugaaagagauguagaucuaggcgccggaacuagacacgucgccgucgagccagagguugcgaaucuagauaucauuggacaaagaauagaaaauauuaaaaaugaacauaagagcacguggcauuaugacgaagacaauccuuauaaaacgugggccuaucacgguaguuacgaaguaaagccuucgggaucagcaucaagcaugguaaacgguguugugagacuauugacaaagccuugggacguuauaccgauggugacgcaaauagcgaugacagauaccacaccauucgggcaacaacgaguuuuuaaagaaaaaguugacacacgcacccccagagcaaagcguggaacggcgcaaauaauggaagucacggccaaauggcuauggggauuccucucacguaauaagaaaccacgaauauguacuagggaggaguucacucggaaaguucgcaguaaugcagcuaucggagcaguauucguggaugagaaucaauggaacucagcaaaagaggccguggaagaugaacgauuuugggauuuaguucaucgugaacgcgaauuacacaaacaaggaaaaugcgcuacuugcguauacaacaugaugggcaaacgugagaagaaauuaggagaauuuggcaaagcaaaggguucucgugcaauaugguacauguggcuaggagcaagauuccuggaauuugaggcuuuggguuuuaugaaugaagaucauugguucaguagagaaaauaguuuaucagggguagagggugagggcuuacacaagcucggguacauacuccgugauauaucuaaaauaccagguggaaacauguaugcggacgauacagcaggcugggacacucggauaaccgaagaugacuugcaaaaugaggcuaaaauaacagacauaauggaaccagaacaugcucuacuggcuacaucaauuuucaagcuaacguaucagaacaaaguaguccgaguacagagaccggccaaaaacggcacaguaauggauguaauuagucgacgggaccaacgcgguucaggacaagucggaacauauggguuaaauacauucacuaauauggaaguccaguuaauaagacaaauggaaagcgaagguaucuucuuuccuagcgaauuagaaucgcccaauuuggcggaacggguuuuagacuggcucgaaaagcauggugccgagcggcucaaaagaauggcaauaucaggugacgacugcguuguuaaaccaauagacgaucgauuugcaacagcucugauagcgcugaaugauaugggaaaaguuagaaaagauauuccacaaugggaaccaucaaaaggauggaaugacuggcaacaaguacccuuuuguagucaucauuuccaucaauuaauaaugaaggacggaagagaaauagucguaccuugcagaaaucaagaugagcuaguaggucgugcuagggucagucaaggugcaggcuggagucuaagagaaacggcguguuuaggaaagucauaugcccaaauguggcaacuuauguauuuccauagaagggauuuacggcuggcagcaaacgcaaucugcagugcuguaccaguugauuggguaccuacaagucgaacgaccuggucuauucacgcgcaccaccaguggaugacgaccgaagauauguuaucugucuggaaucggguauggauugaagaaaaucccuggauggaagauaagacccauguaagcaguugggaagaaguaccuuauuugggaaaacgagaagaucagugguguggcaguuugauuggacugacggcuagggcgacgugggcaacaaacauccaggucgcuauuaaucaaguacgaagacuaauugguaaugaaaauuauuuagauuauaugacaucuaugaaaagauuuaaaaacgaaucagauccagaaggagcucuaugguaa

SEQ ID NO: 21098 - RNA, 9879 nt, Artificial Sequence
  derived and/or modified CDS sequence (opt6) from DENV-1__HM469967__SS-prME
agcgucacaaugcuuuugauguuaaugccuacagcacuugccuuccauuuaacgacacguggaggggaaccgcacaugaucguaaguaaacaagaaaggggaaaaucacucuuauuuaaaacaagcgcggguguaaauaugugcacauuaauagcaauggacuugggcgaacuuugcgaagacacaaugacauacaaauguccucgaaucacugaagcugaaccugaugacguugacuguuggugcaaugccacagauacuuggguaacuuauggaacgugcagucaaacgggcgaacaccgaagagauaaacguuccguagcacuagcaccccaugugggucuaggcuuagaaacgcguacagagaccuggaugucuagugagggcgcauggaaacaaauacaacgaguugaaaccugggcauuaagacauccggguuucacgguaauagcauuauuucuugcucacgcaauaggaacaucaauuacacaaaaaggaauaauauuuauauuauuaauguuaguaacacccagcauggcaaugcgcugcguagguauaggcagcagagauuucguagagggacucaguggggcuacguggguugauguaguauuggaacauggaucuugcgugacgacuauggcuaaagacaaacccacauuagacaucgaacuucugaaaaccgaagucacgaaucccgcgguauuaagaaaauugugcaucgaagccaaaauaaguaauaccacaacggauaguaggugucccacacagggcgaggcaacccugguugaagaacaagacgcgaacuuuguaugucguagaacuuucguagacagaggcugggguaauggaugugguuuauuugggaaaggaucacuuaucacuugcgcaaaauuuaaauguguaacaaaacuggaaggaaaaauaguucaauacgaaaauuuaaaauacaguguuauaguuacagugcauaccggggaucaacaccaaguaggcaaugaaucuaccgaacauggaacuacagcaaccaucacuccacaagcgcccacgacagaaauacagcuaacagauuauggggcucugacauuggauugcucaccacgaacuggacuggacuuuaaugaaaugguccuacuaacaaugaaagagaaauccugguuaguacacaaacagugguuucuagaccuuccucucccauggacaucaggcgcuaguacaagucaggaaacuuggaauagacaggaucuauuaguuacguuuaaaaccgcccacgcuaagaaacaagaggucgugguauuaggaucacaagaaggcgcaaugcauacagcucuuacaggagccacugaaauucaaacaucggggaccacaacuaucuuugcaggacaucuaaaaugccgcuuaaaaauggauaaacuuacguuaaaaggaaugagcuauguuaugugcacaggaaguuucaaacuugagaaagaaguagcggagacucaacauggaacgguacugguccaaauaaaguacgaaggcacggaugcaccauguaaaaucccauucucuacucaggacgagaaggguguaacucaaaacggacgguuaauuacagcuaauccaauagucacugauaaagaaaagccggucaauauagaggcugaaccucccuucggagaaaguuacauaguaauuggugcgggcgaaaaagcgcuaaaacuaucaugguucaagaaaggaucuucgauaggcaagauguuugaagcuacugcucgaggugcaagacguauggccauacuuggagauaccgcuugggacuucggaucgauaggcgguguauuuacaucuguggguaagcuaguacaucaaauuuuugggaccgcguaugggguauuauucagcggcguaucuuggacaaugaaaauaggaaucgggguacuuuuaaccuggcuuggucuaaauagcagaucaaccucccucaguaugacguguauagcaguaggacugguuacgcuauaccuuggugucaugguacaagccgauucuggauguguuauuaacuggaaaggaagggaacuaaaaugugguaguggcaucuucguaacgaacgaaguccacacuuggacagaacaauauaaauuucaggcagauaguccaaaaagauuauccgcggcuaucggaaaggcuugggaggaggggguuugugguauuagaucugcaacacgccucgaaaacauaauguggaaacaaauaaguaaugaguugaaucacauacuauuagaaaaugacaugaaguucacaguaguaguaggugauguagccgggauuuuggcgcaaggcaagaaaaugauacgcccgcaaccuauggaauacaaauauaguuggaaaaguugggguaaagcuaaaauuauaggagccgauguucaaaauacgacauuuauaaucgacggcccuaauacaccggaaugucccgaugaucaacgugcuuggaacaucugggagguagaagacuauggguucggcauauucacuacuaauaucugguuaaaacuaagggauucuuacacgcaaguuugugaucaucguuuaaugucugcagcaauuaaagacucaaaagcgguacacgcugacaugggguacuggauugaaucugaaaagaaugagacauggaaauuggccagggccagcuucaucgagguuaagacauguauauggccaaagagucauacauuguggucaaacggagucuuggaauccgagaugaucauucccaagauauauggaggucccauuucgcaacauaauuacagacccggauacuucacucagaccgcgggacccuggcauuuaggaaaacuugaacuggacuuugaucuaugugagggaacuacaguaguaguagacgagcacugcgggaauagaggaccaucucuuagaacaacaacagucacggguaaaauaauucacgaaugguguugucggagcuguacucuaccaccuuuaagauuccggggcgaagauggauguugguauggaauggaaaucagaccugucaaggaaaaggaagaaaaucuaguuaaaaguaugguaucugcaggaucaggggaagucgauucguuuucucuugguuuguugugcauaaguauaaugauugaagaaguaaugaggaguagauggucucgaaagaugcuaaugacaggcacgcuagccguauucuuucugcuuauaaugggucaauuaaccuggaacgauuuaauuagacuauguauuauggucggggccaacgcuagcgacagaauggggaugggcacuacauauuuagcacugauggcaacguucaagaugcgacccauguucgcggucggacuccuguuccgcagguuaacaucuagagaagugcuccuauuaacuauaggauuaucccuaguugcuucuguugaguuacccaauagucuagaggaacugggagauggucuagcuaugggaauuaugauucuaaaguuacuaacagauuuucagagccaccaacugugggcgacauuacuaucacugacguucauuaaaacuacguuuucacuacacuacgcauggaaaacaauggcaaugguccuaaguauaguaucguuauuuccacuaugcuuaagcacgacuagccagaaaacaacgugguuacccguguugcuaggcucacugggauguaaaccacuaacuauguuuuuaauagcugaaaauaagauaugggguagaaaaucuuggccucucaacgaagguaucauggcgguagguauaguaucaauauuacuuuccagccuucuuaaaaacgacguaccgcuggccggaccauuaauugcuggugguaugcuaauagcaugcuaugugauuuccggaucaucagcugauuuaucacuugagaaggccgcugaaguaaguugggaagaagaagcugaacauucaggagccucgcauaauauucuagucgaaguccaggacgauggcacuaugaaaauaaaagaugaggaaagagaugacacgcuaacgauuuuauuaaaagcgacauuauuagcuguaucaggcguauacccccuuucaauuccagcaacauuauuuguaugguacuuuuggcagaagaagaaacaacgaagugguguauuaugggauacuccuucuccgccuaaaguagaacgcgcaguacucgacgacgguauauaccgaauaaugcaaaggggguuauuaggcaggucccaaguugggguugggguauuccaagaaaacguauuccacacgauguggcauguaacccguggugcagugcugauguaucaagggaaacgguuggaaccauccugggcaagcguuaagaaagaccuaaucaguuaugggggaggguggagacugcaagguucauggaauacgggugaagagguacaggucauugcgguagaaccaggcaaaaauccuaaaaacguucaaacugcgccugggacuuuuaagaccccugaaggagaaauuggagcaaucgcguuagauuuuaaaccaggcacaucaggcucgccaauuguaaaccgugaaggaaagauaguaggccuguacgggaauggggucguaacaacuucaggaacauacguuucagcaauugcucaagcuaaggccucacaagagggccccuugccagaaauagaagaugagguuuucagaaaacggaaccucacaaucauggaucugcaccccggcucaggaaaaacacguagauauuuaccagcuauuguuagagaggcaauuaaaaggaaauuacgaacuuuaaucuuagcuccgacacgaguuguagccucugaaauggcagaagcguuaaaagguaugccaauucgcuaucagacuacagcagucaaaucugagcauacagggaaagaaauaguugauuugaugugccaugcgacuuuuaccaugagacuccuaucaccaguucgcguuccaaauuauaauaugauaauaauggaugaagcacacuuuacugauccuaguuccauagcggcacgugguuauaucucgacaagaguuggaaugggagaggcagcagcuaucuucaugacagccacucccccagguucgguagaggcauucccgcaaucuaaugcaguaauucaagaugaagaaagagauauaccugagagauccuggaacucaggauaugaauggaucaccgacuuccccgguaaaacuguaugguuuguuccuagcauaaaggcuggcaacgauaucgcuaauuguuuaaggaagaauggcaagagagucauucaauuaucaagaaaaacauuugacacggaauaccagaaaaccaaaaacucagacugggauuacgucguuacaacagauauaucggaaaugggcgccaauuuuagagcagauagagugaucgauccaaggagaugucuuaaaccagugauucuaaaagauggaccagaacgaguaauucuagccggacccaugccuguuacuguagccuccgcagcccaaaggagaggccguguaggaagaaaucauaacaaggaaggggaccaauauauuuacaugggccaaccucuuaacaacgacgaagaucacgcacauuggacugaagcuaagaugcuacuugacaacauaaacacaccugaagguauuauaccagcccuauuugaaccagaacgagagaaaucagcugcuauagacggugaauauagacugcgaggugaagcgagaaaaacauuugucgaacucaugagaagaggagaucucccagucugguugaguuauaaggucgcgagcgaagguuuccaauauagugaucggagauggugcuuugacggugaaagaaacaaucaagugcucgaagaaaacauggacguagagauauggacgaaggaaggagaaagaaagaaacuaagaccuagaugguuagaugcacgaacuuacuccgacccgcucgcuuuaagagaauuuaaggaauuugcagccggaagacgaucuguuucgggugaccuuauacuugaaaucgggaaacuaccucagcaccugacccaacgcgcgcaaaacgccuuagacaauuuggucaugcuccauaauucggaacaaggaggucgagcauaccgccacgcaauggaagaacuaccggauacuauagagacuuugaugcuauuggccuuaauugccguacuaacaggaggcguaacccucuuuuucuuaucaggucgaggauuaggcaagaccucaauugggcucuuaugcguaauggcuuccucuguuuuauuauggauggcaucaguagaaccacacuggauagcagcaucgaucaucuuagaguucuuucuaaugguauugcuaauaccagaaccagacaggcaaaggacaccccaggauaaucagcuugccuacguaguaauagggcugcucuuuaugaucuuaacaguugcugcuaaugaaaugggacuccuugaaacgaccaagaaagaccucggaauaggacacguugcaguugaaaaucaccaucaugcugcuauguuagacguagaccuacacccugcauccgccuggacguuguaugcagucgcaacaaccaucauaaccccaaugaugagacacacaauagaaaacacaacggcgaauauauccuugacagccaucgcaaaucaggcugccauuuugaugggauuagauaaaggauggccuauaagcaaaauggauauuggugucccacuuuuagcauuagguugcuauucucaagucaacccacuaacacuaacugcagcuguucugaugcucguagcucauuacgcuauuauugggccugggcuacaagcuaaggcuacacgagaggcccagaaacgaaccgcagcagguauaaugaaaaacccgacgguugaugggaucguagcuaucgauuuagauccaguggucuaugaugcgaaguucgaaaagcaauuaggacaaaucauguuauuaauacuguguacaagucaaauauuacuaaugagaacgacaugggcgcuuugugaauccaucacauuggcaacaggcccacuaacuacacucuggaaaggaucgccugggaaauuuuggaacacaacaauagccguaagcauggccaacauuuuccgagguucuuaccuagcaggagcgggacuggcauuuucacuaaugaaguccuuaggaggaggcaggagaggaaccggggcacaaggggagacacuaggggagaaauggaaacgacaacuuaaucaacuuucaaaaagugaauuuaauacuuauaaacggucugguauaauggaaguagauagaagugaagcuaaagaaggcuuaaagaggggagaaaccacaaaacaugcaguuuccagggguacagccaaacuaaaaugguuuguagaaaggaaucuagugaagccagaaggcaaaguaauugauuuaggaugugguagaggaggauggagcuauuauugugcagguuugaaaaagguuacggaaguaaaaggguauacuaaagggggcccaggacaugaggaaccuauuccaauggcgaccuaugguuggaaucuugugaagcugcauucgggcaaagauguauucuuuauacccccugaaaagugugauacuuuacuuugugauauaggggaaucaucgccaaaccccacaaucgaagaaggccggacgcuucguguucuaaaaaugguagaaccuuggcuaaggaaaaaucaguuuuguauaaagauucucaacccguauaugcccagcguuguagaaacucuagaacaaaugcaacgaaagcauggcggcauguuagucagaaauccacucagccgaaauucaacucacgaaauguacuggguaaguugcggcacagggaauauuguaagcgcugugaauaugacgucaaggaugcuccugaauagguuuacaauggcccauagaaaaccuaccuaugagcgagacguagaccuuggcgcagguacuagacacguagcaguagagccagaaguagccaaucuggacauuauagggcaaaggaucgaaaacauuaaacacgaacacaagaguaccuggcauuacgacgaagacaacccguauaagacuugggcuuaucauggaucuuacgaaguuaaaccaagcggaagugcauccucaauggucaacgguguaguaaaauuauugacgaagccaugggacguaauuccgaugguaacacaaauugcuaugacggauaccacuccauucggacagcaacguguuuuuaaagaaaagguugauacaagaacuccaaaggcaaagaggggcaccgcacaaauaauggaagucacugcaagauggcuauggggguuccugagucgaaauaagaaacccagaauuuguaccagagaggaguucacacggaaggugagaucgaaugcagcgauaggcgcgguguuugucgaugaaaaccaguggaacagugcaaaagaggcagucgaagacgagcguuucugggaccuuguucauagagaaagggaguuacauaaacaaggaaaaugcgcaacuugcguauauaauaugaugggaaaaagggagaagaaacuaggagaguucggaaaagccaaagguagucgagcgauaugguauauguggcugggcgcgcgguuccuagaauuugaagcauuaggcuuuaugaacgaagaucauugguuuuccagggaaaacagucugucgggugucgaaggcgaaggcuuacauaaacugggguacauucuaagggauaucaguaagauuccgggagggaacauguacgcggaugacacugcuggcugggauaccagaaucacagaagacgacuugcaaaacgaagcgaaaauaacugauauaauggaaccagagcacgcccuauuggcuaaaagcauuuuuaaacugaccuaucaaaacaagguuguaagaguccaacguccggccaaaaacgggacggucauggacguaauauccagacgagaucaaagagggagugggcaagucgggacguaugggcuuaacacauucacaaauauggaggcucaacucauacgacaaauggaaucagaggguaucuuuuccccgucugaauuggaaacuccuaaucuagcugaaaggguucuagacugguuagaaaaguacggcguggaacgauugaaacgcauggcuauuucgggagaugauugcgucguaaagccaauagaugauagguuugcaacugcuuugacugcguuaaacgauaugggaaaagugcguaaagacauaccccaaugggaaccaucaaaggguuggaaugauuggcagaagguaccauucuguagucaccauuuccaccaauuaaucaugaaagauggacgcgaaauagucguaccuugccgaaaccaagacgaauuagucggacgagcacgaguaucgcaaggcgcagguuggucgcuaagagagaccgcaugccugggaaaaagcuacgcccaaauguggcagcuuauguauuuccauagaagagauuuaagacuagcugcuaacgccauuugcagugccguuccaguagacuggguuccgacgucgagaacgacguggaguauucacgcucaccaucaauggaugaccacagaggauaugcuuaguguauggaaccgaguuuggauagaggaaaauccauggauggaagauaaaacucauauaucuucuugggaagauguaccuuauuuaggcaagagggaagaccaauggugugguucuuugauuggacuuacagcgagagccacaugggcgacuaauauccaaguagcgauaaaucaggugagacgacugauuggaaaugaaaauuaccucgacuauaugacuucaaugaaacgguuuaaaaaugaaucagaucccgaaggggcucucugguag

SEQ ID NO: 21099 - RNA, 9879 nt, Artificial Sequence
  derived and/or modified CDS sequence (opt6) from DENV-1__JX669468__SS-prME
aguguaacgaugcugcuaaugcuccuccccacugcuuuggcguuucaucuaacuacuagagguggggaaccacauaugauuguaaguaaacaagaacgagguaaaagucuguuguuuaaaacaucagcaggagugaacauguguacccuaauugcuauggaucugggugaacuaugugaggauacgaugacauauaaaugcccaaggauuacugaagcagagccggaugacguugauuguugguguaaugcuacugauacuuggguuacauauggaacauguucucagacgggcgaacaucgaagagacaaacgaaguguagcucuagcuccgcacguagguuuaggauuagaaacacggaccgagacguggaugucuucggaaggugcuuggaaacaaauacaaaaaguggagaccugggccuugagacauccaggauuuacaguuauagcuuuauuucuagcacacgcaaucggcacuucaauaacucagaaagguauaaucuuuauucuauuaauguuaguaacaccgaguauggcuaugagaugcguagguauuggaaaccgagauuucguagaagguuuauccggcgcaaccuggguggacguaguacuagagcacggauccugcguaacuaccauggcuaaaaacaaaccuaccuuggauauugaguuacugaaaacugaaguaacaaauccggcaguauuaagaaaacucuguauagaagcaaaaauuucuaacaccacuacggauagucgauguccaacucaaggagaagcaacacuggucgaggaacaagaugcaaauuuuguauguagaaggacguucgucgaucguggauggggcaacggauguggauuguucggaaaagguuccuugcugaccugugccaaauuuaaaugugugaccaaguuagagggaaagaucguccaguacgagaauuugaaauauucaguuauagucacaguacauacuggugaucagcaccagguaggaaaugaaacuacagagcacggcacuauugcgacuauaacgccgcaggcucccacaagugagauacaauuaacagauuacggugcacuaaccuuagauuguaguccucguacgggucuagacuucaacgaaaugguucuauuaacaaugaaagagaaaagcugguuaguccacaaacaaugguuuuuagaccuaccauuaccauggaccucaggagcgucaacgagccaagagaccuggaauagacaagacuuauuagucacauuuaaaacugcacaugccaaaaagcaagaagucguuguauuaggaagucaagaaggcgccaugcauacggcccugacgggggcuacagaaauccaaacaucuggcacuacaaccaucuuugcuggacaccuaaaauguagacuuaaaauggacaaauuaacauuaaaaggaacgaguuaugugauguguacuggcaguuuuaaacuugaaaaagaaguggcugaaacacaacacgguacaguccuaguacaagugaaauacgaaggaacagaugcgccuugcaaaaucccauuuaguacgcaggacgaaaaaggaguaacacagaauggaagacuuaucacagcuaaucccauagucaccgacaaagaaaaaccggugaacauagagaccgaaccgccauucggagagaguuacauaguaguuggagcuggugaaaaagcacuaaaacuuucuugguuuaagaaaggcagcagcauaggaaaaauguuugaagcaacggcacguggagcgagaagaauggcaauacuaggagauaccgcaugggacuuuggaagcauuggcgguguauuuacaucgguaggaaagcuaguacaucaaguauuuggaacagcguauggugucuuauuuucagguguuagcuggaccaugaagauaggaaucgguauucuauuaaccuggcucggucuaaauucaagaaguacgagccuuaguaugacuugcauagcugucgguaugguuacauuauacuuaggaguaauggugcaagcagauucgggaugcguaaucaauuggaagggaagagaguuaaaaugcgguaacggcauauuuguuaccaaugaaguccauacguggacagaacaauauaaauuucaagcagauucuccaaaaagauugagcgccgcgauagguagagcgugggaagagggaguuugcggaauaagaucagcaaccagacuugagaauauuauguggaaacaaauuagcaaugaauuaaaucauauccuacuagaaaaugacauaaaauucacggucgugguagguaacgcuaauggaauuuuagcccaaggcaagaaaaugauucgaccucaaccgauggaacacaaauauagcuggaaguccuggggaaaagcaaaaauaauaggugcagacauacagaacacuacguucauaauagaugguccagauaccccggaauguccggacgaacaaagggcuuggaacaucugggaaguugaggauuauggguuuggaauuuuuacaaccaacauauggcuaaaacuaagagauucuuauacccaaaugugugaucauagauuaaugucagcagcgauaaaagauaguaaagcaguacacgcggacauggguuauuggauagagucugagaaaaaugagacguggaagcucgcccgagcaaguuuuaucgaaguaaagacaugcaucuggccuaaaucccauacauuauggucuaauggcguucuagaaagugagaugauuauacccaaaauguauggaggcccgauaagucaacauaauuacaggccagguuacuuuacacagacagcgggucccuggcaucuagggaaacucgaauuggauuuugaccuuugugaagguaccacgguaguugucgaugaacacugcggaucuagagggccgucacuucgaacaacuacuguuaccggaaaaaucauucaugaaugguguuguagaagcuguacacuuccuccccuuagguucagaggcgaagauggauguugguauggaauggagauuagaccugucaaagaaaaagaagaaaaccucguuaggagcauggugucagcgggaagcggggaaguagauuccuuuucauuaggaauuuugugugugucgauaaugauugaagagguaaugagaagccguuggagucgaaagauguuaaugaccggaacauuagcuguuuuccuuuuauugauaaugggacagcugacauggaaugaccuuauaagauuauguauuaugguuggagcuaacgcuagcgacaaaauggggaugggcacuacuuaccuugcccugauggcgacuuucaaaaugcgaccuauguucgcaguagggcuguuauuuagaaggcugacaucuagagaaguuuuauuacuuacaauagguuugagucuaguugcauccguagaauuaccgaacucacuugaagaauuaggugauggauuagcaauggguauuaugaugcucaaacuuuuaacagaauuucagccacaccagcuauggacaacgcuacuaucacuuacauuuauuaaaaccacauugaguuuagauuacgcuuggaaaacgacagcuacaguccuaaguauuguaucauuauuucccuuauguuuaucuaccacaucacagaaaacgacaugguuaccuguacuacugggaucauuugguuguaaaccacucacaauguucuuaaucaccgaaaaugagauuugggguagaaaaaguuggccccuaaaugaagguauuauggcgauagggaucguuucuauacuauuaaguucccuacuaaagaacgauguaccccuagccggcccacuuauugcugguggaaugcugauagcuugcuaugugaucaguggcucuagugcggaucuuagccucgagaaagcagccgagguaagcugggaagaagaggccgagcauagugguaccagccacaauauucuaguggaaguucaagacgaugggacuaugaaaauuaaagacgaagagagagaugauaccuugaccauccuuuugaaagcuacuuuacucgcuguaaguggagucuauccuaugucgauaccugccacauuauuugugugguacuucuggcagaaaaagaaacaacgaaguggaguacucugggauacacccaguccacccgaaguggaaagagcaguauuagacgaugguauauaccgaauacuccaaaggggacuauuaggacguucacagguuggaguggggguuuuucaagaugguguauuccacaccauguggcaugugacuagaggagcaguucuuauguaucaaggcaaacgauuagaacccaguugggcaucagucaagaaagaucuuaucucauacgguggggguuggagguuccaagguucauggaacacgggagaagagguucaagucaucgcugucgaacccggaaagaaucccaaaaauguucaaacgacgccaggaacguuuaaaacccccgaaggagaaguaggagcaauugcacuagauuucaaaccggguaccaguggaucgcccaucguaaauagggagggaaaaauagucggauuauacggcaauggagucgucacuacaaguggaacuuaugugucagcaaucgcucaagccaaggccucgcaagaaggaccucuacccgagauagaagaugaaguuuuuaagaaacgaaauuuaacgauaauggauuuacauccagguucgggcaagacgcgaagauacuuaccagcgauugugagagaagccauuaaaagaaagcuacgaacguugauacuagcaccgacacgagucguugcuucggaaauggcggaagcucuuaaaggcaugcccauccgauaccagacuacagcugucaaaucggaacauaccggaagagagauugucgaucugaugugucaugcaacauucacaaugcgccuuuugucaccaguuaggguucccaacuauaauaugauaauaauggaugaagcucacuucacagauccagcuaguaucgcagccaggggcuacauaagcacuagagucgggaugggggaggcagcagcuauuuuuaugacggcaacacccccagguucuguagaggcuuucccacaaucaaaugcaguaauacaggacgaagaaagggauaucccugaaaggaguuggaacucgggcuacgacuggauaacagacuuuccaggaaagacggucugguucguaccuaguauaaaaucagguaacgauaucgcgaauugucuaaggaaaaauggaaaacguguaauacaauuaagucggaaaacauuugacacagaauaccaaaagacuaaaaacaacgacugggacuauguaguuacuacagacauaucagaaaugggggcaaauuuucgugcagaucguguuauugacccuagaagaugucucaaaccggucauauugaaagacggcccggaaagaguuauucuagcuggaccaaugcccgugaccguugcuagcgcagcacaaagaaggggcaggauuggcaggaaucaaaacaaagaaggcgaucaguaugucuauaugggucaaccguuaaauaaugaugaagaccacgcccacuggacugaagcuaagauguuacuagacaauauaaauacgccugaaggaauaauccccgcacuguuugaaccggaacgcgagaaaagugcagcaauagauggcgaguaucguuuaagaggggaagcgagaaaaacguuuguggagcucaugagaagaggugaucucccaguguggcugaguuauaaaguugcuagugaagguuuucaguauagcgacagaagaugguguuucgauggagagcgaaauaaucaaguacuagaagaaaauauggacguagaaauauggacaaaagaaggugaacgaaagaaacuccguccccgaugguuagacgcuaggacguacuccgauccuuuagcucucagggaguucaaagaauuugcagcugggcgaagaagugugaguggcgaucuaauauuggaaauugggaaacucccucaacauuuaacucuacgggcucaaaaugcgcuugauaacuuggugauguuacacaacucugaacaaggaggaaaggccuaucgacaugcuauggaagaauuaccagauaccaucgaaacacuaaugcuucuagcucuuauagccguauuaacaggagggguaacguuauucuuucugagugggaagggcuuaggaaagacaaguauuggucuucuuugugucacagccucuucggccuuauuauggauggcaucgguagagccucacuggauagcugcaucgaucauuuuagaguucuuucuaauggugcuacuuauaccagaaccagauaggcagcgaacaccacaagauaaccagcuugcguacgugguaauuggcuuauuguuuaugauacuuaccguggcagcgaacgaaauggguuuacuagaaacgacgaagaaagacuugggaauaggacauguggcagcagaaaaucaccaacacgcuacaauguuggauguagaucuucauccugcgucggcuuggacauuauacgcuguggccacgacaguaauuacgccgaugaugaggcacacaauugagaauacuacagcgaacauaucucuaacagcaauagcaaaucaagcagcuauacugaugggauuggauaaaggcuggccaauuucaaagauggaucuaggcguuccauuauuggcauuaggguguuacucccagguaaauccuuugacccugacagcggcuguacuaaugcuaguugcccauuaugcgauuaucggaccaggccuucaagccaaagcuacaagggaagcgcagaaaagaacagccgcaggaauaaugaaaaaccccaccguagauggaauagucgccauagaccucgacccugucgucuacgaugcuaaauuugaaaaacaauugggacaaauuaugcuacuuauauuauguaccucucaaauucuauugaugcguacaacuugggcucucugugaaucaauaacuuuagcaacuggucccuuaacgacuuuaugggaggggaguccaggaaaguucuggaauacuacaauugcuguguccauggcuaacauauucagggggaguuacuuggcuggagcugggcuggcuuuuucacuaaugaagaguuuagguggaggaagaagaggaacaggagcucaaggugaaacuuugggagaaaaauggaaaagacaacucaaucaauuaagcaaaagcgaauuuaauacuuauaaaaggaguggaauaauggaaguugacagaagugaagcuaaagaagguuuaaaacgaggagagacgacuaaacacgcagucucuagagguacagcaaaauuacgaugguucgucgaacguaauuuaguaaaaccagaagggaaaguaauagauuuaggguguggacgcggaggcuggucguacuacugugcgggccugaagaaagugacggaaguaaaagguuauaccaaaggggguccuggacacgaagaacccauaccgauggcuacauauggguggaauuuaguaaaauuacauucaggaaaagauguguucuucaugccacccgagaaaugugauacucuacuaugugauauaggcgaaucgaguccgaacccaacuauagaggaagggcgcacacuaaggguacuaaaaaugguugaaccguggcugcgaggaaaucaguuuugcauuaaaauuuugaacccauacaugccuucagucguugaaacacucgaacagaugcaaagaaaacacggaggaaugcuaguaaggaauccacuuucaagaaauucaacgcaugaaauguacuggguaaguugcggaacuggaaacaucgugagcgcagucaacaugaccucucguauguugcuaaacagauuuacuauggcacauagaaaaccuaccuaugaacgcgacgucgauuuaggggccggcacaaggcacgucgccgucgaaccugaaguugcaaacuuagauauuauaggacagagaauugagaauauuaagaaugagcacaaaucuacauggcauuaugaugaagauaacccuuacaagacaugggcauaucauggaucauaugaggucaaacccuccggaagugcgucgucgaugguaaauggagucguaagauuauuaaccaaaccaugggauguaauuccuaugguuacgcaaauagcuaugacggauacuacuccauuuggacagcaacgagucuuuaaagagaaaguugauacuaggacaccaagagcuaagcguggaaccgcgcaaauaauggaaguuacagcaaaauggcucuggggauuccuguccaggaacaagaagccaagaauaugcacucgugaagaauuuacuaggaaggugagaaguaaugcggcgauaggagccguguuuguugacgaaaaucaauggaacuccgcgaaagaagcugucgaagaugaacgauucugggaucuuguacauagggaaagagaauuacauaaacaaggcaaaugugcuacaugcguauauaauaugauggggaaaagagaaaagaaguuaggagaauuugguaaggcgaaggguuccagagcaauaugguauauguggcuuggagcaagauuccuagaauuugaagcucuaggauucaugaacgaagaucacugguucaguagagaaaauucauugucaggaguggaaggugaaggauuacauaagcugggauauaucuuacgagacauuagcaaaauuccaggaggaaauauguaugccgaugacacagcaggcugggacaccagaauaaccgaggaugaucugcaaaacgaagcaaaaauuacagauauaauggaaccggaacaugccuuacuagcaacaucgauauuuaagcuaacauaccaaaauaaggucgugcggguccaacguccggccaaaaaugggacugucauggauguaauaucuagaagagaucaaaggggaucaggucaggugggaacuuaugguuuaaacacauucacuaacauggaaguacaauuaauaagacagauggaguccgaagguaucuucuuuccaagcgaauuagaaaguccaaaucuugcggagagagugcuugauugguuagaaaagcacggugcagaacguuuaaaacgaauggcaauuucaggagacgacugugugguuaaaccgauugacgauagauucgcuacagcuuuaauagcguuaaaugacauggguaaagucaggaaagacaucccacagugggaaccaucgaaaggguggaacgauuggcaacaaguacccuuuuguucacaucacuuccaccaguuaauaaugaaggauggaagagaaauuguuguuccuuguaggaaccaagacgaauuagucgggcgggcaaggguuagccagggggcggguuggagucuaagagaaacagcuugcuuaggcaaaucguaugcucaaauguggcaacuuauguacuuccacagaagagaucuaagacuagcagcaaaugcaauauguucggcaguuccuguagauugggugccaacaucacguacaacuugguccauccaugcacaucaucaauggaugaccacugaagauauguugagugucuggaaucgagucuggauagaagagaauccuuggauggaggauaagacucacguauccucuugggaagaagugccauauuuaggaaaacgggaagaucaguggugcgguagcuugaucggauuaacagcucgcgcaacuugggcaacuaacauucagguggcgauaaaucaaguaagacgcuuaauagguaaugaaaacuacuuagacuauaugacuuccaugaaaagguuuaaaaacgaguccgaccccgaaggagccuuaugguaa

SEQ ID NO: 21100 - RNA, 9879 nt, Artificial Sequence
  derived and/or modified CDS sequence (opt6) from DENV-1__JX669469__SS-prME
agcguuacaaugcuuuuaauguuauuacccaccgcauuggcauuucaucuaacaacucgcgguggugaaccacauaugauuguauccaaacaagaaagagguaaaucacuuuuauuuaaaacaagcgcuggugugaauauguguaccuuaauagcaauggacuugggcgaacuuugugaagauaccaugacuuacaaauguccacguauuacagaagcugaaccagaugacguagacuguugguguaaugccacugauaccugggugacauaugguacguguagccaaacuggggaacacaggcgcgauaaacguagcgucgcacuagcaccgcacgugggacugggacuggaaacgagaacggaaacauggaugucuagcgaaggagcauggaaacaaauucaaaaaguggaaacaugggcacuccgacauccaggauuuacuguaauagcacucuuucuagcacacgcgauaggcacuucuauaacacaaaaaggaauaauauuuauucuguuaaugcuuguaacaccaaguauggccaugagguguguugguauugguaaccgagacuuuguggaaggccucuccggagcuaccuggguggauguaguuuuagagcauggauccugugucacuacaauggccaaaaauaaaccgacccuagauauagaauuguuaaaaacugagguuacaaauccggcaguucugagaaaacuauguauaaaagcuaaaauuucuaacacaaccacagauucccguuguccgacccaaggagaagcgacgcuuguugaggaacaagaugcaaacuuuguaugucgacggacuuuuguugaccgaggguggggaaacgguuguggcuuguucgguaaaggaagucuucugacaugugcuaaauuuaaaugugucacaaaacuugaaggcaaaauuguacaauaugaaaaucugaaauacuccguaauugugacagugcauacuggggaucagcaucagguuggaaaugaaacuaccgagcacgguacuauagccacaauaacuccucaagcgccuacuuccgaaauucaauuaacagauuacggugcccucacauuagacuguaguccucgcacuggauuagauuuuaacgaaaugguauugcuaaccaugaaagaaaaaucuuggcuaguacauaaacaaugguuccucgaccucccguuaccguggacaucaggagcgucgacaagucaagagacauggaaccgccaagauuuauugguaacguuuaaaaccgcucacgcuaagaaacaagagguaguaguguuagguucucaagaaggagcaaugcauacagcauuaacaggggcuacugaaauucagacauccgguacaacuacaauauuugcgggucacuugaaaugucguuuaaagauggauaaacuaacguuaaaagggaccagcuauguaauguguacuggaucuuucaagcuggaaaaggagguagcggagacucaacauggaacaguucuggugcaaguuaaauaugaggguacggacgcaccuuguaaaauccccuucucaacgcaagacgaaaaaggaguaacucaaaacggacgauuaaucacggcaaauccaauagucacagacaaagaaaaaccugugaauauagaaaccgaaccuccauucggagagaguuauauagucgucggggccggugaaaaagcauugaaauugagcugguucaagaaagguaguucaauuggcaagauguuugaagccaccgccaggggagcaaggcguauggcaauccucggcgauacggcaugggauuucggcaguauaggcgggguuuuuaccucaguagggaaauugguucaucaaguuuucggaacagccuacgguguuuuauuuaguggagucucguggacuaugaagauaggaauaggaauuuuguugacgugguugggacuaaauucacgaucgacuagcuuauccaugacauguaucgcugucgggauggucacacuuuauuuaggagucaugguacaagcggacuccggcugcgucauaaacuggaaagggagagagcucaaaugugggaguggaauauuuguaacuaacgaaguacacacauggacggaacaauauaaguuccaagcugauucucccaaaagacuuagugccgccauagguagagcaugggaagaaggaguaugcggaauacguagugcaaccagauuggagaauauuauguggaaacaaauaagcaacgaacuuaaucacauccuacuggaaaaugacauuaaguucacugucgucgugggcaaugccaaugguauacucgcacaggggaagaaaaugauaagaccacaaccuauggagcauaaauacaguuggaaauccugggguaaggcaaagauuauaggagcggacauucagaauacgaccuucauuauugaugguccugacacaccagaaugcccugacgaacaacgagcauggaauauaugggagguggaagacuauggauucgguauauucacuacuaauauauggcuuaaacugagagauucauauacacaaaugugugaucacagguuaaugagugcagcgaucaaagacucaaaggcaguacaugcagacauggguuauuggauagaaucugagaaaaaugagacuuggaagcuagcacgcgcaucauuuaucgagguaaaaacauguauuuggccgaagucacauacucuuugguccaacgguguacuagagucugaaaugauaaucccgaaaauguacggagggccuauaucucaacacaauuauagacccggguacuuuacacaaacugcaggaccguggcaucuaggaaagcuagaacuagauuuugaccuaugugaaggaacuacaguuguuguugacgaacauuguggcucaagaggaccuucacuccgaacaacaacuguaacagggaagaucauccaugaaugguguugccgaucuugcaccuugccuccacuacguuuucggggagaagauggauguugguaugguauggaaauacggccaguaaaggaaaaagaagagaaucuugugaggucuaugguauccgcaggaucaggggaaguugacucuuuuaguuuagguauuuuguguguaucaauaaugauagaggaaguaaugaggagucgcuggagcagaaaaauguugaugacugggacacuagcaguguuucuacugcucauuauggcacaacuaaccuggaaugauuugauacgacuaugcaucaugguaggugcaaaugccucugacaaaaugggaauggguacuacuuacuuagccuuaauggccacauucaaaaugcguccuauguuugcaguagggcucuuguucagacgccugaccucacgugagguccuacuguuaacaaucggucuuagucucguugcaucgguugagcucccaaauagccuagaggaauugggggauggacuugcgaugggcauaaugauguuaaaauuguuaaccgaguuucaaccucaucaacucuggacaacuuugcuaagccuaacguucauuaaaacuacguuaagccuggacuaugcauggaaaacaacugcuaugguucuaagcauugucucccuauuuccauuaugucugaguacaacuucucaaaagacaacaugguuacccguacuccucgguucauucgguuguaagccccuuacuauguuuuuaaucaccgagaacgagauauggggucguaagaguuggccuuuaaaugaagguauaauggcgauugggaucguaaguauauuacugaguaguuuacuuaaaaaugauguaccuuuagcggggccucuaauugcuggaggaaugcucauagccuguuauguaauuaguggaaguuccgcagauuuaucacuugagaaagcagcagaaguaaguugggaagaagaagcagaacauucaggaacaagucacaauauacucguugaggugcaggacgaugggacaaugaaaauuaaagaugaagaaagagacgacaccuuaaccauauuguuaaaagcaacucuccuugcuguaagcggaguuuaccccaugucgauaccugcaacauuauuugucugguacuuuuggcagaagaagaaacaaagaucagggguacugugggacacaccaucaccgccugaggucgaacgagccguucuagacgauggaauauaucguauacugcagcgaggauugcuuggcagaucucaaguagguguaggcguuuuucaagaugggguuuuucauacaauguggcacguuacuagaggugcaguccucauguaucaaggaaagaggcuagagccaucgugggcaucugugaagaaagaucuaauaucuuauggggguggauggcgauuucaagguucauggaacacuggggaagaaguacagguuaucgcaguagaaccugggaagaauccaaagaauguucaaacgacuccuggaacauuuaaaacucccgaaggagaagugggcgccauugcucuggauuucaagccagguaccucuggaaguccaauugugaacagagagggcaagauagugggauuauauggaaauggcguagucacaacaagugggacuuacgucuccgcgauagcgcaggcuaaagccucccaagaagggccacuuccggaaauagaagaugaggucuuuaagaaacgaaaccugacgauaauggaccuacauccaggaagcggcaaaacccgaagauaccuaccagcgaucguaagggaggcaaucaaacgaaaacucagaacacuuauacuugcaccuacgcgaguuguagcauccgaaauggcagaggcuuuaaaaggaaugccaauuagguaucaaacgacugcagucaaaucugaacauacaggcagggaaauuguagaucucaugugucacgcgacauuuaccaugcgacuacuuagcccaguuagaguacccaauuacaauaugauaauaauggaugaggcucauuucacagacccggcaucaauugcugcacgggguuauauaaguacacgggucggcaugggggaagcggcagcaauuuucaugacugcuacacccccagggagugucgaagccuuuccccaaucgaaugcaguuauucaggaugaagaacgcgauauaccagaaagauccuggaacucaggcuacgauuggaucacugacuuuccugguaaaacagucugguuuguaccaucgauaaagucaggcaaugauauagcaaauugccuccgcaagaauggaaaacgagugauucaacuuucuaggaaaacguucgauacagaauaccagaaaaccaaaaacaaugacugggauuaugucguuacuacagauauuucagagaugggagcgaacuucagagcagacagagugauagaucccagaagauguuuaaaaccaguuauacuaaaagauggaccggaaaggguaauuuuagcaggcccaaugccaguuaccguagccucagcggcacaaagaagaggcagaauaggccguaaccaaaauaaagaaggcgaccaguauguauauaugggucaaccucuaaacaacgaugaagaccacgcgcauuggacagaagccaaaauguuauuagacaauauaaauacgccagaaggaauuauaccagcguuguucgaaccagagcgcgaaaagagugcagcaauagauggagaguaucgucugcguggugaggccagaaaaacuuuuguugaauuaaugcgccggggcgauuuaccaguauggcuaagcuauaaaguagccucagagggauuucaauauagugacagaagauggugcuuugacggagaaagaaacaaucaaguucuagaggaaaauauggauguagaaauauggacaaaagagggagaaagaaagaaacugagaccaagaugguuagaugcgcgaacauauucagacccgcucgcucuacgagaauuuaaagaauuugcggcagggagaagaaguguaagcggcgaucuaauacuagaaauaggcaaacucccccaacaccucacauuacgcgcacagaacgcgcuagacaacuuaguaauguugcacaacagcgagcaagggggcaaagccuauagacaugcaauggaagaacugccagacacaauugagacccugaugcucuuagcgcuaauagcgguccuuacaggcgguguuacauuauucuuuuuaucuggaaaaggacuagguaaaacuucuauaggccuccuaugcguuacggcuucuagugcguuauuauggauggccucggucgagccucacuggauagcggcaucaauaauauuagaguucuuucuuaugguauuacuuaucccugaaccggacagacaacgaacaccccaagauaaccaauuggcauacgucguaauuggacuuuuauucaugauuuuaacaguugcagcuaacgaaaugggguuacucgagacgacuaagaaagauuuaggcauaggacauguagcggcugagaaucaccagcaugccacaauucuagaugucgaucugcacccggcgucagccuggacuuuauacgcaguagcgacaaccgugauuacgccaaugaugagacacacaauugaaaauacgaccgcuaacauuucauuaacagccauagcaaaucaagccgcuauucuaaugggccuugauaagggauggccaaucuccaaaauggauuuaggugugccacuacuugcucucgguugcuacagccaagugaauccauuaacauugacagccgcuguccucaugcuaguagcccauuacgcgauuauaggaccgggacuacaggcgaaagcuacaagagaagcacagaaaagaacggcugcagggauaaugaaaaaucccacuguagauggaauuguagcaaucgaucuagaccccguaguuuaugacgcuaaauuugagaagcaauuaggacaaauaaugcuucuuauacuuugcacgucacaaauauuacuuaugagaaccacuugggcccuaugugaaaguauaacccuagccaccggacccuuaaccacacuaugggagggcagcccagguaaguucuggaauacaacuaucgcgguaaguauggcaaauauauucagaggaaguuauuuagcuggugcggguuuggcauuuagcuugaugaaaucacuuggcggugguagaagaggcacaggagcacaaggagagacccugggggaaaaguggaagaggcaacuaaaucaacugucaaaaucugaguuuaacacguauaaacggucagggauaauggaaguagaucgauccgaagcgaaagagggguugaaaagaggcgaaacaacuaaacacgccgucagccgugguacugcaaaauugagaugguuuguagagaggaauuuaguaaaaccagaaggcaaagugauagaccuugguugcggacggggagguuggucauacuauugugcuggccuaaagaaagucacagaagugaagggauacacaaaaggagggccuggacaugaggaacccauaccuauggccacauauggcuggaaccuggugaaauuacacuccggaaaagacguauucuucaugccucccgaaaaaugugauacuuuacuaugugacauuggcgaaagcagcccaaauccuacaauugaagaaggacguacauugcgcgugcucaaaaugguagaaccauggcugcgaggaaaccaauuuuguauuaaaauacucaauccauacaugccaucgguaguagaaacccuagaacaaaugcagagaaaacacggcggcauguugguacggaaucccuugagcagaaauucaacacaugaaauguacuggguuaguuguggaaccggaaauaucgucuccgcugucaauaugaccagucgaaugcuauuaaacagauuuaccauggcccacagaaaaccgacauaugagcgagauguagaucuaggugccggaacacggcauguagccguugaaccagaaguagcuaaucuagauauuauaggccaaagaaucgaaaauaucaaaaaugagcacaaaucaaccuggcauuacgaugaagauaacccuuauaagacuugggcauaucaugguaguuacgaagugaaaccaucagguagugcaucguccaugguaaauggaguaguucgucuucuuacaaaaccuugggaugugauuccaauggugacgcagauagcaaugacagacaccacuccauucggccagcaaagaguguuuaaggagaaagucgacacaagaaccccaagggccaaaagaggaacggcucaaauaauggaagucacugcgaaguggcucugggguuucuuaaguagaaauaagaaaccucguauuuguacucgcgaagaguucacccggaaaguacggucuaacgcagcgaucggagcaguguucguugaugaaaaccaauggaacucagccaaagaagcaguugaagaugaacgauuuugggaucuaguacaccgggaaagagaguugcauaaacaaggaaaaugugcaacuuguguauacaacaugauggggaagagagagaagaaacuaggugaguucgguaaagccaaaggaucacgugcaauuugguacaugugguuaggagcacgauuuuuagaauuugaagcccuagguuucaugaacgaagaccauugguuuucaagagaaaauaguuuaagcggcguagagggagaaggacuacacaaacuaggauauauucuaagagauauaucgaaaauaccaggugggaauauguaugcagaugacacagccgguugggauacgaggauuacugaagaugaucugcaaaaugaagcgaaaauuacagauauaauggaaccugagcaugcauuauuagcuaccucaaucuucaaacugacauaucagaauaaaguaguucgaguacaaagaccagccaaaaaugguacagucauggacguuauuucucgaagagaccaacguggaucuggacaagugggaacauauggucucaacacguucacuaauauggagguucaauuaauaaggcaaauggagagcgaagguaucuuuuucccgucggaacuagagucacccaaucuggccgagaggguguuagacuggcucgagaaacauggggccgaaaggcuaaagcguauggcgaucuccggagaugacuguguaguuaaaccgauagaugaccgauuugcgacagcauugauugcauugaaugacaugggcaaagugcgcaaggauauaccgcaaugggagccaaguaaagguuggaaugauuggcagcaaguuccguucugcucacaucauuuucaccaacuaauaaugaaagacggaagggaaauuguggucccuugucguaaucaagacgagcuugugggcagggcuagaguuucacaaggagcugguuggucuuuaagagaaacugcauguuuaggaaaaaguuaugcgcaaauguggcaauuaauguacuuccacagaagagaucuuagauuagcugcuaacgcuauuuguagugccgugccaguagacugggugcccacaucaaggacaacaugguccauucaugcccaucaccaguggaugaccacagaggauauguuaucaguauggaacagagucuggauugaagaaaauccauggauggaagauaaaacacacguuagcagcugggaggaaguucccuacuuaggaaagcgagaggaucaauggugcggaagccuuauaggauugacagcaagggcuaccugggcaacuaauauccagguugcaauaaaucaaguacgucgucuuauaggaaaugaaaacuaccuggacuauaugacuucaaugaaaagauucaaaaacgaaucugacccagaaggagcauugugguaa

SEQ ID NO: 21101 - RNA, 9879 nt, Artificial Sequence
  derived and/or modified CDS sequence (opt6) from DENV-1__JX669470__SS-prME
ucugucacaauguugcucauguuacucccaacggcacuugcauuucaucugacaacccgcggaggugaaccucauaugauuguaaguaaacaagaaagagguaaaagccuuuuauucaaaacaucagcuggggucaacaugugcacauuaauagcgauggacuuaggugaauugugugaagauacuaugacauauaaaugcccgcgcauuacagaggcugagccugaugacguagacuguugguguaaugccacagauacauggguaacuuaugggacauguagucaaacaggugagcauagacgggacaaaagauccgucgcgcuagcaccacaugucggacuugguuuggaaacaagaacggaaaccuggaugucuagugagggagcauggaaacaaauucagaaaguagagaccugggcccuacgucauccugguuuuacaguaaucgcucuuuuccuugcucaugccauagggacuucaauaacccaaaaaggaaucauuuucauacuauuaauguuaguuacacccucuauggcgaugaggugcguagguauagguaaucgggauuucguagaaggccucucaggggcgacauggguagauguugugcuagagcauggcucuugcgugacuacaauggccaaaaauaaaccuacacuagacauugaacuacuuaaaacggaaguuacuaaucccgcagugcuucggaaacuaugcauugaagcuaaaauaagcaauacaacaacggacaguagaugcccaacucaaggagaggcgacgcuaguagaagaacaagaugccaacuuuguuugucguagaacauuuguagaccgagggugggguaacggcuguggguuauuuggaaaagggagcuuauuaacuugugcuaaauucaaauguguaacaaaauuagaagggaaaauaguccaguaugagaauuuaaaauacagcguaauaguaacugugcauacuggagaucaacaucaaguaggaaaugaaacaacugagcacggaacuauagccacaauaacuccucaggcaccaacuucagaaauacaauuaaccgauuauggugcccuaacauuagacugcucaccucguacaggucuugauuuuaaugaaaugguacuauuaacaaugaaagagaaaaguugguuaguccauaaacaaugguuucuagaucuuccuuuaccauggacuucaggugccuccaccucgcaagaaacuuggaacagacaagaucuauuaguaacauuuaaaacagcacacgcaaagaaacaagaaguaguuguuuuagggucucaagaaggggcaaugcacacagcgcuuacaggggcaacugagauacagacaagcggaacuacuacaauauucgcaggucaucugaaaugucgacucaaaauggauaaacugacguuaaaggguauguccuacguuaugugcacuggaaguuucaaacuagagaaagaaguagcugaaacacaacauggaacaguguuaguacagguaaaauaugagggaacugacgcuccguguaagauaccauuuucuacacaagaugagaaaggcguaacacaaaacggucggcuuauaacagcuaauccuauaguuacagauaaagaaaaaccaguaaauauagaaacagaaccuccguuuggcgaaagcuacauaguuguaggcgcuggagaaaaagccuuaaaacuuaguugguucaagaaaggcucaucaauagggaaaauguuugaggcaacagcaagaggcgcuagaagaauggcaauacuaggugauacagcuugggauuuuggcaguauagguggcguuuuuacaucuguuggcaagcucguucaucaaguguucggaacugcuuacggaguuuuauucagugggguaucguggacuaugaagauaggaauuggaauauugcuuacuuggcuagggcuuaacucucgauccacaucacuuuccaugaccuguauuguggugggcaugguaacccuauaucuagguguuaugguacaagcugacucaggaugcgucauaaauuggaaaggucgagaauuaaaauguggaucaggaauauuugucacuaaugagguacacacuuggacugaacaauacaaauuucaagcugauaguccaaagcgucucuccgcugcuauuggacgggcaugggaagaagguguauguggcauacgaucagcgacccgucuggaaaauauuauguggaaacagauaaguaaugaauugaaccauauuuuauuagaaaaugacauaaaauuuacgguaguaguagggaacgcaaacggcauuuuagcucaaggcaaaaagaugauacgcccucaaccuauggaacauaaauauucauggaaauccugggguaaagcaaaaauaauaggggcagacauucagaauacgacauuuauaaucgauggaccugauacucccgaauguccagacgaacaacgcgcauggaauauaugggaaguugaagacuauggcuucgguaucuucaccacgaacauaugguugaaauuacgcgauucauauacacaaaugugcgaucacaggcuuaugucagccgcaauaaaagacucgaaagcuguucaugccgauaugggauauuggauagaaucagaaaagaaugagacauggaaacuagcacgagcuucuuucauagaaguaaaaaccugcauauggcccaaaucacacacucucuggucaaacggcgucuuagaaucagaaaugauaauaccgaaaauguauggcggucccauaucucagcacaauuacagaccaggauauuuuacacagacagcuggaccguggcaucuagguaaacuugaauuagacuuugauuuaugugaagggaccaccguaguaguagacgaacacugugggagccgaggcccgucucuuagaaccacgacaguaacaggaaaaauaauucacgaaugguguuguagauccuguacuuugccgccacuaagauuucgcggugaggacgguuguugguacggcauggaaauuagacccgugaaagaaaaggaagagaauuuagucagauccaugguaagugcuggaagcggagaagucgacuccuucucguuaggcauccuaugcguuucaauaaugaucgaagaaguaaugagaucccgauggagucgaaaaauguugaugacaggaacuuuagcuguauuccuucuucuuauuauggggcaguuaacuuggaacgaccuaauaagacucugcauuauggucggcgcuaaugcaagcgauaaaaugggaauggggacaacuuacuuagcacuaauggcgacuuuuaaaaugagaccuauguucgcuguaggacugcuauucagacgccuuacaagccgagaggugcuccucuuaacaauuggacucucgcugguagcuagcguagaauuaccaaacuccuuggaggagcucggagaugguuuagccauggguauaaugauguugaaauuguuaaccgaauuucagccucaccaacuguggacuacauuguuaucccuaacuuucaucaagacuacauuaucuuuagauuacgcauggaagacuacagcaaugguucugucgauaguuucacuauuuccgcuaugucuuagcacuaccagccagaaaacaacuuggcuaccuguguugcuaggaucauuugguuguaaaccuuugacaauguuccuuauaacagaaaacgaaauauggggcaggaaaaguuggcccuugaaugaggguaucauggcuguaggaauuguuucuauacuccuuucaucacuacuuaaaaacgauguaccauuagcaggucccuuaauagccggagguauguugauugcuuguuauguaauaagugguuccagcgcugaucucagucuggagaaagccgcggaaguaaguugggaagaagaggcagaacacaguggaacaagucauaauauacugguugaagugcaggaugauggcacaaugaagauuaaagacgaggaaagagacgacacucuaacaauauugcuuaaagcuacccugcuagcagugucuggaguauaccccaugaguauaccugccacuuuauucgucugguaucucuggcagaaaaagaaacagcgaagugguguccuuugggauacuccuucaccaccagaaguagaaagggccguauuagaugaugguauauaccgcauauuacaacggggguuguuagggcgaagccaaguuggugucggugucuuccaagaugguguguuucauacaauguggcaugucacuagaggggccguucuaauguaucagggaaaacggcucgagccaagcugggccuccgugaagaaagauuuaauaucuuacggaggugguuggagauuucagggaucauggaauacaggugaggaaguacagguaauagccguugaaccaggcaaaaacccgaaaaacguucaaacuacgccugguacuuuuaagaccccagagggugaagucggggcaauagcacuugauuuuaaaccuggaacaucuggaucuccuauuguuaauagagaggggaagauuguaggucuuuacggaaauggugucguuacaacuucagguacauaugugucugcaauagcacaggcaaaagcgagucaagaagggccgcuaccggaaaucgaagacgaaguuuucaagaaacgaaauuuaaccauuauggaucuacauccuggaucagguaagacucgucgauacuugcccgcuauuguaagagaagcaauuaagaggaaacugcggacacucaucuuagcaccaacgagaguuguugcuagugaaauggcggaagcacugaaagggaugccuauucgauaucaaacgacggcagucaaaagugaacauacaggaagggaaauaguugacuuaaugugucaugcgaccuuuaccaugcgacuguuaaguccagugagaguaccaaauuacaacaugauuaucauggaugaagcacauuuuacugaucccgccaguauagcugcgcguggcuacauuucgacucgaguagguaugggugaagcggcagcaauuuucaugacagcaacuccgccaggaaguguagaggcauucccacaauccaacgccgugauccaagaugaagaacgagacauccccgaaagaucguggaacucagguuaugauuggauuacggacuucccggggaaaacaguuugguucguaccuucaauaaaaucugguaaugauauagcaaauugucuaagaaagaauggaaaaagggucauacaacuuaguagaaagacguucgacaccgaauaccaaaagacaaagaauaaugacugggacuaugucguaacaacagauauaagcgagaugggugcgaacuuccgagcugauagaguuaucgauccccgacggugcuugaaaccuguaauacuaaaagauggcccugaaagaguuauauuggcaggacccaugccuguaacuguugcuucagccgcucaacggcguggucggauaggaaggaaucagaauaaagaaggagaucaauacguauauaugggccagccucuuaauaacgacgaagaucaugcgcauuggacugaagcgaagaugcugcucgacaacaucaacacaccggaaggcauaauaccugcauuauucgaaccagaaagagagaaaucugcagccauagacggugaauauaggcuuagaggagaagcuaggaaaacauuuguagaguugaugagacgcggagaucucccagucuggcuaagcuacaaggucgcgucagaaggguuucaauauagugacagacguuggugcuuugacggcgaacggaauaaucaggugcucgaagagaauauggacguugagauuuggacuaaggaaggagaaaggaagaaacuaaggccaagaugguuggaugccagaaccuauagugacccucuugcacuaagagaauuuaaagaauuugcggcaggaaggagaucugucuccggagauuugauauuagaaauuggaaagcugccacaacauuuaacguuaagggcccaaaacgcauuagacaaccugguaauguuacacaauagugagcaaggugguaaagcguaccgucaugcgauggaagaacugcccgauacuauagaaacguuaauguugcucgcccugauagcaguuuugacuggugggguuacuuuauucuuucuaucaggaaaaggacuugggaaaacguccauugguuuacuguguguaaccgccaguagcgcacuauuauggauggcaucuguagaaccgcacuggauugcagccagcauaauacuagaguucuuuuugaugguauugcugaucccagaaccagacagacaaagaacaccccaagauaaccaacuugcauauguaguaauaggguuguuauucaugauccucaccguagcugcaaaugaaauggggcuucuugaaacuacuaagaaagauuuaggaaucggacacguagcugcagaaaaucaucagcaugcaacaauguuggauguagacuugcauccagcaucggcauggacgcuauacgcuguggcgaccacagugauaacaccgaugaugagacacaccauugagaacacaacagcuaauauuucacuaaccgcuauagcuaaccaagcagcuauauuaauggggcuagacaagggcuggccgauaucaaagauggaucugggagucccguuauuggcauugggauguuauucacaaguaaacccacuaacccucacagcagcaguuuugaugcuugucgcacauuaugccauaauagguccagggcuacaggcaaaggcaacacgagaagcccagaaaagaacggcggcaggaaucaugaaaaaucccacgguagauggaauaguugcuauagaucuagacccaguaguauaugacgcgaaauucgagaaacaacucggacagauaauguuacugauucuuugcacuagccaaauccuacuaaugagaacaacaugggcgcuaugcgaaaguauaacacuagcuacgggaccacuuacgacacuuugggagggaucuccugggaaguucuggaauacuacuaucgccguuucaauggcgaauaucuuccgaggaucuuaucuggccggagcuggcuuggcauuuucauuaaugaagucauugggaggcgguaggcgcggaacaggcgcccagggcgagacguuaggugagaaguggaagcggcagcuaaaccagcuaaguaaaucagaguuuaauacuuacaaaaggagcggaaucauggaaguagaccggagugaggccaaagagggacuaaagcguggagaaacaaccaagcaugcaguuagccguggcaccgcaaaacugaggugguucguugaaagaaacuuaguaaaaccugaaggcaaaguaauugaucugggaugcggcaggggaggguggagcuauuauugugcagggcuaaagaaagugacggaaguaaaaggguacaccaaagguggaccagggcacgaggaaccuauaccuauggcgacauauggauggaacuuaguaaaacuacauuccgggaaggauguauucuuuaugccacccgaaaaaugcgauacacucuuaugcgacauuggagaaaguucaccuaauccaacaauagaagaaggacguacauugagaguucucaaaaugguagaaccuuggcugagaggcaaucaauucuguauaaaaauacuaaacccauauaugccgagcguugucgaaacacucgaacaaaugcaaagaaagcauggcggcaugcuagucaggaauccuuuaucgcggaacagcacgcacgaaauguacugggucucaugcggaacggguaauauaguaucugcuguaaauaugacaucacgaaugcuauuaaauagguuuacaauggcgcaucguaaacccacuuacgaaagagacguagauuuaggggcagggacccgucauguagcugucgaaccagaaguagcuaauuuggauauuaucggacaaagaaucgagaauaucaaaaacgaacauaagucuacauggcauuaugacgaagauaaccccuauaaaacuugggccuaucauggcaguuaugaggugaaaccuucgggauccgcgagcaguaugguuaauggagucguuagacuucuaacuaaaccaugggauguaauaccuaugguaacucaaauagcaaugacagauacaacaccauuuggacagcaaagggucuuuaaggaaaagguggauacgagaacgccaagggcuaagcgagguacugcacaaauaauggaaguuacugcaaaguggcucuggggcuuucucucgcgcaacaagaaaccacgcauuuguacaagggaagaauuuacaaggaagguucgaucaaacgcagccauaggcgcuguauucgucgacgaaaaucaauggaacucagccaaagaagcugucgaggaugaaagguuuugggauuuaguucauagggaaagagaacuacauaagcagggaaaaugugcuacguguguguacaacaugaugggcaagcgagagaagaaauuaggagaauuuggaaaagccaaaggcagcagagcaauuugguacauguggcuuggagcaagguuucuagaauuugaggcucuggguuuuaugaacgaagaccauugguuuucuagagaaaacagcuuauccgggguagaaggugaaggacuacauaaacuugguuacauucuacgcgacauaucuaaaauucccgggggaaacauguacgccgacgacacggcgggcugggacacccgaauaacagaggaugaucuccguaaugaggcaaagauuacggauauaauggaaccugaacaugcauugcuagcgaccaguauauuuaaauuaacauaccagaacaaaguuguuagaguucaacgaccagcuaaaaauggaacaguaauggaugugauaucccgcagagaucaaagggguaguggccaaguaggaacuuauggacugaauaccuuuacuaacauggagguacaauuaauacggcaaauggaaagugagggcauauucuuuccaucugagcucgaaucuccaaaccuagcagaaagaguacuagauuggcuugaaaaacacggcgcugaacgacuuaaaagaauggcaaucuccggugacgacugcguuguuaaaccaauagaugauagguuugcaaccgcccuaauugcacucaacgacaugggaaaagugcgaaaagauaucccucagugggagccaagcaaggguuggaaugacuggcaacaaguuccuuuuuguucccaccauuuccaucagcucauaaugaaagauggaagagaaauuguuguaccaugccgaaaccaagaugaacuuguagguagggcuagggucagucagggagccgguuggucuuugcgcgaaacagcaugucugggcaaaaguuacgcacaaauguggcaacugauguacuuccaccgaagggacuugcgacuagcugccaacgcuaucugcucugcaguaccaguagacuggguuccgacaagucguacaacauggucgauccaugcucaucaucaauggaugacuacggaagauauguugucaguauggaauagaguauggauagaagaaaacccguggauggaagacaagacucacguuucuagcugggaggaagucccuuauuuaggaaagagagaagaccaaugguguggcagcuuaauaggacuaacagcaagggcaacaugggcaacaaacauacaaguugcaauaaaucaaguacgcagauugauaggcaaugagaacuauuuagacuauaugacaucgaugaaaagguucaaaaacgaaucagauccagaaggagcauugugguag

SEQ ID NO: 21102 - RNA, 9879 nt, Artificial Sequence
  derived and/or modified CDS sequence (opt6) from DENV-1__JX669471__SS-prME
ucaguuacgaugcuccuaauguuacucccaacggcucuagcauuucacuuaacuaccagaggaggcgaaccacauaugauugucucaaaacaagaacgagggaaauccuuauuauuuaaaacuuccgcaggcgugaacaugugcacauugauagcaauggaccuaggggaguugugcgaagacacuaugacuuauaaaugcccuaggaucacugaagcggagccugaugauguugacuguugguguaacgcaacagacacguggguuacauacgggacaugcucacaaacaggggaacauagaagggauaaacgaagugucgcguuagcaccucacguugggcugggacuugaaaccagaacugaaacuuggaugucaagugaaggagcauggaaacaaauucaaaaagucgagacgugggcacuacgacauccaggcuuuaccgugauugcccuauuccuggcacaugcuaucggaacaucaauuacacaaaaagggauaauuuuuauucucuugauguuaguaacgccaucaauggcgaugcgauguguaggaauaggaaaccgagacuuuguugaaggauuauccggagcgacauggguagacgucguccucgagcaugguaguuguguaaccacaauggccaaaaacaaacccacauuggauauagaacugcugaaaaccgaaguuacaaaucccgcaguccuccgcaaauuguguauagaggcaaaaaucagcaacacaacaacugauaguagguguccuacucaaggagaggcaacuuuaguggaagaacaagacgcuaauuuugugugccggcggacguucguugauagagguugggguaaugguugcgguuuauucggaaaaggcucccuguuaacaugcgccaaauuuaagugcgugacgaaacuagaagguaaaauuguucaauaugaaaaccuuaaauauucuguaauaguuaccguccacacaggcgaucaacaucaaguugggaaugaaacgacagaacauggaacgaucgcaacaauuacuccacaggcgccuacuucagaaauucaacugacagauuacggagcacuaacgcuugacugcucgccaagaacaggucucgauuuuaaugagaugguauugcuaacgaugaaagaaaaaucaugguuaguacacaaacaaugguuccuggaccucccauuaccauggacaucaggugcaucuacuagccaggaaacauggaaucgccaagaccuauuggugacauuuaaaacggcccaugcuaagaagcaggaaguagugguacucggcucacaagaaggcgcgaugcacacagcuuuaacaggggcaacagaaauucagacgagcggcacaacaacuauauuugccgggcacuuaaaguguaggcugaaaauggauaaacuuacacucaaaggcacaucguauguaauguguacugguaguuucaaacuagagaaagaagucgcagagacccagcaugggacaguauugguucaaguaaaauaugaagguacugacgcucccuguaaaauccccuuuaguacucaagaugaaaaaggcgugacgcaaaacggacgucuaauuaccgcuaauccgaucgucacugacaaagagaaaccuguuaacaucgagaccgaacccccauuuggugaaucguauauagugguaggugcgggggaaaaggcuuuaaaauuaagcugguucaagaaaggaaguucaauuggcaaaauguuugaagcaacagcucgaggagccagaagaauggccauacuaggcgauacagcuugggauuucgggucaauuggaggaguauucacaucuguaggaaagcugguucaccaagucuucgggacagcuuacggaguucuauuuagugguguauccuggacuaugaaaauagguaucgguauacuacuaacauggcuuggucuaaauucucggagcaccagucucucuaugacaugcauugcuguugguaugguaacucuauaucuagggguaaugguacaagcugauuccgguugugucauaaauuggaaaggcagagaguuaaagugcggaagcgguauuuucguaacuaacgagguacauacguggaccgaacaauauaaauuucaagcagauucaccaaaacgucuaagcgcagcuaucggaagggccugggaagagggagugugcggaauacgaucggcaacgagauuagagaauauaauguggaaacaaauaucgaaugaacugaaucacauucuauuagaaaaugacauaaaauuuacaguagucguugggaacgccaacgggaucuuggcacaaggcaagaagaugauaagaccccagccaauggaacauaaguacucuuggaaaaguugggguaaagcaaagauuauaggcgcggauauucaaaacaccacauuuauaauugauggaccggacacacccgaauguccagaugaacaacgggcguggaauaucugggaaguugaagacuauggauuugguauuuuuacaacgaacauuugguuaaaacucagagauaguuauacacagaugugcgaccauagauugaugucagcugcaauuaaagauucuaaagccguacacgcggacauggguuacuggauugaaucugagaaaaaugaaacauggaaauuagcuagagccucauucauugagguaaaaacaugcaucuggccaaaaucucauacacuauggaguaauggcguauuagaaagcgaaaugaucauccccaaaauguacggaggaccaauaucccaacauaauuauagacccggauauuuuacgcaaacugcuggaccauggcaccucggaaaacuugaacuggauuucgacuuaugugaaggaaccacgguuguaguggaugaacauuguggcuccagaggucccucuuugcgaacuacuacagugacuggaaaaaucauccaugaaugguguugucgaucauguacauugccaccauugagguuuaggggagaggauggaugcugguaugguauggagauucgaccuguaaaagaaaaagaagaaaauuuagucaggagcauggucucggcuggcucaggggaaguagacucauucucuuuagggauacucuguguaucgauuaugauagaagaagucaugcgaagccgauggucuaggaaaaugcugaugacgggcacacuagcugucuuccuucuacugauaaugggacaacuaacguggaacgacuuaauaaggcuuuguauaauggugggugcuaaugccucagauaaaauggguaugggaacaacuuacuuggcucuaauggcaaccuuaaaaaugcgaccgauguucgcagugggccuauuauucagaaggcugacaaguagagagguuuuacuacucaccauaggucuuucauuggucgcauccguugagcucccaaacucauuggaagaacuaggcgauggacuggccaugggaauaaugauguuaaaacuacuaaccgaguuucaaccacaccaacuguggacuacccuauugagucuuacauuuauaaagacuacccucaguuuagacuaugcauggaaaacaacggcaauggucuugucaauuguuucauuauucccccuguguuuaucaacgacaagucagaaaacgacuuggcuuccuguauugcuagggucuuucgguuguaaaccuuuaacaauguuuuuaauaacagaaaaugaaauauggggaaggaaaucauggccacuaaaugaagguauaauggcuauaggcaucguaaguauacuauugucaucuuuacuuaaaaaugauguaccauuagcugggccccugauugcaggagguauguuaauagcuugcuauguaaucagugguuccuccgccgaucuaucucuagaaaaagcggcagaaguuuccugggaagaagaagcggaacauagcggcacaagucacaauauccucguagaaguccaagaugacggaacuaugaaaauaaaagacgaagagagggaugauacauuaacaauccuucuuaaagcaaccuuacuagcaguaucugguguguauccaaugagcauaccagcuacccuauuuguaugguacuucuggcaaaagaaaaagcagcgaagugggguuuuaugggacacccccaguccaccggaaguugagagagccguauuagaugauggaauuuacaggauucuccaaagaggguuauuaggcaggucgcaaguaggaguggguguuuuucaagaugggguuuuucacaccauguggcaugucacgaggggcgcuguacugauguaccaaggaaaaagguuagaaccuagcugggcuagcgucaagaaagaucuuauauccuauggagggggcuggagauuucagggaucauggaacaccggugaagaaguacaaguuauugcuguagaaccuggcaaaaacccuaaaaauguacaaacgaccccggguacuuuuaaaacaccagagggggaaguaggagcgauagcuuuggauuucaaaccaggaacuucagguucuccgauaguaaacagagaagggaaaaucguaggauuauauggaaacggggucguaacaaccagugguacauacgugucugccaucgcacaggcaaaggcgucgcaggaaggucccuuaccagaaauugaggacgaaguauuuaaaaagcggaaucuaacgauaauggaccuucaucccggcuccggaaaaaccaggcguuauuugccagccaucguuagagaagcaauaaaaaggaaauuaagaacauuaauuuuggcacccacaagagucgucgccucagaaauggccgaagcacuaaaggguaugccuauaagauaucaaacaacagcuguuaaaagcgaacauaccggaagggagauuguggacuuaaugugucacgcaacauuuacuaugagacuuuuaucaccaguacgaguaccgaauuacaauaugauuauuauggaugaagcacacuuuacaguuccagcaaguauagcggcuagaggauacauuaguacgaggguggguaugggggaagcagcugcaauauuuaugacagcgacaccgccugguucaguagaagccuucccacaauccaaugccguaauccaggacgaggaaagagauauaccugagaggucuuggaacucuggauaugacuggauaacagacuuuccagguaagacaguaugguucguuccaaguaucaaaucagguaaugauauagcaaauuguuuacguaaaaauggcaaaagaguaauucaguuaagucgaaaaacguucgauacagaguaucagaaaacgaaaaacaacgauugggauuaugucguuaccacugauauaucagagaugggagcaaacuuuagagccgaucgggugauugauccucgacgaugccugaaaccggugauauugaaagaugguccugaacgcguaauacuggcgggacccaugccaguaacaguagcauccgcggcccaaagacguggacgaauuggucguaaucagaauaaggaaggggaccaauauguuuauaugggacaaccacuuaauaaugacgaagaucacgcgcacuggacggaggcuaagauguuacuugacaacauuaauacgccggaagguauaaucccugcacuauuugaaccugaaagagagaaaagugcagcgauagauggcgaauaucguuuaagaggcgaagccagaaaaacauucguggaauugaugcgaaggggagaccuuccaguuugguugaguuauaaagucgcaucugaaggcuuucaauacucggaucgucgaugguguuuugacggagagcguaauaaccaggucuuagaagaaaauauggauguugaaaucuggacuaaggaaggagagcggaaaaaguuaaggccacgaugguuagaugcacgaacauauucugacccacuagcacuucgggaauuuaaggaguuugcagcaggcagacgaucgguuagcggagacuuaaucuuagaaauaggaaagcuaccacaacaccuuacgcaaagagcacaaaaugcacuagauaauuuaguaauguugcacaacagugaacaaggaggaaaagcauacagacaugcaauggaggaauuacccgacacaauagaaacauugaugcuauuagcauuaaucgccguucuaacaggaggagucacauuauucuuuuuaagcggaaagggucuugggaaaacuucaauaggacuucuauguguaacggccucaagugcuuuacucuggauggcaucagucgaaccccacuggaucgcagcuucaauaauauuagaguucuuucuaauggugcugcuaauacccgagccugaucgacaaaggacuccccaagauaaucaacuugcuuacguugucauaggacucuuguuuaugauccuuacaguagcugcaaaugagaugggacuauuagaaacaaccaagaaagaucucgggauaggacacgucgcggcagaaaaccaucagcacgcaaccauguuagauguagacuuacaucccgcgucagcauggacauuauaugcaguagcuacaacuguuauaacgcccaugaugcgucauacaaucgaaaacacaacugcgaauauuucgcuaacagcaauagcaaaucaagccgcgauccuaaugggauuagauaaaggguggccaauuucaaaaauggauuuaggaguaccacuacuagcacuaggcuguuacagucaagucaauccgcuaacacuaacagcagcaguacucaugcugguagcucauuacgcaauuaucggaccuggauuacaggcaaaagccacuagagaagcgcaaaaacgaacugcagcugggauaaugaaaaaucccacaguagacggaauaguugccauagauuuagacccagucguguaugaugccaaauuugaaaaacagcucggucagauaauguuacugaucuugugcacuucucaaauauuacuuaugcgcaccacaugggcucuaugugaauccauuacccuagcaacuggaccacucacgacacuaugggaagggucuccaggaaaauuuuggaauacuaccauagcagucaguauggcaaacauauuuagaggaucuuauuuagcgggagcgggguuagcauuuagccucaugaagucccuaggagggggacgacgcggcacaggggcgcaaggagaaacgcuuggagaaaaguggaaaagacaacuaaaccagcuuucaaaguccgaauuuaacacuuauaaacguagugggaucauggaaguagaucgaagcgaagcuaaagaagggcuuaaacgcggagaaacgaccaagcaugcugucagcagaggaacugccaaauuacgcugguucgucgaaagaaaucuaguuaaacccgagggaaaaguuauagaucuuggaugcgguagaggaggauggagcuauuauugugcggggcuuaagaagguaacggaaguaaaagguuauacaaaaggagggccaggucacgaagaaccgauaccuauggcaacuuauggauggaaucucguaaaacuucauucugggaaagacguauucuuuaugccuccugaaaaaugugauacauuacuaugugacauaggugaguccucaccaaaccccaccauagaggaagggagaacauuaaggguucugaaaaugguugaaccuuggcuccgaggcaaccaguuuuguaucaaaauucuaaacccuuauaugcccucagugguggaaacauuagaacaaaugcaacggaaacauggcggaaugcuagugcguaauccucuaagccguaacucuacacaugaaauguauuggguuagcugcggaacuggaaacauaguaucugcagugaacaugaccucgagaaugcuucuaaaucgauuuacuauggcucaucggaaaccuacguaugacagagauguggaccuaggcgcagggacaagacauguggcaguggagccagaaguagcgaacuuggauaucauagggcaaagaauagaaaacaucaaaaacgaacauaaaucaacuuggcacuaugaugaggacaauccuuacaagacuugggcuuaucacggaaguuacgaagucaaaccaucaggcucugcgaguucaaugguuaacgggguagucagacugcuaaccaagccuugggacguuauuccaaugguuacacaaaucgcaaugacugacacuacacccuuuggacaacaacgaguguucaaggaaaaagucgacacucgcaccccacgugcuaaaagggguaccgcucaaauaauggaaguuacagcaaaguggcucuggggcuuucuaucgagaaauaagaaaccuagaauaugcacuagggaagaauuuacaagaaaaguaagaaguaacgcugcaauaggcgcgguauuuguagacgaaaaucaguggaacucugcaaaagaagcuguagaagaugaacgauuuugggaucuuguacauagagaacgggaacuucacaaacagggaaagugcgccacauguguauauaacaugaugggcaaaagagagaagaaauuaggugaauuuggaaaagccaaaggguccagagcgaucugguauaugugguuaggugcaagauuucuggaauuugaggcauugggcuucaugaaugaagaucacugguucuccagagaaaauucuuuaucaggcguugagggugaaggucuccauaaacuugguuacauacuacgagauauuaguaagauacccggaggcaauauguaugcagaugacacugcuggcugggacacccgaaucacugaggacgaccuacagaaugaagcuaaaauuacggauaucauggagccagagcaugcgcucuuagcaacuucgauuuucaaauugacguaucaaaacaaagugguuagaguccaaagaccagccaaaaacggaacagugauggauguuauaucaagaagggaccaacgugguagcggacaaguuggaacauauggacuuaauacuuuuacaaauauggaagugcaacucauaagacaaauggaauccgaagguauauucuuuccaucagaacuagagagcccuaaucuugcugagagaguuuuggacuggcuagaaaaacauggugcagagaggcugaagcgaauggcaaucucgggcgacgacugcgugguaaaaccuaucgacgacagauucgcgaccgcauuaauagcccucaacgacauggguaagguacguaaggacauuccacaaugggaaccgaguaaaggguggaacgacuggcagcaaguaccguucugcucucaucauuuccaccaguuaauaaugaaagauggucgagaaauuguaguuccaugucgaaaccaagaugagcuaguagggcgggcaagagugucacaaggagcggguuggucccugagggagaccgcuugucucgggaaaagcuaugcacaaauguggcaguugauguauuuucauagaagggacuuacgccuggccgccaaugcaauaugcagcgcaguacccguagauuggguaccuacuucucguaccacguggaguauucacgcacaucaccaguggaugacuacagaagauaugcuuucaguauggaacaggguauggauugaagagaauccuuggauggaggacaaaacacauguaagcaguugggaggaaguaccauaucuagguaaaagagaggaccaauggugcggaaguuuaauagggcuaacugcaagggcaaccugggcaaccaacauacaaguggcaauaaaccagguaagaagacucaucgguaaugaaaauuaccucgacuauaugacaucgaugaaaagauuuaagaaugagucugaucccgaaggagcauuaugguag

SEQ ID NO: 21103 - RNA, 9879 nt, Artificial Sequence
  derived and/or modified CDS sequence (opt6) from DENV-1__JX669472__SS-prME
ucuguaaccauguuauuaaugcuguuaccuacugcgcuugcguuucauuuaacuacucgcggaggugaaccacauaugaucguuucaaaacaggaacgagggaaaucgcuauuauuuaaaacgucagcuggagucaauauguguacgcuaauugcuauggaccucggcgaacuaugcgaagauaccaugacuuauaaauguccacgaauuaccgaagcggaaccggaugauguugacuguugguguaacgcaacugauacauggguaacuuaugggacaugcucgcaaacgggggagcauagacgugacaaaagaucagucgcacuugcaccgcacgucgggcucggucuggaaacacguacugaaacauggaugagcagugaaggagcguggaaacaaauacagaaaguggaaacuugggcguuaaggcauccgggcuuuacgguaauagcguuguucuuagcgcacgcaauaggaacuagcauuacccaaaaaggaauaaucuucauacuacucaugcuaguuacuccaucaauggcuaugagaugcguuggaauaggcaauagagauuuuguugaaggccuaucaggcgcuacuuggguagauguaguuuuagaacacggaucuugugugacgacaauggcgaaaaauaaaccuaccuuagacaucgagcuauuaaaaacugaagucaccaauccagcaguucugagaaaauuaugcauugaagcaaaaauuaguaacacuacgaccgauucgagaugccccacucagggagaagcaacccuaguugaagaacaggaugcuaauuuugucuguagacguacuuucgucgauaggggaugggguaauggaugcgggcuuuuuggaaaaggcuccuuguuaaccugcgcgaaauucaaaugcgucaccaaauuagaagggaaaauaguccaauaugaaaaucucaaauacucaguaauaguuacggugcacacuggagaccaacaucaaguuggaaaugagacaacugaacauggaacuaucgcaacuauaacuccucaagcuccgacaagugaaauccagcuaacagacuauggagcucuaacacuugacuguaguccucguacaggacucgacuuuaaugaaaugguuuuacuuacuaugaaagaaaaaucaugguuaguucacaaacaaugguuccucgaucugccauuaccauggacaucgggggcaucaaccucccaagaaacuuggaacaggcaagaccuauuaguaacuuuuaaaaccgcacacgccaagaaacaagaggugguaguauuggggucacaagaaggagcuaugcauacugcacuuacaggugcaacagaaauucaaaccagcggaacaacaacgauauuugccggccaucuaaaauguagacuuaaaauggacaaauuaacauuaaaaggcacaucauacguaaugugcaccgggagcuucaaacuagagaaggaaguggcugaaacccagcacgggacuguauuaguccaaguaaaguacgagggaacagaugcaccaugcaaaauuccauuuaguacccaagacgaaaaaggaguuacucagaacggccgauugauaacagcgaacccgauuguaacagauaaggaaaagccuguaaauauagaaacggagccgccguuuggggaaucauauauagucgugggcgcaggagagaaagcucucaaacuuucaugguuuaagaaagggucaucgauugguaaaauguucgaagcgacugcucgaggagcucgaagaauggcaauuuuaggagacacugccugggauuuuggcagcaucggaggcguauucaccuccguaggaaaacuuguccaccagguauucgggacagcuuauggcguauuauucaguggagucagcuggacaaugaaaauagggauuggaauauuacuuacguggcuaggguuaaauagucguuccacaaguuugaguaugacauguauugcagucgggauggugacucuauaccuuggaguaaugguucaagcugauuccggcugugugaucaacuggaagggaagagaacuaaagugcggcaguggcauauuugucacuaacgagguacauacauggacagaacaguauaaauuccaggcagacucuccuaaaagacuuagcgcagcuauagggcgugcaugggaagaaggaguuugcgggauaagaucugccacacgacuugaaaauauuauguggaaacagauuucuaaugaauuaaaucacauacugcuagaaaaugauaugaaauucacuguuguugugggaaaugcgaacggaauuuuggcacagggcaagaaaaugauaaaaccacaaccuauggaacauaaguauucauggaaaaguugggggaaagcuaagauuauuggagcagauauacagaauacgacuuuuauaaucgacggcccugacacacccgaaugucccgaugagcagcgugcauggaacauaugggagguagaagacuauggauucggcaucuucaccacaaauauauggcucaaacugcgagacuccuauacacagaugugugaucaccguuuaaugucagcagcaaucaaggauucuaaagcaguacaugccgacaugggauauuggauagaaucggaaaagaaugaaacuuggaaguuggcaagagccuccuucauugaagucaaaaccuguauauggccgaaaagccauacacucugguccaauggaguacuagaaucagaaaugauuauaccuaaaauguauggugguccuauuucgcaacacaauuaccggcccggauauuuuacgcaaacagcuggaccauggcaucuaggaaaguuagaacuugacuucgaucuuugugaaggcaccacagugguuguugaugaacauugugguucuagaggcccaucacuaagaacuacgacgguaacagguaaaauaauccaugaauggugcuguagaucaugcacccuaccaccauuacgcuuuagaggugaagacggcuguugguacgggauggaaauuagaccuguaaaggaaaaagaagagaaucuaguuaggucaauggugucugcugguucaggggaagucgacaguuuuaguuuaggcauuuuaugcguaaguaucaugauugaggagguaaugcguucuagauggagccggaaaauguuaaugacggguacguuagcuguauuuuuacuacuaauaaugggccaacuaacguggaacgaucuaauacgacuguguaucauggugggcgcuaaugcuucugauaaaaugggaaugggcacaacuuaccucgcauuaauggcuacuuuuaagaugagacccauguuugcggucggacuuuuauucagaaggcugaccucucgggaaguauuguuauugacgauaggcuugagucuuguugcuagcguagaauuaccuaacagcuuggaagaacucggcgauggauuggccauggguauuaugauguuaaaacuuuuaacagaauuucaaccccaccaauuauggaccacuuuacuuaguuuaacguucauuaaaacaacgcugucacuagauuaugcuuggaaaacaacagcuacugucuuaucuauaguaucucuauucccauuaugccucaguacuacaucccagaaaacuacaugguuaccagugcuuuuaggcuccuuugguuguaagccacucacgauguuuuuaaucacagaaaauaaaauauggggaagaaaaucauggccguuaaacgaaggcauaauggcuaucgguauaguaucuauuuuauuaucaucucuacugaaaaacgacgucccauuagcggggccucuaauagcggguggaauguuaauugcuuguuauguuauuagcggaucgagugcagaccuuaguuuggaaaaagcagccgaaguuucuugggaagaagaagcagagcauagugggacuucacauaauauccuuguagaaguccaagaugauggaacaaugaaaaucaaagaugaggaaagagaugauacguuaaccaucuuacuaaaagcaacguuacuggcagugaguggaguguacccuaugucaauaccugcgacucuauuuguuugguauuucuggcaaaagaagaaacaaagauccgggguauugugggacacuccaaguccaccggaaguagaaagggcuguucuugaugauggcauauauagaauuuuacaaagaggucuauuaggccgaucacaaguaggaguaggaguuuuucaagauggaguauuucacacaauguggcauguaacccgcggagcaguacugauguaucaaggcaagagauuggagccauccugggcgucagucaagaaagacuuaauauccuauggaggaggguggagauuucagggaucauggaauacaggugaagaaguccagguuauagcaguugaaccagguaaaaacccuaaaaacguucaaacaacgccuggcacuuuuaagacaccagaaggcgaaguuggagccauugcccuagauuuuaaaccaggaacuucagguucgccgaucguuaaucgugaggguaaaauuguaggguuauauggcaacggaguuguaacgaccagcgggacuuauguuucagcuauagcacaggcgaaagccagucaagaaggaccucuuccagaaauagaagaugaaguguuuaagaaacgaaauuugacaauuauggauuuacacccugggucugggaaaacaagaagauaucucccagcaaucguccgugaagcgauuaaaagaaaauuaagaaccuugauacuagcaccaaccagaguugucgcuagugagauggcagaagcauugaaagguaugcccauucgauaucagacaacugccguaaaaucugagcacacuggccgggaaauaguagaucuaaugugccacgcgacuuuuacaaugcguuuacuaucaccgguacgaguaccuaacuacaauaugauuaucauggaugaagcucauuuuacggaccccgcgucgauagcagcacgagguuauauauccaccagaguagguaugggugaggcagcugcaauuuucaugacggcaacaccaccaggaucaguggaagcauuuccccagucuaaugcaguaauucaggacgaggaacgagauauacccgagcguucguggaacucggguuacgacuggauaacagauuuuccaggcaaaaccguaugguucgucccgaguauuaagucaggaaaugauauugcaaacuguuuaaggaaaaaugggaagagaguuauacaacuaucgagaaaaacuuuugauacugaauaucaaaagacuaaaaauaaugacugggauuaugucguuacuaccgauauaagugaaaugggcgcuaauuuccgagcagaccgaguuauugauccgagaagaugccuaaagccgguaauauuaaaggaugguccggagcguguaauauuggcaggaccaaugccagugaccguugcaagcgccgcacaacguaggggacggauaggcaggaaucaaaauaaagagggagaucaauacgucuacauggggcaaccucuaaacaacgacgaagaccaugcccacuggaccgaagccaaaauguuacuugacaacauaaauaccccagaagguauaauaccagcguuauucgaaccggaaagagagaaaagugcggcuauagauggagaguauaggcuacguggagaagcccgaaaaacuuuuguggaacuaaugagacgaggagacuuaccaguaugguugagcuauaaaguggcgucugaagguuuucaauauucggacagacgauggugcuucgauggagagcgaaauaaucaagugcuagaagaaaacauggacguagagauauggacuaaggagggagagcggaagaaacuuagaccucgguggcuugaugcaagaaccuacucagauccauuagcacuuagggaguucaaagaauuugcugcaggacggcgcaguguaucuggcgaucuuauauuggagaucggaaaguuaccucaacaccugacauuaagagcucaaaaugcacuagauaauuuaguuauguuacacaacucugaacaaggugguaaggcauauagacaugccauggaagaacugccugauacaauagaaacuuuaaugcuacuagcauugaucgcaguacuuacuggugguguaacccucuucuuuuuaaguggcaaagggcuagguaagacgucaauuggauuauuauguguuacggcaucuagcgcccuguuauggauggcuuccguagaaccccauuggauagcggccaguaucauacuugaguucuuucuaauggucuuauuaaucccagaacccgauaggcaaagaacaccacaggacaaccaauuagcauacguuguaauaggucuauuauuuaugauauuaacuguagcggccaaugaaaugggccugcuagagacaacuaagaaagaccuaggaaucggccauguagcugccgaaaaccaucaacaugcaacuauguuagacguugauuuacaccccgccagcgcauggacacuauacgccguggccaccacaguaaucacucccaugaugcgacauacaauagaaaauacgacugcgaauauaagucuaacggcgauagcuaaucaggcagcuauucugauggggcuagacaaagguuggcccauaagcaagauggauuugggcguaccacuauuggcucuaggauguuauucacaagucaaccccuuaacuuuaacggcagcgguauugaugcuaguugcgcacuaugcuauaaucggcccgggacuacaagccaaagcaacaagagaagcacaaaaacgaacugcagcagggauaaugaaaaauccaaccguugacggaauaguagccauugaucuugauccaguaguauaugaugcaaaauuugagaaacaacuaggacaaaucauguuguuaauccuuuguacaucucaaauauuacuaaugcguaccaccugggcccugugugaauccauaacacuagcuacugggccauuaacaacauugugggagggaucucccggaaaauucuggaauacaacuauagcuguauccauggcaaacauauuuagggguaguuauuuagcaggagccgguuuggcguuuucauuaaugaaaucucuggguggaggaaggagaggaaccggcgcacaaggggagacccuaggagaaaaauggaaacgacaauuaaaccaauuaucaaaaucagaauuuaauaccuacaaaagaaguggaauuauggaaguagacagaucagaagcgaaagaaggauuaaaaagaggagagacuacuaaacacgcugugaguagaggcacagcuaaacuacgaugguuuguagaaagaaacuuaguuaagccagaaggcaaagugauagacuuaggcugcggaagggguggaugguccuauuauugcgcgggacugaagaaagucaccgaaguaaaaggauauacuaaaggugguccuggacaugaagaacccauaccaauggccacguacgguuggaaucuaguuaaauugcacucugguaaggacguauucuuuaugccgccagagaagugugacaccuuauugugcgauauaggagaaaguucaccaaauccaacuaucgaagaaggaagaacccuaagaguccuuaaaauggucgaaccuugguugagagguaaucaauuuuguauuaagauucucaauccuuauaugcccaguguaguagagacauuagaacaaaugcaacgaaagcacggugggauguuagucagaaauccuuuaucuagaaacaguacacaugaaauguauugggugucuugcggaacugguaacauaguaucugcgguuaauaugacuucuagaauguuacuuaaccguuuuacaauggcccauagaaagcccacauacgaacgcgacguagauuuaggugcaggaaccaggcacguagccguagaacccgaaguugccaaucuagauauaauuggccaaaggauagaaaacaucaaaaaugaacacaaaaguacguggcacuacgaugaggauaacccuuauaaaacaugggcguaccauggguccuaugaaguuaagcccucagguucggcaucaagcauggugaacggugucguucgauuauugacuaaacccugggaugucauuccuaugguuacccaaauagccaugacggacacaacuccauucggucagcagagaguauuuaaggagaaaguagacaccaggacgccaagggcaaagcgaggaacagcacaaauuauggaaguaacugcaaaaugguuauggggauucuugucgcgaaauaagaaaccuagaaucugcaccagagaggaguucacacggaaagugcgaucaaacgccgcuaucggagcuguauucgucgacgaaaaccaauggaacagugcaaaggaagcagucgaagaugaacguuuuugggauuuaguacauagggaaagagagcuacacaaacaggguaagugugcaacauguguauauaauaugaugggcaagcgugagaagaaacuuggggaguucgggaaagcgaaaggaucacgugcaauaugguauaugugguuaggagcgcgauuuuuagaguuugaagccuuggguuucaugaacgaagaucacugguucucacgugaaaauagcuuaucgggaguugaaggcgaaggucuacauaaauuagguuacauauuaagagauauuucaaaaauucccgggggaaauauguacgcggacgauaccgcugggugggauacccgaaucaccgaggacgauuugcagaaugaagcuaaaauaacagacauuauggagccggaacaugcuuuacuagcuacaaguauauuuaaacuuacuuaccaaaacaagguaguccguguucaaagaccugccaaaaaugguacuguaauggacguuauaagccgccgggaucagagaggauccgggcagguaggaacguacggucuaaauacuuuuacgaauauggaaguacaauugaucaggcagauggaaagugagggaauauucuucccaucugaacuagagucuccgaaucuggcugaacgagucuuagauugguuagaaaagcauggugcugaaagauuaaaaagaauggccauauccggcgaugauugcguaguaaaaccuaucgaugaucgcuuugcaacagcuuuaauagccuugaaugauauggguaaaguuagaaaggacauaccacagugggagccauccaaaggauggaaugacuggcaacagguuccauuuugcucacaucacuuucaccaauugaucaugaaagauggaagggaaauaguaguaccgugucgcaaucaggacgaacuuguuggacgggcaagaguaagccaaggagccggauggaguuuacgcgagaccgccugucuagguaaaaguuaugcucaaauguggcaauuaauguauuuucaucgccgagacuugcgccuagcugcaaacgcaaucuguagugcaguaccuguugacuggguaccuacuucacgaacgacuuggucaauacacgcacaccaucaauggaugacgaccgaagauauguuaaguguauggaaucguguuuggauugaagaaaacccuuggauggaggacaagacucacguaaguuccugggaagaaguaccguauuuagggaaacgagaagaucaguggugugguagccuaauuggguuaacagcaagggcaacgugggcgacaaauauacaaguagcaauaaaucaggugagacgguugauagguaaugagaauuaccuugacuauaugacuucuaugaaacguuuuaagaacgaaucagauccugagggcgcgcugugguaa

SEQ ID NO: 21104 - RNA, 9879 nt, Artificial Sequence
  derived and/or modified CDS sequence (opt6) from DENV-1__JX669473__SS-prME
ucgguaacuaugcuuuuaaugcugcuuccaacggcacuugcauuucacuugacuacacgcggaggugaaccacauaugauaguaaguaaacaagagagaggaaaaucucuacuauucaaaacaagugcuggaguuaauauguguacucuaauugcaauggauuuaggagaguugugcgaagauacaaugacuuacaaauguccacggauaacagaggcagaacccgacgauguugacugcuggugcaacgcaacagauacuugggugacauacggaacuuguagccaaacgggugagcauagacgggauaaaagauccgucgcgcuagcaccgcaugugggacucggguuagaaacaagaaccgagaccuggaugucaucagaaggugcauggaaacaaauacaaaaaguagaaacaugggcucugagacauccaggauuuacaguuauagcacuauuuuuagcacaugcaauuggcacuucuauuacucaaaaaggaauaauuuucauucuucuuaugcuaguuacaccaagcauggcaaugcguuguguaggaauagguaaccgagacuucguagaaggucuuaguggagcuacguggguggauguuguuuuagaacacggaaguugugugacaacuauggccaaaaauaaaccaacucucgauauagaacuacucaaaacggaagucacaaauccugccguacuucguaaacuaugcauagaagccaaaauaaguaauacuacaacggauaguagauguccaacacaaggagaggcaacgcuuguggaggaacaagaugcaaauuucgugugccgacguacauucguagacagagguugggguaauggaugcggguuauuugggaaagggagcuuauugaccugugcaaaauucaaauguguaacaaaacuagaaggaaaaauuguccaauaugaaaaucuuaaauacucuguuauuguaaccguacauacuggagaccaacaccagguagguaaugagacaacugaacacggaacuaucgcaacuauaacuccgcaagcaccaucaucugaaauucaacuaacggauuacggagccuuaacuuuggacugcaguccccguacaggccuugacuuuaaugaaaugguccugcuaaccaugaaagagaaaaguuggcuaguacacaaacaaugguuucuggauuuaccuuugccauggacaagcggugcaagcacaucacaagagacauggaacagacaagauuuacuugucacguuuaaaacagcacaugcuaaaaagcaagagguuguagugcuagguucucaagaaggugccaugcauaccgcuuugacaggugccacugaaauacaaacaucaggaaccacgacaauauucgcuggacaccuaaaaugccgauugaagauggacaagcucacauuaaaaggcacuucguaugucauguguacaggaucauucaaauuagaaaaggagguagccgaaacccaacaugguacuguguuaguccaagugaaauacgaagguacagaugcaccgugcaagauucccuuuucgacccaggacgagaaaggaguaacacagaacggaaggcuuauaaccgcaaauccuaucgucaccgauaaggaaaaaccgguaaauauagagaccgagccgccguuuggugaaucauauauagucgugggcgccggugaaaaagcguugaaacuuagcugguucaagaaagguucuucuauugggaagauguuugaggcaacagcgcgcggagcuaggcguauggcuauucuaggugacacugcaugggacuuugguaguauaggagggguuuucaccaguguagguaaguuaguacaucaaguauucgggacagcuuauggaguuuuauucucugguguuaguuggacaaugaagaucggcauugggauauuauuaaccuggcuaggauuaaauucuaggucaacauccuugucuaugacauguauagcaguagggauggugacauuauacuugggaguaaugguacaagcugacucuggauguguaauaaacuggaaggguagggaacuaaaaugugguucgggaauuuucguaacuaaugaaguacauacuuggacugaacaauauaaauuccaggcugacucgccaaaacgguugucagcagcuauaggucgagcgugggaggaaggggugugcggaauaagauccgcuacaagauuagagaauaucauguggaaacaaaucucaaaugagcuuaaccacaucuuacuugaaaacgauaugaaauuuacgguagugguugguaacgcgaacggcauuuuagcgcaagguaagaaaaugauaaagccacaaccgauggaacacaaauacaguuggaaaagcugggguaaagcuaaaauuauuggagcagauauacaaaacgcuacguuuauaauugacgguccggauaccccugaaugucccgaugaacaaagagcauggaacauaugggagguggaagacuauggauucgguauuuuuacgacuaacauauggcucaagcuacgggacucauauacucaaaugugcgaccacagacuaaugucagcggccauaaaggauucaaaagcaguacacgcggauauggguuauuggauugaaagugagaaaaaugaaacguggaaacuagcacgugccucauucauagaaguaaagaccuguauauggccaaaaucucauacucuauggucaaauggaguguuagaaucagaaaugauaauuccuaaaauguauggcggcccuauaucucaacacaauuaccgaccgggauacuuuacccagacagcgggaccauggcaucuaggaaaauuagaauuagauuucgauuuaugcgaaggaacaacaguagucguugacgaacauugugggagucgaggacccaguuugaggacuacuacagugacugguaaaauuauucacgaguggugcugccggucuuguacacuaccacccuuaagauuuagaggugaggauggcuguugguaugggauggaaauacgaccaguaaaggaaaaagaagaaaaucucguucguaguaugguuagugcugggucaggggaaguagacaguuuuaguuuaggaauuuuauguguuucgauuaugauagaggaggucaugagaaguagguggucacggaaaaugcuaaugacagguacacuggcgguauuccuauugcuaauuaugggacagcuuacauggaacgacuuaauaaggcuauguauaaugguaggcgccaacgccagugacaagauggguaugggaaccacauacuuagcauuaauggcaacauuuaaaaugagaccuauguucgcuguuggucuacuauuuagaagacucacaaguagggaaguauugcuguuaacgaucggucuuucuuuaguugcaagcgucgaauuaccuaauagccucgaggaauuaggugacggucuugcaaugggcaucaugaugcuaaagcuacuaacggaauuucaaccucaucaauuguggacaaccuugcuaucccugaccuucauaaagacuaccuugucacuugacuacgccuggaaaacuacugcaacggucuugaguaucguaucucuuuucccacugugccuuucaaccaccagucaaaagacuaccugguuaccagucuuguuagggucauuugggugcaaaccguugacuauguuucucauuacagaaaauaaaauauggggccgaaaaucauggccacuaaacgaaggcauaauggcuauugguauuguaucaauuuuauuauccagccuacucaaaaacgauguaccauuggcagggccauuaauagcgggcggaaugcuuaucgccugcuauguuauuagcggaucgagugcugauuugucacuggagaaagccgcagagguaucgugggaggaagaggcugaacauucuggaacuagccauaauauacuuguugaaguacaggaugaugguaccaugaaaauaaaagaugaagaacgugaugauacuuuaacuauucuucucaaagccacauuauuagcaguaagcgguguuuauccaauguccauaccagcgacacuauuuguaugguauuuuuggcagaaaaagaagcagagaaguggugucuugugggacacuccuuccccacccgaaguagaaagggcaguuuuagaugacgguaucuauagaauccugcaacggggucugcugggucgaagucagguaggaguuggcguauuccaagacggcguguuucacacaauguggcauguuaccaggggugccgugcuaauguaccaggggaaaagacuugaaccgucaugggcuuccguaaagaaggauuuaauaagcuacgggggagguuggcgauuccaagguucguggaauaccggagaggaagugcagguaauagcggucgaaccaggcaaaaaucccaaaaaugugcaaacuacacccgguacauuuaaaacaccagagggugaagucggagcaauagcucuugauuuuaaaccaggcacuucuggaucacccauugugaauagggaaggcaaaauuguaggacuauacgguaaugguguugugacaacaucuggaacguauguaucggccauagcucaagcaaaagccagucaagaaggaccgcuaccugaaauagaggacgaagucuuuaagaaacgaaacuugacuauaauggaucuacauccaggaaguggaaaaacaagacgguaucucccugcaauaguuagagaggccauaaaaagaaaacuaagaacauuaauacuggcaccuacaagaguaguugcgucagaaauggcggaagcucucaagggaaugccaauuagauaucagacgacagccguuaaauccgaacacacaggucgagagaucguggaucuuaugugucaugccacuuuuacuaugagguuauuguccccaguuagaguaccaaacuauaacaugauuauuauggacgaagcucauuucaccgauccagcaagcauugccgcuagagguuacaucucaacgcgaguaggaaugggcgaagcggcugccauuuuuaugacggcgacaccacccggaagugucgaagccuuuccacagucaaacgcgguaauacaggaugaagaaagggacauaccggaaagaagcuggaauagugguuaugacuggauaaccgacuucccaggcaaaaccguaugguuuguuccuuccaucaaaaguggaaacgauauagcaaacuguuuacguaaaaauggaaaaagagugauacagcuaucaagaaaaacguuugacacagaauaucagaaaacaaagaacaacgauugggauuauguaguaaccacagauaucucagaaaugggagcaaauuuuagagcagacagagucauugauccacgcagaugucuuaaaccaguuauauuaaaggaugggccagaaagagugauacuugcgggaccaaugccuguuacagucgcuucagcggcucaacgaagaggaagaauaggacggaaucaaaauaaagaaggugaucaauacguauauaugggucaaccacugaacaaugacgaagaccaugcacacuggacagaggcaaaaaugcuauuggauaacaucaauacaccggagggaauaauuccagcuuuauuugaaccagaaagagaaaagagugcagcaauagauggugaauaccgauuaaggggagaagcacgcaagacauuuguugaacugaugagacguggugaucuucccguguggcuaucuuauaaaguggcaagcgagggauuccaauauucagacaggagaugguguuuugauggggagagaaauaaccagguucuagaggagaacauggacguagaaauuuggacgaaagagggcgaaaggaagaaacuuagaccgcgauggcuugacgcucggacguacuccgauccacucgcacuaagggaauuuaaagaauuugcagcggguagaaggagugucaguggagauuuaaucuuagaaauaggaaaauugccacagcauuuaacauugagagcgcagaaugcccuggacaauuuaguaauguuacacaacucggaacaaggcggaaaggcguaccgacacgccauggaagaacugccagacaccauagaaacauuaaugcuccuagcucuuauugcuguacuuacgggaggugugacuuuguucuuuuuaucgggaaaaggauuggguaaaacaucuauaggacuacuguguguaacagcguccagugcacuacuguggauggccucggucgaaccucauuggauagcugcaucuauaauauuagaguucuuucuuaugguccuacuaaucccggaaccagaucggcagagaaccccacaagauaaucaguuagccuacguugucauaggccugcuauucaugauauugacgguugcagcaaacgaaauggggcugcuugaaacgacgaagaaagaccuuggaauuggacauguggccgcagaaaaucaccaacaugcgaccaugcuagacguagaccuucauccagcaucggccuggacauuguaugccgucgcuacgacaguaauaacucccaugaugaggcacacaauagaaaacacuacugcaaauauuagucuaaccgcuauagcuaaucaagcagcuauucuaauggguuuggacaaaggauggccuauuuccaaaauggauuuaggagucccauugcucgcccuagggugcuauagucagguaaacccacuuacccuaaccgcugcgguguuaaugcugguugcucacuaugccaucauuggaccugguuuacaggcaaaggcgacaagggaagcgcagaaaagaacagcugcaggaauaaugaaaaacccaacagucgacggaauuguagcgauagaccuugacccggugguauacgaugcuaaauucgaaaaacaacucggacaaauuaugcugcuaauacuaugcacgucgcaaauauuauuaaugagaacaaccugggcccucugugaaucuauuacccuagcaacaggaccguuaacuacccuuugggaaggcagcccaggaaaauucuggaauacaaccauagcgguuucaauggcaaauauauuucgcggcucauauuuagcgggagcagguuuggccuucagucuaaugaaaucccuaggaggagggaggagagguacaggcgcucagggcgaaacauuaggagaaaaauggaaacggcaauuaaaccaauuaaguaaaucugaguuuaauacauacaaaaggagcgggaucauggagguggauaggucagaagcgaaagaaggccucaagagaggcgaaacaacaaagcaugccguaagucguggcacggcaaaauugagaugguuuguugaacgaaaucucguaaaacccgaagguaaggucauagaucugggauguggucguggcggcuggucguacuauugcgccggacucaagaaaguaacagaagucaagggauauacuaaagguggccccggccaugaggaacccauaccuauggcuacguauggauggaauuugguuaaauuacauucaggaaaagaugucuucuuuaugccaccggaaaaaugugauacacuucugugugacauaggagaaaguagcccaaacccaaccauugaagagggaaggaccuuaagaguucuaaaaaugguagaacccugguuacgagggaaccaauucugcauuaaaauauugaauccuuauaugccuucaguagucgagacauuagaacaaaugcaaaggaagcacggagggauguuaguccgaaacccauuaucucgaaacucaacccaugagauguauugggugagcugcggaacaggaaacauuguaucagcgguuaauaugacgucacguaugcuacuaaauagauucacuauggcacaccggaaaccgacuuaugaaagagauguagaucuaggagcuggaacacgucauguggcaguagaaccagaaguagcaaaccucgauauaauuggccaacguauagaaaacaucaaaaaugaacacaaaucgaccuggcauuaugaugaggauaaccccuauaaaacaugggcuuaccaugguaguuaugaaguaaaaccgagcggaucugcaucaagcauggucaacggaguaguacgauuauugacuaaaccuugggacgucauaccgauggugacucaaauagcuaugacggacacuaccccuuucggccaacaaagagucuucaaagagaaaguugauacacguacaccaagggccaagagggguacugcgcaaauuauggaaguaacagcuaagugguuauggggguuucuaagucgcaauaagaaaccgagaauauguacuagagaggaauuuacacggaaagucaggaguaaugcugcuauaggugcaguauuuguggaugaaaaccaauggaauagugcgaaagaagcagucgaagacgaaagauucugggacuuaguacauagagaacgagaacugcacaagcaaggcaaaugugcaacuuguguguacaacaugauggguaagagagaaaagaaguuaggagaauuuggaaaagcaaagggcucacgggcuauaugguauauguggcuaggagcccgcuuuuuagaguucgaagcacuagguuuuaugaaugaagaccacugguucucaagagaaaacagucuuucaggaguagaaggugaaggauugcauaaauuaggauauauucugagagauauuagcaaaaucccgggagggaauauguaugcggaugauacagcagggugggauacuagaaucacugaggaugacuugcagaaugaggcgaaaauaacugacauaauggagccagagcaugcucuccuugcaacgagcaucuuuaaacuuacguaccaaaacaagguuguaagaguacaaagaccugcgaaaaaugggacagucauggacgugauuucacgaagggaucaacguggcucaggacaaguagggaccuaugggcuuaauacauuuacaaauauggaagugcaacuuauaagacaaauggaaucugagggaauuuucuuucccagugaauuagaauccccaaauuuagcagaaaggguacucgacuggcuagaaaaacacggcgcagaaagacucaagagaauggcuauauccggagaugauugcguuguuaaaccuauugacgauagauuugccacugcguuaaucgcauuaaaugacaugggaaaaguaagaaaagauaucccgcaaugggaaccuuccaaaggauggaacgauuggcaacaagugccauuuugcucacaccauuuccaucaauuaaucaugaaagacggaagggagauaguagucccaugccgaaaccaagacgaacuggucggacgagcgcguguaucacagggggccgguuggucacucagagaaacagcaugcuuaggaaaaucguaugcacaaauguggcaacuaauguacuuucaucguagagauuuaagauuggcggccaacgccaucuguagugcaguaccaguagauugggugccuacaagucgcacuacguggucaauucaugcucaucaccaauggaugacaaccgaggauaugcucuccguuuggaauaggguauggauugaagaaaaucccuggauggaagacaaaacacacgucaguaguugggaagaagugccuuaccuggguaaaagagaagaccaguggugcgggaguuugauugggcugacagcacgagcgacuugggcaaccaauauacaaguagcgauaaaucaaguaagacgauuaaucgggaaugaaaauuaucucgauuacaugacaaguaugaaaagauuuaaaaacgaaagugauccggaaggagcacuuugguaa

SEQ ID NO: 21105 - RNA, 9879 nt, Artificial Sequence
  derived and/or modified CDS sequence (opt6) from DENV-1__JX669474__SS-prME
uccguuacgaugcuauuaaugcuauuacccacugcuuuagcuuuucaucuaacuacuagagguggugaaccacauaugauugugagcaaacaagaacgugguaagagcuuacuguucaaaacuucugcaggggugaacaugugcacauugauagcaauggacuuaggggaauuaugugaagauacgaugacauauaaaugcccucggaucacagaagcggaaccagaugacguagacugcugguguaaugccacagauacauggguaacguacggaacaugcucacaaacaggagaacaucgaagagacaaacgcucagucgcucuugcaccacacguuggucuaggacuggaaacucgaacagaaacauggaugagcucugaaggggcguggaaacaaauccaaaaaguugaaacaugggcucuaagacaccccggguuuacggugaucgcucuuuucuuggcacaugcgauuggaacaucaauaacgcaaaaagggauuauauuuauccuuuugauguuaguaacgccaucaauggcaaugcgguguguagguauaggaaauagggacuucguagaaggucucagcggugcaacguggguugauguaguacuggaacacgggucauguguuaccacaauggcuaaaaacaaaccaacucuugauaucgaauuacuuaaaacugaaguuacaaaucccgcaguccuaagaaaacuuugcauagaagcgaaaauaagcaacaccacgacugauucaagaugcccuacacaaggagaagcaacccuaguugaagaacaagaugcaaacuuuguaugucgaagaacuuucguggauaggggcugggggaaugguuguggucuguuuggaaaagggucuuuguugacgugcgcaaaauuuaaaugcguaaccaaauuagaaggaaaaauaguacaauaugagaaucuaaaauacagcguaauaguaacaguacacacaggugaccaacaucaaguuggaaaugaaacuacggagcacggcacaauugcuacaaucacuccacaagccccuacaagugaaauucaacuaacggauuauggagcauugacacucgacuguaguccccgcacuggucucgauuucaacgaaauggucuuauuaacaaugaaagagaaaaguuggcugguacacaaacagugguuccuagauuuaccacucccuuggacauccggagcaagcacaucacaagaaacuuggaaucgucaggaccuauuggugacauuuaaaacagcacacgcaaagaaacaagagguaguaguauugggcucgcaagagggagcaaugcacacggcacuaacgggcgccacagaaauccaaacaaguggcaccacuacuauauucgccggacaucuuaaaugcagauuaaaaauggauaaacucacgcucaaagggaugucguacguaaugugcaccggcucguuuaaacuugaaaaagaaguugcagaaacccagcacggaacuguauuaguucagguuaaauacgaaggaacugaugcuccguguaaaauuccuuucucuacacaggacgaaaaaggcgucacacagaauggucgacugauuacagcuaacccgauugucacagacaaggaaaaacccguaaauaucgaaacugaaccaccauucggagaaaguuauauuguugugggugcaggggaaaaagcgcuaaaauuaucaugguuuaagaaaggaucaucaauaggaaaaauguuugaagcgacagcucgaggagcgagacggauggccaucuugggcgacacagcgugggacuuugguuccauagguggcguauuuacuucagugggaaaauuaguucaccaaguguuuggaacggcauauggcguucuuuucaguggaguaucuuggacuaugaagauaggaauaggaauacuccuuacuuggcuaggcuuaaacucuaggaguacuucccuauccaugacguguaucgccgucggaauggucacguuauauuugggaguuaugguucaggcugauagcggaugugucauaaacuggaaaggaagagaguuaaaaugcgguaguggcauauucguaacaaacgaaguacauacauggacagagcaguauaaauuccaagccgacucucccaaaagguugagcgcagcaauuggacgugcaugggaggaaggaguguguggaauuagaucagcaacacgacuugagaauauuauguggaaacaaauuagcaaugaacucaaucauauucuauuggaaaaugacaugaaauuuaccguagugguaggcaacgccaauggaauauuagcgcaagggaagaaaaugauaaaaccgcaaccaauggagcacaaauauucauggaaaucguggggcaaagcuaaaauaauaggcgccgacauacagaacgcuacauuuauaaucgauggacccgauacaccagaguguccagacgaacaaagggcguggaacauaugggaaguagaagauuaugguuuugggauuuuuacuaccaacauauggcuuaaauuaagggauagcuacacacaaaugugcgaucaccgucuuaugagugcggcaaucaaagauucaaaggcagugcaugcagauauggguuauuggauugaaucagagaaaaaugaaaccuggaaauuagcuagagccucguuuauagaaguuaaaacauguauauggccgaagagucauacauuauggucuaaugggguucucgaaucagagaugauaauuccuaagauguauggaggcccaacuucucaacacaauuaccguccggguuacuuuacucagacagcaggaccuuggcaucuaggaaaauuagaacuagacuuugacuuaugugaaggaacaacgguugugguggaugagcacugcgggucuagaggaccaucacuacgaacaacgacaguuacggggaaaauaauacaugaguggugcuguaggaguugcacgcuaccacccuugcguuuucgaggagaggauggaugcugguaugguauggaaauccgcccagugaaagagaaagaagaaaauuuagugcgaucaauggucucagcugggucuggcgaagucgacagcuuuuccuuaggcauacuauguguaaguauaaugauagaagaagugaugagaagccgcuggucccgcaaaauguugaugacagguacacuagcaguauuucuauuacuuauuaugggucaauugacuuggaaugauuuaauaagauugugcauaaugguuggcgcaaaugcuagcgauaaaaugggaauggggacuacguaucuagcuuugauggcgacguucaagaugcggccgauguucgcagugggauuguuauuccgucgguuaacuucacgggaaguauuacuucucacaaucggucuaagccuuguugcaucuguagaacuuccuaauucucuugaagaauugggggacggacuagccaugggcauuaugaugcuaaaacuucuuacugaauuucaaccacaccaguuauggaccacguuauuaagucuuacauuuauuaagacuacacuuucauuagacuaugcuuggaaaacaacugccacgguuuuaucaauugucucauuguuuccccuaugcuugucuacaacaucacagaaaaccacuuggcuacccguauuauuagggucuuucgguuguaaaccgcugaccauguucuuaaucacagaaaaugaaaucuggggccguaaaaguuggccuuugaacgaaggaauuauggccauaggcaucguaucgauacuacuauccagcuuacucaaaaaugauguaccucuugccggucccuuaauugcaggaggaauguuaauugccugcuauguuauaucaggcaguucugccgaccuaucauuggaaaaggccgcggaagucagcugggaagaagaagcggaacauucugguacaagucauaauauccuaguagaaguccaggaugauggcacaaugaaaauuaaggacgaagaaagggacgacacacuuacaauauuauuaaaagccacccuccuagcuaucucgggaguauaucccaugaguauuccggcuacauuguuuguaugguauuuuuggcaaaagaagaaacagagaagugggguccucugggacacaccgaguccuccugaaguugaacgugccguucuugaugaugguauauaucgaauacuacaacgaggauuacucgggcgaucacaaguagguguugggguuuuucaggauggagucuuccacacaauguggcaugucacacgaggugcaguacuaauguaccagggaaagagauuagaaccuuccugggccagugucaagaaagauuuaauaaguuauggaggaggauggcgauuccaggguaguuggaauacuggugaagaagugcagguuauagcgguugagccgggaaagaauccaaagaauguacagacaacaccugguacguucaagacaccggagggugagguuggugcgauagcacuugauuuuaaaccuggaacuucuggaucacccauagucaaccgagagggaaaaaucguuggguuguauggaaacggagucguaacaacuucagguacguacguuagcgcuauagcacaagcaaaggcgucucaggaagggccacuucccgagauagaggaugaaguguuuaagaaaagaaaccugacuaucauggauuugcacccggguucaggcaagacuagaagauaucuaccagcuauugugcgcgaagcaauaaagagaaagcuccggacuuuaauauuagcaccaacuagaguaguagcuagugagauggccgaagcguuaaaggguaugccaauccgauaccaaacgacugcaguaaagucggaacacacgggacgagagauuguugaucugaugugucaugcuacuuucaccaugcgacuguuaucaccagucagaguacccaauuacaauaugaucaucauggaugaagcccauuuuacugaccccgcaucuauagcggcacgaggauacauuucuacacgagucgguaugggugaagccgcugcgauuuuuaugaccgcuacucccccgggaucuguagaagcauuuccacaaagcaaugcuguaauacaagaugaggagagagauauaccagaaaggucauggaacagcgguuacgacuggaucacugauuuuccuggcaaaacaguuugguucguacccucaaucaaaucugguaaugauauagcgaacugucugaggaaaaaugggaaacgcguaauacaguuaucuagaaaaacauucgauacggaauaccaaaagacuaaaaauaaugauugggacuauguuguuacaacagauauaucagaaaugggagccaacuucagagcggaccggguaauagacccuaggcgcugcuuaaaaccuguuauuuuaaaggacgguccagaaagggugaucuuagccggcccaaugccaguaacgguggcuucugcagcccaaagaaggggucgaauagguagaaaccaaaauaaagagggggaccaauacguauauaugggccaaccuuuaaacaaugacgaggaucacgcacauuggacagaagcaaaaauguugcuagacaacauuaauacuccagaagguauaauaccugcgcuguucgaaccggaacgugagaaaagugcagcaauagauggagaguauagauuacgcggagaagccagaaaaacuuuuguagaauuaaugcgccguggggauuuacccguuuggcugaguuauaaaguugccucagaaggguuucaauacucggaucgcagaugguguuuugacggggaacgaaauaaucaaguacuagaggaaaauauggacguagagauuuggacgaaggaaggcgaaaggaagaaacuacgacccagaugguuagacgcacggacuuacucagauccauuggcuuuaagagaauuuaaagaauuugcggcgggacggagaagcguaaguggugauuuaauacuugaaauuggaaaacugccucaacaucugacuuuaagagcucaaaaugcacuugacaaucuaguuauguuacauaacagugaacaagggggaaaggcauaccgucaugcaauggaagaacucccagauacaauagaaacacuaaugcugcuggcacugauagcaguuuuaacgggcggugucacauuauuuuuccucucaggcaaaggguuagguaaaacaucaaucggucuucuauguguaacggccaguagcgcuuuacuuuggauggcaucgguagagccgcacuggauagcggcaucgauuauacuugaguucuuccuaaugguucuuuuaauaccagaaccggauagacaaaggacgccacaagacaaucagcuugcuuauguagucauaggucucuuauuuaugauuuuaacgguugcagcgaaugaaaugggauuguuggagaccacgaagaaagaccuaggaauaggacauguagcagcagaaaaucaucaacacgcuacaauguuagacguagauuugcaucccgcaucagcauggacauuauacgcagucgcuacuacagucauaacaccaaugaugagacauacaaucgaaaacacaacagcaaauauuagcuuaacagcaauagcuaaucaagcugcgauacuaaugggacuagauaaagguuggccaaucucgaaaauggaucuugguguaccgcucuuagcauuaggcugcuauucacaagugaauccacuaacucuuaccgcagcaguucuaauguuaguagcacacuaugcgauaauuggucccggguuacaagcaaaagcgacccgggaagcacagaaaagaacggcugcuggaauaaugaagaacccaacaguagaugggauuguagccauagaucuagauccaguaguuuacgacgcgaaguuugaaaaacaacuagggcagauuaugcuucuaauacuuugcaccagccaaauccuucuuaugcguacaacuugggcauugugugaaaguauaaccuuggcaacaggaccauugacuacauuaugggaagguuccccaggcaaauuuuggaauacgaccauagcuguguccauggcaaauauuuuucggggaucauaccucgccggugcaggauuggcauucuccuuaaugaaaucguuaggaggugggcgccgugggacaggagcgcaaggcgaaacuuugggagagaaguggaaaaggcagcuaaaucaacucucaaaauccgaguucaacacuuauaagcgaucaggcauaauggaaguagacaggagugaggcaaaggaaggacugaagcguggugaaaccacaaaacacgcggugucacgcgguacagcaaaacugcgcugguucguagagcgaaaccuugugaaaccggaggggaagguaauagaccuaggguguggacgugggggauggagcuauuacugugcaggauugaaaaaggugaccgaaguuaaaggauauacaaaaggagggcccggacaugaagaacccauuccuauggccaccuauggauggaauuuggucaagcuacauaguggaaaggauguauucuuuaugccuccagagaagugcgauacguuacucugugacauaggggaaagcagccccaauccaacuauugaggaggguaggacacugagaguacucaaaaugguagagccguggcuuaggggaaaucaguuuuguaucaaaauuuuaaauccuuauaugcccagcguuguugaaaccuuagaacaaaugcagagaaaacacgguggcaugcuaguaagaaauccucugucaagaaauaguacucaugaaauguacuggguuaguugugguacaggaaauauagugucagcgguuaauaugacaaguagaauguuacuaaaccguuuuacaauggcucauaggaaaccuacguaugaacgagaugucgauuuaggagcagguacacggcacguugcaguugaaccugaagucgcuaaccuagauauaauuggacagagaauugaaaacaucaagaaugaacacaaaagcacauggcauuaugaugaagacaauccuuauaaaaccugggccuaucacggcuccuacgaagucaagccauccgguagugcaagcaguaugguuaacggcguaguaagacuacuaacaaaaccaugggauguaauaccaaugguuacgcagauagccaugacagauacuaccccauuuggacaacaaagaguuuucaaagagaaaguagauaccagaacaccucgugcaaagagagguacugcucaaaucauggaaguuacagcaaaauggcuguggggauuuuuaucuagaaauaaaaagccuaggauauguacgagagaagaauuuacgcguaaaguaagaagcaaugcugcuaucggugcgguguuuguagacgagaaucaguggaauagugcaaaagaagcuguggaagacgaaagauuuugggaucuuguccauagagagagagaacuacacaaacagggaaaaugcgcaacgugugucuacaauaugaugggaaagagggagaagaaacuaggcgaguuugggaaggcaaaagggagucgagcuauaugguauaugugguuaggggcccguuuccuggaguucgaagcauuaggauuuaugaacgaagaccauugguuuucaagagaaaauucacuaaguggaguggaaggagaaggacuacacaaacugggauauauauuaagagauauuucaaaaauaccaggugguaauauguacgcagacgauacggcugguugggauacgcgcauaacggaagacgaccuacaaaaugaagcaaaaauuacagacauuauggaaccugaacaugcuuuguuagcuacaucgauuuuuaaguuaaccuaccaaaauaaagucguucgaguucagagaccugcgaagaacggaaccgucauggaugugauuagccgcagagaucaaagagggagcggacaagucggaacauacggacuaaauacguucacgaauauggaaguacaacucauacgacagauggagucagaaggaauauucuuucccagugaacucgaaaguccuaaccuugccgaaagaguccuugauuggcuagaaaaacacggugcagagcgacuuaaacggauggcuauaaguggagaugauuguguuguuaagccaauagaugaccgauucgcuaccgcuuuaauugcacucaacgacauggggaaaguacguaaagacauaccccaaugggagcccuccaaagguuggaaugauuggcaacaaguaccauucuguagccaucauuuucaucaacuuauaaugaaagacggaagagaaauuguaguaccaugucguaaucaagacgagcugguagggagagcccgaguaagccaaggugcuggcuggucacugagagaaacggcaugucugggaaaaucuuaugcgcagauguggcaguuaauguauuuucauagaagagaucucagacuagccgcaaaugcaauauguagugcggugccaguagauuggguaccaacgucccggacgacauggaguauccaugcucaucaccaauggaugacuacagaagauaugcuuucuguauggaauaggguauggauagaagagaaccccuggauggaagacaagacacacguauccagcugggaagaaguuccauaucuaggaaaaagggaagaccaguggugugggucguuaaucggucuaacagccagagcgacaugggccacgaauauacaaguagcaaucaaccaaguaaggagauuaaucgggaacgaaaauuaccuugacuauaugacaucaaugaaacgcuuuaaaaaugagucagacccagaaggagcuuuaugguaa

SEQ ID NO: 21106 - RNA, 9879 nt, Artificial Sequence
  derived and/or modified CDS sequence (opt6) from DENV-1__JX669475__SS-prME
aguguaacuauguuauugaugcuguuaccaacugcuuuggcauuucaucugaccacgcgaggcggggaaccacacaugauuguuagcaaacaagaacgcgguaaaucuuuauuauuuaaaacaagugcuggaguuaauauguguacuuuaauugcuauggaucuuggagaauuaugcgaagauacgaugaccuauaaauguccccgaauuacugaagcggaaccagaugacguugauugcuggugcaacgcaacugauacauggguaacauauggaacgugcucccaaacaggggaacauagaagagauaaacggagcguugcauuagcgccucacguugguuugggguuagagacuaggacagaaaccuggaugaguagcgaaggggcauggaaacaaauacaaaaaguggaaacaugggcauuacgccacccgggauucacaguaaucgcuuuauuucuagcacacgcuaucggaacaucaauuacucaaaaagguauuauauuuauccugcuaaugcuaguaacucccucaauggcgaugcgaugcguaggcauagguaacagggacuuuguagagggacuuucuggagcaacauggguggaugugguauuagagcauggcagcugcgucacaacaauggcgaaaaauaaaccgacauuagacaucgaacuacuaaagacagaaguuaccaaucccgcaguucuacguaagcuauguauagaagcaaagauuagcaauacuacaacugauuccagauguccaacacaaggagaagcaacauuaguagaagaacaagacgcgaacuucguuugucgaaggaccuucgucgaucgugguugggggaacgguugcggccuauucggaaaagguucuuuacuaaccugugcaaaguuuaaaugcguaacaaaauuagagggaaagauugugcaauacgaaaaucuuaaguauaguguuauaguaaccguccauacaggagaccaacaucaagucggaaacgaaacuacagagcauggaacuauagcgaccauaacaccacaagcuccaacaagugagauacaauuaacagacuauggagcguuaacacucgauugcagcccacgaacaggguuagacuuuaaugaaaugguacucuuaaccaugaaggaaaaaucauggcuaguacauaaacaaugguuccuagacuuaccacuaccauggacuucgggugccaguacaucacaagaaacguggaauagacaagaccucuugguaacauucaaaacagcacaugccaagaaacaagagguaguaguguuggguagucaagaaggagcuaugcacacugcucucacaggugcuacugaaauccaaacaaguggaacuacaacgauauucgcagggcauuugaaaugucgguuaaaaauggacaaacuaacacuuaaaggaaccaguuauguaaugugcacggguaguuuuaaauuagaaaaagaaguagcugaaacacaacauggaacaguacuuguucagguaaaguacgaaggaacggacgcccccuguaaaauuccguuuucaacgcaagaugaaaaaggagugacgcaaaaugguaggcuaauaaccgcaaaccccauagugacagacaaagagaaaccagugaauauagagacggaaccacccuuuggagaaaguuauaucgucguuggcgcuggggaaaaagcauugaaacuaaguugguucaagaagggaucuagcauaggaaagauguuugaagcgaccgcaagaggggcuaggagaauggccauauuaggagacaccgcaugggacuuuggguccauaggaggcguguucacuuccguaggaaaacuuguccaccagguauuuggaacugccuacggggugcuauuuagugguguaaguuggacgaugaaaauagguauagggauucuccuuacuuggcuuggauuaaacucgagaagcacgagucuaucaaugacuugcaucgcuguaggaaugguaacauuauacuuggggguaaugguacaagcggauucaggauguguaauaaauuggaaaggucgugaauugaaaugugguucaggaauauuuguaacgaaugagguacauacauggacggaacaauauaaguuucaagcagauagcccaaaacgauuaagugccgcaauagguaaggcaugggaggaaggugucugcggcauaagaagcgcuacacgucuggagaauauuauguggaagcaaauaucgaaugaguuaaaccauauauuacucgagaaugacaucaaauuuacagucguaguuggaaacgcaaaugguauacucgcucaaggaaagaaaaugaucagaccucaacccauggagcacaaauauucauggaaaaguuggggcaaagcuaaaauuauaggugcugauauacagaacacaacuuuuauuauugauggaccagauacgccugagugccccgaugaacagcgcgcauggaauaucugggaaguagaagauuacggauuugguauauucacuacaaauauauggcucaaacuuagggacucauauacacaaaugugcgaucauagauuaaugagugcagcgauuaaagauucuaaggcaguacacgcggacauggguuauuggauagagucagagaaaaaugagacauggaagcuggcacgggcuucuuuuauagagguuaaaacaugcauauggcccaaaagccacacccuauggucuaacggcguucuugagucagagaugaucauacccaaaauguacggaggcccuauuagucaacauaacuaucgaccuggauauuuuacgcaaacagcugggccguggcauuugggaaaacuugaauuagacuucgauuugugcgaaggaacaacagucguaguugaugaacacuguggcaguagaggacccucacuaaggacgacaaccgucacaggcaagauaauacaugaaugguguugccggagcuguacacuaccaccccugagauuucguggagaagaugggugcugguauggaauggagauuagaccaguaaaggaaaaagaagaaaauuugguuagaagcauggugagcgccggauccggggaaguagauaguuuuagucuaggaauacuuugcguaucgauaaugauagaagaaguaaugagaucacgauggucuaggaaaaugcuaaugacaggcacacuagcaguauuuuuauuauuaauaaugggucaguuaacauggaaugacuuaaucagacuauguauaaugguuggggcgaacgcaagugauaaaauggggauggguaccaccuaccuggcauugauggcgacuuucaagaugaggccgauguucgcuguaggacuuaguuucagaagguugacaucacgggagguauuacuccuaacaauugggcucagucuaguagcuucuguagaacuaccaaacagcuuagaggaauugggcgaugguuuagcuauggggauuaugauguugaaauuguugaccgaauuucaaccacaccagcuauggacaacuuuguuaucauuaaccuuuauaaaaacuacauugucauuagauuaugcguggaaaacaaccgcuaugguauuaucuauagucucccucuucccucucugccuaucaacgaccucacagaaaaccacguggcuacccguucuacugggaucguucggauguaagccacuuacaauguuucuaauaacggaaaacgaaauaugggggcguaaaucauggccauuaaaugaagguauaauggcuauagggauaguuucuaucuugcugucuagucuacugaaaaaugauguaccauuagcaggcccgcuuauagcgggaggcauguugauugcaugcuauguaauaagugggucuucugccgaccucucucucgaaaaagcugcagaggugagcugggaagaagaagcggaacauaguggaacaucacacaauauucuggucgaaguacaagacgauggcacaaugaagauaaaggacgaagaacgagaugauacauuaacgauacuacuuaaagcaacucuacuagcuguuaguggaguauauccgaugucgauccccgcaacguuauucgugugguacuuuuggcaaaagaagaaacaacgaucuggugugcuaugggauacgcccucuccaccugaaguagagcgagcaguuuuggaugauggaaucuaucggauuuuacaacguggauugcugggaagaucccagguagggguagggguguuccaggacgggguguuucauacaauguggcauguuacacgaggagcuguucuuauguaccaagguaaacgccuugagcccagcugggcaucggugaagaaagacuuaaucagcuauggagguggauggcguuuucaaggaucuuggaauaccggugaagaaguacaggucauugcugucgaaccugggaaaaauccgaagaacgugcaaacaacaccaggaacuuucaaaacuccagaaggagaagucggagcaauagcgcuagacuucaaaccaggcacgucagguagcccaauuguaaauagggaagguaagauagucggucuauaugguaaugggguuguaacgacuucuggcacauaugugagugcuaucgcacaagcaaaggcuucgcaagaagggccccugccugaaaucgaagaugaaguauucagaaaacgaaaucuaacuauuauggaccuucauccagguaguggaaaaacccgccgauauuuacccgcuauaguaagggaagcuauuaagagaaaauuacggacucuaauacucgcgccuacuagaguaguagccucugagauggcagaggcauuaaaggggaugccgauaagguaucaaacaacagcugucaaauccgagcauacgggccgagagauaguggaccuaaugugccaugcgacguuuacaaugcgucuauuaucucccguucgaguaccuaauuauaacaugauaauuauggaugaagcucauuuuacugaucccgcaucaauagcagcuaggggauacauuaguacuagaguaggcaugggagaagcagcagcaauuuucaugaccgcuacgccuccuggcucuguagaggcuuucccacaauccaaugcagucauacaggaugaagaacgagacauuccagaacgaucuuggaacuccggauacgacuggauuacggauuuccccggaaaaacaguaugguucguaccaucaauuaagucgggcaaugacauagccaauugcuuacgcaaaaaugggaaaagagugauacaacuuucaaggaaaacauuugacacugaauaucagaaaaccaagaacaacgauugggauuacguagugacuacugacauaagcgaaaugggcgcuaacuuucgggcugauagagugauagauccucgacgauguuugaagccggucauauuaaaagauggaccugaacggguaauauuagccgguccuaugccugucacaguggcuucggcugcucagaggcgaggaagaaucggaagaaaucagaacaaggaaggggaccaauauguauacaugggacaaccuuuaaacaacgaugaggaccacgcucacuggaccgaggcuaaaauguuauuggauaacaucaacacuccugagggaauaauacccgcacuuuuugagcccgaaagggaaaaaucugcagcaaucgauggagaauaccggcuuaggggcgaagcucgaaaaaccuucguugagcugaugagaagaggcgaccuuccuguaugguuaagcuauaagguugccuccgaagguuuccaauacucagacagaagauggugcuucgacggagagagaaacaaucaaguauuggaagaaaauauggaugucgaaauauggacaaaggagggggagaggaagaaacugcguccccgaugguuagaugcaaggaccuacucagauccauuagcguugagagaauuuaaagaauuugcagcaggcagacgaagcguuucaggcgaccugauuuuggaaauagguaaauugccacaacauuuaacacucagagcgcagaaugcacuagacaaucugguaauguuacacaacagcgagcaaggagggaaagccuauagacaugcuauggaggaacuaccugacacaauugaaacauuaaugcuuuuggcuuuaauagcgguucuuacaggaggaguaacucuguucuuucucucaggaaaaggauuaggaaaaaccaguauaggccuacuuugcgucacagcuaguagugcccugcuauggauggccucaguagaaccacauuggaucgcugcuucuauuauauuggaguucuucuuaaugguucuguugauuccagaaccugaucgacaacguacgccccaggacaaccaguuagcuuaugugguaauagguuuguuauuuaugauacugacggucgcagccaaugaaauggggcuauuagagaccacuaaaaaggacuuagguauugggcacguagcugcagaaaaccaucaacaugccacaauguuagauguugaccuacacccggcaucagccuggacuuuauaugcuguugccaccacaguaauuacgcccaugaugagacacacgauugaaaauacaacugccaacaucucucuaacggccauugcuaaccaagcagccauacuuaugggguuagauaaaggauggccaaucagcaaaauggaucucgguguaccauuauuggccuugggguguuauagccaagucaauccauuaacgcuuaccgcugccguacuaauguuggucgcacauuaugcaauaauugggccuggucuacaggcgaaagcuacacgagaagcucagaagcgaacagcagcgggaauuaugaaaaauccaacaguugacggcaucgucgcgauagaucuggaucccguagucuacgaugcuaaauucgaaaaacaacuaggacaaauaaugcuucuuauauuauguaccagccaaaucuuacuuaugcgaacuacgugggccuuaugcgaaaguauaacacucgcuacagguccauugacuacuuuaugggaggggucacccggcaaauuuuggaacacaaccauagcaguaaguauggcaaauauuuuuagagguucuuauuuggccggugcuggacuggccuuuucauuaaugaaaaguuugggcgguggaaggcgugguacaggggcucaaggagagacauuaggagaaaaguggaaacggcaacugaaucaacuguccaagagugaauuuaacaccuauaagaggagugguauaauggaagucgacagaagugaagcuaaagaaggucugaaaagaggggaaacaacuaaacaugcaguaucgcgagguacagccaaacuacgaugguuuguagagcggaaccuagugaaaccugaagggaaggucaucgaucucgguuguggcagaggcggguggaguuacuacugugcaggacuuaagaaggucacggaagucaaaggcuacacuaaagguggaccaggacacgaagaaccuauuccuauggcaacauacggauggaauuuaguuaaauuacacucagguaaggauguauuuuucaugccgccugaaaaaugugacacacugcuuugugauauuggagaaucaaguccuaauccaacuauagaagagggacgcacacugcgcgugcuuaaaaugguagaaccuugguuaaggggaaaucaauucugcauaaaaauacuaaauccauauaugccaagugucgucgaaacuuuagaacaaaugcagagaaagcauggagggaugcuugucagaaauccuuuaucacguaauagcacccacgaaauguauuggguauccuguggcaccgguaacauaguaucugcagucaacaugacaucgcgcauguuacuaaaucgauuuacuauggcucaucgcaaaccuacauacgaaagagauguagauuuaggugcaggaacaagacacguagcgguggaaccagaaguagcaaauuuggauaucauuggacaacgaauagagaauauuaagaaugaacacaagucuaccuggcacuacgacgaagauaauccuuacaaaacaugggcguaucacggaucauaugaggugaagccuagcggaagcgccucaagcaugguaaaugguguaguucgauugcuuacuaaaccuugggauguaauacccaugguaacucagauagccaugacugauacuacccccuucggccaacaacgagucuucaaagaaaaaguagacacgcgaacgcccagagcaaaaagagguacugcacagauaauggagguaacugcuaaaugguuauggggauuccuaaguagaaauaagaaaccaaggauaugcacccgggaagaguucacccgaaagguacguagcaaugcggcaaucggggcuguauuuguagacgaaaaucaauggaacuccgcuaaagaggcuguagaggaugaacgcuuuugggaucuaguucauagggaaagggaacugcauaaacaagguaaaugcgcuaccuguguguauaauaugaugggaaagagggagaagaaacuuggagaguuugggaaagccaagggaagcagagcgauaugguacaugugguuaggugcgcgcuucuuagaguucgaagcauuaggauucaugaacgaggaccauugguuuucccgagaaaauucucuaucgggaguagaaggugaaggacuucacaaacucgguuauauacuaagagauaucagcaagauaccaggaggaaacauguacgcugaugacacagcugggugggacacaagaauaacagaggacgaccuccaaaaugaagcuaagauuacagacauuauggaaccagaacaugcauuacuagccacaaguauauuuaagcugacuuaccaaaacaaagugguaagaguacagagaccagccaaaaauggcacugucauggauguaauaucuaggagagaccaaagaggaaguggacaaguagguacguacgggcuuaacacuuuuacaaauauggaaguucaacuuauucgacaaauggagucagagggaauauucuuuccaucagaauuagaaucccccaaucuugcagagcgaguuuuagacugguuagaaaaacacggggcagaaagacuuaaacguauggcaauuaguggagacgauugcguggucaaaccaauugacgauagguuugcaaccgcguugauugcgcuaaacgacauggguaagguaagaaaagauauuccacagugggaaccgucuaagggauggaaugauuggcagcaaguacccuuuuguagccaccacuuccaucaacuuauaaugaaagauggaagagaaauuguuguaccgugucgaaaucaagaugagcuaguugggagagcuagaguaucucagggagcuggauggagucuccgggagacugcauguuuaggaaaaaguuacgcacagauguggcaacuuauguauuuccaucguagagacuugcggcuggcagcaaacgccauaugcucagccguccccguagacuggguaccaacaagcaggacgacguggucaauucaugcacaucaccaguggaugacaacagaggauauguugucugucuggaauagaguuuggauagaagaaaacccuuggauggaggacaagacccaugucucuucgugggaagaagucccuuaccuagguaaacgugaagaccagugguguggcuccuuaauagguuuaacagcgcgugcaacaugggcgacaaacauucaaguagcuauuaaucaaguacguagacuaauaggaaaugaaaacuaucuagauuacaugaccucaaugaaacgauucaaaaacgaaagugaucccgaaggugcucuuugguga

SEQ ID NO: 21107 - RNA, 9879 nt, Artificial Sequence
  derived and/or modified CDS sequence (opt6) from DENV-1__JX669461__SS-prME
aguguaacaauguuacuuaugcuauuacccacugcacuagcauuucauuugacgacacgagggggugaaccacauaugauaguaaguaaacaagaacgaggaaaaaguuugcuuuuuaaaacaaguguaggaguaaauaugugcacacugauugcaauggacuuaggagaacuaugugaagauaccaugacguacaaauguccgagaauaacggaagcggaacccgacgauguagacuguugguguaacgcaacagauacauggguaaccuacgggaccugcucacaaacuggugaacacagacgugauaaacgaucuguagcgcucgcuccccauguaggacucggauuagaaacuagaaccgagacguggaugagcuccgaaggagcauggaaacaaauucaaaaaguugaaacuugggcgcuaaggcauccagguuuuacaguuauagcacuguuuuuagcacacgcaauagguacuagcaucacgcaaaaaggaauuauuuuuauauugcuaaugcuaguaacaccaucaauggcgaugcgaugcgugggaauugguaacagagacuucguugaaggucuuucgggugcaacuuggguagaugucguacuagaacauggaucauguguaacaaccauggccaaaaauaaaccgacguuggacauagaauugcucaaaacugaaguaacuaauccagcugucuuacgcaaacuaugcauugaagcuaaaauauccaauacaacaacugauaguaggugcccgacgcaaggugaagcaacucugguugaagaacaggacgcaaauuucgucugcagacgaacguuugucgaccgaggaugggguaacgguuguggucuauucggcaaaggaagccuguugacgugcgcaaaauuuaaaugcguaacaaaacuggaagguaaaauaguucaauacgaaaauuuaaaauacucagugaucguaacaguacacaccggcgaccaacaccaaguaggcaacgaaacuacagaacacggaacaauagcaacaauaacaccacaagcgccgaccagcgaaauacaacugacugauuacggagcguugacacuugacuguaguccucguacggguuuagauuuuaaugaaaugguguuauugacuaugaaagagaaaaguuggcuuguucauaaacagugguucuuagauuuaccguuaccauggacaagcggagcaagcacgucacaagaaacauggaacagacaagaccuacuuguaacuuuuaaaacugcacacgccaagaaacaagaaguuguuguauugggaucccaagaaggcgcgaugcauacagcucugacaggagcaacagaaauucaaacuucaggcaccacuacaauauucgcuggucaccuaaaaugucguuuaaaaauggauaaauuaacucugaaagggaugucuuauguuauguguaccgguaguuucaaauuagaaaaagaaguagcagaaacacagcauggaaccguuuugguacaaguaaaauaugaagguacagaugcuccaugcaaaauaccauuccugacucaagaugaaaaaggugucacacaaaacggacgacuaaucacggcaaauccuauaguaacggauaaagagaaaccagucaauauugagacugaaccaccuuuuggggaauccuauauuguaguaggagcaggggaaaaagcccuaaaacuuaguugguuuaagaaaggcucuagcauuggaaaaauguuugaggcuacagcaagaggagcacgaagaauggcaauucuuggcgauacugccugggacuuuggaaguauaggaggauuauuuacaucuguugggaaacucauucaucaaguuuuugggacugcuuaugguguuuuauucaguggcguaaguuggacuaugaaaaucggaaucgggauucuacugacuuggcuuggcuuaaauucaagauccacuucccuaucuaugacaugcaucgcuguaggaaugguaacauuauaucucggaguaaugguacaagccgauucaggcuguguuauaaauuggaaagguagggaacucaaaugcgguuccggaaucuuugugacuaacgaagugcauacauggaccgaacaauacaaauuccaggcagacucccccaaaagauuaucggcggccauaggaaaagcaugggaggagggcgucugcgguauaagaucagcgacaaggcuagaaaauauaauguggaaacaaauaucgaacgaguuaaacuacauccuccucgaaaaugauaugaaauucacagugguaguaggcgacguaaacggcauauuagcccaggguaagaaaaugauacgcccucaaccuauggaacauaaauauucauggaaaagcugggguaaagccaaaaucauaggcgccgacauacagaauacaacguucauaauagauggaccagauacaccggaauguccagacgaucaaagagcuuggaauauaugggagguggaggauuacggguucggaauauucaccaccaacauuuggcuaaaacuuagggauucgcacacccaaaugugcgaccauagacuaauguccgcagcaaucaaagauucaaaagcggugcaugcagacaugggguauuggauugaaagcgagaaaaaugaaaccuggaaacuggcaagagccagcuuuauagaaguuaaaacaugcauuuggcccaaaucacauacgcuaugguccaauggugucuuagaaucugagaugguuauacccaaaauauauggugguccgaucucacaacacaacuacagaccaggauacuuuacacagaccgccggaccguggcacuuagggaaacuagaacuagacuucgaccucugugagggaacaacgguggucguggacgaacauugcggauaucgcggaccauccuuaaggacuacgacuguaacugguaaaauaauccaugaaugguguugccgcaguuguacacucccaccguuacgcuuucggggagaagacggcugcugguacggaauggaaauccgacccgucaaagaaaaagaagaaaacuuaguacgaaguaugguuucagccggaucaggggaaauggacuccuucucccuagggauccuuugugucucgauauuaauagaagaaguaaugagaucuagguggucccgcaaaaugcuaaugacagguacacuagcagucuuccuguuacuaauuaugggccaguugaccuggaaugauuuaauuagacuuuguaucauggugggugcaaacgcaagcgauaaaauggggauggggacaacauacuuggcuuuaauggcuacguuaaaaaugcggccuauguuugcagugggacuuuuauuccggagacuaaccagucgugaagugcuacuguuaacggugggacuaaguuuaguugccaguguagaacuuccaaauagucuagaagaauuaggcgacggauuagcaaugggaauuaugauguuaaaacuauuaaccgauuuccaaccucaucaauuauggaccacguuauuaucuuuaacuuuuauacguaccagucuaucauuagauuacgccuggaaaacaauggcuauggcauugaguauaguaucuuuguuuccauuguguuuaagcacuacgucgcagaaaacuaccuggcuccccguucucuuaggcucauuuggcuguaaaccgcucacuauguuucucauuacagaaaauaaaauuuggggacgaaaaaguuggccaauaaacgaggguauaauggcagucggcauugucucaauccuccugucuucacugcuuaaaaacgacguaccgcucgcuggaccuuugaucgccgguggaaugcuaauagcauguuacguaauaucugggagcagugcagaucucucucuugagaaagcagcagaagucucgugggaagaagaagcugaacauucagggaccucccauaacaucuuaguagaaguucaagacgacggaacgaugaagauaaaagacgaggagagagaugacacauuaacaauacuacugaaagcaacuuuacuagcugugucagguguauacccuaugucuaucccugcuacauuauucguaugguauuucuggcagaagaagaaacaacgaucgggugugcuuugggauacaccuaguccaccagaaguagaacgugcagucuuagacgacggaauauaccgaauacugcaacgggguuuauuaggccggucccaagucggaguugggguauuccaggacggaguauuucauaccauguggcacgugacacggggugccguucuaauguaccaaggcaaacgauuagaaccgagcugggcuucugucaagaaagauuugauuucuuauggcggaggguggcgcuuucagggaucuuggaauacaggagaagaaguacaagucauagcuguagaaccaggcaaaaaucccaaaaacgugcagacuacaccagggacuuucaaaacgccggagggcgaaguuggcgcuauugcccucgauuucaaacccgggacaucagggaguccaauaguaaaccgggaaggaaaaauuguaggauuguacggaaauggaguuguaacaacaucuggaacauauguauccgcuaucgcucaggccaaggcuacgcaagaagggccucuuccugaaauugaagacgaagucuuuaagaagcggaaucuaacgauaauggauuuacauccgggaucaggaaaaacgcgaagguauuuaccagcuauaguuagagaagcuauaaaacgaaaacuuagaacauuaauacucgcuccgacucgagucguugcuagugaaauggcugaagcacugaagggcaugccaauacguuaccaaacuacggcaguuaaaucagaacauaccgguagggagaucguggaucugaugugucaugccacuuuuacuaugaggcuccugaguccaguacgggucccaaauuauaauaugaucauuauggacgaggcacacuuuacugauccugcaagcauugcagccagagguuacauaaguacucgcguaggcaugggagaagcagcagccauuuuuaugacagcaacgccuccagguagcguggaagccuucccgcaauccaaugcugucauucaagacgaagaaagagacaucccugaaaggucguggaacucugguuacgauuggauuacggauuucccggguaagacaguaugguucgugccuaguauuaaaaguggcaacgacauagcuaacugucucaggaaaaaugggaagagagugauucaacugucaaggaaaacauucgacacugaauaucagaaaaccaaaaacaacgauugggacuacguaguaacgacagauaucagugaaaugggagccaauuucagagcggaucgaguuauagacccaagacgguguuuaaagccaguaauacuaaaagaagguccagaaagggucaucuuagcugguccaaugcccguaacuguggcauccgcggcacaaagaagaggaagaaucgguaggaaccaaaauaaagaaggcgaccaauacauauauaugggucaaccacugaacaaugaugaagaccaugcccauuggacagaagcaaagaugcuacuugauaauauuaacaccccagaagguauuauaccugcccuauuugaaccugaaagagaaaaaucugcugcuaucgauggcgaauaucgacuaagaggagaagcacgaaagacauuugucgagcugaugagacgaggagaucucccagucugguuaagcuauaagguugcuucagaaggcuuucaauacucggauagaagauggugcuuugauggcgaaagaaauaaccaaguauuagaggaaaauauggauguagaaauauggacaaaagaaggagagcggaagaaacugcgaccucguuggcuagacgcgagaacuuacuccgacccacucgcuuuaagagaauuuaaggaguuugccgcaggaaggagaaguguuucaggagaucugauacuagaaauuggaaagcuaccucagcaccuaacacuacgugcucagaacgcauuagauaacuuagucaugcuucauaauagcgaacaaggagggaaggcauaucgacacgcuauggaagaacuuccggauacuauagagacacugaugcuacuggcguuaauagcuguauuaacugguggcgucacauuauucuuucuuagcgguaagggauuaggcaaaaccagcauaggacuacuauguguuauggcaucuagugcauuacuauggauggcaucgguagaaccccauuggauagcugcuucgauaaucuuagaguuuuuccugaugguucuacuaaucccagaacccgauagacagagaacaccacaagacaaucaguuagcauacguaguuauagguuuacucuucaugauacugacaguugcagcaaaugaaaugggacuacuagagacaaccaagaaagaccuggggauaggucauguagcugucgagaaucaucaccaugcgacgauguuggauguagaucugcggccagcuucagcauggacccuauacgcaguugcuacgacaguaauuacaccuaugaugcgacacaccauugaaaauacuacggcuaauauaucgcuaacagcuauagcaaaucaagcagcuauucugaugggucuugacaaagguuggccgauaucaaaaauggauauaggcguuccguugcuagcacucggauguuacagucaaguaaauccuuuaacauuaaccgcagcggucuuaauguuaguugcacacuaugcaauaauagguccuggauuacaagccaaagccacucgagaggcacaaaagaggaccgccgcaggaauuaugaaaaaccccacgguagauggaauuguaacuaucgauuuagauccuguaguguacgacgcuaaauucgaaaaacaguuaggucaaauuaugcuguugauacucugcacaucgcagauccuucucaugcggacaacaugggcucuaugugaaaguauaacguuagcaacaggaccucugacuacacucugggagggaucucccgguaaauuuuggaacaccacgauagccguaucuauggcaaauauauucagaggcaguuaccuugcaggcgcuggucuugcuuuuucacuaaugaagagucugggugguggacgucgcgggacaggggcgcaaggugaaacacuaggugaaaaguggaaaagacaauuaaaccaacuuuccaaaucagaguuuaacacuuacaagaaaagugggauaauggaaguagauagaucugaagccaaagaggggcuuaaacggggagaaacuacaaaacacgcaguuaguagagguacggcuaaacuccguugguucguagagaggaaucuagugaaaccagaagguaaaguuauagaucuagguugcgggaggggagguuggaguuauuauugugcaggacuaaagaaagucaccgaagugaagggauauacgaaaggagggccuggacaugaggaaccgauaccgauggcgacguauggauggaaucucguuaaguuacauucaggcaaggaugucuucuuuacuccgccugaaaaaugcgacaccuuguuaugugauauaggugaauccagcccgaauccgacgaucgaggaaggaagaacucuacgaguuuuaaagaugguagagccauggcucagaggaaaccaauuuuguaucaaaauacucaauccauacaugcccucaguaguagaaacucuagagcaaaugcaaagaaaacacgguggaaugcuuguaagaaauccacuaucaagaaacaguacacaugaaauguauugggugaguuguggaaccggaaauaucguaucggcugucaauaugacaucaagaaugcuacuaaauagauuuacaauggcgcaucgaaagccaacauacgaacgagauguggaucuuggagcuggaacacgacauguggccguagagccagaaguggcaaacuuggacauaaucggccagagaauagagaauauuaaaaaugaacacaaaucuaccuggcauuaugacgaggacaaucccuauaagacaugggcauaucauggaucauacgaggucaaaccaucaggaagugcaucaucaaugguuaauggcgugguacgacucuuaaccaaaccuugggacguaauaccaauggugacacaaauagcaaugacagacacuacacccuucggacaacaaagagucuuuaaggaaaagguagacacacgaacuccuagagcaaagcgcggcacugcacaaauuauggaaguuaccgcaaaauggcuauggggcuuccucagcagaaauaagaaaccacgaauauguacaagagaggaguucacacguaaaguaaggucaaacgcugcuauaggggcuguauuuguagaugagaaucaauggaacucagcaaaagaagccguugaagaugaaagauucugggaucuugugcaccgcgaacgggaauugcauaaacaaggcaaaugugcaacaugcguuuacaacaugaugggaaaacgagagaagaaacuaggcgaauuugguaaagcaaaagggucucgagccaucugguauaugugguuaggagcucgauuccuugaguucgaggcuuuaggauucaugaacgaagaccacugguucagucgugagaauagccucucagguguagagggagaaggucuacacaaacuuggguauauacuacgcgauaucucgaaaauaccaggcgguaauauguaugcugacgauaccgcaggcugggauacacgaauuacagaagaugaccuacagaaugaggcuaagauuacugauauuauggaaccagaacaugcccuauuagcgacuucgaucuuuaagcucacauaccaaaauaaagucguuagaguacaaagaccagcaaaaucaggcacgguaauggacgucauuucaagaagggaucaaagagguaguggccaaguuggaaccuacgguuuaaauacuuuuacaaauauggaaguucaguuaauaaggcaaauggaaucugaaggaaucuuuagcccaagcgaacuugaaacaccgaauuuggcuaagaaaguauuagauuggcuagaaaaacauggugcggaaagauugaaacggauggcuaucucaggagacgauuguguaguaaagcccauagacgauagguuugcaacagcucugacugcucuaaaugauauggggaaggugaggaaagauauuccucaaugggaaccgagcaaaggauggaacgauuggcaacagguuccauuuugcagucaccauuuucaccaacuuauuaugaaggacggaagggaaauaguagucccuugucgaaaccaggacgaguuaguaggacgcgcaaggguaagucaaggagcaggguggaguuuacgugaaacugcaugucuuggaaagaguuaugcacaaauguggcaauuaauguauuuucaucgacgcgauuugcgacuagcagcaaacgccauaugcagcgcgguacccguugauugggucccaaccaguaggacaacguggucaauucaugcccaucaccaauggaugacgaccgaagacaugcugaguguguggaauagaguguggauagaagaaaauccguggauggaagacaagacccauguaucgucaugggaagaagugccuuaucucgggaaacgggaagaccaguggugcgguucauugauugguuuaaccgcacgcgcuacgugggcuacuaauauccaagucgcaauaaaccaaguaagacgucugauaggcaaugaaaauuaucucgauuacaugacaagcaugaaaagguucaagaaugaaagcgacccggagggagcguuaugguaa

SEQ ID NO: 21108 - RNA, 9879 nt, Artificial Sequence
  derived and/or modified CDS sequence (opt6) from DENV-1__KF184975__SS-prME
aguguaaccaugcuucuaauguuaaugccgacugcuuuagcauuucauuuaacuacaagagguggagaaccccacaugauaguuucaaaacaagaacgggguaaaucgcuacuuuuuaaaacgucugcgggagugaauaugugcacauuaauagcaauggaucugggagaacuaugcgaagacaccaugacauauaaaugcccccgaauuacugaagccgaaccagaugauguagacuguuggugcaaugccacggacacauggguaacuuaugggaccugcucacaaaccggugaacacagaagggauaaaaggagugucgcucuagcuccgcaugugggauuaggucuggaaacuagaacggaaacuuggauguccagcgaaggugcuuggaaacaaauacaacgugucgaaacaugggcauuacgucaccccggguuuaccguaaucgcuuuauucuuggcacaugcaaucgguaccucaauuacccaaaaagguauuauauuuauuuuguuaaugcugguaacaccaucaauggccaugcguuguguagggaucgggucgagggauuuuguugaaggucuauccggagcaacuuggguagacguuguacuugaacacgguucauguguuacaacuauggcaaaagauaaaccaacuuuggacaucgaacuauuaaaaacugaaguaaccaaucccgcuguccuacgcaaacuuuguauagaagcaaaaauuucaaauacgacgacagacaguagauguccgacccaaggagaggcaacacuugucgaggagcaagaugcaaauuuuguuugucgucgaacguuuguggacagaggaugggguaacggaugcggauuauuuggaaaaggaagucuacucacaugcgcaaaauucaaauguguaacgaaacuggaaggaaagauaguacaauacgagaauuuaaaauacuccguaauuguaacgguccauacagaagaucaacaucaggugggaaacgaaacaacugaacauggaacaauagccacaaucacaccccaagcuccaacgucugagauacaguuaacggacuauggugcuuuaacacuagacuguaguccuagaacagggcuggacuuuaaugaaaugguucuucuaaccaugaaagagaaaaguuggcugguacacaaacaaugguuucuagauuuaccauugcccuggaccucaggagcuucaaccagccaagaaacauggaaucgccaagauuuacucgucacauuuaaaaccgcacacgcaaagaaacaagaaguaguaguauuaggaagucaagaaggagcaaugcacacugcauuaaccggagcuacagaaauucagaccagcggaacaacaacaauuuuugcaggacaccuaaaaugucgccuaaaaauggacaaacucaccuugaaagguaugaguuauguuauguguacgggcagcuuuaaauuagaaaaagaaguagccgagacacaacauggaacaguucugguacaaguuaaauacgaagguacggaugcaccaugcaagauuccuuuuucaauacaagaugagaaaggaguaauacaaaacgguagguugauaaccgcuaacccgauugugacugacaaggaaaaacccguaaauaucgaaacggaaccucccuucggggaaagcuacauugugguaggggccggagaaaagacacuaaagcuaaguugguuuaagaaaggcucuaguaucggaaagauguucgaagcaacagcacgcggagcccgaaggauggcaauauuaggugauacggcaugggauuuugggucaauaggaggcguuuucaccuccguaggcaagcucguacaccagguauuuggaacagcguacggaguacuauucagugguguuaguuggaccaugaagauagggauuggaauacuuuuaacgugguuaggacuaaacagcagaucgacaucacuaucaaugacauguauagcaguggggaugguaaccuuauaucuuggugucaugguucaagccgauaguggaugcgugaucaacuggaaaggaagagaacucaaaugugguucuggaauauucgucacaaaugaaguacauacauggacugaacaauauaaauuucaagccgacaguccuaaaagacuauccgcugcgauuggcaaggcgugggaagaaggugugugcggaauuagaucagcuacuagauuagaaaauguuauguggaaacaaaucagcaaugaacuaaaucacauauuacuagagaacgauaugaaauuuacagugguaguaggugacguuaauggcauucuagcacaaggaaagaaaaugguacguccccagccaauggagcauaaauacuccuggaaaaguuggggaaaagccaaaauaauaggugccgauauucaaaacacuacuuucauaaucgaugguccagacacaccugaauguccugacgaucagcgggcauggaacauaugggaaguugaggacuauggauuuggcauauuuaccacuaauauauggcuaaaauuaagggauaguuauacgcaaaugugcgaccauaggcugaugagugcggcgauaaaagauaguaaagcgguacaugccgacauggguuauuggauagaaagugagaaaaaugaaacguggaagcuagcaagagcuucauuuauugaagucaagacauguaucuggccaaaaucacauacauuaugguccaacggaguauuagaaagugaaaugauaauaccuaagauuuauggaggacccacuucacaacacaauuauagaccuggcuacuuuacacaaacugcggggccuuggcaucuuggcaaacuggaacuagacuuugaucuuugugaagguacaaccguaguggucgaugagcacugcgguaaucgagggccauccuuacgaacuacuacggucacugggaaaauaauucacgaaugguguugccgaagcugcacacuaccaccauuaagauucaaaggagaggacggauguugguauggaauggaaauaagaccuguaaaggaaaaagaggaaaaccuaguaagaucgaugguguccgcuggauccggagagguagauaacuuuagcuuaggcuuguuaugcgucuccauaaugguugaagaaguaaugaggucccgauggaguagaaaaaugcuuaugacugggacacucgcagucuuuuuauuguugauaaugggucaguugacguggaacgaccuuauacgauuauguauuaugguaggugcaaacgcuucugaucgaaugggaauggguacgacuuaucuugcacuaauggcgacauucaaaaugagaccuauguuugcugugggacuauuguuuagacguuuaacuucuagggaaguucuacugcugacaaucggacuuucccucguugcauccguugaacuuccuaauucguuagaagaauuaggugauggauuggcgaugggaauaaugauguugaaauuacuuacugauuuucaaagucaccaacuuuggacaacucuucucagcuuaacauucgucaaaacgacacuaagucuagauuaugcuuggaaaacaauggcuauggugcucucgauuguaagccuauuuccacuaugcuuauccacaacuucccagaaaaccacguggcucccggugcuauuaggcagcuucgguuguaagccguugacuauguuccugauaaccgaaaauaaaauuugggggagaaaaagcuggccccuaaaugaaggcaucauggcuguaggaauugcaagcauccuauugucaucucuacucaaaaacgaugugccguuagcuggaccacucauugcugggggaauguugauagccugcuauguaauaagcgguucgucagcagaccucagcuuggaaaaagcagcagaaguuagcugggaagaagaggcagaacacucuggugccagccauaauauccuaguugagguucaagacgauggaacgaugaaaauaaaggaugaagagagggaugacacuuuaaccauauuguugaaagcaacacuacuggccguauccgguguauaccccaugucuauaccagcuaccuuauuugucugguauuuuuggcagaagaagaaacaaagaagcgggguccuaugggacaccccuaguccaccugaagcugagaaggcaguucuagacgauggcauauauaggauucuucaacgaggucuucucggacgaagucaagucggaguuggagucuuccaagacggcgucuuccauacuauguggcauguuacacguggggcaguccuuauguaucaagguaaaagggucgagccaucaugggcauccguaaagaaagaccuaauuucguauggaggugguuggcguuuucaagguuuauggaauacuggggaggaaguacaagucauagcgguugaaccgggcaaaaauccucgaaacguacaaaccacucccgggacauucaaaacacccgagggugaagucggcgcaauagccuuagauuucaaaccaggaacaagcggaucuccaauaguaaaccgagagggcaaaauaguuggacuuuacggaaacggcguagugacuacgagcggcacuuauguuucagccauugcacaagcaaaggcuucacaagaggguccacuuccagagaucgaagaugagguauuccgcaaacgaaauuuaacuauaauggaccuacauccgggcucuggcaaaacaagaagguacuuaccagcaauagugagggaagcuauaaagagaaaauuacgcacucuaauccucgccccaacacgaguuguugccucggaaauggcagaggcuuuaaaggguaugccaauucgguaucaaacaaccgccgucaagacugagcauacuggccgagaaauaguagacuugaugugccaugcaacauuuacgaugagguugcuaucgccuguaagaguaccuaauuauaauaugauuauaauggaugaagcccacuuuacagacccagccuccauagcugcgcgcggauauaucagcacgcgagucggcaugggcgaagcugcagcaauauucaugacugcuacuccaccaggaucaauggaggcuuuuccgcagaguaaugcagugauccaagacgaagaaagggacaucccagagcguucuuggaacucuggauacgacuggaucacggacuuuccgggaaagacaguaugguuuguaccaagcaucaaaucgggaaaugauauugcaaacuguuugagaaagaauggaaaacgcguuauacaguugucacgaaaaacuuuugauaccgaguaucagaaaaccaaaaauaaugauugggacuauguuguaacaacugauaucucagaaaugggcgcaaauuuccgagcagauagaguuauagauccucguagauguuuaaagccagucauacugaaagacggaccggaaagggugauacucgccgguccgaugccgguaacagucgcguccgcggcgcaaaggaggggcagaauuggaagaaaccaaaacaaggaaggugaucaauacgucuauaugggccaaccccuaaauaaugacgaggaucaugcgcacuggacagaggcaaaaaugcuucuugacaacauuaauacaccagaaggcauaauacccgcucuauuugagccugagagagagaagucagcugcuauugauggugaauaccgcuuaaggggugaagcgagaaagacauuuguagaguuaaugaggagaggugauuuaccuguguggcuaucuuauaaggucgcauccgaaggcuuccaauauucagaccgcagaugguguuucgacggcgaacguaauaaccagguacuagaagaaaacauggaugucgaaauauggacaaaagaaggagaacguaagaaacugagaccaagauggcuagaugcucgcacuuacagugacccucuugcuuuacgcgaauuuaaagaauuugcagcaggccgacgcaguguuaguggggaccuaauucuagaaauaggaagauuaccacaacaccuaacguuaaaagcacagaaugcauuagauaaucuagucauguuacacaacucugaacaaggaggaaaggcauauagacacgcaauggaagaacugccagauacaauagagacucuuauguugcuugcucuaauagcaguauuaacuggcggggucacuuuguucuuucucuccggcaaagggcuagguaagacaagcaucggcuuauuaugcgucauggccucaucaguacuauuauggauggcaaguguagagccucacuggauugcagcaucaauuauacucgaguucuuuuugaugguacuccugauaccagaacccgaucgucaacguacaccgcaagauaaccaauuagcauacgugguaauaggucuauuguuuauaauauugacaguugcagcuaaugaaaugggguugcuugaaacuacgaagaaagacuuagguaucggacauguugcagcugaggaucaucaacaugcaacaauguuagauguagauuugagaccggcuucagcguggacauuauacgcuguugcuaccacaauaauaaccccaaugaugcgccacacgauugaaaacacaacugcaaacauaaguuuaacagccauagccaaucaagcagcaauccucaugggauuagauaaaggauggccaauaucgaagauggacaucgguguuccguuacuugcacuaggcugcuauagucaagugaacccacuuacauugacggcagcaguauuaauguugguagcccacuacgccauaauaggaccaggguuacaggcaaaagcgacacgggaagcacagaaaaggacagcugcuggcaucaugaaaaauccuaccguagauggcauaguggcuauugaccuugauccuguaguuuacgauacaaaauuugaaaaacaauuaggacaaaucaugcuccuaauccuuuguaccagucaaauccuucuaaugcgaacaacgugggccuuaugugaaaguauuacgcuugcgacggggccauuaacaacucuuugggaaggcucacccggaaaauucuggaauaccacuauugcuguguccauggcaaacauauuccgcggaaguuaucuggcaggcgcuggacuugcauuuucauugaugaagaguuuagguggaggaagaagggggacaggggcacagggggaaacacuaggagaaaaauggaaacgacaauugaaucaauuaaguaaaucugaguucaauacauacaagcguucgggaauuacagaaguagaccgcagugaagcuaaagagggacuaaaaagaggagaaacaacaaaacaugcgguuucacgcggugcugcuaaauuaagaugguucguagaacgcaauuuagugaaacccgagggaaagguaauugauuuagguuguggucgagggggauggucauauuacugugcaggacugaaaaaggucacggaggugaaaggguacacuaagggcgguccuggacaugaggaacccauacccauggcuacauauggauggaacuuaguaaaacugcauuccgguaaagauguauucuuuauuccaccagagaagugcgauaccuugcucugcgacauuggagaaaguaguccaaauccuacuaucgaagagggacgaacccuaagaguucuuaaaaugguugaaccauggcuaagagguaaucaauuuuguauuaaaauauuaaauccauauaugccaucaguaguugaaacacucgaacaaaugcaaaggaaacaugggggaaugcuaguccgaaauccacuuaguagaaauuccacucaugaaauguauugggucucuuguggaacggggaacauugucucagcagugaauaugacuucuagaauguuguuaaauagauucacuauggcccaucgaaaaccgacauaugaacgcgacguagauuuaggagcugggacacggcauguagcuguagaaccggaaguugcaaauuuggauauaauagggcaacgaauagagaauauuaagaaugaacacaaauccaccuggcauuaugaugaagauaacccauauaagacaugggcuuaccacggaucuuaugaagugaaaccgucugggucagcgagcucgaugguuaacggaguagugagacuacugacaaaaccaugggacgucauucccaugguaacacaaauagcuaugaccgacacgacuccguuuggacaacagcgaguauuuaaagaaaaaguugauacccgaacgccuagagccaaaagaggcacagcgcaaauaauggaggucacagcgaaauggcuauggggcuuccuauccaggaauaagaaaccaaggaucuguacgagggaagaauuuacacggaaaguucguagcaacgcggcuaucggggcaguuuucguagaugaaaaccaauggaacucagccaaagaagcaguagaagaugaaagauuuugggaccuuguccauagagagcgagaauuacacaaacaagguaaaugcgccacgugugucuauaacaugaugggaaagagggagaagaaacuaggagaauuuggaaaagccaaaggaucaagggccaucugguauaugugguuaggugcaagauuuuuagaguucgaagcacucggguuuaugaacgaagaccauugguucagcagagagaacagcuuaucaggaguagagggggagggucuucauaaauuaggauauaucuuaagagauauaucaaaaauacccggagguaauauguacgcagacgauaccgcagguugggacacacguauuacggaagaugauuugcaaaaugaagccaaaauaacagauaucauggaacccgaacaugcacuucuugcaaccucgauauucaaacuaacauaccaaaauaagguaguaagggugcaacguccggccaaaaguggaacaguaauggauguaauaucaagaagagaucaaagaggaagcggucaagucggcacguauggacuuaauacuuucacaaacauggaaguacaguuaauaagacaaauggaauccgaggguauuuucuuacccagcgaauuagaaacuccuaaccuugcugaaagagcacuagauugguuggaaaagcaugguguagaaaggcuuaaacguauggcuauuucaggcgaugauugcgugguuaaaccaacagaugauagauucgcaacggcucuuacugcccuaaacgacaugggaaaagugcgaaaagauauuccacagugggaaccguccaaaggauggaaugauuggcaacaaguacccuucuguucccaucacuuccaucaacucauuaugaaagacggaagggagauugugguaccaugcagaaaucaggacgagcucguuggacgggcccguguaucacaaggggccggauggaguuuaagagagacugcauguuuaggaaaaucuuacgcacaaauguggcaguuaauguauuuccaucgacgagaucuacgccuugcugccaaugcuauaugcucagccguaccgguugauuggguacccaccucuagaaccacuuggucuauacaugcccaccaucaguggaugacaacugaagauauguuaaguguuuggaacaggguuuggauagaagaaaacccauggauggaggauaagacccauguuucuagcugggaggacguuccguacuuagguaagcgagaagaccaauggugcgguucauuaauaggccuuacugcgagagcaacaugggcaacgaauauccaaguggccauaaaucaaguaaggcgauuaauagguaacgaaaauuauuuggacuacaugaccucgaugaagagauuuaagaacgaaucggauccggaaggugcuuugugguaa

SEQ ID NO: 21109 - RNA, 9879 nt, Artificial Sequence
  derived and/or modified CDS sequence (opt6) from DENV-1__KT831765__SS-prME
ucgguuacgauguuauugauguuaaugccaacagcacuggcuuuucacuuaaccacaagagguggggaaccacauaugauagucaguaaacaagaaagaggaaaaucauuauuauucaaaacaagugcggggguuaauauguguacgcuuauugcgauggaucuaggagaacuaugugaagauacaaugacauacaaauguccgcgcauaacugaagcugaaccagacgauguugauugcugguguaaugcaacggauacauggguuacauauggaacguguagccagacaggagaacauagaagagauaaaagaucaguagcguuagcaccacauguaggucuuggauuagaaacaagaacagaaacuuggaugaguagugaaggggcauggaaacagauacaacgaguggaaacaugggcacuucgacauccugguuucacugugauagcauuguuucucgcacaugcgauaggaaccucgaucacacaaaaaggaaucauauuuauauuguuaauguuagugacccccucaauggcaaugagauguguagguaucggaucacgggauuuugucgagggucuaucaggugcgaccuggguagacguaguacuugagcauggcucauguguuacaacuauggccaaagacaaaccuacccuggacauagaacuccuuaaaacggaaguuacaaacccagccguauuaagaaaauuaugcauagaggcuaaaauuucaaauacgacaaccgacagccguuguccuacacaaggagaagcgacuuugguagaagaacaagaugccaacuucguaugccgacgaacauuuguagauagagguugggggaacgggugcgguuuauuugguaaaggcagccuaauuacgugcgcuaaauucaaaugugugacaaaauuagaggguaaaaucguucaguaugaaaacuuaaaauacucgguuauugucacuguucacaccggugaucaacaucagguggggaaugaauccaccgaacacggcacaacugcaacaauaacgccucaagccccaacaacagaaauacagcugaccgauuauggagcauuaacauuagacugcucaccccgaaccggccuagacuuuaaugaaauggugcucuuaacuaugaaggagaagucaugguugguacauaaacaaugguuucuagaccucccauuaccauggacaucgggagccaguacaagucaagaaaccuggaaucgucaagauuuguuaguaacauuuaaaacagcccacgccaagaaacaagaaguagugguucucggaucccaagaaggugcaaugcauacugcacuaacuggcgcaacagagauacaaacgagugguacgacuacaauauuugcaggacaucuaaagugccgacucaagauggauaaauuaacacuaaaaggaaugagcuacgugauguguacgggcucauuuaaauuagagaaagaaguugcugaaacacagcacggaacaguauugguucagauuaaauaugaaggcacagaugcaccguguaaaauaccauucaguacacaagacgaaaagggaguaacacaaaauggaagguuaauuacagcgaauccaauaguuacagauaaagagaagccuguaaacaucgaagcggagccaccguuuggugaaucauauaucgucauuggggccggcgaaaaagcacugaagcucaguugguuuaaaaaggguucaucaaucggaaagauguuugaggccacugcacgaggugcacgacguauggccaucuuaggagacaccgcgugggauuucgggaguauaggggguguguuuaccaguguaggcaaauugguacaccagauauucggaacagcauauggaguccuauucucaggagugucguggacgaugaaaauugggauaggcguuuuauuaacguggcuuggucuaaauucaagauccacaagucuauccaugacaugcauagcugucggauugguaacccuauauuuaggaguaaugguccaagccgauagugggugugucauaaacuggaagggucgagaacuaaagugcgggagugguauauucgucaccaacgaggugcacacuuggaccgagcaauauaaauuucaagccgauuccccaaaaaggcugagugcagccauagguaaggcaugggaagaaggcgucugcgguauacgaucagcgacuagguuggaaaauaucauguggaaacaaauauccaaugaacuaaaucauauucuacuagaaaaugauaugaaauuuacaguaguaguaggcgauguggcuggaauacuagcgcaaggcaaaaagaugauaagaccacaaccgauggaacacaaauauucauggaaaagcugggggaaggcaaaaauuaucggggcugauguccaaaacaccacuuuuaucaucgauggaccgaauacuccagaauguccagacgaccaacgagcguggaacauaugggaaguggaagacuauggcuucggcauauuuacaacaaacauaugguugaaacuaagagacucguauacacaggugugcgaucauagguuaaugucggcugcaaucaaggauuccaaagcaguacacgcggauauggguuauuggaucgagagugaaaagaaugagacauggaaauuagcacgagccagcuuuauugaagugaaaacuugcauuuggccuaagagucauacgcuauggaguaauggcgugcuagaaucggaaaugauuauaccgaaaauauauggaggcccuauaucucaacauaaccaucggccgggauacuucacucaaacagcaggaccauggcaucuaggcaagcuagaacuagacuuugaucugugcgaggggacuaccguaguggucgaugagcauugcggaaacaggggaccaucuuuacgaaccaccacuguuacgggaaaaauuauucacgaauggugcugucggagcuguacguugccaccacuaagauacagaggcgaggauggguguugguacggcauggagauccggccuguaaaagaaaaagaggaaaacuugguaaaaucaaugguuucagccggaucuggggaaguagacucguucucccugggucuauuauguauaucaauaaugaucgaggagguuaugcgcagucgauggucuagaaagaugcuuaugacuggaacucuggcaguauucuuucuacuaaucaugggucaguuaacguggaacgaccuaauaagauuauguaucaugguuggagcaaacgcaucagauagaaugggaauggggacuacauauuuagcacuaauggccacguucaaaaugcgcccaauguuugcaguuggucucuuauuccggagguuaaccucuagagaggucuuacuauuaacaauagguuugagucucguggccucgguagaacuaccuaacucacuagaggaacucggagacgguuuagcgaugggaauaaugauacugaaacuauuaacagauuuccaaucacaccaacuaugggcgacacuauuaucauuaacauuuauaaaaacgaccuuuagucuacauuaugcuuggaaaacuauggcaaugguauugaguaucguaucucuuuuuccguuauguuuaagcacaaccucccagaagacgacuugguuaccaguccuacugggaucgcugggcuguaagccacuuacaauguuccuaauagcggaaaacaaaauuuggggacgcaaaaguuggccuuugaaugaaggaauuauggcaguaggaaucguuucaauacuuuuaucaucacugcuuaagaaugauguaccacuagccggcccgcucauugcgggaggcaugcuuaucgcauguuauguaauuaguggaucaagugcugauuuaucacuagaaaaagcagcugaaguuagcugggaagaggaagccgagcacaguggugcaagccauaauaucuugguggaaguucaagaugaugguacuaugaaaauuaaagacgaggaacgcgaugauacucuuaccauucugcugaaagcgacacuuuuagcgguuucaggaguguauccccuuucaauacccgccacacuauuuguaugguacuucuggcagaagaagaaacaaaggagcgggguacuaugggauacaccaucaccaccugaaguggaacgagcuguuuuggaugacggaauuuaccguauaaugcaacgagguuuauuaggucggucgcaagugggugucgggguauuccaagagaacguauuucacaccauguggcauguaacacgaggagcuguucucauguaccaggguaaaagacuggagccguccugggcaucggucaagaaagacuugauuucuuacgguggcggauggcgucuacaagguucauggaauacuggagaggaaguucaaguuauugcuguugaaccaggcaaaaaucccaaaaauguacagacugcaccaggaacuuucaagacaccugaaggagaaguuggagccauugcacuugauuuuaaaccgggcacauccgguagcccuauugucaaucgagaagggaaaaucgugggauuauacgggaacgggguagucaccaccagugguacuuacgucagcgcaauugcacaagcaaaagcaagucaggaaggaccguuaccagaaauagaagacgaaguuuucagaaaaagaaaccugacaauaauggaucuucauccaggaagcggaaaaacaaggcgauauuuacccgcgauaguaagagaagccauuaagcgaaaauuacgcacauuaauacuagcaccaacaagaguaguugcuagcgaaauggccgaagcauuaaaggguaugccgauaagauaucaaacaacagcaguuaaaagcgaacauacaggaaaggaaauuguagaucucaugugccaugcgacauuuacgaugagauuacuuucacccgucagaguaccgaauuauaacaugauaauaauggaugaagcccacuuuacagauccauccaguauugccgcaagaggcuacauuucaacccgaguuggcaugggagaagcagccgcuaucuucaugaccgcuacaccuccugggucgguagaggcuuuuccccaauccaacgcagugauucaggaugaggaaagagacauaccugaaaggucuuggaacuccggauaugaauggauuacugauuuuccggggaaaacugucugguuugucccaaguauaaagucaggaaacgacauugcgaauugcuugaggaagaacgguaagagaguaauacagcuaucuaggaaaaccuucgauaccgaguaucagaagacuaaaaacaaugauugggacuacguggugacgacagauauuucagaaaugggcgcaaauuuccgagcagacagaguaaucgacccaaggagaugcuugaaaccaguaauuuuaaaggacggaccugaacgcguaauuuuagcagguccaaugccgguuacaguugcaagcgccgcccaacgccggggaaggauaggacggaaccauaauaaggaaggggaucaauacauuuauaugggacagccauugaacaaugacgaagaucaugcucauuggacagaagcaaaaaugcugcuagauaauauaaauacgccugaaggaauaauaccagcguuguucgaaccagagagagagaaaagugcugcaauagacggugaauaucgauugaggggagaagcaaggaaaacuuucguagaacuaaugagaaggggugaucuucccguuuggcuaucuuauaagguagccagugaaggguuucaauacucugauagacguugguguuucgauggagaacgaaacaaucaaguacuugaagaaaauauggacguugaaaucuggacaaaagaaggcgaaaggaagaaacuacggccaagaugguuagacgcucgaacuuauagcgauccuuuagcguuaagagaauuuaaggaauuugcugcaggaagacgaucuguuaguggcgacuuaauacuugaaaucgggaagcuaccgcaacaccuuacccagagagcacagaacgcguuagacaaucuggugaugcuacauaauagugagcaaggaggcagagcauaucgacacgcaauggaggaacuaccagauacaauagagaccuugauguuauuagcccuuauagcuguauugaccggaggcguuacacuauucuuccuuagugguaagggauuaggaaagaccuccauuggacuucuaugcguaauggcaagcuccgucuuauuguggauggcaagcgucgaaccccauuggaucgcagcuucuauaauccuagaguucuuuuuaaugguucuguuaauaccagagccggauagacaaagaacaccucaagacaaucaacuagcuuacgugguuauaggaauguuauucaugauucuuacaguagcugcuaacgaaaugggauuacuggaaacaaccaagaaagacuuaggcaucggacauguugcuguugaaaaucaucaccaugcugcgaugcuugacguagacuugcaccccgccucagcuuggacccuauaugccguugccacaaccaucauuacgccaaugaugagacauacaaucgaaaacacaacagcuaauaucagcuuaacggcuauagccaaccaggcugcaauccuaaugggccuggacaaaggcuggccaauaagcaaaauggacaucggcgucccucucuuagcucuaggguguuauagucaaguuaaucccuuaacccuaacagcagcuguuuuaaugcuuguagcucauuaugcaauuauuggccccggauuacaagcaaaagcaacuagggaggcacaaaagaggacugcagcuggcauuaugaaaaacccaacuguugacggcauagucgcuauagaucuagacccgguuguauacgaugcaaaauuugaaaaacagcuuggacagauaaugcuacugauacuauguacaagucagauauuauuaaugagaacaacgugggcuuuaugcgaaucaauaaccuuagcuacaggaccacuaacaacuuuaugggagggaucuccagguaaguucuggaacacaaccauagcaguuaguauggcuaacauuuucagagguaguuaccuagcgggagcuggacuagcauucucguuaaugaaaagccuagggggaggccguaggggaacuggcgcucagggagaaacccuaggugaaaaauggaaacgacaacuaaaucaacugucuaaaagugaguucaacacauauaaacggucugguaucauggaaguugauagaucagaggcuaaggaaggacugaaaagaggagaaacaacuaaacaugcuguaagcagggguacagccaaacuuaggugguucguugagcgaaauuuaguaaaaccagaagggaaagugauagaucugggcuguggaagaggaggauggaguuacuacugugcgggacugaagaaagugaccgaaguaaagggcuauacaaaagguggaccaggacacgaagaaccaauuccuauggccaccuacgguuggaaucuagugaaacugcauagcgggaaagacguguucuuuguuccaccagaaaaaugcgauacuuuacuaugugauauaggagaaagcaguccaaaccccaccauagaagaagggcgaacuuugagaguucuaaaaaugguugaacccuggcuaagaggcaaccaauucuguauaaaaauacuaaauccuuauaugccuagugucguggaaacacuugagcaaaugcaacggaaacauggcggaaugcuaguccgaaacccacugagucgaaauucaacucacgaaauguauuggguaaguugcgguacgggaaauauuguguccgcgaucaauaugacaagcagaaugcugcucaaucgauuuaccauggcgcaccgaaaacccacauaugaaagagacguagauuugggagcggguacuagacauguuacgguagagcccgaaguggcaaacuuggacauuauuggucaacgaauagagaacauuaagugugaacauaaaaguaccuggcacuaugacgaagauaauccauauaaaacaugggcauaucaugggucauaugaagucaaaccauccggaagcgcaucauccaugguaaaugggguuguaaaacucuuaacaaagccaugggauguaauuccaaugguuacacaaaucgccaugacagauaccacacccuuuggccagcaaagaguauucaaagaaaaaguagacacacguacuccaaaagccaaacgagggaccgcacagauaauggaagugacugcuagaugguuauggggauuucuaucccguaauaagaagcccagaauuugcacgagagaagaauuuacgcguaaaguacgaucaaacgcugccauaggugcaguuuucguagaugagaaccaauggaacucagcaaaagaagcuguagaagaugaacgcuuuugggauuuaguacacagggaaagggaacuacauaagcaaggcaagugcgccacaugcguauauaauaugaugggaaaaagggagaagaaauuaggggaauuugguaaagccaaaggaagucgagcgauaugguauauguggcucggggcuagguuccuugaguucgaggcuuuagguuuuaugaaugaagaccauugguucaguagagagaacucguuaucgggaguugagggugaaggacuacauaaacuuggauacaucuugagagacauaaguaaaauuucgggcgggaauauguaugccgacgauacagcaggaugggauacgaggauuaccgaagaugaucuccaaaaugaagccaagauaacugaaauaauggagccugaacacgcgcagcuagcaaaggcgauuuucaaacuaacguaccagaacaaggugguaaggguucagagaccagcaaagaauggaacgguaauggauguuauuucaaggcgugaucaacguggaaguggccaaguaggaacauacgggcuaaacacauucacaaauauggaagcacaauugauuaggcagauggaaagcgagggaauauuuagccccagcgaauuggagacuccgaaucucgcagagaggguacuggauuggcucgaaaaauacgggguggaaagguuaaaaaggauggcuauuaguggugacgauugugucguaaaaccaauagaugacagguuugccaccgcccucacagccuuaaacgauaugggaaaaguucgaaaagacauaccacagugggagccguccaaaggauggaacgacuggcagcagguuccguucuguagccaucauuuucaccaguugauaaugaaggacggucgggagauagucguaccaugucgcaaccaagacgaacuggucggcagagcaagaguaucucaaggugcaggauggucccuacgagaaacugcgugcuugggaaagucguacgcgcaaauguggcaacuuauguauuuccacaggagagaccuacgauuagcagcuaaugcaauauguucugcaguaccaguagacuggguuccaacaaguagaaccacauggucuauucaugcacaucaccaauggaugacuacagaagauaugcucucagucuggaaucguguauggauugaagaaaauccauggauggaagauaaaacgcauauuucgucaugggaggaugucccauaccuagggaaaagggaagaccaauggugcgguucgcuaauuggacuuaccgcucgagcuacuugggcaacuaacauacaaguagcgaucaaucaaguaagacgacuaauaggcaaugaaaacuaucuugauuacaugacaucaaugaaaagauuuaaaaacgaaucugauccugagggugccuugugguaa

SEQ ID NO: 21110 - RNA, 9879 nt, Artificial Sequence
  derived and/or modified CDS sequence (opt6) from DENV-1__KP188567__SS-prME
agcguaacaaugcuacuuauguuauuaccgacagcacucgcguuucaccugacgaccagggguggggaaccacauaugauaguuagcaaacaagaacgggguaaaagccuacuguuuaaaacgucaguaggcguaaauauguguacgcuuauugcaauggaccuuggcgaauuaugugaagauaccaugacguauaaauguccgagaaucacggaagcagaacccgacgacguagauuguuggugcaaugcuacagacacuuggguuacuuacgguacauguagucagacaggugaacauagaagagauaaacgcucaguagcccuagcaccccacgucgggcuugguuuagaaaccaggacagaaacguggaugagcucggaaggagcauggaaacaaauucagaaagucgaaacuugggcauuaaggcauccaggauucacuguaauagcguuguuccuagcacaugcuauugggacaucuauuacucaaaaaggcauaauuuuuauccuauuaauguuagucaccccgucaauggccaugcgcuguguagggauuggaaacagggacuuuguagaagguuuauccggagccacguggguagacguuguacuagaacauggcucuuguguuacuacaauggcuaaaaauaaaccuacucuugacauagaguuacucaagacagaaguuacaaauccggcaaucuugagaaagcucugcauugaggcaaaaauaucaaacaccaccacagauagccgaugcccaacacagggcgaggcuacucugguagaagaacaagaugcgaacuucguaugccgcagaacguuugucgauagaggauggggcaacggauguggucuuuucgggaaggguucacuucuuacaugugcuaaauucaaauguguaacaaaauuagaaggaaagauaguccaguacgagaauuuaaaauacuccguaauuguuacuguucauacaggggaucaacaucagguuggaaaugaaacaacggagcauggcacuauagcaacaauaacuccacaagcuccaacaucagaaauccaauuaacugacuacggagcauuaacuuuagacuguagcccuaggacagguuuagauuucaacgagaugguucuacuaacaaugaaagagaaaucaugguuaguacauaaacaaugguuucuagacuuaccgcuaccauggacauccggagcaagcacaagucaagagacuuggaaucgacaagauuuauuagucacauucaagacugcgcaugcgaagaaacaagagguugucguauuaggaagucaggaaggugccaugcauacagcucuuacgggggcaacugaaauacaaacuucugggacaaccaccauauuugcggggcaccuaaaauguagauuaaaaauggauaaauuaacacuaaaggguaugagcuacgucauguguacugguucguucaaauuagaaaaagaaguggcggaaacacaacacgguacaguccuuguacaagugaaauacgaaggaacagacgcuccuuguaaaauucccuuucuaacccaagacgaaaagggagugacacaaaauggaagacuaauaacugcaaaucccauagucacggauaaagaaaaaccugucaacauagaaacagagccacccuuuggcgagaguuacauaguuguaggggccggagaaaaagcguuaaaacuaucgugguuuaagaaaggaaguucuaucgguaaaauguuugaagccacugccagaggagccaggcggauggcuauacuaggagauacagcaugggacuucgggucgaucgggggauuauuuacuucuguugggaaacuaauacaucaagucuucgguacagcuuacggcgugcuauuuuccgguguaaguuggacaaugaagauagggauagguauuuuacuaacaugguugggcuugaacagccgaucaacaucuuuaaguaugacgugcauugcgguggguauggucacguuguacuuggguguaauggugcaggcugauagcgggugugugauaaauuggaaaggucgugaauuaaaguguggaucaggcaucuuuguaacaaaugagguccacacauggacggagcaauacaaauuucaggcagauaguccaaaacgguugucggcagcuauagggaaagccugggaggagggagucugugguauacgaucugcuacaagacuggagaacaucauguggaaacaaauuaguaacgaauugaacuacauacucuuagaaaaugauaugaaauuuacuguaguagucggugacgucaauggcauauuagcucaaggcaagaaaaugauaaaaccacaaccuauggaacacaaauacucauggaaaaguuggggcaaggcuaaaaucauaggagccgauauucagaacacgacuuuuaucaucgacgguccugauacuccugaaugucccgaugaccaacgugcuuggaacaucugggaaguagaagauuacggauuuggaauauuuaccaccaauauauggcuaaaacuccgagacagccauacucaaaugugugaucacagauugaugucggcagccaucaaagauagcaaggcugugcacgccgacaugggauauuggauugaaagugagaaaaaugaaacauggaaacuagcacgagccucauucauugaagucaaaacgugcauauggccaaaaucgcacacccuuuggaguaacggagugcucgaauccgaaaugguuauuccaaagauauacggagggccuauuagccaacacaacuaucgcccuggguauuuuacccagacagcagggccauggcaucucggaaaacuugaacuagacuuugaccugugcgaaggaacaacagucguaguagaugagcauugugguuacaggggcccaucucucagaacuacaacugucacgggcaaaauaauacaugaauggugcugucgcaguuguacuuuaccaccgcuucgcuucagaggugaggauggcuguugguacgguauggaaaucagaccgguuaaagaaaaggaggaaaaucuuguuaggagcauggugucagcgggaaguggcgagguagauucguucucgcuagggauucuaugcguaucaauacuuauagaagaaguaaugaggucccgcuggucucguaaaauguuaaugacagguacacuggcgguguuucuuuuacugaucaugggacaauuaacauggaaugaucucauucgccuuuguauaaugguuggggcaaaugcauuagaucgcauggguaugggaacuacuuaccuagcuuugauggccacauuuaaaaugcgaccgauguuugcgguuggauuguuguuccggcgucucacaucaagagagguacucuuauuaacugugggacucucuuuaguagcaucaguagaauuaccaagcagucuagaagaacugggcgacggacuugccaugggcauaaugaugcuaaaauuauuaacggacuuucaaccucaucaacuuuggacuacacuccuaucauuaaccuuuaucaggacgucauugucauuagauuaugcguggaaaacaauggcgauggcucuaaguauaguaucacuguuucccuuauguuuaaguacaacuucacagaagacaacuuggcuuccgguacucuuaggcucauuuggaugcaagccacuaaccauguuuuuaauuacugaaaauaaaauuuggggcaggaaaaguuggccaauaaacgagggaaucauggcuguugggauaguaagcauauuacucaguucucugcuuaagaaugacguuccucuggcagguccauuaaucgcggguggaauguugauagccuguuacgugauuagcgguuccucugcagaucugucauuggaaaaagcugcagagguaucaugggaagaggaagcagagcauuccgguaccucacauaauauccuaguagagguacaagacgacgggaccaugaaaauaaaagaugaagaacgcgaugacacacuaacaauauuacuaaaagcuacauuacucgcaguaucaggcguauaccccaugucaauacccgcgacacucuucgugugguauuucuggcagaagaagaaacaaagaucuggcguuuuaugggacacgccaucaccaccagaaguggaaagggccguguuagacgauggaauauauagaauacugcagcguggacuauuaggaagaagccaaguagggguagggguauuucaagaugguguuuuucacacaauguggcaugucacaagaggagcugugcugauguaccaagggaaaagauuagaacccucaugggcgagcguuaaaaaggauuuaauaucguauggagguggauggagauuucagggcucguggaacaccggggaagaagugcaagucauagcaguagaaccagguaaaaacccuaaaaacgugcaaacuacaccugggacauucaagacuccagaaggagagguaggggcuauagcauuagauuucaaaccggggacaaguggcagcccaauaguaaaccgagaagguaaaauaguaggacuauacggaaacgguguggucacaacgagugggacauaugugucagcaauagcgcaagccaaagccacacaagaaggaacauuaccggagauagaggaugagguauuuaaaaagcgaaaucuaacaauaauggaucuacauccgggaagugguaagacgcguagauauuuacccgccaucguaagagaagcaauaaaaaggaaacuaaggacuuugauucuagcaccaacaagaguaguggcaucggaaauggcggaagcauuaaaagguaugccaauucguuaccaaacgaccgcaguaaaguccgagcacaccgguagggagauuguagacuuaaugugucaugcaacauucacuaugcgacuguuaaguccaguacgaguaccuaauuauaacaugauaaucauggacgaagcucauuuuaccgacccagcuucgauagcugccaggggguacauaaguacgagaguagguaugggagaagcggccgcuauauucaugacagccacaccgccaggcaguguagaagccuuuccucaauccaaugccguuauucaggaugaagaacgggauauaccggaacgaucauggaacucgggauaugauuggauaacagacuucccuggaaaaacgguuugguucguuccaucaauaaaaucuggaaaugacauagcgaauugucuaagaaagaauggaaaacgaguaauacaacuaucgaggaaaaccuucgacacagaauaucagaaaacuaaaaacaacgauugggacuauguaguuacgacagacauaagugaaaugggagccaauuuuagggcggauagggugaucgauccgcgacgauguuugaaaccugucauuuuaaaagaaggcccagagagaguuauucuggcagggccuaugccuguaacaguagccagcgcagcacaaagaagaggucgaaucggcaggaaucaaaauaaagaaggggaucaauauauauacauggggcaaccguuaaacaaugaugaagaucacgcacacuggacugaagcuaaaauguuacuugacaacauaaauacgccagaaggcauuauucccgcccuuuuugaaccggaacgagagaaaagcgcagcaauugacggugaguauaggcuaagaggagaagcucgaaagacauucguagaauuaaugagaagaggugacuuaccgguauggcugucuuauaaaguugccuccgaaggauuucaauauucagaccgaagauggugcuuugacggagagagaaauaaucaaguauuagaggaaaauauggauguagaaauauggacuaaagaaggagaacgaaagaaacuaagaccccgauggcuugaugcuagaacauauucugauccguuagcauuacgagaauuuaaggaguucgcugcuggaagaagaucuguuaguggagacuuaauucucgaaauagggaaauuaccgcaacaucuaacucuucgagcucaaaaugcucuagacaaccuaguaaugcugcacaauucugaacaaggagguaaagcauauagacacgcuauggaagaguugccggacacaauugaaacauuaaugcuucucgcucuaauagccguuuugacuggaggaguaacguuauuuuucuugucagggaaagguuuagggaaaacaucaauuggacuacuuuguguaauggcauccagcgcauuguuauggauggcaucuguagagccacauuggauugcagcaucaauaauauuagaguucuuccuuaugguacuccuuauaccagaaccagauagacaaagaacaccacaagauaaucaauuagcuuacguaguaauaggauuguuguucaugauucuuaccguugcagcuaaugaaauggggcuuuuagagacaacuaaaaaggaccuaggcauuggacauguagcgguggaaaaccaucaucaugcgacaaugcuagauguugauuuaaggccagcgucugccuggacccuauaugcaguagcgacaacuguaauaacuccgaugaugaggcauaccauugaaaacacaacugcaaauauaucgcuaacggcgauagccaaccaggcugcuauacugaugggacuugacaaaggauggccaauuuccaaaauggacauuggcguaccauuauuagccuuaggauguuauagucaggucaaucccuuaacauuaaccgccgccguuuuaaugcuaguggcccauuacgcuauuauagguccuggacuucaagcuaaggccacucgcgaagcccagaaaaggaccgcggcuggcauaaugaagaacccaaccguugacggcauaguaacaauagaccucgauccgguaguauaugacgcaaaguuugaaaaacaauuaggucagaucaugcuccucauacucugcaccagucagauauuacucaugcgcacuacuugggcauugugcgaauccauaacacuggcgaccgguccuuuaacaacccuaugggaaggaucgccuggaaaauuuuggaauacaacuauagcaguaaguauggcaaacauauucaggggaucguaccuugcuggagcgggacuugcuuuuagccuuaugaaaaguuuagggggaggacgacggggcacaggcgcccaaggugagacauuaggagagaaauggaaacggcaacuuaaucaacuaaguaagucagaguucaauacguauaaaaagucaggaauaauggaaguagauagaagugaagcaaaagaaggccuuaaacguggcgaaacuaccaaacaugcaguaaguaggggcacggcuaaauuacgcugguuuguugaacgaaaucucgugaaacccgagggcaagguaauugacuuaggaugcggaagagggggauggucuuauuauugcgcuggacucaagaaaguaaccgaaguuaaagguuauacaaaaggcgggccaggacacgaggaaccuaucccuauggcuacauauggcuggaacuuagucaaacugcauaguggcaaagauguauucuuuaccccuccagaaaaaugugauacccuauuaugcgacauaggcgaaucaaguccaaauccuacgaucgaagaggggagaacucugcgaguauugaaaaugguggagccaugguuacgcgggaaccaauucuguauaaaaauccuuaauccauauaugcccagugugguagaaacguuagaacagaugcaaagaaagcauggaggaauguuggucagaaauccacugucaagaaauucuacacaugaaauguauuggguaaguugcggaacgggaaacauuguaucugcaguaaauaugacuucucggauguuguugaaccgcuuuacaauggcacauaggaagccuacuuacgaacgugacguggaucuuggagccggcaccaggcauguugccguagagccugaaguugcaaacuuagauaucaucggucaacgaaucgaaaacauuaagaaugagcacaagucuaccuggcacuacgacgaagauaacccauacaagacaugggcauaccacgggucauaugaaguuaaacccagcggaagcgcuaguucgaugguaaaugguguugugagacuuuuaacaaaacccugggaugugauuccaauggugacucagauagccaugacagauacaaccccguucggucagcagcggguuuuuaaagaaaaaguagauacaaggaccccaagagccaaaagaggaacagcacaaauaauggaggucacugcaaaaugguuguggggauuucucagccgaaacaaaaagccgcgcaucuguacgagagaagaauuuacacgcaaaguacgauccaaugcugcaauaggagcgguuuuugucgacgaaaaccaguggaauagugcgaaggaagcaguagaagaugaaagauuuugggaucuagugcauagagaaagggagcuucauaagcaggguaaaugugcuacaugcguauauaacaugaugggcaaaagagaaaagaaacugggggaauuuggaaaagcaaaaggcucuagagcgaucugguauauguggcuaggggcucgauuuuuagaauuugaggcucuuggguucaugaaugaggaucauugguuuaguagagaaaacagccuuuccggaguggaaggugagggccuacauaaacuagguuacauuuuacgugacauaucaaaaauaccgggaggaaacauguacgcugaugacacagcaggaugggauacacgcauuaccgaagaugacuugcaaaaugaagcaaaaauuacugacaucauggagcccgaacacgcacuacuagccaccagcaucuuuaaauuaacauaccagaauaaaguagucagaguucagaggccagcuaaaaguggaacaguuauggauguaaucagccgaagagaccagcgaggauccggccaaguaggaaccuaugguuugaacacauuuacgaauauggaaguccaauuaauaaggcaaauggaauccgaagguauauuuucaccgagugaacuagagacuccaaaucuagcgaagaaaguucucgauuggcuugaaaaacauggcgccgaaagacuuaaaagaauggcaaucagcggggaugauugcguuguaaaaccuauagacgacagguuugccaccgcauuaacagcacuaaaugacauggguaaaguaagaaaagacauaccucaaugggaaccaagcaaaggauggaacgacuggcaacaaguaccguuuugcagccaccacuuucaucaguuaauuaugaaagauggacgcgaaauuguugugccguguaggaaucaggaugaacugguuggacgggccagagucucccaaggagcuggauggucucuaagagaaacagccugucuuggaaagaguuacgcccaaauguggcagcuaauguacuuccauagaagagaucuacgacuugccgcuaaugcgauuuguucugcuguuccugcagacuggguuccaacaucuaggacgacauggagcauacaugcacaucaucaauggaugacaacggaagacaugcugaguguauggaaccgcguauggauagaagaaaacccguggauggaagauaaaacacacgucucaucuugggaagaagucccuuauuuggguaagcgagaagaccaauggugugguagccuaaucggucuaaccgccagagcgaccugggcaaccaacauucaaguagccauaaaucaaguaagacgucuuauaggaaacgaaaacuauuuagacuauaugacuucuaugaaaagauuuaaaaaugaauccgaccccgaaggagcacuaugguag

SEQ ID NO: 21111 - RNA, 9879 nt, Artificial Sequence
  derived and/or modified CDS sequence (opt6) from DENV-1__KP188568__SS-prME
aguguuaccauguugcugauguuauuaccaacggcucucgcauuccacuuaaccacacgagguggagaaccacauaugauaguuagcaaacaggaaaggggcaaaagucuguuauucaaaacaaguguaggugugaauauguguacuuuaauugcgauggacuuaggagaauuaugugaagauacuaugacuuauaaauguccucguauuacagaagcggaaccugaugauguugauuguugguguaacgcaacagacaccuggguuaccuauggcacguguucacagacuggugaacaucggagagauaaaaggucaguagcauuagcaccacauguagguuuaggccuugaaacgaggacggaaacauggaugucaagugaaggggccuggaaacagauacaaaaaguggaaacgugggcauuacgucauccuggauuuacuguaauagcucuauucuuagcgcaugcuauuggaacaagcauaacgcaaaaagggauaauauucauacuucuaauguuagucaccccuucaauggcaaugcgcugcguaggaaucgguaaucgagauuucguagaagggcuaucaggugccacauggguagaugucguguuagaacacggaagcugcguaacaacuauggcgaaaaauaaaccaacauuggauauugagcuacuaaaaacagagguuacaaaucccgcagugcuaagaaaauuguguauugaagcaaaaauaagcaauacaacaacugacaguagguguccaacccaaggagaagccacacucguagaagaacaagaugcaaacuucguaugucgaaggacauuuguagaccgcggguggggaaauggauguggacuauucggaaaagggaguuugcuaacgugugcaaaauuuaaauguguuaccaaauuggaaggaaaaauuguccaauaugaaaauuuaaaauacucaguaaucguaacuguacauacuggggaucaacaccaagucgguaaugaaacaacagaacacgguacaauugcaacuauuacaccccaggcuccaacgagugaaauacaacuaacagauuauggcgcacuaacacuggacugcucuccccguacuggucuagacuucaacgagaugguauuguugaccaugaaagaaaaaucuuggcucguacacaaacaaugguuucuagaccuaccuuuacccuggacuucuggugcaucaaccagucaagaaacauggaaucgacaagauuuacucguaaccuuuaaaacggcacacgcgaagaaacaggaaguuguaguccucgggagucaagaaggagcuaugcauaccgcgcuuacaggcgcgacugaaauacaaaccagugggacaacaacaauuuucgcaggacaucuuaaauguagacuaaaaauggacaaacucacacuaaaaggaaugucuuacgucauguguacugggaguuuuaaacuugaaaaagaaguagcagaaacccaacacggaacaguuuuaguacaagugaaauaugaaggaacugaugcaccuuguaaaauuccuuuccugacucaagacgaaaaaggagucacucaaaaugguagguuaauaaccgcuaacccuauagucacagauaaagaaaaaccuguuaauauugaaacagagccaccauuuggugaaucuuacaucguugucggugccggcgagaaagcacucaaauuaaguugguuuaagaaaggcuccucaauuggaaaaauguucgaagcaacugcacgaggcgcacgacgaauggcaauucuuggugauaccgcuugggacuuugggaguauuggagggcuauucacuucaguaggaaaacuaauucaucagguauucgguacagcguacgggguccuguuuucuggagucaguuggaccaugaaaauaggcauugggauauuacuaacgugguugggacucaauagcagaucaaccaguuugagcaugacauguauagcagucggcaugguuacucuauacuugggcguuaugguacaagcagauucuggaugugucauuaacuggaaagggcgagaacuaaaauguggguccgggauauucguuacaaacgaaguucacacuuggacugaacaauauaaauuucaagcugauaguccaaaacgucuaagugcagcaauagggaaagcaugggaagaaggaguuugcgggaucagaucugcaacacgucuggagaauauaauguggaaacagaucucuaacgaauugaaccauauauuacuagaaaacgauaugaaauuuaccguaguuguaggggacgugaaugguauccuggcucaggguaagaaaaugauacgaccacaaccaauggaacauaaauauucauggaaaucauggggaaaggccaaaauaauaggcgcagauauucaaaacaccacuuuuauaauagacgguccagauacuccggaaugcccagaugaccaacgagcguggaauauaugggaaguagaggauuacggcuuuggaauauuuacaacaaauauauggcuuaaauugcgugacagccauacucaaaugugcgaucaucgauuaaugucagcagcaauaaaggauaguaaggcgguacacgcugacaugggauacuggauugaaucagagaaaaaugagacauggaaacuggcaagagcaaguuuuauagaggucaaaaccuguauauggcccaaaucucacacccuguggagcaacggaguccuagaaagugagauggucauuccaaaaaucuacggaggccccauaucacaacauaauuaucgaccugguuauuuuacacaaacagccgggccguggcacuuaggaaaacuagaauuagauuucgaucucugcgagggaacaaccguaguaguggaugaacacugcgguuaucgcggacccagcuuaaggacgaccacaguaacagguaaaaucauccaugaaugguguugucgaucaugcacauugccgccauugcguuuucguggagaggacggcuguugguaugggauggagaucagaccaguuaaagaaaaagaagaaaacuuaguaagguccauggugucagcagguuccggcgaaauggauaguuuuagucuagguaucuuaugugucagcauuuugauugaagaaguuaugaggucaagauggagcagaaaaauguugaugacagguacgcucgcgguauucuuuuuacuaauaaugggacaauuaacauggaacgauuuaauacgcuuaugcauaaugguaggggccaaugcauccgauagaaugggcauggggacgacauauuuggcacugauggccacuuuuaagaugagaccuauguuugcuguagggcuacuguuuagaagauuaacuucuagagaaguguuauuauugacaguuggacuuaguuuaguggcgucgguagaauuaccaaauucauuagaagaacuaggcgauggucuagcaaugggaauuaugaugcuaaaacuccuuaccgauuuucaaccacaccaauuauggacaacacuauugucuuuaacauuuauacgaacuucgcuaucacuagauuacgcauggaagaccauggcaauggccuuaagcauaguaagucuuuucccacuuuguuuaucaacaacuagccaaaagacgacguggcuaccuguacuacuaggaucguucggauguaaaccucugacaauguuccuaaucacagaaaauaagauuuggggacgaaaaucuuggccaaucaaugaaggaauaauggcaguaggaauaguauccaucuugcuuucaagccuacucaaaaacgacguaccucuagcgggaccacuuauagccgggggcaugcuaauagcauguuacgucauuaguggaagcagugcugacuuaagccuagagaaggcggcagaaguaaguugggaggaagaagcagaacacucugggaccucacacaauauacuuguagaaguucaggacgacgguacuaugaaaauaaaagacgaggaacgagacgauacccucacaauacuauuaaaggcaacacuacuagcaguaucaggaguuuaucccaugucuauaccugcuacucucuuuguuugguacuuuuggcaaaagaagaaacaaagaagcggagucuuaugggacacacccagcccgccugaaguggaaagagccguacucgaugacggaauauaucgaaucuuacaaagaggucuucucggacgaucacaggucggugugggaguauuucaagauggaguauuucauacuauguggcauguuacacggggagcgguauugauguaucaagguaaaagguuagaacccucaugggcaucagucaagaaagacuugauaagcuauggagguggguggagauuucaaggcagcuggaacaccggagaagaaguacaaguuauagcgguggagcccggcaaaaaucccaagaauguacaaacaacgcccgguacguucaaaacccccgaaggggaaguaggugcuauugcuuuagauuucaaaccaggaacuucuggaucccccauaguuaacagagaagguaaaauagucggauuauauggcaauggaguuguuacaaccucaggaacauacguaucugcaauagcacaagcgaaagcuacacaagagggaccauuaccagagaucgaggaugaggucuuuaagaaaaggaaucuaacaauuauggaccuccauccgggaucagguaaaacgagaagguaucuacccucaauuguacgagaagcuauuaagcgaaaacuuagaacccuuauauuggcgccuacaagagugguugcaucagaaauggcugaagcucuuaagggaaugccaauucgauaccaaacaacugcugugaaaagugaacauacuggacgcgaaaucguggaucuaaugugccaugcgaccuucacgaugagacuguuaucuccuguacgaguaccuaauuauaauaugauaauaauggaugaggcgcauuuuaccgacccugcaucuauagcagcgcgagguuauauaucuacaagaguugguaugggagaggcggcugccauuuucaugacagcgacuccgccgggaagcguggaagccuuuccgcaaucaaaugccgcuauucaagacgaagagagggacauacccgagcgaagcuggaacacaggauaugacuggaucaccgacuuuccuggaaagacuguuugguucgucccaucuauuaaaucagggaaugacauagcuaauuguuuaaggaaaaacggaaaacggguaauacaacugucuaggaaaacguucgauacagaguaucaaaagacuaaaaacaaugauugggacuacguagucacaacugauauaagcgaaaugggggcaaacuuucgcgcagaucguguaauagauccgcggcgauguuuaaaaccaguuauacucaaggagggaccagagcgaguaaucuuagccggacccaugccuguaacgguggcauccgccgcacaacgacgcgggcggaucggaaggaaucaaaacaaggaaggugaccaauacauauacauggggcaaccccuaaauaaugaugaggaucacgcacauuggacggaagcaaaaauguuguuagauaacauaaauacaccagaaggcaucauaccagcccuguuugaaccagaaagagaaaagagcgcggcuauagauggugaguacagguuacgaggagaagcacgaaaaaccuuuguggaacucaugcgacggggugauuuaccgguuugguuaucauauaaagucgcgagugagggauuucaauauagcgaucgucgauggugcuuugacggcgaaagaaauaaucaaguguuagaagagaauauggacgucgaaauauggacaaaggaaggagagaggaagaaacuuagaccuagauggcuggaugcgaggacauauucggauccuuuagcuuuaagagaauuuaaagaguucgcugcuggaagaagauccguuucaggagaccuaauuuuagagaucggcaaguugccccaacaucuuacacugcgcgcucaaaaugcucucgauaacuuggugaugcuacauaacucagaacagggugguaaggcuuaucgccacgcgauggaagaauuaccagauacgauagaaacauuaaugcuucucgcucuaauugcugugcuuacuggaggggugacccuuuucuucuuaucggggaaagguuugggaaaaacaucaauaggacuacuaugugucauggcaagcagcgcacuacuauggguagcaucaguggaaccucauuggauugccgcaaguauuauucucgaauuuuuccuaaugguacuccucauaccugaaccagauagacaaaggaccccacaggauaaccaacuggcuuacguuguaaucggcuuauuauuuaugauacucacaguggcagccaacgaaaugggccuucucgagacaacgaagaaagauuugggaauuggucauguugcaguagaaaaucaccaccacgccacuauguuagacguagaucuaaggccugccucugcguggacucuguacgccguagcaacaacggucauaacaccuaugaugaggcauacaauugaaaauacuacagcaaauaucagccuaacagcgauagcaaaucaagcggccauacuaauggguuuagauaaagguuggccuauaaguaaaauggauauaggagucccacuguuagccuuggguuguuauucgcaaguaaauccuuuaacauuaacggcagcaguacuaauguuaguagcccauuaugcaauuauagguccgggguuacaagcuaaggcuacccgugaagcccaaaaacggacagcagcaggcauuaugaaaaauccaacuguagauggaauaguuacaauugaccucgacccaguaguauaugaugcuaaguuugagaagcagcuugggcaaauaaugcuucuaauacuaugcaccucccaaauacuuuugaugcggaccaccugggcacuaugcgagucgaucaccuuagcuacaggaccucuuacaacgcucugggaagguucaccuggaaaguuuuggaauacgacaaucgcggucaguauggcgaauaucuuucgagguucauaccucgccggugcaggcuuagcauucucggugaugaaaagccuuggggguggacgccgagguacuggagcccagggcgaaacccuaggugaaaaguggaaaagacaacucaaucaacugucaaaaucagaauuuaauaccuauaagaaauccgguauaauggagguagacaggucggaggccaaagagggucuuaaacgcggcgagacuacuaagcaugcgguaagucgcggcacugccaagcuaaggugguuuguagaacgcaaucuggugaaaccugagggaaaaguuauugaucuagguuguggucgagguggaugguccuauuauugcgcuggauuaaagaaaguaacggaaguaaaaggauauaccaaagguggcccuggacaugaagaaccaauaccuauggcuacauauggauggaauuuaguuaaauugcauucagggaaagaugucuucuuuacgccaccagagaaaugugauacuuuguuaugcgauauaggagaauccucaccuaacccaaccauugaagaaggcagaacgcuuagagugcuaaaaauggucgaaccgugguuaagagguaaucaauucuguaucaaaauauuaaauccauacaugccgaguguagucgagacacuagaacaaaugcagaggaaacacggcgguaugcucguaagaaauccauuaagcagaaacucaacucaugagauguacuggguaagcugugguacagguaacauagugucggccguuaauaugacuagccgaauguuacugaaucgauucacuauggcccaccgcaaaccaacuuaugagagggacguugaccugggggccgggaccagacauguugcuguugagccugaaguugcuaaccuugauauuauaggucagcgcauagaaaacaucaaaaacgaacauaaaucuaccuggcauuaugacgaagacaauccauauaaaacaugggcguaucacggaaguuaugaaguuaaaccaucuggaucagcaucauccaugguuaauggaguugucagacuacucacuaaaccaugggaugugaucccgauggugacucaaauagcaaugacagauacaacaccauuuggucaacagcgcguuuuuaaggaaaagguagauacuagaacuccuagagccaaacgaggaaccgcccaaaucauggaaguuacagcaaaaugguuauggggauuucugucuagaaacaaaaagccgagaauuuguacucgggaagaguucacaagaaaaguucguuccaacgccgcaaucggugcgguauuuguggaugagaaccaauggaacucggcaaaggaggcgguagaagaugaacgcuucugggauuuaguacaucgugaacgugaauuacauaaacaaggaaaaugcgcuacuugcguuuauaacaugaugggaaagagagagaagaaauuaggagaguucggcaaggcaaaaggcaguagagcuaucugguauauguggcuaggcgcuagauuucuagaauuugaagcauuaggguuuaugaaugaagaccacugguucagccgugaaaacucacucuccggaguagagggagaaggccuucacaagcuaggcuauauucuccgggauauuucgaagauuccuggagguaauauguaugcagaugauaccgcaggaugggacacccgaauaacggaagaugauuuacagaaugaagcuaaaauaacugacauaauggaaccggaacaugcacuccucgcaacuucuauauucaaauugacuuaucaaaauaaaguaguaagaguccagcggccagcgaagucggguacagucauggacguuauaagcagaagagaucagcgcgggucgggucaagucggcacauauggguugaacaccuucacaaacauggaaguacaguugauuagacagauggaauccgaggggaucuuuagcccauccgaauuagaaacaccuaacuuggccaagaaaguucuggacugguuagaaaagcauggagcugaacgacugaagagaauggccauuaguggagacgauugcguaguuaagccaauugacgauagauucgcgacagcguuaacagccuuaaacgauaugggaaaaguaagaaaagacauaccucagugggagccauccaagggauggaaugauuggcaacaagucccuuucuguagucaccauuuucaccaauuaauuaugaaggaugggagagaaauaguaguaccaugucgaaaccaggacgagcuagucgggagagcaagaguaucgcaaggggcgggcuggucacuaagagaaacagcaugccucggaaaaucauacgcccaaauguggcaauuaauguauuuucauagaagagaucuaagacuagcugccaacgccaucuguucagcaguucccguugacuggguuccaacgaguagaaccacauggaguauacacgcccaccaucaauggaugacuaccgaggauaugcuuucuguauggaaucgcguauggauugaggaaaauccuuggauggaagauaaaacucacguaucaagcugggaagaggugccauacuuaggaaaacgagaagaucaauggugcgguagccuaauaggauuaacugcucgggcgaccugggcaacgaacauccagguagcuaucaaucaaguucgucgguuaauuggcaacgagaauuaucuggauuacaugacaaguaugaaaagauuuaaaaacgaaucagauccggaaggagcauuaugguaa

SEQ ID NO: 21112 - RNA, 9879 nt, Artificial Sequence
  derived and/or modified CDS sequence (opt6) from DENV-1__KF971870__SS-prME
ucgguaacuaugcuccuuaugcuaaugccgacugcacuagcuuuucaccuaacuacaaggggaggagaaccgcauaugaugguuucaaaacaagaacgagguaaauccuuauuauuuaaaacuucugcuggaguaaauaugugcacucugauagcaauggaucuaggcgaacucugugaagacacaaugacauacaaaugcccaagaauaacugaagcggaaccggaugauguggacugcugguguaacgcaaccgacacuuggguuacuuacggaacguguucucaaacaggagaacaucgucgggauaaaaggaguguugcucucgcgccucaugugggauuaggauuggaaacucgaaccgaaacuuggaugaguagugaaggagcuuggaaacaaauacaacgaguagaaacuugggcacuaagacacccaggauuuacaguaaucgcuuuauuucuagcacaugcaauaggaacauccaucacacaaaaaggaauuauauucauacucuuaaugcuaguaacaccaaguauggcaaugagaugcgucgguauaggauccagagacuuuguugaaggauuaaguggagcaacauggguagauguaguuuuagaacaugggucauguguaaccacgauggcaaaagauaaaccuacacucgacauugaacuuuuaaaaacagaaguuacaaaucccgcaguucucaggaaacuaugcauagaagcaaaaauuaguaauacaaccacagauucuagguguccgacacaaggagaagccacucucguggaggaacaagaugcaaacuuuguaugcagacggacauucgucgacagagguuggggaaauggcugcggguuguuuggaaaaggcucauuaaucacaugugcaaaauuuaaauguguaaccaaauuagaaggaaaaauugugcaauaugaaaauuuaaaauauucaguaauuguaacaguacauaccggagaucaacaccaggucggaaacgagucaacagagcauggaacaacagcaacaaucacgccgcaggcaccuacgacggagauucaguuaacagacuacggagcauuaacauuagauuguucgccuagaacuggacucgauuuuaaugaaaugguacuucucacaaugaaagaaaaaucuuggcuaguucacaaacaaugguuucuagacuugccgcuuccuuggacaaguggagcaucaacuucucaagaaacauggaaccgccaagacuuauuagugacauucaaaacagcgcaugcuaaaaagcaggaaguaguaguauuaggaucucaagaaggugcaaugcauacggcguuaacaggagcaaccgagauacaaacaucagggacaacaaccauauucgcuggccauuuaaaaugucgguuaaaaauggacaaacuuacuuugaaaggaaugucauauguaaugugcaccggaucauuuaaacuagaaaaggagguagcugaaacacaacauggcacaguucucgugcaaauuaaauacgaaggaacggacgcgcccugcaaaaucccuuucaguacucaggacgagaaagggguuacgcaaaauggaagauuaauaaccgcaaauccuauuguaaccgauaaagaaaaaccaguaaauaucgaggccgagccuccuuuuggagaaaguuauauuguaaucggagccggugaaaaagcacucaaauuaagcugguucaagaaaggcaguuccauaggaaaaauguucgaagccacagcaagaggggcgagacguauggcaauauuaggagauacugcgugggacuuugggucaauuggcgggguauucacaucagugggaaaauuaguucaccagauauuugguacagcauacggaguccuuuucaguggagugucguggaccaugaaaaucggaaucggcguguuguugaccuggcuugguuuaaacagcaggaguacaucuuuaaguaugacauguauugcuguagggcuaguaacccuauauuuaggugucaugguucaagcagauucagggugcguaauaaacuggaaagggagggaguuaaaaugcgggucgggcauuuuuguuaccaaugaaguacauacuuggacggagcaguauaaauuucaagccgacaguccuaaaagacucucggcugcgaucgggaaagccugggaagaaggaguaugcggcauaaggagugcuacaagacuagaaaauauaauguggaaacaaauuaguaacgaguugaaccauauuuuacuagaaaaugacaugaaguucacaguaguugucggagauguggccgguauuuuagcucagggcaaaaagaugauaagaccacagccaauggaauacaaauacucuuggaaaagcugggguaaagcaaaaauuauaggcgccgacgugcaaaacacaaccuucauaauagacggccccaacacaccagaaugcccagacgaccaaagggccuggaauaucugggaagucgaagacuacggcuuugguauauucacaaccaacauuuggcuuaaacuaagggacagcuauacgcagguaugcgaccaucgauugaugucuagcgcgaucaaggauucaaaagcaguacaugcggacauggguuauuggauugaaucagagaagaaugauacauggaaacucgcucgugcaucuuuuaucgaaguaaaaacaugcauauggccaaagucacauacccuguggucuaacggaguauuagagucagaaaugauaaucccuaaaauauacggcggaccuaucucccaacacaauuaccggccagguuauuucacccaaacugcuggcccauggcaucuugguaaacuggaguuagacuuugaucuaugugaaggaacaacaguagugguugaugaacauuguggaaaucggggcccuagcuugagaacuaccacgguaacagguaagauuauacacgaauggugcuguagaucaugcacacucccgccacuucgauuccgcggagaagacggcuguugguauggcauggaaauaagaccaguaaaagaaaaagaagaaaaccuuguuaaaaguauggucucugcaggcucaggugaaguugacucuuuuucacugggguuacuuugcauuagcauuaugauagaagaaguaaugagaagccgcugguccagaaagaugcugaugaucgguacccuagcuguauucuuccuguuaauuaugggucaguuaaccuggaaugauuugaucagguuauguaucaugguaggggcaaacgcaagugaucgaauggggauggggacuacguaucucgcacuuauggcuacauuuaagaugagaccuauguucgcaguaggacuuuuguuuagacgguuaacaaguagagagguuuuacuguugacuauuggauugucacugguugcaagugccgaacugccaaauucauuagaagaguuaggagacggacuggcgaugggaauuaugaucuuaaaguuguugacggacuuccaaucacaucaacuaugggcuacauuacuaagucuuacauucauaaaaacuacuuuuucgcugcacuacgcguggaagacgauggccaugguacugagcaucguaagucuguucccauuaugccugagcacgacaucacagaaaacuacauggcuuccaguauuacuugguagucucgguugcaaacccuuaaccauguuccuaauagccgagaauaaaauuugggguagaaaaagcuggccacuuaacgagggaauuauggcugucggcauaguuagcauuuugcucucaucguuacuuaaaaaugacguaccuuuggcaggaccgcuaaucgcgggagguauguuaauagcuugcuacgugauaucagggagcucagcagauuuaucguuggaaaaagcagcagaaguuaguugggaggaggaagcagagcacucaggugccucucauaauauuuuaguugaaguacaagaugauggaacuaugaagauuaaggacgaagaacgugacgauacauugaccauacuucuaaaggcuaccuuguuggcgguaagugguguguuuccauuaagcaucccagcaacacuguuuguaugguauuuuuggcagaagaagaaacaaagaucaggcguuuuaugggacacgccgucucccccugaaguugaaagagcgguacuggacgacgggaucuauaggauaaugcaaagggguuuacucggacguucucaaguaggaguagguguauuucaagaaaauguauuucacacaauguggcacguaacucguggagccgucuugauguaccagggcaaacgauuggaacccaguugggcgagugucaagaaagaucuaauaucuuauggaggaggcuggagauuacaaggaucauggaauaccggggaagaaguacaggugauagcagucgagccuggcaagaauccaaagaauguucaaacugcucccggcacuuuuaaaaccccugaaggagagguuggcgccaucgcauuggauuucaagcccggaacaaguggcucgcccauuguaaacagagaaggaaagaucguagguuuauacggaaacggcguaguuacuaccucaggaacauauguuagugcaauagcgcaagccaaagccucacaagagggaccauuaccagaaauugaggacgaaguguuucggaagagaaaccuuacgauaauggacuuacauccagggucugggaagaccagacgauacuuaccugcaauaguucgagaggcaaucaaaaggaaguuacguacgcucauucuugcuccuacgagaguuguugcuucugaaauggcugaagcauugaaagguaugcccauaagauaucagaccaccgcggucaaaagcgaacacacaggaaaggaaauaguugaccucaugugucaugcuacuuuuacaaugagauuacugaguccuguuagggucccuaacuauaauaugauuauuauggaugaagcucauuuuacugaccccagcucaaucgcagcccggggauacauaucaacccgaguaggcaugggugaggcagcagcuauuuuuaugacagcgacaccgccuggaucagucgaagcguuuccacagaguaaugcaguaauucaagaugaggagagagauauuccagagcguaguuggaacucaggguaugaauggauuacugauuuuccugguaaaacaguuugguuuguaccuagcauuaaaagugggaaugauauugcaaauugccucaggaaaaauggcaaaagagugauccaacuaagcagaaagacuuucgauaccgaguaccaaaagaccaaaaacaacgauugggauuacguaguuacaacugauauuagcgaaaugggagcaaauuucagggcugauagaguuauugacccaagaagaugccuuaaaccaguaauucuaaaagauggaccugaaagaguuauucuggcugguccaaugccgguaacaguagcaucagccgcucaaagacgagggaggauugguagaaaccauaauaaagaaggagaccaguacaucuacaugggccaaccguuaaauaacgacgaggaccaugcccauuggacagaagcuaaaaugcuguuagauaauauaaauacuccugaaggaauaauuccggcauuauuugaaccugaacgggaaaagagugcggccauugauggagaauauagauuaaggggcgaagcccgcaagacauuuguagaauugaugagaaggggugaucuaccgguaugguugucguacaaaguagccagugaggguuuccaauauagcgaucgaagaugguguuuugauggggaacgaaacaaucaaguacuagaggagaacauggauguagaaauauggaccaaagagggggagagagagaaauugcgaccacgaugguuaggcgcucggacauacucggacccacuagcucugagagacuucaaagaauuugcggcaggucgaaggagcguaucgggagacuuaauucucgagaucggaaaguugccacagcaccuaacacagcgugcacaaaacgcauuggauaaucuuguuaugcuccacaacagucagcaaggcgggagggcauauacacaugcuauggaagaacugccagacacuauugaaacucuaaugcuacucgcuuuaauagccguacugacugguggugucacgcucuuuuuccuaaguggaaggggacuaggaaaaacaucgauuggucugcucugcguaauggcgucaucugugcuauuguggauggcaucaguagagccucacuggauagcagccucaauuauauuggaguucuuucugaugguacuuuugauuccggaaccagacaggcaaaggacuccucaggacaaccaacuugcauacguagugauaggcuugcuguuuaugauauugacuguggcugccaacgaaaugggucuauuggaaacaacuaagaaagacuuaggaauuggucacgucgccguugaaaaucaccaccaugccgccaugcucgacguugaucugcacccagcaucugcauggacccuguaugccguugcgacaacaauaauaacucccaugaugcgccacacaaucgaaaauacaacugcgaauauaucauugaccgcaauagcaaaucaagcggcuaucuuaauggguuuagauaaagguuggcccaucucgaaaauggauauuggugucccgcucuuagcacuugguugcuauucacaagugaacccgcuaacucuaacugcagcaguuuugaugcucguggcucauuaugcuauaaucggaccaggacuucaagcuaaagccacaagggaagcccaaaaacgaacugcugccgguauuaugaagaacccuacuguugacgggauuguagccauagaucuagauccagucguguaugaugcaaaguuugaaaaacaacugggacagaucauguuacuuauacuuuguacuucacaaauccuucuaaugagaacuacaugggcauuaugcgaaaguauuacucuugccacaggaccauuaacuacacuuugggaagguucaccggggaaauuuuggaauaccaccauagcaguuagcauggcaaacauuuuuagggguucauauuuggcuggagcaggauuggccuuuucauuaaugaagagucuugggggcggaagaagaggaacgggggcucagggcgagaccuuaggugaaaaauggaaaaggagguuaaaucaauuaucaaagucagaguucaacacauauaagagaagcggaaucauggaagucgauaggagugaggccaaagaaggauuaaaacggggugaaaccacaaagcacgcagugucgcgagggacugcaaaauuaaggugguuugucgagcggaaucuugugaaaccugagggaaaggugaucgacuuaggauguggaagagguggauggucauauuauugugcgggcuugaagaaagugaccgaaguuaaaggcuacacuaagggugggccaggacaugaggaaccuauuccuauggccacauacggguggaauuuaguaaaauuacacucugggaaagauguauucuuuauaccaccugaaaaaugugauacguuacucugugacauuggagaaaguagcccaaauccaacaauagaagaagguaggacauuaagaguuuuaaaaauggucgaaccaugguugagaggaaaccaauuuugcauaaaaauccugaacccuuauaugccgucugugguugaaacuuuagagcaaaugcaaagaaaacauggcggaaugcugguacggaacccgcuaucaaggaacucaacucacgagauguauuggguaaguuguggaacgggcaacauaguaucagccguaaauaugacguccagaaugcuauuaaacagauuuacaauggcccaucggaaaccgaccuacgaacgugaugucgauuuaggcgcgggcacuaggcacguagccguggagccagagguugccaaucuagauauaauugggcaacgaauugaaaacauuaaacaugaacacaaaaguacauggcacuacgaugaagauaauccguacaaaacuugggcauaucauggaaguuacgaagugaaaccauccggcagugccuccagcaugguaaauggaguaguaaaacuauuaacuaaaccuugggaugugaucccaaugguuacucaaauagcaaugacugauaccacuccuuucggacagcaaaggguauuuaaagaaaaaguugacacuagaacacccaaagcaaaacgaggaacagcacaaaucauggaaguaacagcccgaugguuguggggcuuuuugucuagaaacaagaaacccagaauuuguaccagggaagaguucacaaggaagguuagaaguaaugcagcuauuggagcaguguuuauagaugaaaaucaguggaacucugccaaagaagcuguagaagaugaaagauucugggaucucguccaucgugaacgcgaguuacauaaacagggcaagugcgcaacauguguauacaacaugaugggcaagcgugagaagaaacuuggagaauuuggaaaagccaaaggaaguagggcgauuugguauauguggcugggugccagauuccucgaguucgaagcacuaggauucaugaaugaagaccacugguuuagucgggagaauagccucagcggaguagaaggagaaggacuucauaaguuagguuacauauugcgggauaucucgaaaauaccugguggaaacauguacgcugaugauacggcagguugggacacacguaucaccgaagaugacuugcaaaacgaagcaaaaauuacggacauuauggaaccagaacacgcauuacuugcaaaagcgauauuuaaacuaacauaucagaacaagguaguccgaguucagagaccagccaaaaaugggacaguaauggauguaauuucaaggagagaucaaagggguaguggacagguagggacauaugguuuaaacaccuucacuaauauggaagcccaauuaauuaggcagauggagucagaaggaaucuuuuccccuucugaacuugagaccccaaaucuggccgaaagaguuuuagauugguuaggaaaauaugguguagaaaggcuuaagcguauggcaaucucgggagaugauuguguaguaaaaccuauugaugauagauuugcgaccgcauuaacugcauuaaaugauauggggaaagugcguaaagauauuccgcaaugggaaccuaguaaaggauggaaugacuggcaacaaguaccauuuuguagucaucauuuucaucaauuaauaaugaaagacgguagagaaaucguaguaccuuguagaaaccaagaugaauuaguaggaagggcuaggguuucacagggagccggcuggucacucagagaaacagccuguuugggcaagaguuaugcacaaauguggcaauuaauguauuuccaucguagagacuugagacuagcggcgaaugcgauauguucugcggugccugucgauuggguaccaaccucacgaaccacauggagcauucaugcacaccaucaauggaugacaacugaggacauguugaguguauggaaccgaguuuggauugaggaaaacccguggauggaagauaaaacacacauaucaaacugggaagauguucccuaccucgguaaaagagaggaucaaugguguggcagcuugauuggccuuacagcuagggcaacuugggcuaccaauauacaagucgcuauaaaccaagugaggcgucucauuggaaacgaaaauuaccuugauuauaugacgucaaugaagcgauuuaaaaaugaaucagauccagagggggcuuugugguaa

SEQ ID NO: 21113 - RNA, 9879 nt, Artificial Sequence
  derived and/or modified CDS sequence (opt6) from DENV-1__KF971871__SS-prME
agcguaacuauguuauuaaugcugaugccuacggcguuagcauuucacuuaacgacacgagggggagaaccucauaugauggucucaaaacaagaaaggggaaaaaguuuguuauuuaaaaccucugcaggagugaacaugugcacccuuaucgcaauggacuuaggugaauuaugugaagacacuaugacuuauaaaugcccgcguauaacggaagcugaaccagaugacguugauugcuggugcaacgccaccgacacaugggugacauaugggacaugcagucaaacaggugaacauagaagagacaaacggucaguggcauuggcaccacacguuggcuuagguuuggaaacucguacagaaacuuggaugaguagcgaaggagcuuggaaacaaauacaacguguagaaacuugggcuuuacggcauccgggauuuacgguaauugcgcuauucuuagcgcacgccaucggaacaaguaucacacaaaaagguaucauauucauuuugcuuaugcuaguuacccccagcauggcaaugcgcugugugggaauagguucacgagauuuuguagaagggcuuuccggagccacauggguagacguaguucuagaacaugggaguugugucaccacuauggcgaaagacaaaccgacccuugacauugaacuacugaaaacugaagucacaaauccagccguauuaagaaaacuaugcauugaagccaaaaucuccaauaccaccacugauuccagguguccaacucaaggagaagcaacacuuguugaggaacaagacgcaaauuucguauguaggcguacauucguagaucgcggguggggaaacggauguggauuauuugguaaaggaagccuaauaacuugugcaaaguucaaguguguaacaaaacuagaagguaaaauaguccaguaugaaaauuuaaaauacagcgucauaguaaccgugcauacuggugaucaacaucaaguagggaaugaaucuacagaacaugggaccacugcuacuauaacaccacaggccccuacaacagagauucaacuaacggauuacggggcuuugacuuuagacugcucacccagaacuggauuggauuuuaaugagaugguccuacuuacgaugaaagagaaaucauggcugguucauaaacaaugguucuuggauuuaccucugccauggacgucaggagccagcacuucacaagaaaccuggaacaggcaagaccuucuaguaacguuuaagacagcgcaugccaagaagcaagaaguagucgugcuaggcucgcaagaaggugcuaugcauacagcacucacgggcgccacugaaauccagacaagugguacaaccacaauauuugcaggacaccuaaaauguagacugaaaauggauaagcugacgcuuaaagggauguccuauguaauguguaccgguaguuuuaaauuggagaaagaggucgcugaaacacagcaugguaccguccuuguucaaaucaaauaugaaggaacagaugcaccaugcaagauuccauucucgacucaggaugaaaaaggaguaacacaaaacggacgauuaauuacagccaacccaauaguuacggacaaagaaaaaccaguuaacaucgaagccgaaccaccauuuggagaaucguauaucguaauaggggcuggcgagaaagccuuaaagcucucgugguuuaagaaaggaucaucgaucgguaaaauguucgaagcuacggcaagaggagcaaggagaauggcaauacuaggugauacagcgugggacuucgggucuaucgguggaguauucacaagcgucggaaaauuaguccaucagauauuugggacggcauaugguguuuuauuuagugggguuagcuggacuaugaagauaggcauaggaguguuacuaacguggcugggacuuaacucacgaagcacgucacuaucaaugacgugcauugcaguaggucuagucacucuauauuugggcguuaugguucaagcagauagcggcugcguaauaaauuggaagggacgggaacuaaagugcgggagugguaucuuuguaacuaaugaaguacauacauggacagaacaguacaaguuccaagcagacucacccaaaagauuaucagcugcaauuggcaaagccugggaggaaggaguuuguggcauaaggucggcaacaagauuagaaaauaucauguggaaacaaauaagcaacgaauuaaaucacauccucuuggaaaaugacaugaaauucacaguaguaguaggagauguagcaggcauccuagcacaagggaaaaagaugauucguccacaaccaauggaguauaaguauucauggaaaagcuggggcaaagcaaaaauaauaggagcagacgugcaaaauacgacauuuauuauagauggcccaaauacaccagaaugcccugacgaucaacgugcauggaauauaugggaaguugaggauuacgguuucgguaucuuuacaacgaacauauggcuaaagcuaagagauuccuauacacaaguuugugaccacagauuaaugucagcagcuaucaaagauagcaaggccguacaugcggauauggguuacuggauagaaagugaaaagaaugacacuuggaaacuugcucgcgcuucuuuuaucgaaguuaagacuugcauuuggccaaaaucucauacacuauggucuaacgggguauuggaaagcgagaugauaauuccuaaaauuuacgggggucccauaucgcaacauaauuaucgcccuggauacuuuacacaaacagcaggaccuuggcacuuagggaaauuagaacucgacuuugacuugugcgaagggacgaccguuguaguugaugaacacugcgguaauaggggaccaucauuaagaacgacuacaguaacaggaaaaaucauacaugaauggugcugccguaguuguacuuugccacccuuacgauucaggggagaggauggcugcugguacggaauggaaauuagacccguaaaagaaaaagaagagaacuuaguuaagagcaugguuucugcagguucaggcgaaguugacuccuuuaguuuaggcuuacucugcauaucaauaaugauagaagaagucaugaggucacguuggucaagaaagaugcuaaugauagguacacuagcaguauucuuucuuuuaauaaugggucaacuaacauggaacgaccuaauaagacuguguauuaugguuggugcgaaugcuucagacagaaugggcauggguacaacauaucucgcacucauggccaccuucaaaaugcgaccuauguuugcaguugguuuacuuuuccgacgguuaacaucaagggaagugcucuuacuuacgauuggacuaagccugguagcuucugcagaacuaccaaauucacuagaagaauuaggcgauggauuggcuaugggcauaaugauucucaaacuauugacugauuuucagucgcaucaacugugggcgacauuguugagcuuaacauucauuaaaacaacguuuagccuccauuacgcuuggaaaacaauggcuaugguauugucaauuguuucucucuuuccgcugugccuaucaaccacuucucaaaagacuaccugguuaccuguucuucuagggucacuaggaugcaagccccuaacuauguuuuuaauagccgaaaauaaaaucuggggacguaaaucguggccccugaaugagggaaucauggccgucggcaucguaaguaucuuauugagcaguuugcugaaaaacgacguuccacuagcuggaccccuuauagccggaggaauguuaauugcauguuacguaaucucaggaucaucagcugacuuaucguuggaaaaagcggcagaaguaucaugggaagaagaagcugaacacucaggugccagccauaauauucuagucgaaguacaagacgacggaacuaugaaaauaaaagacgaagaacgugacgauacacuuacaaucuuacuaaaggcaacuuuauuagcugugucugggguauucccuuuaucaauacccgcuacucuauuugugugguacuuuuggcagaaaaagaaacaaagaaguggaguccuuugggauacacccucgccacccgaaguggaaagagcuguacuugaugauggcauuuauagaaucaugcaacggggauuacuuggucgaucucagguuggaguaggcguauuucaagaaaaugucuuucacacaauguggcauguaacaagaggcgccguccuaauguaccaaggcaaacgucucgaaccaucaugggcuucuguuaagaaagauuugaucucauauggaggaggauggagacuacaaggaaguuggaauaccggugaagaaguccaaguaauagcaguagaaccugguaaaaauccuaaaaaugugcaaacagcaccgggaacauuuaagacuccugaaggcgaagugggcgcaauugcauuagauuuuaaacccgggaccuccggaagccccauaguaaacagagaaggaaaaauagucggcuuauaugggaacggugucgucacgacauccggcaccuauguaagugcaaucgcacaggcuaaggcaagccaagaaggcccacuaccugagauagaagaugaaguauucagaaaaagaaacuuaacaauuauggacuuacauccagguagcggaaagaccaggcguuaucuccccgcaauagugcgagaggcuauaaaaaggaaacuaagaaccuuaauccuagcaccgacccgcgugguggcaagugaaauggcagaggcuuuaaaaggaaugcccauaagguaccagacgaccgcaguaaagucggagcauaccggaaaagagauuguggaucuaaugugccaugcaacauuuacuaugcggcuucucucaccaguucggguacccaacuauaacaugauaauaauggacgaagcucacuucaccgaccccucuuccauugcggcacgagguuacauaucgacacggguagguaugggagaagcagcggccauauuuaugacugcuaccccuccuggcagugucgaagcauucccccaaagcaaugcugucauacaagacgaagaaagagauaucccagagaggucuuggaacaguggcuacgaauggauuacagacuuuccugguaaaacaguaugguuuguuccaaguauaaaaucugggaacgauaucgcaaacuguuuaaggaaaaauggaaaacggguuauacaacucucgagaaaaacuuuugauacugaguaucagaaaacgaaaaauaacgauugggacuaugugguuaccacagauauaagugaaaugggagcaaauuucagagcagacagagucauagauccucgaagguguuuaaaaccgguaauuuugaaggacggaccagagcgaguaauccuagcagggccaaugccaguaacaguggccucggcagcacaaaggcggggacguauaggacguaaucauaauaaggagggagaucaauauauauacaugggucagccuuuaaacaaugacgaagaucacgcucacuggacagaagcaaaaaugcuuuuagacaacauaaacaccccagaaggcauaaucccugcauuauuugaacccgaaagagagaaaucagcagcaauagauggcgaauaucgucugcgaggcgaagcaagaaagacauuuguagaacuaaugagaagaggcgaccuaccaguauggcuaucuuauaaaguagccucagaaggguuucaguauucugauagacguugguguuucgacggcgaacgaaacaaccaaguccuugaagagaacauggauguagaaauauggacuaaagaaggugagcguaagaaacuacgaccacguugguuaggcgcucguacguauagugauccucucgcccuccgagaauuuaaagaauuugcagcuggaagacgaucgguuucaggugacuugauauuagagaucggcaagcuaccucagcauuuaacgcaaagagcacaaaaugcacuggacaaucuaguaaugcuucacaacagugaacaaggcggacgcgcauauagacacgcaauggaagaacugccagacacgaucgagacauuaaugcugcucgcauuaauagcagucuuaacagguggaguuacucuauucuuuuuaaguggcagaggacuggguaaaacaaguaucggacuacucugugucauggcaucaucgguucuuuuauggauggcaucgguagagccacauuggauagcagccucaauuaucuuggaguucuuucuuaugguccuauugauucccgaacccgauagacaacgaacuccucaagacaaucaacuagcuuacguagucaucggucuccuauuuaugauauuaacuguggcagcuaaugaaaugggacuccuagaaacuacuaagaaagaccucggaaucggacauguugcaguggaaaaccaucaucaugcagcgauguuagauguggaccuucauccggcaucugcauggacacuauaugcaguagcuacuacaaucauaaccccaaugaugcgacauacaauugaaaacacaacagcuaacaucagucuuacagcuauugccaaucaagcugcaauuuuaaugggucuugacaaagguuggccaauauccaaaauggauauugguguuccacugcucgcucuuggauguuauucacaaguaaauccauugacauuaacagcagcaguguugaugcucguggcgcauuacgcuauaauagguccaggacuacaggcaaaagcuacaagagaagcucagaaaaggaccgcagcgggcauaaugaaaaauccgaccguugauggaauaguagcaauugaccuugacccaguuguguaugaugcaaaauuugaaaaacaauuaggacagauaaugcuucuaauuuuaugcacaucacagaucuuauuaaugagaacaacgugggcguuaugcgaaucgauaacacuggcuacgggaccuuuaacaacucuuugggaaggcucucccggaaaauuuuggaacacgacaauagcgguaucuauggccaauauauuucgaggaaguuaucuugcuggagccggucuagcauuuagcuugaugaaaucgcuagguggcggacgaagagguacuggugcacaaggcgagacccuaggcgagaaauggaagcgaagauugaaucaauuaucaaaguccgaguucaauacauacaaaaggucagguaucauggagguugauaggucggaagcuaaggagggauuaaaaaggggagagaccacaaaacacgcagucucaagagguacagcaaagcuacgaugguucgucgaacguaaccuuguaaagccugaaggcaagguuaucgaccuagguugcgggcgaggaggauggagcuauuauugcgcgggacuaaagaaagugacugaaguuaagggauacacaaaaggagguccuggacaugaagaacccauacccauggcuacguauggguggaaccugguaaagcuacauaguggaaaggauguauucuuuauaccaccagaaaagugugacacccuuuuaugugacauaggggaaucgagcccuaacccaacgauagaggaaggcagaacucuaaggguacuuaaaaugguagaaccuugguuacgagguaaccaauucuguaucaagauacucaacccauacaugccaaguguuguagaaacauuagaacaaaugcagaggaagcacggagggaugcuggugagaaacccucuaagcagaaacagcacacacgagauguacuggguaaguuguggcacagguaacauuguuagugcaguaaacaugacaucacgaauguuguugaaucgauucacaauggcacaucggaaaccaaccuaugaaagagacguagaccuuggagccggcacgagacauguugccguagaaccagaaguugcaaaccuugauauaauaggacagagaauugaaaauauaaagcacgagcauaagucgacguggcacuacgaugaagacaacccguacaaaacuugggcuuaucauggaaguuaugaagugaaacccucagguucagcuucgucgaugguaaauggagucgucaaacuacucaccaaaccaugggauguaaucccaauggucacucagauagcuaugaccgacacaacgccguuugggcagcaacggguuuucaaggaaaaaguggauacuaggacaccaaaagcuaagcggggaacugcacaaauaauggaaguaacagcgaggugguuaugggguuuccugucgcggaauaagaaaccgcgaauauguacgcgggaggaguucacccggaaaguaagaucuaacgccgcuauaggagccguuuucaucgaugaaaaucaguggaacucagcaaaagaagcagucgaggaugaaagauuuugggauuugguucauagggaaagagaauugcacaagcaaggcaaaugcgcaacuuguguuuauaauaugaugggcaaaagggagaagaaauugggggaguucggaaaagcaaaaggaucaagagccauuugguacauguggcuuggagcgagauuccucgaguucgaggcucuggguuuuaugaaugaggaucauugguucagcagagagaacagccuaucuggcguagaaggugagggauuacauaaacucggauauauucuucgcgauauauccaaaauacccggaggaaacauguaugcggaugauacugcaggaugggauacucggauuacugaagaugaccugcaaaaugaggcaaaaauaacggauauuauggaaccugaacacgcguuacuagcaaaggcgauauuuaaacuaacauaucaaaauaaagucgucagagugcaaagacccgcuaaaaacggaacuguuauggacgucauaagcagaagagaccaaagaggaagcggacaaguugguaccuauggacuaaauacauuuacaaauauggaagcacagcugauaagacaaauggagucugaggguauauuuaguccaucugaacuagaaaccccgaaucuagcagaacgaguacucgacuggcuggguaaauacgguguagaaaggcuaaagagaauggcaaucucaggagacgauuguguagugaagccaauagaugauagauuugcuacagcacugaccgcacuuaacgauaugggaaaaguacguaaggauaucccccaaugggaaccaagcaaagguuggaaugauuggcagcaagucccauuuuguagccaucacuuucaucaguugauaaugaaagauggaagagaaauaguaguaccauguagaaaucaggaugaguuaguaggucgagcgcgaguaucacaaggggcugguuggucauugagagaaacagcaugucuaggcaaaagcuaugcucagauguggcaguuaauguauuuucaucgaagagaucuuagacucgcugcuaacgcuauauguuccgcaguaccuguugacuggguaccaacaucuaggacaacuuggucuauacaugcucaucaucaguggaugacaacggaggauaugcucagcgucuggaauagaguauggaucgaagaaaauccauggauggaagauaaaacacacaucuccaacugggaagacguacccuaucuaggaaagagagaagaucaauggugugguucccugauaggacuuaccgcuagagcuacuugggcaaccaacauccagguggcaauaaaccaaguccgucgguugauaggaaaugagaacuaccuugauuacaugacuagcaugaaaagauucaagaaugagagugauccagaaggugcgcuaugguag

SEQ ID NO: 21114 - RNA, 9879 nt, Artificial Sequence
  derived and/or modified CDS sequence (opt6) from DENV-1__KF971869__SS-prME
agcgugacaaugcuucuaaugcuuaugccgacggcguuagcguuucauuuaacuacacguggcggggaaccgcacaugaugguaucaaaacaggaacgagggaaaucucuuuuguuuaaaacuucagcuggaguaaauaugugcacacuaauagcgauggaucuaggugaauuaugugaagacacuaugacuuauaaaugcccaaggauuacagaagcugaacccgacgauguugauuguugguguaaugcuacggauacauggguaacuuauggaaccuguagucaaacaggagaacaucgccgugauaaacgcaguguggcucuagcgccacauguaggguuaggauuagaaacacguacugaaacauggaugucgucggaaggagcauggaaacaaauacagagaguugaaacgugggcucuacgccaucccggauuuacuguaauugcucuauucuuagcucaugcaauuggaacaagcauaacucagaaagguauuauuuuuauauuacucauguuagucaccccaucaauggcgaugcguugugugggaauuggaucucgagauuucguagaaggucucuccggagcaacuugggucgacgugguuuuagagcaugguuccuguguuaccacgauggcaaaagacaaaccuacgcuagacauugaauuguuaaaaacugaaguaacaaauccggcuguacuacgcaaauuauguauugaggccaaaauaagcaauaccacgaccgacagcagaugcccaacacaaggugaggcuaccuuaguugaggagcaagacgcaaauuuuguaugucggcgcaccuuuguagacagaggguggggaaaugggugcggucuguuugggaaagggucacuuauaacgugcgcaaaauuuaaaugcguaacaaaacuagaaggcaaaauuguacaguaugaaaacuugaaauauuccguaauuguaacaguacauacgggagaccagcaccagguaggaaacgaauccacagaacauggaacuacagcuacaauaacuccucaggcuccuacaacagaaauacaacuaacggacuauggcgccuuaacgcucgacugcucaccacgcacuggguuagauuuuaaugaaaugguauuauuaacaaugaaagaaaaauccuggcugguacacaaacaaugguuucuugauuugccauuaccuuggacauccggugccucaacaucucaagagacauggaauagacaagaucuuuuaguaacauucaaaacagcgcacgccaagaaacaagaaguugugguacuuggcagucaagaaggugcaaugcauacagcuuuaacaggcgcuacggaaauacaaacguccggaacaaccacuauauucgcaggacaccuaaaaugucgccuuaaaauggauaaguuaaccuuaaaaggcaugucguauguaauguguacagggucauucaaacuagaaaaagagguggcggaaacacaacacgggacuguuuuagugcaaauaaaauacgaaggaacagaugcacccuguaaaauaccuuuuuccacucaggaugagaaggguguaacgcaaaacgguagauuaauaacggcaaacccgauugucacagauaaagaaaaacccguaaacauagaagcugaaccaccauucggugagaguuacauuguuauuggggcaggagaaaaagcacuuaaacucaguugguuuaagaaaggaaguucuauaggcaagauguucgaagcuacugccagaggggcccgaagaauggcaauucuaggugauacugccugggacuuuggaucaauaggugggguauucacgucggucggaaagcuaguacaccaaauauucgggacagcguacggagugcuauucaguggcguaaguuggacuaugaaaauaggaauaggagugcuuuuaaccuggcuagggcuaaacagucggagcacaucauuaucuaugacuugcauagcagugggauuagugacccuuuauuuagggguuauggugcaagcagacagugggugcguuauuaauuggaaggggcgcgaacucaagugugguucagguaucuucguuacaaaugaaguacacacuuggacagagcaauauaaauuccaagcagacucuccgaaaaggcugucugcggcaauagguaaagccugggaagaaggaguaugcggcauacguagcgccacaagguuagaaaauauuauguggaaacagauaagcaacgaauugaaucauaucuuacuagagaacgacaugaaguuuacggucguugucggcgauguggccggaauacucgcacaagggaaaaagaugauuagaccgcaaccuauggaauauaaauauaguuggaagucauggggaaaagcuaagauaauuggagccgauguacaaaacaccaccuuuauaauagaugggccgaacacgccagaaugcccugaugaucaaagggcuuggaacaucugggaaguugaggauuauggcuuuggaauauuuaccacgaauauuugguuaaagcuccgugauuccuauacccaagugugcgaccaccguuuaaugucagcagcuauuaaagacuccaaggcaguacaugcggauaugggcuauuggaucgaaucugagaaaaaugauacguggaagcuagcacgcgcaaguuuuauugagguaaagacauguauauggccuaaaucucauacacucuggucgaauggugucuuagaauccgaaaugauaauacccaagauauaugguggaccuaucagucaacauaauuauagacccggauauuuuacacaaacagcgggaccauggcaccuagguaaacuugaauuggauuuugauuugugcgaaggaacuacuguggucguagaugaacacugcgggaaccgagggccaaguuuacguacgacgacaguaacaggaaaaauaauacacgaauggugcugucgaagcugcacccugccuccguuacguuuuaggggugaagauggguguugguaugguauggaaauccgaccgguaaaggaaaaagaagagaaccuaguuaaaucaaugguaagcgcagguucaggagaaguggauaguuucucucuggguuuauugugcauuuccauuaugaucgaagaaguuaugaggaguagguggaguagaaaaauguuaaugauagggacauuagcagucuucuuccuccugauuaugggucaacucacuuggaaugaucucauaaggcuaugcauaaugguaggggcgaacgcuucagaccguaugggaaugggaacaacauaccuggcgcuaauggcgacuuuuaaaaugaggccaauguuugcggucggauuguuauucagaaggcuuacaucacgugaaguacuucucuuaacuauuggacuuucauuaguagcuagugcagaauugccaaauucucuggaagaauuaggagauggacuugcaauggguauuaugauacuaaaauuacucacggauuuucaaucacaccaauuaugggcaacccugcuuagcuuaacauuuauaaaaacaacguuuucacuccacuaugccuggaagacaauggcaaugguuuugagcauaguaucauuauuuccucuaugucugaguacuacuucacaaaagacuacauggcugccaguacuacuuggaaguuuaggaugcaaaccauugacgauguuucucauagccgaaaauaagauauggggacggaaaucauggccucucaacgaaggaauuauggcgguuggcauugugucaauacuauugucaaguuuguugaaaaaugauguaccgcuagcagguccauuaauagccggugguaugcucauagccugcuauguuauaagcgguucuucagcagaucucagcuuagagaaggcagccgaagucucaugggaggaagaagcugaacacagcggcgcuucucacaauauuuugguagaaguucaagacgaugguacaaugaaaauaaaagaugaagagagagaugacacccuaacuauacuacuaaaagcaacgcuguuggcaguuagugguguguuuccauuaaguauacccgcaacauuguuugugugguauuuuuggcagaagaagaaacaaagaagugggguauuaugggacacaccuaguccaccugaaguagaaagagcaguauuggaugauggaauuuacaggauaaugcagagaggucuacuuggaagaucucagguuggaguuggaguauuccaggaaaacgucuuccauacuauguggcacguaacgcgaggagcaguccugauguaccaaggaaaacggcuagaacccaguugggcuucagucaagaaagaccuaauaucauauggaggaggauggagauuacaaggauccuggaauacgggagaagagguacaagucauugcuguugaacccggaaagaacccaaagaauguucaaacagcgccaggcaccuuuaaaacgccagagggugaagugggcgccaucgcuuuagacuuuaaaccggguacaagcgggucccccauaguaaacagagaagguaaaauaguuggacuauacggaaacgggguaguaacaacuuccggaacauacgugucugcaaucgcucaggcgaaagcaucccaagagggaccccucccagaaaucgaagaugaaguguuucgaaagagaaauuugacuauuauggaucuccacccaggcucggggaaaacacggcgauauuuaccugcaauugugagagaggccauuaagcguaaacuaagaacccugauacuggcuccuacacgaguuguagccagcgaaauggcugaagcauuaaaagguaugccgauuagauaucaaacuacagcaguuaaaagcgaacacacagguaaagagauuguggaccuaaugugccaugcuacuuucacgaugcgccuucuaagccccgucagaguaccgaauuacaacaugauaauuauggaugaagcacacuuuacggacccauccucgauagcagcucguggauauauuucuacuagaguuggaaugggagaggcggcugcgauauuuaugacugcgacuccaccagguucagucgaagcauuuccacaaucaaaugcaguaauucaagaugaggagagggacauaccugaaagaucguggaacucaggcuacgaguggaucacagauuuucccggaaaaacaguaugguucgucccuucuauaaagucugguaacgacaucgcgaacugcuuaagaaagaaugguaaaagaguuauacagcugucucguaaaaccuucgacacagaauaucagaaaacgaagaacaaugauugggauuaugucguuaccacugauauaucggagaugggggcaaauuuucgagcggaucgaguaaucgaccccagacgaugccuuaagccaguaauuuugaaagacggucccgagagaguaauccuagcaggaccaaugcccguuacuguagccucugccgcgcaaagaagaggccguauaggcagaaaccauaacaaggaaggugaucaguauauuuauaugggccaaccuuugaauaaugaugaagaucaugcacacuggacugaggcgaaaaugcuucuggacaacauuaacacccccgaaggaauaaucccagcguuauucgaacccgaaagagagaaaucagcagcuauagauggcgaauaucgauugaggggagaagcgaggaaaacauucguugaauugaugagacgaggggaucuaccgguauggcuaucauauaagguagcuucagaaggauuucaauauucagauagaaggugguguuuugauggagaacggaauaaucaaguuuuagaagagaacauggauguggaaaucuggaccaaggaaggugaaagaaagaaauuaaggcccagaugguuagacgcaaggacauauagcgacccucuagcgcucagagaauuuaaagaauuugccgcaggacgacguagugucagcggugaccugauauuagaaauaggaaaacuuccgcagcaccucacacaaagagcacaaaaugcacuagacaaccucguaaugcuccauaauuccgaacaaggagggcgcgcguauagacacgcaauggaggaauuaccagacacaaucgagacguuaaugcuauuagcauuaaucgcgguucugacaggaggaguaacauuauuuuuccuauccggaagagguuugggaaaaacuucuaucgggcuacucugugucauggcaucaucaguacuucuauggauggcauccguagaaccgcauuggaucgcagccucaauaauacuagaguuuuucuugaugguauuacugauaccagaaccugaucgucagaggacaccgcaagauaaucaauuggcguacgucgucauuggauuguuauucaugauauuaacugucgcugcaaaugaaaugggacuuuuagaaacaacgaaaaaggaccuggggauaggucacgucgcagucgagaaucaccaccaugcagcuaugcuagacguagaucuacauccugcuagcgccuggacccuauaugcaguggcaacuaccauuauuacaccuaugaugaggcauacaauugaaaacacaacggccaauaucagcuuaaccgccauagcaaaucaagcugccauacuuaugggauuagacaagggauggccaaucucaaaaauggacauaggugucccacuucucgcucuugggugcuauucccaaguaaacccucucacuuuaacugcagcaguacucauguuaguugcgcauuaugccauuauaggacccggacuucaagcaaaggcaacgcgugaagcgcaaaaacggacugcagcaggaaucaugaaaaauccaacaguugaugggauaguagcgauagaucuagauccugucguauacgaugcuaaguucgagaaacaguuaggccaaauuaugcuucuaaucuuaugcacuucgcaaauauuauuaaugcgaacaacuugggcgcuaugugagucaaucacauuagcaacugggccuuuaacuacuuuaugggaaggcagcccggggaaauuuuggaauacgacuauugcaguaucgauggcgaauauuuuuagagguaguuacuuggcgggagcgggacuagcauuuucguuaaugaagucacuaggggguggucgucgugggaccggagcucaaggagaaacgcugggagaaaaauggaaaagaagauuaaaccaauuaaguaaaucagaguucaauaccuauaaaagaucugguauaauggaaguggaucgauccgaagcaaaagagggacuaaagcgaggggaaacuacuaaacaugcgguuucgagagguacagccaaauugagaugguuuguugagcgcaauuuagucaaaccagaagggaaaguaaucgacuuaggauguggacgcggaggcuggagcuauuauugcgcuggucucaagaaagucacggaggucaaggguuacaccaaaggcggaccaggacacgaggaaccgaucccaauggccacguauggcuggaaucuugugaaguuacauagugguaaagauguauucuuuauuccaccggaaaaaugcgacacacugcuaugugacauuggggagucauccccgaauccgacuauagaggaaggacgcacgcuuagaguauuaaagaugguagaaccauggcuccgagguaaucaauuuuguaucaagauucuaaacccguacaugccgucaguagucgagaccuuagaacaaaugcaacgaaaacaugguggaaugcuaguacgaaacccucuuagucggaauaguacucaugaaauguauuggguuuccuguggaaccgggaacauaguuucggcaguuaauaugacgucgagaaugcuacugaaucgauuuacaauggcacacaggaagccuacauaugaacgugaugucgauuuaggagcuggcacuagacauguagcaguagaaccagagguagcaaacuuagauauuauaggccagagaauagaaaacauaaaacaugaacacaagaguacauggcauuaugacgaggacaaccccuauaaaacgugggcauaucaugggagcuacgaaguaaaaccuuccgguagugccaguagcaugguaaaugggguagucaaauuauugacuaaaccaugggauguuauaccgaugguaacacaaauugccaugacagauacaaccccuuuugggcaacagagaguauucaaagaaaagguagacacaagaacaccgaaagcaaagagagguaccgcucaaauaauggaggucaccgcacgauggcuuuggggauuuuuaaguaggaacaagaagccucggaucugcacacgugaagaauuuacccgcaaaguaagaucaaacgcugcaauaggagcaguauucauagacgaaaaccaauggaacucugccaaagaggcuguagaagaugagcguuuuugggauuuaguacaccgagaaagagaacuacacaagcaagguaaaugcgcgacgugugucuacaacaugaugggaaaaagagagaagaaacuaggugaauuuggaaaagcgaaagggucaagggcgauaugguacauguggcuaggggcaagguuuuuagaguuugaagccuuaggcuuuaugaaugaagaccauugguuuuccagggaaaauucauugaguggugucgagggagaggguuuacauaaacuuggauacauacuucgagauauaucaaaaauacccggaggaaauauguaugccgaugauacggcuggaugggacaccagaauuacagaagaugaucugcaaaacgaagcaaaaauaacugauaucauggaaccagaacacgcguuacuugcgaaagcaauauucaaauugacauaucaaaauaaaguuguacguguucaacgaccggcgaaaaaugguacuguuauggacguaauaagucguagagaucaacgcgguucugggcaaguuggaacauaugguuuaaauacuuucacuaacauggaggcacaacuaauaaggcaaauggagagcgaagggauauuuucgccuucagaacuggaaacaccgaacuuagcagaacgaguccuagauugguuagguaaauauggaguugaaaggcuaaagagaauggcgauauccggagacgauuguguaguuaagccgaucgaugaucgauucgcaaccgcauuaaccgcuuuaaacgauaugggaaaggugagaaaagauauaccucaaugggagccgaguaaggguuggaaugacuggcagcaaguaccauuuugcucucaucacuuucaccaacuaauaaugaaagauggacgugaaauagucguuccgugcagaaaccaagaugagcuaguagggcgagcaagaguaucacaaggagccgguuggucacuucgagagacugcuugucuaggaaaaagcuaugcgcagauguggcaauugauguauuuucaccggagagaccucagacuugcagcaaacgccaucuguagcgcuguaccaguagacuggguccccacgaguagaacaacguggucuauacaugcacaccaucaauggaugacaaccgaagacauguugagcguguggaaucggguuuggauagaagaaaacccguggauggaagauaagacacauauuaguaauugggaagaugucccuuacuuagguaagcgcgaggaccaaugguguggaaguuuaauaggcuugacagccagagcaacuugggcuacaaauauacaaguggcaauaaaucaggucagacgauugauaggcaaugaaaauuauuuagauuacaugaccaguaugaagcgauuuaagaaugaaagugauccugaaggugcauuaugguaa

SEQ ID NO: 21115 - RNA, 9879 nt, Artificial Sequence
  derived and/or modified CDS sequence (opt6) from DENV-1__JN903578__SS-prME
ucaguaacuaugcuacuaaugcuacugccuacggcauuggccuuucauuuaacuacuagagguggggaaccgcacaugauaguaucaaagcaggaaagagguaagucccuuuuguucaagacaucagugggagucaauauguguacucuaauagccauggaucuuggggaauuaugcgaagauaccaugacauauaaauguccucguauaacggaagcagaaccagacgacguagacuguugguguaaugcgaccgacacauggguaaccuaugguacuugcucucaaacaggcgaacauaggcgugacaaaaggagcguggcauuagcuccacauguaggacuagguuuagaaacaagaacagaaaccuggauguccucugaaggagccuggaagcaaauccaacggguagaaacgugggcacuaagacauccaggauuuacugugauugcucucuuuuuagcucacgcaaucgguacuagcauaacgcaaaaaggaauuaucuucauucuacuuauguugguaacaccaaguauggcaaugcgauguguggggauagguaaucgagauuuuguggaagguuuguccggagccacguggguagauguaguccuugaacaugguaguugcguaacuacaauggcuaagaacaagccuacguuagacaucgagcuccucaaaacagaaguaacaaauccggccguacucagaaaacuauguauugaagcgaaaauaaguaauacgaccacggacucacguugcccaacucaaggugaagcuacuuuagucgaagaacaagaugcuaauuucgucugucguagaacauuuguugauagaggauggggaaauggauguggacuauuugguaaggguucucuccugacgugcgccaaauucaaaugcguaacgaaacuugaaggcaaaguuguucaauaugagaauuugaaauauucuguuaucguaacaguacauacaggagaucaacaucagguagguaaugaaacgacagagcacggaacuauugcaacuauuacaccccaggcuccaacgucugagauucaacuuacugacuauggugcacuaacacuagacugcaguccgcgaacggguuuggauuucaacgaaaugguccuauuaacaaugaaagaaaaaucuuggcuaguucacaaacaaugguucuuggaccuaccccuaccuuggacaaguggcgcuucuacaagccaagaaaccuggaacagacaagaccuguuagugacauucaaaacagcacaugccaagaaacaagaaguagucguacucgggucucaagagggugcgaugcauacagcacuaaccggcgcaacugagauccaaacgucaggaacaacaacaauuuucgcuggccaucuaaaauguagacuuaagauggauaaacuaacuuugaaagguaugaguuacguuauguguacggggucuuucaagcuggagaaagaaguggcagaaacacagcauggaacugugcucguacaggugaaauacgaaggaacugaugcaccauguaagaucccuuucuuaauucaagaugaaaaagggguaacgcaaaacgggcgauuaauaacagcaaauccaauuguuacugacaaagaaaaaccaguaaacauagagacugaaccaccuuuuggugaaagcuacauugucgugggagcuggugaaaaggcacuaaaacuaucuagauucaagaaaggaucuaguauaggaaaaauguuugaagccacugccagaggggcacgucggauggccauauuaggcgauaccgcgugggacuucgguucuaucggagggguguuuacauccguuggaaagcuaauacaccaaguuuuugguacagcauauggaguauuauuuucagguguaucauggaccaugaaaauuggaauagguauucuacuaacaugguuaggacuaaacagucgaucaacaucucuaucaaugacauguauuacuguuggaaugguaacccuauacuugggcguaaugguucaggcagauucuggcugcguuaucaacuggaaaggaagagaauugaaaugcggaucuggaauuuuuguaaccaaugaaguacauacguggacugaacaauacaaauuucaggcggacagcccaaaacggcuuagcgcggcuauaggaaaagcaugggaagaggguguauguggaauaagauccgcgacacgauuagagaacauaauguggaaacaaaucagcaacgaacucaaccauauuuuacucgaaaaugauaugaaauuuaccguaguaguaggagaugcaaaugguauauuagcccaggggaaaaagaugauacgaccucaaccaauggaacauaaguauucauggaaaaguugggguaaagcaaagauaauaggagcagauauacaaaauaccacauucauuauagaugggccggauacaccugaaugcccggaugaccaaagagcguggaauauuugggaaguggaagauuaugguuuuggaauauuuacuacgaauauaugguuaaaauuaagagacagcuacacacaaaugugugaccauagacucauguccgcggcaauaaaagacaguaaagcugugcaugcagacaugggauauuggauugagucagagaaaaaugaaaccuggaaacuugcucgugcgucguuuaucgaaaucaaaacauguauauggccaaaaucgcauacauuauggucuaauggagucuuggaaagcgaaaugauuauaccaaaaauauauggcgguccaauaucacagcauaaucauagaccaggcuauuucacacaaacggcuggucccuggcaucuggggaaacuugaguuagacuuugauguuugugaagguacaacaguggugguugaugaacacugcggaaaucggggaccuucccucagaacuacaacuguaaccggaaaaaucauucaugaaugguguugccgaaguuguacauuaccuccgcucagauuuagaggagaagauggauguugguacggaauggaaauacgcccagugaaagaaaaagaagaaaaccuaguucgaagcaugguaucugcaggaaguggcgaaguagacucuuucucgcuagguuugcuauguguuaguauuaugauagaagaaguaaugcgaucgagguggagccgcaaaaugcucaugacggggacguuagccgucuucuuucuccucaucaugggccaacuaacauggaacgauuugauacgauuauguauaaugguaggagcaaauguaucugauagaaugggaaugggaacgaccuaucuagcccuuauggcaacuuuuaaaaugcguccaauguucgccguggggcuacuauucagacgguuaaccaguagagaaguauuauuauuaacgauaggauuaaguuuaguagcaagugccgaacuacccaauuccuuggaagaacucggcgauggucuugcaaugggcauaaugaugcuaaaguuacuaacugauuuucaaagucaucagcuauggacaaccuugcuuucacuuacuuuuauuaaaacuacucugaguuuagacuaugccuggaaaacuaucacaaugauccuuucuauagucagcuuauucccauuaugucucucaacaacgucacagaaaaccacguggcuaccagucuuguuaggcagcuuuggaugcaaaccauuaacgauguuucuuauaacugaaaauaagauauggggucgaaaaucauggccccuaaacgaaggaaucauggcuguaggaauuguaucaauuuuguugagcucucugcuaaagaacgacgugccacuagcaggaccacugauugcagggggaaugcuaauagcguguuaugugaucucgggaucuucugcagaucucucgcucgaaaaagcugcagaagucaguugggaagaagaggcugaacacagugguacuucacauaauauauuggucgagguacaggaugacggaacgaugaaaaucaaggaugaagaacgagacgauacgcuaacgauauuacuuaaagcgacauuacucgcagugagugguguauauccuaugagcauaccggcaacauuguucguuugguauuucuggcagaagaagaaacaacggagcggaguguuaugggauacucccucaccucccgaaguggaaagagcgguauuggaugaugggauauacagaaucuuacaaagaggccuccuuggaaggucacaagucgguguaggcguauuccaagacggcguauuucauacaauguggcauguuacucgaggagcuguucuuauguaucaaggaaaaagauuagaaccauccugggcuucagucaagaaagaccuuauuucauaugguggaggauggagauuucagggaaguuggaauacaggcgaagagguacaaguaaucgcaguagaacccggcaaaaauccuaaaaaugugcagacaacgcccggaacuuuuaaaaccccugagggagaaguaggagcuauagcauuggauuuuaaaccagguacuagcggaucuccaauagucaaccgggagggcaaaauugucggccuauacggcaacgggguuguuacgaccagcggaacauaugugagcgccauugcacaagcaaaagcaagccaagaaggaccccuaccagaaauagaagaugaaguuuuuaaaaagagaaaucuaacuauaauggaucuucaccccgguuccgguaaaacuaggagguaccuucccgcaaucguuagagaagcaauaaaacgcaaacuucgaacuuuaauacucgcuccaacaagaguaguagcaagugaaauggcugaggcuuuaaaggguaugccgauaagauaccaaacaaccgcaguaaaaucagagcacacgggccgcgaaauaguugacuuaaugugccacgcaacuuucacaaugcgauuacugucaccugugcgaguaccgaauuauaacaugauaauaauggaugaggcucauuucacagauccagccagcaucgcggcaagaggcuacauuuccacacgaguuggaaugggagaagccgcugcaauuuucaugacagcgacgccaccagguucagucgaagccuucccacaaucaaaugcaguaauacaggacgaagaaaaagacauaccagaaagaaguuggaacucagguuacgauuggauaacggauuucccaggaaaaacugucugguucguuccaaguauaaaaucuggaaaugauauugcaaacugcuuacguaaaaaugggaaacggguuauacaacuaagccguaagacauuugacacugaguaucagaaaacuaaaaauaaugauugggauuauguugugacuacagauauuagcgaaaugggcgcuaauuuccgcgccgauagaguaauugauccaagacgaugccucaaaccaguuauuuuaaaagaugguccugaaaggguaauuuuggcaggaccuaugcccgucaccguggcuucggcagcgcaacgccgaggaagaaucggucgaaaucaaaauaaagaaggagaucaauaugucuacaugggacaaccuuuaaauaacgacggagaccaugcacauuggacggaagcgaagaugcuacuugacaauauaaacacaccugaaggaauaauaccagcauuauuugaaccagaacgugagaaaagugcagccaucgacggcgaauaccgcuuacguggagaagcuagaaaaaccuucguagaauugaugagacgaggugaccuuccggucugguuaucuuauaagguagcuagugaaggguuucaauauagcgacaggcgauggugcuuugacggagagagaaauaaccaaguuuuagaagaaaacauggauguagaaaucuggacuaaagagggagagaggaagaaauugagaccucgcuggcucgacgcccgaacuuauucugauccacuggcccuuagagaauuuaaagaauuugccgccgguagaagaucaguaucuggcgaccucauuuuggagaucggcaaacuuccacaacauuuaacgcuaagggcacaaaacgccuuggauaaucugguaauguuacauaauucagaacagggugguaaggcuuauagacacgcaauggaagaacuacccgacaccauugaaacacuaauguuacuagcucuaauugcaguacuaacgggagggguaaccuuauucuuucucucagguaaaggccuagggaaaaccagcauuggauuauuguguguaauggcuuccucugcuuuacuauggauggcuaguguagaaccucauuggauagcagcaucgaucauuuuagaauuuuuccuaaugguacuucuaauaccugaaccagacagacaaaggaccccacaagacaaccaacuagcauacguagucaucggccuacuauuuaugauacugacagucgccgcaaaugaaaugggcuuguuggaaaccaccaagaaggacuuagguaucggacacguugcagccgaaaaucaccaucacgccacaauguuagacguugaucuacgaccagcaucggcuuggacauuguacgcggucgcgacaacaguaaucacacccaugaugcgacacacaauagaaaauacuacggcuaacauaagccuaaccgcuaucgcaaaccaggcagcaauucuaaugggacucgacaagggauggccuauuaguaaaauggacauaggaguaccucuguuagcacuagguuguuacagccaagugaauccacuaacucuaaccgcagcuguacuuauguuagucgcucauuacgcaauaauagguccaggccuacaagcgaaagcgacuagagaagcacagaaaagaaccgccgcagguaucaugaaaaauccaacuguagacgguaucguggcaauugaucucgacccuguaguuuaugaugcaaaguuugaaaagcaauuggggcaaauuaugcuccuaauccuauguacgucacagauucuuuuaaugcgaacgacaugggcguuaugcgagagcauaacauuagcaacgggucccuuaaccacguuaugggaaggguccccagggaaauucuggaacacaacgauagcaguuucuauggcuaauauuuucagagguucauacuuagccggugcuggucuugcguucagcuuaaugaagucauuaggcgguagccggcgggggacaggagcccagggggaaacguugggggaaaaauggaaaagacaacuuaaucaacuaucuaaaagugaauuuaauacguacaaaaggaguggaauaauggagguagauaggucagaagcgaaagaaggacuuaaaagaggagaaacaacgaaacacgcgguaucaaggggaacagcaaaacuucguugguuuguugaaagaaaccugguuaaaccagaaggcaagguuauagaucugggaugcggcagagguggguggucauauuauugugcuggacucaaaaagguaacagaagugaaaggcuauacaaaaggcgggcccggucacgaagaaccaauaccgauggcuaccuauggguggaacuuaguaaaauugcacagcgguaaagacgucuucuuuauuccuccggaaaaaugugauacuuuguuaugcgauaucggcgaaucuagcccgaauccaacgaucgaagaaggaagaacccuuagaguauugaaaaugguugaacccuggcugcgcggaaaccaguucugcauaaaaauauuaaacccauacaugccaucugucguagaaacauuggaacaaaugcaaagaaaacauggagggaugcuuguacggaacccccugucaaggaacucuacucaugaaauguacugggucagcugugggaccgguaacauagucagcgcagugaauaugacaucccggaugcuucuaaauagauuuaccauggcacaccgaaaaccaacauacgaaagagacguggauuuaggagcgggaacuaggcacguugcgguugaaccagaaguggcaaaccuggauauaaucgggcagagaauagagaauauuaaaaaugaacauaaaucuacauggcauuacgaugaagacaauccuuauaaaacaugggcauaucacggaucguaugagguuaaaccaucuggauccgcuaguuccaugguaaaugguguaguucgucuacucaccaagccaugggauguaauuccaauggucacacaaauagcgaugacggauacuacccccuuuggucagcaacgaguuuucaaagaaaagguagauacgcggacuccacgagccaaaagagggaccgcacaaauaauggaggugacugcaaaauggcuuugggguuuucuuagucgcaacaaaaagccgagaauauguacaagagaagaguucacucguaagguaagaucgaacgcugcuaucggggcuguauucguugacgaaaaucaauggaacagugcaaaagaagcaguugaagaugaacgauuuugggaucuaguucauagagagcgugaauuacauaagcagggaaagugugcaacgugcguuuauaauaugauggggaagagagagaagaaacuaggagaauuuggaaaagcgaaaggaucaagagcaauaugguauauguggcuaggugcccgguucuuagaguucgaagcacugggauuuaugaacgaagaucauugguuuagcagggagaauagucugagcgggguagagggagaaggucuccauaaauuaggauauauauuacgcgauauuucgaaaauucccggagggaacauguaugcugaugacacagcaggaugggacacacgcauaacggaagacgauuuacagaacgaagcaaaaauaaccgauauuauggagcccgaacacgcguuacuagcgacuucaauuuucaaauuaacuuaucaaaauaaagucguaagaguacaaagacccgcuaaaucaggaacaguuauggacguaauaagucgacgcgaucaaagaggaaguggacaaguagguacauauggccuuaauacuuuuacgaauauggaaguucagcucaucaggcagauggaaucggaggguauuuuccuuccaucggaauuagagacuccuaauuuagcuaaacgagucuuagauugguuagaaaaacauggagcagaacguuuaaaaagaauggcgauaucaggggacgacugcguaguaaaaccgaucgacgauagauuugcaacagcuuuaacggcgcuaaacgauauggguaaagugaggaaagauaucccacagugggagccaucgaaagguuggaacgauuggcaacaggugcccuucugcucacaccauuuucaucaacuaauaaugaaagauggaagagaaauugugguaccuuguaggaaucaagacgagcuaguaggcagagcacgcguaucgcaaggugcaggauggucuuuacgagagacagcuuguuuaggaaagucauaugcucaaauguggcaacugauguauuuucaccgacgagauuuaagacuggcagcuaacgcaaucuguucggcaguaccuguagacuggguucccacgagcagaacaacauggaguauucaugcucaucaucaauggaugacgacagaagacauguuaucaguuuggaaucgggucuggauagaagaaaacccauggauggaggauaaaacucacguuucuucgugggaagaagucccguaccuaggcaagagagaagaucaauggugugguaguuuaauugguuuaacagcucgagcuacgugggcaacaaauauacagguagcaauaaaucaaguacgaagacuuauagguaaugaaaauuacuuggauuauaugacaacaaugaagcguuuuaaaaacgaguccgaucccgaaggcgcauugugguaa

SEQ ID NO: 21116 - RNA, 9879 nt, Artificial Sequence
  derived and/or modified CDS sequence (opt6) from DENV-1__JN903579__SS-prME
aguguaacaauguuacuuauguuguuacccacagcauuagcauuucaucugacaacaagggguggagaaccgcacaugauaguugguaaacaagagcgaggaaaaagucuauuauucaaaaccagugcuggaguaaauauguguacgcugauagcaauggacuugggagaauuaugcgaagauaccaugacuuacaaauguccaaggauuacagaagcagaaccagaugauguagauugcugguguaaugcuacagacacuugggucacauacggcaccuguucccaaacuggggaacacagaagagauaaaagauccguggcauuggcaccucauguaggccuuggauuagagacaagaaccgagaccuggaugucaucggagggcgccuggcgucaaauacagaaaguugagacuugggcuuugcgucacccuggauucacagucaucgcauuauuucuagcacaugccauaggaacgagcauaacucaaaaaggaauaauuuuuauccuguuaauguuaguaacgccgaguauggcaaugagauguguagguauaggaaaccgagauuucgucgaaggcuuaucaggggcaacuuggguugauguuguacuagaacacggaucgugcgugacaacaauggcuaaaaauaagccgacauuagauauagaacuucucaaaacugaaguuacuaauccagcgguacuaagaaaacuuuguauagaagccaaaauaucuaacacuacuaccgauucacggugcccaacccaaggugaagcuacuuuaguagaagaacaagacgcaaauuuugugugccgucguacuuuuguagauaggggcugggguaacgguuguggguuguuuggcaaaggaucgcuucuuaccugcgcuaaauuuaaaugugucacgaaacuugaagguaaaaucgugcaguaugaaaauuuaaaauauaguguaauaguuacaguacacacuggugaccaacaccagguugguaaugaaacuaccgaacacgguaccauagcaacgauaacuccgcaagcuccaacuucagagauccaacuaacagacuauggagcuuuaacuuuggauugcagcccgagaacaggacuagacuuuaaugaaaugguauugcucacaaugaaagaaaagaguuggcuaguacauaaacagugguuuuuagauuuaccucuaccauggacuucgggagcuagcacaucacaagagacguggaacaggcaggacuuacuuguaacuuuuaaaacagcacacgccaagaaacaagaaguaguaguccuaggaucacaagaaggagcgaugcacacugcacuuacuggugcaacugaaauucagacgagcgggaccaccacaauauuugcaggacacuugaaauguagguuaaaaauggauaaauugacacuaaaggggguaaguuacguaaugugcacuggcuccuuuaaauuggaaaaagagguagcugaaacccaacauggaacuguauugguucaaguuaaauacgaggggacugaugcuccauguaaaauaccuuuuuccacccaagaugaaaaaggugugacucaaaauggaagguugauuaccgccaacccuaucguaaccgacaaagaaaaaccagugaacauugaaaccgagcccccauucggagaaucauauaucguaauaggggccggugaaaaggcuuugaaacuaaguugguucaagaaagggucaaguaucgggaagauguucgaggccacagcuaggggagcucgacgaauggcaauacucggagauacugcuugggauuuugguaguauaggcggcguuuuuaccaguguaggaaaauuaguucaucaaguuuuuggaaccgcguacgguguacucuuuucuggaguuucguggacaaugaaaaucgggauaggaauauuacucacauggcuuggacuaaauucucgauccacaucuuugaguaugacuuguauagcugucgguaugguuacguuauaccuuggggucauggugcaggccgacaccgguuguguaauaaacuggaaaggcagggaauuaaaaugcggaucagggaucuucgugacuaacgaaguacacacguggacugaacaauauaaguuucaagcagacucgccuaaaagacuaagugcagcgauagggaaagcaugggaggaagggguuugugguauccguagugcuacuagacuugaaaauauuauguggaaacaaauuagcaacgagcuaaaccacauacuauuagaaaaugauaugaaauuuaccgucguuguuggagaugcgaacggcauauuaacgcaagguaagaaaaugauuagaccccagccaauggaacacaaguauaguuggaaaagcugggguaaagccaaaauaauuggugccgauacacagaauacaacuuucauaauagauggcccagauacaccggaauguccagacgaccagagggcuuggaauaucugggagguggaagacuauggauuugggauauuuacgacaaacauuugguuaaagcuacgagauagcuauacacaaaugugugaucaucggcugauguccgccgcuaucaaagacucaaaagcuguccacgcagauaugggauauuggauagaaucugagaaaaacgaaacuuggaaacuugcaagagcaucauucauugaagucaaaacgugcauauggccaagaucucacacgcuuuggucuaacggagucuuagaaucagaaaugauaaucccgaagauauauggcggcccgauaucucagcauaacuaccgaccaggauauuucacacaaaccgcgggcccuuggcaccuuggaaaacuagaguuggacuuuaaucugugcgaaggaacaacaguaguuguagaugaacauugcgggaauaggggaccgagcuuacguacuacaacagucacagguaaaauaauacacgagugguguuguagaucuuguacauuaccuccuuugagauuccguggagaagauggauguugguaugguauggagauuagaccuguaaaggagaaagaagaaaaccuuguuagaaguaugguaucagcuggaaguggggagguggauucuuuuucacuuggacucuuaugcgucagcauaaugaucgaagaaguaaugaggagucguuggaguagaaaaaugcugaugacagguacucuugcaguuuucuuucuauugauaaugggacaauuaacauggaacgaucucaucagacuaugcauuaugguuggggccaauguuucugaccgaauggguauggguacaacuuaucuugcauuaauggcgacguucaaaaugcgaccaauguucgcuguaggacuauuguuccgcagacucacaaguagggaaguucuauuacuuacaauuggucucucacuugucgccagcgcggaauuaccuaauucacucgaagaguuaggagacggacucgcuauggguauaaugaugcuaaaauuauuaacugauuuccaaagucaccaauuauggacaacacuccucucacuaacauuuauuaaaacaacacuaucacuagauuaugcauggaaaacuauagcaaugauacuaaguaucgucagucuauuuccacugugccuaucuacaacuagccagaaaacuaccuggcuuccuguacugcuaggaucauucggauguaaaccgcuaaccauguuucuaauaacggaaaacaagauuuggggucgaaagucguggccacucaacgagggaauaauggccgugggaauagugagcauucuguuaucaucccuguugaaaaaugacguaccguuagcuggcccccuaauagcaggcggcaugcuaaucgcauguuacguuauuuccgggagcuccgccgaucuaucauuggagcgagcagcggaaguaucaugggaagaagaagccgagcauagcggcgccucucauaacauucuuguagaaguccaagaugacgggacuaugaaaauaaaagaugaagaacgugacgauacacugacaauauuacuuaaagcaacguuguuagcaguuuccgguguauauccaaugaguauaccagcgacucuauucguaugguauuuuuggcagaagaagaaacaaagaagugggguacucugggacacaccuucuccaccagaaguggaaagggccguauuagacgacgguauauauaggauacugcaaagaggcuuguugggacguucacaaguaggcguuggaguuuuucaagacggcguauuucacacaauguggcaugugacccgaggcgcaguccuaauguaccaaggaaaaaggcuugagccauccugggcaagugucaagaaagaucugauaucauacggcggaggauggagguuucaaggaaguuggaauacaggugaagaaguacaaguaauugccguagaaccagggaaaaauccaaagaauguacagacaaccccuggcacuuucaaaacucccgagggagagguuggugcaauagcccucgacuucaagccagguaccuccggaucacccaucguuaaucgcgaagguaaaauaguuggguuauauggcaauggcguggucaccacuucgggaacauauguaucagcaauugcgcaagcuaaagcaagccaagaaggccccuuacccgaaauugaggaugagguuuuuaaaaagcguaauuuaacaauaauggauuuacacccaggcucagguaaaacccgcagguauuugccagcuauagugagggaagcaaucaagcgaaagcugagaacgcuaauacuugcaccgacccgaguaguugcgagugaaauggccgaggcuuugaaagguaugccgauaagguaucagacaacagcagugaaaucagagcacacaggaagagaaauuguugaucuaaugugccacgccacguucacgaugcgccuacuaaguccuguuagaguuccuaacuauaauaugauuauaauggaugaggcacacuucacagaucccgcaucuauagcagcuagagguuacauuaguacaagaguuggaaugggcgaagcggccgcuauauuuaugacagcuacgccaccggguucaguagaggcuuucccacaaucgaacgcagucauccaagaugaagaacgagauaucccugaacguucauggaauagcggauacgauuggauaacggauuuucccggaaaaacgguuugguucguaccaucaauuaaaaguggaaaugacaucgcaaauugucugcgaaagaacgguaaaagagugauacagcuaaguagaaaaaccauagauacugaauaucagaagaccaaaaauaaugauugggacuaugugguaacaacagacauuagugaaaugggagcaaauuuucgugccgauagaguaaucgacccgaggagauguuuaaagccuguuauauuaaaggauggaccugaacguguaauacucgcuggaccuaugccuguaacugcugcuucugccgcccaacgaagaggccggauuggaagaaaccaaaauaaggaaggggaccaguacauauauaugggucaaccccuuaauaacgacgaagaucacgcacauuggacagaagcgaagaugcucuuagacaauaucaacaccccagaagguauuauaccggcauuauucgaaccagaacgagagaaaagcgcggcaauugauggugaguacagacucagaggagaggcacgaaagacauuuguugaacugaugcgacguggugauuugccuguauggcuuucauacaaaguagcaagcgaaggcuuucaauacagcgaccggcguuggugcuuugauggcgagaggaacaaucaaguauuagaagaaaacauggauguagaaauauggacaaaagaaggagaacguaagaaacuacggccucguuggcuagaugcgcgaaccuauuccgauccauuagcacuuagggaauuuaaagaguucgcagcaggaagacgaucaguaucuggugaucuaauccuggaaauuggaaaauugccucaacaucuaacuuuacgugcucaaaaugcguuggacaacuuagugauguugcauaacagcgaacaaggagguaaagcauauagacaugcgauggaagaacugccagauacaauugaaacuuugauguuacuagcauuaauagcagucuugacaggaggugugacgcuauucuuccuaagcggcaaaggauugggaaaaacaucaauuggucuacucuguguuauggcaucaucaguuuuauuauggauggcaaguguugagccacacuggauugcagcgaguaucauuuuggaguucuuuuuaaugguacuccuaaucccagaacccgacagacaaagaacuccccaagauaaucaauuagcuuacgucguaauuggaucuuuguucaugauacuuacgguugcagcgaaugaaauggggcuucuggaaacaaccaaaaaggauuuggguauuggacacguagucgcggaaaaccaucaccacgcuacaacacuagauauugaccuccaccccgcaagcgcguggaccuuauacgcagucgcaacgacuauaauaacuccaaugaugagacacacaaucgagaauacaacagcuaauauaucucuaacagcaauagcaaaucaagccgcgauauugaugggacuggauaaaggcuggccuauaaguaaaauggauauaggugugccacuucuugcguuaggaugcuauucacaggucaaucccuuaacacuaaccgcugcugugcuaaugcuagucgcccauuaugcaaucaucggaccuggacuccaagcgaaagcuacaagagaagcgcagaagagaaccgcagcaggcauaaugaagaauccuacaguggacggaauaguugcaaucgaccuagacccaguaguguaugaugccaaguucgagaaacagcugggucaaauaaugcugcugauacuaugcacaagccaaauucuucuuaugcggacaacaugggcacuuugcgaaucaauuacucuagcuacaggaccccucacgacauuaugggaaggcagucccggaaaauuuuggaauacaacuauagcuguaaguauggcuaauauuuuucguggaagcuaccuagccggugccggauuagcuuucagucucaugaaaaguuuaggaggaggucgaagggguacuggagcucagggagaaacuuugggugaaaaauggaagcggcaacuuaaucaguuaagcaaaagugaauuuaauacguauaaacgaaguggcauuauggaaguugaccgauccgaggcaaaggaaggccuaaaaagaggcgagacuaccaaacacgcaguaagucggggaacagcuaaauuacgaugguucguagagagaaacuugguaaagcccgaaggaaaagugauagaucuuggcuguggaaggggaggcugguccuauuacugcgcagggcuaaagaaaguaacagaaguuaaaggcuauacaaaagggggaccagggcacgaagaaccuauuccaauggcuacuuauggcuggaacaucguaaaacuccauucaggaaaagauguuuucuucacaccgccggaaaagugcgacacacuguugugugauauaggagagaguucgccaaauccuacgauugaagagggucgcaccuuacgcguacuaaaaaugguugaaccauggcuacgagguaaucaauuuuguauaaaaauuuugaaucccuauaugccuucaguaguggaaacguuagagcaaaugcaacgaaagcaugguggaaugcuaguacgcaauccguuaucgagaaauucaacucaugagauguauugggucaguugcggcacugggaauaucguuucugcagugaacaugacgucuagaauguuguuaaacagauucacaauggcacacaggaaaccaacuuacgaaagggauguugacuugggagcaggcacuaggcacguagcgguugaaccugaaauagccaauuuagacauaaucggucaaaggauagaaaauauuaagaaugagcacaaauccacauggcacuaugaugaggacaacccuuauaaaacaugggcuuaucaugguucauacgaaguuaaaccaucuggcuccgcaucauccaugguuaauggggucguaaggcuacucacaaagccaugggauguuauaccaaugguuacgcaaauagcaaugacugacacgacgcccuuuggccaacaacgugucuuuaaagaaaaaguagauacacgaacaccgcguccgaaaagaggaaccgcccagauuauggaaguaacggccaaaugguuaugggguuuucucucuagaaacaagaaacccaggaucugcacaagagaagaauuuacaagaaaaguaagaagcaacgcggccaucggggcagucuuugucgaugaaaaucaauggaauagugcaaaggaagcugucgaggacgaaagauuuugggaucuaguucauagagaaagagagcuccauaaacagggcaaaugcgcaacaugcguguauaauaugauggggaaaagagagaagaaauugggcgaguuugguaaggcaaaaggaucgcgagccauaugguauaugugguuaggagcgcguuuccuagaguucgaagcacuaggauucaugaaugaggaucacugguuuucaagagaaaacucauuaagcggcguugagggcgaaggucucuauaaacuuggcuauauacuuagggauauaaguaaaaucccuggcggcaacauguacgcugaugacaccgcggggugggauacaaggauuacugaagacgacuugcagaacgaagcuaaaaucaccgauaucauggaaccagaacaugcauuacuagcaaccucaauuuuuaaacuaacauaccaaaauaaaguuguaagaguucaaagaccggcuaagucggggacuguaauggacguuauaucccgucgugaccaacggggcucaggacaaguaggaacuuauggucuaaacacauucaccaauauggaaguacaauuaauaagacaaauggaaucugagggcauuuucucaccuuccgaacuagaaaacucaaauuuagcggaaagaguauuagacuggcucgaaaagcacgguguggaaagacuuaagcggauggcaauuaguggcgaugacuguguuguuaaaccuacggaugaucguuuugccacugcauugacggcuuugaaugauauggguaagguaaggaaagacauaccccaaugggaaccaaguaaaggcuggaaugauuggcagcaaguccccuuuuguucacaucacuuccaccagcuaauaaugaaggaugguagggaaauaguaguuccuugcagaaaccaggacgagcucguaggacgagcuagaguaucacaaggcgccggauggucucugagagagaccgcaugcuuaggaaaaaguuacgcccagauguggcaacuuauguacuuucauagacgagauuuaaggcuugcagccaaugcaauuuguucagcugugccuguuaauuggguaccgacaucacguacgacauggaguauucacgcccaccaccaauggaugacaacagaagacauguuaucaguguggaaccgaguguggaucgaagaaaaccccuggauggaagauaaaacacacguaucuaguugggaggauguaccauaucuuggcaaaagggaagaccaaugguguggcucacuaaucgggcucacagcaagagccacgugggcaacuaacauucaaguugcaauuaaccagguaagaagauuaauugguaacgaaaauuacucugauuacacaacaaguaugaaaagguuuaaaaaugaaucugacccugaaggugcacugugguaa

SEQ ID NO: 21117 - RNA, 9879 nt, Artificial Sequence
  derived and/or modified CDS sequence (opt6) from DENV-1__JN903580__SS-prME
agcgucacaauguugcuaauguuacuucccacugcucucgcauuucaucugacuacccgaggaggugaaccucauaugauaguaagcaaacaagaaagaggcaaaaguuuguuauuuaaaacuagcgcaggagucaauauguguacauuaaucgcaauggaucuaggagaguuaugcgaagacacgaugacauauaaauguccgcgaauaacagaggcugaaccagacgauguugacugcuggugcaaugcuacugauacuuggguuacauaugguacguguagucaaacaggugaacaucgaagagacaaacgaucuguugcacuagcaccucauguaggccuaggauuggaaacaagaacagagacauggaugucaucggaaggugcguggcgccaaauacaaaaaguagaaacaugggcacuaaggcacccaggauuuacaguaauagcacuauuuuuggcucacgcuauugguacuucuauaacccaaaaaggaaucauuuucauauuacuaaugcuagucaccccgucaauggcuaugcgcugugucgguaucgguaauagagacuuugucgaaggauuaagcggcgcaacauggguggacgucguacuagaacacgguuccuguguaacaacaauggcgaaaaauaaacccacauuagacauugaacuauuaaaaacagaaguaacuaacccagccguucucagaaaauuauguaucgaagcgaagauaucaaauacuacuacagacucuagauguccaacgcaaggcgaggcaacacucguagaggaacaggaugcuaacuuugugugucgacgaacuuucgucgauaggggcuggggaaacggguguggcuuauucgggaagggaagccuuuuaaccugcgccaaauucaaaugcgucacaaaacuagaaggaaagauaguacaauaugagaaucugaaauacagcguaaucguuacgguacacaccggagaucaacaccaaguaggaaacgaaacuacagaacaugggacaauugccacaaucacaccucaagcucccaccucggaaauucagcugacagacuauggagccuuaaccuuggacugcucgccgcggacaggguuagauuuuaaugaaaugguuuuacuuacaaugaaagaaaaaucgugguuagugcauaagcaaugguuucuagaucuaccauuaccguggacuucuggagcaucuacaagucaggagacauggaacagacaggaucuguuaguaacauucaaaacggcacacgccaagaaacaagagguggugguucucggaucacaagaaggugcaaugcauacagcuuuaacgggagcaacggaaauacagacaucagguacgacaacaaucuuugccggucaccucaaaugcaggcuaaaaauggacaaacuaacauuaaaaggcguuaguuaugucauguguacuggcaguuuuaaacuagagaaggaagucgcugaaacucaacacggaacuguccuaguacaaguuaaauacgaagguaccgacgcuccauguaaaaucccauucaguacacaagacgaaaaaggaguuacgcaaaacggccggcugauaacugccaaccccauagucacagauaaagaaaaaccugugaauauagagacggaaccaccauucggugagucuuacauugugauuggagccggugaaaaagcccucaagcugaguugguuuaagaaagguucuaguauuggcaaaauguuugaagcaacagcacguggugcacgaagaauggccauccucggagauacugcaugggauuuuggcucuauaggaggaguauucacaaguguuggaaaauugguacaucaaguguuuggcacagcuuacgggguguuguuuucuggaguaaguuggaccaugaaaauaggaauaggaauccuacuaacauggcuaggacuaaauucccguaauacaaguuuaucaaugacauguaucgccguuggcauggucacacuuuacuuaggaguaaugguacaagcagauacugggugcguaauaaacuggaaagguagggaauuaaaaugcggcucuggaauauucguaacaaacgaaguccauacauggacagaacaauauaaguuucaagcggauucaccaaaaaggcucagcgcagcuauaggcaaagcaugggaggaaggaguaugcgguauccgaucggcaacaagauuagaaaauauaauguggaagcaaauaucaaacgagcuaaaucauauacuauuagaaaaugauaugaaguuuacaguugucguuggcgacgccaauggaauauuaacccagggaaagaagaugauacgaccacagcccauggaacauaaauauucauggaagaguugggguaaggcaaaaauuauaggugcugauacacaaaauacaacauucauaaucgaugguccagauacgccggaaugucccgacgaucagcgugcguggaacauaugggaaguggaagauuauggcuuuggaauuuuuacaaccaauauuuggcuaaagcuacgagacucuuacacccagaugugcgaucaucggcuaaugucggcagcgauaaaagacucaaaagcuguacacgccgauauggguuauuggauugagucagagaaaaaugaaacauggaaacucgcaagagcgucauuuauagaaguuaagacuugcauuuggccaagaagucacacacuuuggucaaaugguguguuagaaagugagaugauuauuccaaaaaucuauggaggaccaauaucccagcacaacuacagaccaggauauuuuacacaaacagcaggcccuuggcaccuaggaaaguuagaguuagacuuuaaucuaugugagggaacgaccguugugguagacgaacauugcgguaacagaggcccuagcuuaagaacaaccaccguuacagggaaaauaauacacgaaugguguugucgaagcugcacauugccaccacugagauucaggggagaagauggauguugguacggaauggaaauuaggccggugaaggaaaaggaggagaacuuagugagaagcaugguaucggcgggaucgggagaaguugacucauuuuccuuaggguuauuguguguaucuauaaugauugaagaagugaugaaaucaaggugguccaggaagaugcuaaugacggggacuuuagcuguauucuuucucuugaucaugggucaacuaacauggaaugaccuaaucagauuaugcauaaugguaggagcuaaugucucagacaggaugggcauggggacuacauaucuagcgcuaauggccaccuuuaaaaugcgaccgauguuugcaguaggauugcuauuucguagauuaacgucucgugaaguccuucuccuaacgauaggccuaaguuuaguagcuagcgcugaacugccuaauaguuuagaggaacuaggcgauggguuagcuaugggaaucaugaugcuaaaguuauugacagauuuucaaagucaccagcuguggacuacgcuuuuaucauuaaccuucauuaagacgacucuuagucuugacuacgcauggaaaacaauugcaaugauucucucaauaguaagccuauuuccucuaugcuuaucgacaaccucacaaaagacaacaugguuaccaguacuguuggguucauuuggcugcaagccacucaccauguuucuuaucaccgagaacaaaauaugggggcggaaaaguuggccacucaacgaagguauaauggcugucggaauuguaucgauuuuauuaucuucacuguuaaagaaugacgucccccucgcuggaccuuuaauugccggcggaaugcucaucgcuugcuacgucauaucagguucaagcgcggauuuaucuuuagaacgagcggcugaggugucgugggaagaagaagcagagcauaguggcgcgucccacaacaucuuaguagaaguacaagaugaugguacaaugaaaauaaaagacgaggaaagagaugauacacuuacuauucuuuuaaaagccacacuauuggcaauuucuggagucuacccaaugucgauuccagcgacacuauucgugugguacuucuggcagaaaaagaaacagcgaagcggaguauuaugggacaccccuaguccgccagagguugagagagcgguguuggaugacggcaucuaucggauacugcagcgaggauugcuaggcagaucucaagugggagucggcguguuucaagacgguguauuuaggacaauguggcaugugacacgaggagcuguucuaauguaucaggggaaacgucuugaaccaucaugggcaucaguuaagaaagaccugauuaguuacggaggaggguggagauuccaagggucauggaauacaggagaggaaguacaaguaauugcaguggaaccaggcaaaaauccuaaaaacguacaaaccacuccaggaacuuuuaaaacgccugagggcgaagugggcgcaauagcucuugacuuuaaaccaggaacaagugguagcccaauugugaaccgagagggaaagauugucggauuauauggcaaugggguugugacuacaucuggcacguaugucagcgcuauagcucaggcaaaggcgagccaggaggggccuuuaccagagauagaagaugagguuuuuaagaaacgcaauuuaacaaucauggaucuucauccugguucagguaaaacucgucgauacuuacccgccauaguaagagaggcaauuaagcguaaacugcgaacccuuauucuagcgccgacaagagucguggcaagugaaauggcugaagcccugaaagguaugccgauucgcuaucaaacaacagcuguuaaauccgaacauacaggccgcgagaucguagaccuaaugugccaugccacauuuacaaugagauugcucucaccugucagaguuccaaauuauaauaugauuauaauggacgaggcacacuucaccgacccagcaucuaucgccgcuaggggauauauuucaacaagaguuggaaugggagaggcggcggcaaucuucaugacugcaacaccgcccggcucgguagaggccuuuccacaaucaaacgcugucauacaggacgaagaaagagauauuccagagagaucauggaauaguggauacgauuggauaacagauuuuccggguaaaacagugugguuuguaccaagcauaaagucggggaaugauauagcuaauugcuuaaggaaaaauggaaagcggguuauacaacugagcagaaagacuuucgacacugaauaccagaaaaccaaaaauaaugauugggacuacguggucacaacagauauuucagagaugggggcaaauuucagagcggauaggguuaucgauccuagaagauguuuaaaaccagugauauuaaaagacggacccgaaagagucauucucgcugggccaaugccagugacggcugccagcgcugcacaaagacgcgggcguauaggaagaaaccagaauaaggagggagaucaguauauuuacauggggcaaccauuaaauaacgaugaagaucacgcccauuggacugaggcaaaaauguuauuagauaauauaaauacaccugaagguauaauucccgcgcuauuugaacccgaacgugagaaaagugccgccauagacggggaauauagguugagaggcgaggcgcgaaaaacauuuguugaauugaugcgaaggggugauuuaccagugugguuaucguacaagguagccagugaaggcuuccaauauucagacagaagauggugcuucgauggcgagcguaauaaucagguacuggaggaaaauauggauguggaaauuuggacuaaggaaggagaacgaaagaaauugagaccaagauggcuugacgccagaacauacucagauccauuagcccuacgggaguucaaagaauuugccgcaggaaggagaaguguaucaggagauuuaauccuggaaaucggaaaacucccgcagcaucuaacguugagagcucagaacgcacuagauaaccuagucaugcuucacaauagugaacaagguggaaaagcguauagacaugccauggaagaacuaccugauacaauagaaacguugaugcuauuggcccucauugcaguacugacagguggagugacccucuucuuucuaaguggaaagggauuagggaaaacaaguauugggcuauuaugugugauggcgucgucuguacuacuauggauggcuuccguagaaccccauuggauagcugcuucuauaauauuagaguucuuucucaugguucuucuaaucccagaaccagauagacaaagaaccccucaggacaaccaacuagcauacguaguaauuggucuauuguucaugauacuaacagucgcugcaaaugaaauggggcuauuagaaacaaccaagaaagaucuuggaauuggccacguuguggccgaaaaccaucaucaugcgacaaugcuugauauugaucuacacccagcaagcgcauggacccuauaugcaguagcuacaacuauuauaacaccuaugaugagacauacaauugagaauacgacagcaaacaucagccuaacugcaauagcaaaucaagcugcgauauuaaugggacucgauaaaggauggccaauuagcaaaauggauauuggggugccuuuauuagcacuagguuguuauucucagguaaacccacuaacuuugacagcagcgguauugauguuaguugcgcauuaugccauuauuggaccuggucuacaagccaaggcaaccagagaagcacaaaaacgcacugcugcgggaauuaugaaaaauccaacgguagauggaauaguagcuauagaucuagacccuguaguuuacgaugcaaaauuugaaaaacaacucggacagauaaugcuacuuauccuauguaccucccaaauucuucuuaugcgcacaacuugggcacuaugcgaaagcauuacucuugcaacaggaccacugacgacuuugugggaagguagccccggcaaauuuuggaacacaaccauugcugugucuauggcaaauauuuucagaggguccuaucuugcgggugcagggcuagccuuuucauuaaugaaaucguugggugguggcaggcgagauacgggggcgcaaggggaaacuuuaggcgagaaauggaagagacaacuuaaccaauuaaguaaaccagaauuuaacacauacaagcguuccggaauaauggaaguagauagaagcgaagccaaagaaggcuuaaaacguggagaaacuacaaagcacgcuguuucacgagguacugcuaaguugagaugguuuguugaaagaaaccuuguaaaaccagaaggaaaaguaauugaucuuggauguggaagagguggguggucuuacuauugugcugggcuaaagaaaguuacugaaguaaaaggcuauacgaagggugguccaggacacgaagaacccauaccaauggcuacauauggcuggaauauaguaaaauuacauucagggaaagacguguucuuuacgcccccagaaaaaugugauacauuauuaugcgauauaggugagucaucgccuaauccuacgauagaggaaggccggacgcuaagaguuuugaagaugguugaacccuggcugcgggggaaucaauuuugcauaaaaauauuaaauccuuauaugccuucagucguugaaaccuuagaacaaaugcaacgaaaacauggagguaugcuuguaaggaauccacugagucgcaacucaacgcaugagauguauugggucucaugcggcacuggcaacaucgugucggcgguaaauaugacaagucgaauguuacugaaucguuucacuauggcacacagaaaaccuacguacgagagagauguagaucugggugcagggaccagacacguagcuguagaaccagaaauagcgaauuuagauaucauugggcagagaauggaaaauauaaagaacgaacauaaaaguacguggcacuaugaugaagauaauccauauaagacaugggcauaucacggaaguuaugaaguuaaaccaucaggcuccgcuaguaguauggucaacggcguaguuagguuauuaacuaagccuugggauguuauuccgaugguuacacagauugcaaugacagacacaacgccauucggacaacaaaggguuuuuaaagaaaaaguugauacacgaacuccacguccgaaacguggaacagcacaaauaauggaagugacagccaaauggcuauggggauuuuuaaguaggaauaagaaaccaagaauauguacacgcgaggaguucacaaggaaagugcgaagcaaugcagcgauaggagcuguguucguagaugaaaaccaauggaacuccgcuaaggaagcuguugaagaugaaagguucugggaucuaguacauagagagagagaauugcauaaacaaggaaaaugcgccacaugcguauacaacaugaugggaaagcgugagaagaaauuaggggaauuuggaaaggcgaaagguagccgggcuauuugguauaugugguuaggagcaagauuucuagaauuugaggcauugggauuuaugaacgaagaccauugguuuucacgcgaaaauagucuaucgggcgucgaaggagagggacucuauaagcuaggauacauccuaagggacaucucuaaaauaccgggaggcaauauguaugcagaugauacggccggaugggacacaaggauaacagaagacgaucuacagaacgaagcaaagaucacugauauuauggagccugaacaugcccuccucgcuaccucaaucuucaagcucacauaucaaaacaaagugguacggguucaacgaccggcaaaaucagguacagucauggaugucauaucucgcagagaucaaagaggaucaggacagguaggcacauacggacuaaacacuuuuacaaacauggagguucagcugauccgccagauggagucagaagggauuuuuagcccaagugaauuagaaaauucaaauuuagcagagcguguccuugacuggcucgagaagcaugggguagagagauuaaaaagaauggcaauuaguggcgacgauugcguaguaaagccuacagaugacagguuugcaaccgcauuaacggcucuaaaugacauggguaaggucagaaaagauaucccacaaugggaaccaucaaaagguuggaaugacuggcaacaaguaccuuucuguucucaccauuuccaccaguuaauuaugaaagaugggcgagaaaucguaguuccgugucguaaucaagaugagcuaguagggagagcuagagucucacagggcgcugguuggucauugcgcgaaacagccugccuaggcaaaaguuacgcgcaaauguggcaacuaauguauuuucacagaagagaucuucgguuggcugcuaacgcaauuuguagugcaguaccuguuaauuggguaccaaccuccaggacaacuuggucuauacacgcucaucaccaauggaugacgacagaggauaugcuuucuguuuggaaucgagucuggauagaagaaaauccuuggauggaagacaaaacgcauguaaguucuugggaagauguccccuacuugggaaaaagagaagaccaauggugugguagcuuaauaggucuuacagccagggccacuugggcaacuaacauucaagucgccauaaaccagguaagaagguuaauaggaaacgagaacuauagugacuauaugacuucaaugaaaagauucaagaaugaguccgauccagaaggggcccugugguaa

SEQ ID NO: 21118 - RNA, 9879 nt, Artificial Sequence
  derived and/or modified CDS sequence (opt6) from DENV-1__JN903581__SS-prME
ucaguuacaauguuauuaauguuguuaccgacugccuuggcuuuucaccuaaccacacgugguggggaaccacacaugauagugucaaaacaagaacgugggaaaucgcuuuuauucaaaaccucagccggggugaacauguguacgcuaauagcaauggaucuaggggaauuaugugaagacacaaugacuuauaaaugccccagaauaacagaagcugagccugaugauguugauugcuggugcaaugcgacagacacaugggugaccuauggaaccuguagucaaacgggagaacaucguagagacaaacgaagugucgcauuggcgccacacgucgggcugggauuagaaacgagaacugaaacguggaugaguucggagggggcuuggagacaaauucagaaaguagaaacaugggcacuucgacacccuggguucacuguaauagcuuuauuucuugcgcacgcaaucgggacaucgauuacacaaaaaggaauuaucuucauucuauuaaugcucguaacaccgaguauggcuaugaggugugucggaaucgggaauagagauuucgucgaaggucuuagcggagcgacauggguagacguagugcuagaacauggcagcuguguaacuacaauggccaaaaauaaaccaacguuggacaucgaacuucugaaaacugagguaacuaauccugcgguauuacguaaacuauguauugaagcuaaaaucucgaacacgaccacagauagccgauguccgacacagggggaggcgacauuagucgaagaacaggaugcgaauuuugugugcagaagaacuuuugucgaucguggaugggguaauggaugcggacuauucggaaaagguaguuuacugacuugugcaaaauucaaaugcguaaccaaacucgaggguaaaauaguccaauacgaaaaucuuaaauauagcguuauuguaaccguacauacuggagaccagcaucaggugggcaacgaaacuacagaacauggaacgaucgcaacaauuacaccgcaagcgcccacaucugaaauacagcucacagacuacggugcacuaacguuggacuguucuccgcguacuggauuagacuucaacgaaaugguucuacuuaccaugaaagagaaaaguuggcugguccauaaacaaugguuucuugauuuaccauuacccuggacaucgggagcuucgacuagccaggagacguggaacagacaagacuuauuagucacauucaaaacagcacaugcgaagaaacaagaaguuguagucuuaggaucccaggaaggugccaugcauacugcucuaacuggggcuacggaaauccagacuucgggaacgacaacaaucuucgcgggacaucucaaaugucgccuaaaaauggacaaauuaacauuaaaagggguaucuuaugucauguguacuggauccuucaaguuggaaaaagaaguagcagaaacacaacauggcacagugcucguacaagucaaauacgaaggcacggaugcaccauguaaaauuccguuuucaacacaggacgaaaaagguguaacccaaaacggcagacuaaucaccgcgaacccuauagucacagauaaagaaaaaccaguaaauauagaaacugaaccaccuuucggcgaaucauacauugugauaggggcuggagagaaagcccugaaauugucaugguucaagaaaggcaguucuauugggaagauguucgaggcaacagcaagaggugcucgaaggauggcuaucuuaggagauacggcuugggauuuuggaaguauaggaggcguguuuaccuccguaggaaaguuagugcaucaagucuuugguacagcauaugggguauuauuuucaggugucaguuggacgaugaaaauaggaauuggaauccuacugacuuggcugggucucaauucuagaaauacuucgcuaucaaugacguguauagcaguagguauggugacguuguauuuagguguaaugguucaagcagauacagguuguguaaucaauuggaagggaagagaguuaaaauguggaagugguauauuuguaacaaaugaagugcauaccuggacugaacaauacaaauuucaggcagacucgccaaagagacuuucugcugcaauagggaaagcaugggaagaagguguauguggaauaagguccgcaacaagguuagaaaauaucauguggaagcaaaucucaaaugaacugaaucauauuuugcuugaaaacgacaugaaguuuacgguuguuguaggcgaugcaaacggaauacugacccaagguaagaaaaugauuagaccccaaccgauggagcacaaauauucauggaagucaugggggaaagcgaagauaaucggagcagacacucaaaauacaacguucauuaucgaugguccagacaccccugagugccccgaugaucagcgagcguggaauauaugggaagucgaagauuacgguuuuggcaucuuuaccacaaauauuugguuaaaacuuagagacuccuauacgcaaaugugcgaccacagauuaaugucugccguuaucaaagacucuaaagcaguacaugcugacaugggguauuggauugaaucugagaagaaugagacauggaaauuagcgagagcauccuuuauugaaguaaaaacaugcauauggccaagaagucauacgcuguggucaaaugguguuuuagaauccgagaugauaaucccaaaaauauacggaggaccaauuagucaacauaauuaucgcccaggauauuucacacaaacugcaggcccauggcaucucggaaagcucgaacuugacuuuaauuugugcgaagggacuacaguugucguagaugaacacugcgguaacagggggccaucacugcggaccacuacaguaacaggcaaaauaauacaugagugguguugucgaaguuguacacuaccgccacucagguuucgcggagaagacggauguugguauggaauggaaauaaggcccguaaaggaagaggaagaaaaucucguucgaucuaugguaucagcuggcaguggugaaguagacaguuucucguuggguuuacuauguguuucaauaaugauagaagaaguaaugaaauccagguggucaaggaaaauguugaugacuggcacccuugcaguauucuucuuacuaaucaugggacaauuaacguggaaugauuugaucagacucuguauaaugguaggugcaaacguuucagacagaaugggaaugggaacaacauacuuagcgcuuauggcaacauuuaaaaugagaccuauguuugcagugggcuuacucuucagaagauuaacaucucgugagguuuuauuauugacaauugggcucucacucguagcaagugcagaacuuccaaacuccuuagaagaacuaggagacggauuggcaauggggauaaugaugcuaaaacuccuugccgacuuucaaucgcaccaacuauggacaacucuucuuagcuuaacuuuuauaaaaacuacguuaaguuuagauuacgccuggaaaacaaucgcuaugauccuuagcauaguguccuuauuuccucuuugucuuaguaccacgagccagaaaacaaccugguuaccagucuuacucggcucguucggcugcaaaccccuaacaauguuuuuaauuaccgaaaacaaaauuuggggacgaaaauccuggccauuaaacgaagggauaauggccguagguauaguaucaauucuuuugaguaguuuacuaaagaacgaugugccuuuagccggcccguugauagccggugguaugcucauugcaugcuaugucaucaguggcucgucagcagauuuguccuuagagcgagcagcagaagugucaugggaagaagaagccgaacacucaggcgcuucacacaauauauugguagagguacaagacgaugguacgaugaaaauuaaagacgaagaacgggacgauacacucacaauucuuuuaaaagcgacauugcuggcuauuucagggguuuacccaaugucuauuccggcuaccuuguuuguaugguacuuuuggcagaagaagaaacaaagaaguggcgucuugugggacacacccucaccuccugaagucgaacgcgcuguacuugaugacgggauauaccgaauuuuacagcgaggauuacuagggagaagccaagucggaguuggcguauuccaagauggaguauuccacacuauguggcauguaacaaggggagcagugcuuauguaccaaggcaaacgauuagagccaucaugggcuuccgucaagaaagauuuaauuucguacggaggagguuggagauuucaaggauccuggaauacaggugaggaaguucaaguaauugcaguagaaccgggcaaaaauccaaagaacguacaaacaacacccggaaccuuuaaaacgccagaaggggaaguaggggcgaucgcacuagauuuuaaacccgguacaucagggucgccuauuguaaauagagaagguaaaauuguaggcuuauacggagauggaguaguuacuacaucgggaacguacguauccgccaucgcacaagcaaaagcaagccaagaagggccauugccagaaauugaagaugaaguauuuaagaaacgaaauuuaacaauaauggaucuccauccggguagugggaaaacuagaagauaccugccagcaaucgucagagaagcaauuaagaggaaauugagaacucuaauauuagcuccaacuaggguuguagccucugagauggccgaagcacuuaaaggaaugccaauaagauaccaaacuacagcuguaaaaucggaacauacuggacgggagauaguagauuuaaugugccaugccacauuuacuaugaggcuacugaguccaguaaggguaccaaauuacaauaugaucauaauggaugaagcccacuucacagacccugcguccauagcagcuagagguuauauuagcacacgagugggcaugggggaagcugcugcaauauuuaugaccgcuacgcccccagguuccguggaggcuuucccccaguccaaugcugugauacaagacgaggaaagggauaucccugagcggucguggaacucaggauaugauuggauuaccgauuucccgggcaaaacaguuugguucgucccgaguauuaaaucuggaaaugacauagcaaauugccuacguaaaaaugguaaaagaguuauacaacuuuccagaaagacauuugacacugaauaucagaaaaccaagaauaacgacugggacuauguuguaacaaccgacauaagcgaaaugggcgcaaauuuuagagcagaccgagugauugaccccaggcgguguuuagaacccguaauauuaaaagauggacccgaaagagugaucuuagccgggcccaugccaguuacagcugcgucggcugcgcaacgacgggguagaaucgggagaaaucagaauaaagaaggagaucaauacauuuacaugggacaaccacuaaacaaugaugaagaucaugcucacuggaccgaggccaaaaugcuuuuagacaacauaaauacaccagaagggauuaucccagcucuauuugaaccagaaagggaaaaaucugcugcuauugauggagaauacagacuccguggggaggcccgaaaaacauuugucgaacugaugagacgaggcgauuuaccagucugguugaguuacaaagucgcuuccgaagguuuccaguauucugaccgacguugguguuucgacggcgagcgaaauaaucaaguacuggaagaaaauauggauguagaaauuuggacaaaagagggagagcgaaagaaacuacggccuagauggcuagaugcacgaacuuacagcgacccguuagcucucagggaauuuaaagaguuugcagccggaaggcgaagcguuagcggcgauuuaauucuagaaauugguaaacucccucagcauuuaacccuacgagcccaaaaugcacuagauaaccuaguuauguuacacaauagugagcaaggugggaaagccuauagacacgcaauggaagaacuucccgauacaauagagacucuaaugcuauuggcucuuaucgcaguucuaacaggaggagucacauuguucuuucuuaguggcaaaggauuaggaaaaacaucgauaggccuucuaugugucauggcuagcucuguauuacuauggauggcuaguguagagccgcauuggauugcugcauccauaauauuggaguuuuucuugaugguucuauuaauaccagaaccugauagacaaagaacaccucaagauaaucaacuagccuauguaguaaucggcuuguuguuuaugauauugacgguugcugcuaacgaaaugggucuauuagaaaccacgaagagagauuuaggaauaggacacguuguggccgaaaaucaccaucaugcuacgauguuagauauagauuuacaucccgcuagcgcauggacauuguaugcuguagcaacgacuauaauuacccccaugaugcgacacacuauugaaaauacuacugcaaauauuucacuuacugccauugcaaaucaagccgcaauacucaugggauuagauaaggguuggccaauaagcaaaauggauauagguguuccauuacucgcauuaggaugcuacucgcaaguuaauccauugacauuaacggcugcgguccuaauguuagucgcgcauuaugcaauaauaggacccggccuccaggcaaaagcuacuagagaagcgcagaaacgaacugccgcaggaaucaugaaaaauccaaccguagauggcauaguggcuauagaccucgaucccgugguguaugaugccaaauuugaaaaacaguuaggccaaauaauguuguuaauuuuaugcacuucacaaauauuacugaugaggacaaccugggcacuaugcgaaagcauaacgcuagcuacgggaccucucaccacauugugggaaggcucuccuggaaaguuuuggaauacaaccauugcugucaguauggcuaauaucuuuagggggucauauuuagccggugcggguuuggcguucucccuaaugaaaucguuaggggguggacgucggggaacuggagcucagggugaaacacucggggaaaaauggaagcgccaacugaaccaauuaaguaaaucugaguucaacacuuacaagagguccggcauuauggaagucgaccgaucggaagcaaaggagggcuugaagcgcggagaaacaacuaagcaugcaguuucaagagguacaguaaaauuacgaugguuuguagagcgaaaucuuguaaaaccagaaggaaaagucauagauuuaggcuguggacguggcgguuggaguuauuacugugcugggcuaaagaaaguuacagaaguuaagggguacacaaaagguggaccaggacacgaagaacccauuccgauggccacguauggauggaauauagugaaacuccacaguggaaaggauguguucuuuacuccucccgaaaaaugugacacacuauuaugcgauaucggggaaagcucaccuaacccuacuauagaggaaggaagaacauuaaggguccuaaagaugguugaaccauggcugcgugguaaucaguuuugcauaaaaauucuaaauccuuauaugcccucaguugucgagacccuugaacaaaugcaaaggaaacauggagggauguuaguucgcaaccccuuaucuagaaacaguacccaugaaauguauugggucaguuguggaacugguaauauaguuuccgcaguuaacaugaccucaagaaugcuucuuaauagauuuacuauggcacauagaaaaccaacuuaugaaagagauguggaccuaggcgcaggaacaaggcauguagcuguggaacccgagauagccaauuuagauauaaucgggcaaaggauugaaaauaucaaaaaugaacauaaaucuacuuggcauuaugaugaggacaacccauauaaaacaugggcauaucaugguagcuaugaaguuaaacccaguggaagugcaucaagcaugguaaacgguguaguucguuuguuaacgaaaccgugggacguaauaccgaugguaacucaaauagcuaugacagauacuacgcccuucggccaacaaagaguuuuuaaagagaaaguagauacacgaacaccacgacccaagaggggaaccgcacaaauuauggaaguaacugcaaagugguuauggggauuuuuaucaaggaauaagaaaccuagaauauguaccagagaggaguucacaagaaaaguccgaucuaacgccgcuauuggcgcuguuuuuguugacgaaaaucaguggaauagugcuaaagaagcugucgaggacgaacgauuuugggauuuggugcaucgagaacgagaacuacauaaacaaggcaagugcgcuaccugugucuauaauaugauggguaaaagagagaagaaauugggugaauuuggaaaagcuaaaggaagcagagcaauaugguauaugugguuaggggcaagauuuuuagaauuugaagcucuaggauuuaugaaugaagaccauugguucaguagagaaaacuccuugagugggguagagggggaaggauuauauaaauuaggguacauccuaagagauauuucaaaaauaccaggcggaaauauguaugccgaugauacggcaggaugggauacucgaauuacggaagacgaccuacaaaacgaagcgaaaauuaccgauaucauggagccugaacaugcacuccuagcaacaaguaucuuuaaauuaacuuaccaaaauaaaguaguuagaguucaacguccggcuaagucaggaacaguuauggauguuauaagcagaagggaucaaagaggaucaggacaaguagggacauauggccucaacacguuuacaaauauggaaguucaacuuauaagacaaauggaguccgaagguaucuuuaguccaagcgaguuagaaaauucaaaucuagcagaacggguacuugauuggcuagagaaacauggaguggaaagauugaaaaggauggcgauuucaggcgaugauugcgucgucaaaccaacagacgaucgguuugccacugcccuuacggcguugaacgauauggggaaaguacguaaagauauuccccaaugggagccuagcaaggguuggaaugacuggcaacaagucccauucuguucccaccauuuucaccaauuaauuaugaaggacggccgggaaauaguaguucccugucgaaaucaagacgaauuaguuggcagagcaagaguuucgcaaggggcggguuggucacuacgagaaacugcaugccuagggaaaucauacgcacagauguggcaacucauguauuuucaucgccgagauuugagguuagccgcuaaugcgauaugcucagccguuccaguaaauuggguaccaacgagucgaacaacauggagcauucaugcccaccaccaauggaugacaacugaagauaugcuaucaguauggaacagaguauggauagaagaaaacccauggauggaagauaaaacacaugucucaucaugggaggacguaccauauuuaggaaaacgcgaagaucaauggugugguagucuaauaggauuaacugcaagagccacaugggcgacgaacauacagguagcgauaaaucaaguaaggcggcucauagguaaugaaaauuacucagauuauaugacaucuaugaaaagauuuaaaaacgaaucagauccagaaggagcguugugguaa

SEQ ID NO: 21119 - RNA, 9879 nt, Artificial Sequence
  derived and/or modified CDS sequence (opt6) from DENV-1__KX380796__SS-prME
ucaguaacaaugcuuuuaaugcucuuaccgacugcauuggcuuuucauuugaccacucgaggaggagaaccacauaugauuguaagcaaacaggaacgcggcaaaucauuacuauuuaaaacgucagcggguguaaacauguguacucuaauagcaauggaucuaggagaacuaugcgaagauaccaugacuuauaaauguccacguauaacagaagcagaacccgaugauguugacuguugguguaacgcaacagacacuuggguuacuuacggaacauguucacaaaccggcgaacaucgacgugauaaacggagcguagccuuggccccacacgucggauuagggcuagaaacaagaacugagacuuggaugucuagugaaggggcauggagacagaugcagaaagucgaaacaugggcucugaggcacccuggauucacaguaauugcacucuuucucgcucaugcgauagguaccucaauuacacagaaaggcauaauuuucauuuuacuuauguuagucacaccgucaauggcuaugagaugcgucgggauagggaaucgcgauuuuguggaaggacuaaguggggcuacuuggguggaugugguucuagaacaugguucauguguuacaacaauggcuaaaaacaaaccgacgcuggauauagaauuacugaaaacggaaguaacaaacccagccguucugcguaaauuaugcauagaggcaaaaauaucaaauacuaccacggauucacgcuguccgacacaaggcgaagccacccugguugaagaacaagaugcgaauuuuguaugcagaagaacuuucguagaccgaggcuggggaaaugguuguggucucuuugguaaagguucacuacuuacaugugcuaaauuuaaauguguuacaaaacuagaaggcaaaacuguacaguaugaaaauuuaaaauacaguguaauaguaacuguacacacaggggaccagcaucaagucggaaaugagacuacagaacaugguacaauagcuacgauaacaccacaagcgccuacaagugaaauacaauuaaccgauuacggggcacugacauuagacugcaguccaagaacaggguuagacuucaaugaaaugguacucuuaacaaugaaagagaaaaguugguuaguacauaaacaaugguuucuagaccuaccgcucccauggacgucuggagcaaguacaucacaagaaacuuggaaccgucaagauuuauuagugacauucaagacagcucaugccaagaaacaagagguaguaguuuugggaagucaagaaggagcuaugcacacagcacucacaggugcaacugaaauacagacuagcgguacgacaacaauauuugcuggacaucuaaaaugcagacuaaaaauggauaaauuaacacugaaaggcguuucguaugucaugugcacagggucauuuaaauuggaaaaagaaguggcugaaacacaacacgggacaguauugguucaagugaaauacgaagguacugacgcaccaugcaaaauacccuucucaacucaagacgaaaagggaguuacucaaaauggcagauuaauuacagcgaauccaauagugacggauaaagaaaaaccaguaaauaucgaaacugaacccccauuuggggaaagcuauauaguaauaggagcuggugaaaaagcauugaaacuaaguugguuuaagaaggguaguucaaucggcaaaauguuugaggcaacagcgagaggagcaagacgaauggcgauccugggggauacggcgugggauuucggaucaauuggugggguguucacgucuguuggaaaacucguccaccaaguuuuuggcacagcguauggcguccuuuuuaacggagucaguuggacaaugaaaauuggaauagggauccuacugacaugguuaggacuaaauucgcguaguacuucacuaucgaugacauguauagcgguggguaugguaacucucuaucuaggaguuaugguucaggcagauucuggaugcgucauuaacuggaaagggcgagaacugaaaugugguucggguaucuucgucacuaaugaagugcauacguggacggagcaauauaaauuccaggccgacaguccaaaacgacucagugcagcuauuggcaaggcuugggaagaagguguguguggaaucaggagcgccacucgacuagagaauauaauguggaagcagaucucgaaugaacuuaaccauauccugcuugaaaaugauaugaaauuuacagucguagugggagaugccaacgguauacuaacacaagguaaaaagaugauacgaccccaaccuauggaacacaaauauaguuggaaaucauggggaaaagccaaaauaaucggcgcagacacacaaaauacuacauucauaauagacggaccagauacaccagaauguccagaugaccagagagcauggaauauuugggagguugaagauuacggguucgguguuuucacuacaaacauaugguuaaaauugcgugacucguauacccagaugugugaucacagacucaugagcgccgcuauuaaggauagcaaagcaguacaugcagacaugggguacuggauugagagcgagaaaaacgaaacauggaaacuggcccgugcaucauucaucgaagugaagacuugcauuuggcccagaucacacacccuauggaguaacggagucuuggaaucagaaaugauuauaccaaagaucuaugggggaccgauaagucagcauaauuaucggccuggguauuucacacaaacagcaggaccuuggcaucuaggcaaauuggaauuagacuuugaucuaugugaaggaacaaccguagugguagacgaacacuguggcaauagaggaccgagucuuagaacuacgacugucacuggaaaaauaauccaugaauggugcugucgcagcuguacccucccacccuuacgauuccguggagaagacggaugcugguauggcauggaaauucgaccgguaaaggagaaagaagaaaacuuagugagaucuaugguuucagcaggaaguggagagguugauucuuuuuccuuaggucuucucugugucaguauaaugauagaagaaguuaugagaucucgcuggucacggaaaaugcuuaugacaggaacacuugcuguguucuuucuucuaauaaugggacaauugacauggaaugauuuaaucagacuaugcauaaugguaggggcaaauguaucugacaggauggggaugggcacuacuuauuuagcguuaauggcaacguucaaaaugaggcccauguucgcagucggacuuuuauucaggagguuaacuucacgagaaguuuuacuuuugacgauaggacuaagccuaguugccagugucgaacuaccaaauucgcuggaggaauuaggggacggacuugcaauggguauuaugaugcuuaaacuuuuaacagacuuccagccacaucaauuauggacaacacuacucagcuugacuuuuauaaaaaccacuuuaucacuagacuaugccuggaagaccauggcuaugguucuauccauagucucuuuguuuccucugugccucaguaccacgucccagaaaacuacauggcuuccaguacuuuuagguuccuucgguuguaaaccacuaacaauguuucuaauaacagagaacaaaauauggggacgaaaaucauggccacuuaaugaagguaucauggccguugguauaguaucaaucuugcucucuagccugcuaaagaaugaugucccuuuggccggaccacuuauugcaggagguauguugauagcauguuauguaauaucagguuccagcgcugacuuaucauuggaaagagccgcagaagucucaugggaagaagaggcugagcauucuggggccucacacaacauacugguggagguccaggacgauggaaccaugaagauaaaagacgaagaaagagaugauacauuaacaauucuauuaaaggcuacacuccuagcagugagcggaguguacccaaugagcauuccugccacuuuauucguaugguauuucuggcagaagaagaaacagcgauccggaguucuuugggauaccccaucaccacccgaagucgaacgagcagucuuggaugacggaaucuauagaauacuucagcguggacuucuuggaaggucacaggucggcguuggggucuuucaagacggcguguuucacacaauguggcauguuacuagaggagcaguuuuaauguaucaggguaaaagauuggaaccgucaugggcuucggucaagaaagaucuuauaucuuacggaggagguuggagguuccagggaagcuggaacacuggcgaagaaguucaagucauagccguagagccagggaaaaauccuaagaacguacaaacgaccccaggcacguuuaagacacccgaaggagaaguaggagcgauugcauuagauuuuaaaccuggaacaucaggcaguccaaucguaaaucgagaaggaaagauugucggucuauacggcaauggcgugguaacaacaucaggaacauauguguccgcgaucgcccaggcuaaggcuucucaagaggggccuuugccggagauugaagaugaaguuuucaaaaagagaaaucucacaauuauggaccuucacccaggaagugggaaaacuaggcgauaucuuccugcaaucguacgggaagcuauuaaacguaaauuacgcacacuaaucuuggcuccaaccagaguuguugcuucggaaauggcugaggccuugaaagguaugccaaucagguaucaaacaacugcuguaaaaagugaacauaccggaaaggagauaguggaucucaugugucacgcgacauuuacuaugagacuccucagcccuguacgugugccuaauuacaauaugauuauuauggacgaggcgcacuuuacugauccagcuuccauagccgcaagaggcuacauuaguacaagaguugguaugggugaagccgcagccauauuuaugacagcaacgccgccaggaucggucgaggcuuucccacaaucuaaugcagucauacaagaugaggaacgugacauaccagaacgcucauggaacucuggcuacgacuggauaacagauuucccaggaaaaacagugugguuuguuccuucgauuaagucaggaaacgauauagcaaacugccucagaaagaacggaaaacggguaauacaacuaucgagaaaaacguuugauacugaauaucagaaaacuaaaaauaacgauugggauuacgucguaacaacagauauaucugagaugggagccaauuuucgggcggaucgaguaauugauccgaggagaugucuuaaaccaguuauccuaaaagauggcccagagcgaguaauucuagcugguccaaugccugugaccgcagcaucggcugcucaaaggagaggucgaauuggucgaaaucaaaauaaagaaggagaccaauauauuuauaugggacagccucuuaauaaugacgaagaccaugcccauuggacugaagcaaaaaugcuauuagacaacauaaacacuccugaagguauaauuccagcacuauucgagccggaacgugagaaauccgcugcgauagauggugaauaccgccuaagaggagaagcaagaaaaacauuuguagaguuaaugcgaaggggugauuugccgguauggcuauccuacaaggucgcaucugaggguuuucaauauucagaccgaagaugguguuucgacggggaacgaaauaaccagguuuuagaagagaacauggauguggagaucuggacuaaagagggggaaagaaagaaauuaagaccucgguggcuagaugcuagaacauauucugauccguuagcguuaagggaguucaaggaauuugccgcggggcgaaggucuguuagcggagaccugauauuagaaauaggaaagcuaccccaacacuuaacgcuuagagcccaaaaugcacuugacaaccuagucaugcugcacaauucugaacaaggaggaaaggcauacagacacgcgauggaagaauuacccgauacuauugaaacuuuaaugcuacuagcacuaaucgcuguccugaccggagggguuaccuuauucuuucuuuccggaaaaggguuaggaaagacuagcauaggacucuuaugcgugauggcaucaaguguucuucuauggauggcuagcguagaaccacauuggauagcagcauccauaauauuagaguucuucuuaaugguccuacuaauacccgaaccugacagacaaagaacaccacaagacaaccaauuagcguauguuguuauaggacuucuuuuuaugauacuaaccguugcagcgaaugaaaugggauuacuagaaacaacuaagaaagaccuagguauuggacaugugguugcugagaaucaucaucaugcgacuaugcuagauauugaucuacaucccgcaagcgcauggacauuguaugcaguugcgaccacaauaauuacuccgaugaugagacauacgauagaaaauacaaccgcuaauauuuccuugacagcuauagcaaaucaagcugccauacucaugggacucgauaaaggauggccaauaagcaaaauggauauaggugugccauuguuagcacugggauguuauucacaagugaauccccuaacccucacagcugcuguucuaaugcuaguagcacacuaugcaauuauaggaccugggcuacaagcaaaagcaacuagagaagcucagaaaagaacggccgcagggauaaugaagaauccaacagucgauggaaucguggcgauagacuuggacccugucgucuacgacgcaaaguuugaaaaacaauuagggcagaucaugcuacuaauucucuguacaucacaaauccuacuaaugcggaccaccugggcacuaugcgaaagcauaacguuagcgacggguccguuaacaacccugugggaaggaagcccaggcagauuuuggaauacgacaaucgccguguccauggccaauauauuucgggggucguaccuggcgggugcuggacuggcuuucucacuaaugaaauccuugggcggugguaggaggggaacgggagcucaaggagaaacacuuggugaaaaauggaaaagacaacuuaaucaacuaaguaaaagugaauuuaacacuuacaaaagaaguggaauuauggaaguugaucgcucagaagcaaaagagggccuaaagcgaggugaaacgacgaagcaugcuguaucacguggaacggcaaaauugagaugguucguagaaagaaaccuugugaaacccgaagggaaagugaucgaucuaggaugcgguagaggcggaugguccuauuacugcgcaggucucaagaaaguuacagagguuaaaggguacacaaaaggugggccuggacacgaagaaccuaucccaauggcaacguacggcuggaacauaguuaaguuacauagugggagagauguuuucuuuacaccuccagaaaaaugcgacacucuacucugugauauaggagagucaucaccaaacccaacaauagaagaaggccggacccuuaggguacuaaaaaugguagaaccaugguuaagggggaaucaauucugcaucaaaauccuaaacccauauaugccuucugugguagagaccuuagaacaaaugcaaaggaaacauggagguauguuaguaagaaauccauugagucgaaauucuacucacgagauguacuggguaucaugugguacagggaauauaguaagcgccguaaacaugaccaguaggauguugcucaauagauucaccauggcucaccgcaaaccaacauaugaacgugacguagaccuuggcgcagggacgaggcauguagccguugaaccugaaauagcuaacuuagacaucauaggacaacggauugaaaauaucaaaaaugaacauaaaaguacuuggcauuacgaugaggacaacccauacaagaccugggcguaccacgggucguaugagguaaagcccucagguucagcgucuagcaugguaaauggagugguuagacuccuaacuaagccgugggacguaauaccaauggucacgcaaauugcuaugacugacacaacaccuuuugggcagcagagagucuucaaagagaaaguggauacuagaacuccaaggccaaaaagaggaacugcucaaaucauggaaguaacagcaaaguggcuguggggcuucuuauccagaaauaaaaagccacgcauaugcacaagggaggaguuuacucguaaaguacgcucuaaugcugccauuggggcgguuuucgucgacgaaaaccaauggaacucagcgaaagaagcaguugaagacgaacgcuucugggauuuaguucaucgagagcgagaacuccacaaacaagguaagugcgcaacaugcguguacaacaugaugggaaaacgagagaagaaauuaggggaguuuggcaaagcuaagggcagucgagccauaugguauauguggcucggugcucgguuucuggaguuugaggcuuuaggauuuaugaaugaagaucacugguuuucacgagaaaacuccuuaucgggagucgaaggugaaggcuuacauaaacuuggcuauauuuuacgggauauaucaaaaauaccaggugguaacauguaugcugacgacacggcgggaugggacacaagaauaacggaagacgaucuacaaaaugaagcaaaaauuacagacauaauggagccagaacacgcacuucuugcgacuagcaucuuuaaacuaaccuaccaaaacaaaguugugcgcguacagcgccccgcgaaaucuggaacuguuauggaugugauaagccguagagaccaaagagguucgggacaaguugggaccuacgguuuaaauacuuucaccaacauggaggugcaguuaauacgacaaauggaaucagaaggcauuuucagcccaucagaacuagagaacucgaauuuggcagaaagggucuuagauuggcuagaaaagcacgguguugaacguuuaaaaagaauggcaaucagcggagaugacugugucguuaagcccacggacgauagauuugcgacagccuuaaccgcauuaaacgauauggguaagguaagaaaggacauaccacaaugggaaccuaguaaaggcuggaacgauuggcaacagguacccuucuguagucaccauuuucaucaauuaauaaugaaagauggccgugaaauaguaguuccuugccgaaaucaagacgaacucguaggacgagcaagaguaucccaaggugcaggguggucccuuagagaaacagcaugccucgguaaaucauacgcacaaauguggcaauugauguauuuucaccgccgugaccucagacuagcagcuaaugcaauauguagugcaguaccugucaacugggugccaacuagcaggacuacauggaguauacaugcacaucaccaauggaugacuaccgaggacauguuaucuguuuggaauagaguuuggauagaagaaaacccauggauggaggauaaaacgcauguuagcucuugggaggauguaccauaucucgggaaaagggaggaccaauggugcggaucauuaauagggcuaacagcccgugcgacaugggcgaccaauauacaaguugcgauuaaucaggucagaagauugauagguaaugaaaacuacuuagacuauaugaccuccaugaagagauuuaagaacgaaagcgauccagaaggcgcacuuugguag

SEQ ID NO: 21120 - RNA, 9879 nt, Artificial Sequence
  derived and/or modified CDS sequence (opt6) from DENV-1__KX380799__SS-prME
agcguaacaauguuacuaauguuauuaccuacggcucuugcguuucauuuaacaacaagaggaggugaaccacauaugaucguuagcaaacaagaacgaggaaaaucacuacucuuuaaaacgucggcuggcgucaauauguguacgcucauagcaauggaucuaggagaauuaugcgaagacacaaugacauauaagugcccaagaaucacagaagcugaaccugaugauguugauugcugguguaaugcuacagacacuugggucaccuauggcacuuguucucaaacaggugaacacagaagagauaaaagaaguguugcuuuagcaccacacguaggcuugggacucgaaacuagaacugaaacauggaugucuucagaaggagcuuggcgacaaauacaaaaaguugaaaccugggcacuacgacacccaggauucacaguaaucgcccuauuucuugcacaugcgaucgguacuucuaucacacaaaaaggaauuauuuucaucuuacugaugcuaguaacacccaguauggcaaugagaugcguaggaauaggaaacagagauuuuguggaagguuugucaggagccaccuggguagacguaguacuagaacaugguucaugcguaaccacuauggcuaaaaauaaaccgaccuuagauauagaacuacuaaagacagaaguuaccaauccagcaguccuacgaaaacuauguauagaagcaaaaauuucuaacacaacuacugauucgagauguccaacccaaggugaagcgaccuuaguagaagaacaggacgccaauuucguuugucgcaggacauucguugaccgugguuggggaaauggauguggacucuuuggcaaagguucccuauuaacgugugcaaaauuuaaaugugugacaaaacuugaagggaaaauaguucaguaugaaaaccuuaaauauucgguuauuguaacaguccacacaggagaucaacaccagguuggaaacgaaacaacugaacaugggacuauagcaacuauaacgccucaagcgcccaccagugaaauucaauugaccgauuauggagcauugacccuagacuguucaccaagaacgggacuggacuuuaaugaaaugguuuugcuaacgaugaaagagaaaaguugguuagugcauaaacagugguucuuagaucuaccgcucccauggacgucgggugcgucaacaagucaagaaaccuggaaccgacaagauuuauuaguaacuuuuaaaacagcacacgcuaagaaacaggaaguaguuguguuaggcagucaagaaggagcaaugcauaccgcccucaccggagcuacagaaauacaaacuucugggaccaccaccauauucgccggacacuugaagugccgacuaaagauggauaaacuuacuuuaaagggggugaguuauguuaugugcacagguaguuucaaauuagagaaagaagucgcggagacacaacauggcacuguauuaguacaaguuaaauacgaggguacagaugcgccauguaaaauaccaauaucaacgcaagaugaaaaaggugugacacagaauggacguuuaauaacugcuaauccaauaguaacagacaaagagaaaccuguaaauauugaaacagaaccuccuuuuggugagucguauaucguaauaggggcuggagaaaaggcauugaaauugucgugguuuaagaagggaucaaguauaggaaaaauguucgaagccacagcaagaggugccagaagaauggcaauauuaggugacacugcuugggacuuuggcaguauaggggguguguuuacaucaguagguaaauuaguacaucaaguuuuuggcacggcuuaugggguacuauuuuccggugugucauggacaaugaaaaucggaauugguaucuuauugacauggcuuggucuaaauucccgcaguaccaguuuaaguaugacuugcauagcaguugguaugguaacacuuuauuuaggagucauggugcaagcagauuccggcugcguuauaaauuggaaagggagagagcuuaaguguggaucugguauauuuguaacgaaugaagugcacacuuggaccgaacaauauaaauuucaagcagauucaccuaaacggcuuagugcugcuauaggaaaagcgugggaagaagggguaugugggauccgaagugcuacgagacuagaaaauauaauguggaaacaaauaaguaacgaauuaaaucauauauuguuagaaaacgauaugaaauuuaccgucguaguaggagaugcaaauggaauccugacucaaggcaaaaagaugauacgaccucaacccauggaacauaaauacucauggaaaucauggggaaaagccaaaauaauaggugcggacacgcagaauacgacguuuauuauagacgguccagacacuccagaguguccagaugaccagagggcguggaacauaugggagguagaagacuauggauuuggaguguucacaacaaacauuuggcugaaauugcgcgauucuuacacgcaaaugugcgaucauagauuaaugagugcagcuaucaaagauucgaaagcaguacacgccgauaugggguauuggauugagagugagaaaaaugagacguggaaauuggcacgcgccagcuucauugaagugaaaaccugcauuuggccccgaagucauacucuaugguccaacgguguucuugaaagcgaaaugauuauaccuaaaaucuacggaggcccgauaagccagcauaauuauaggcccggcuauuuuacacaaacugcagguccauggcaucuaggcaaguuagagcuagauuucaaccugugcgaaggcacaacagugguaguugaugaacauugcgguaaucgaggaccaucgcuuagaaccacgacggucacuggaaaaaucauccaugaauggugcugcagaagcuguacacuaccucccuuaagauuucgaggagaggaugguugcugguauggaauggagauacgacccguuaaggaaaaagaagaaaaucuagugagaucgauggucucagcaggaucaggugaggucgauagcuucuccuuaggacuauuguguguuagcauuaugaucgaggagguaaugagaucacgaugguccagaaagaugcugaugacaggaacauuggcaguauucuuuuuacucauuauggggcaacuuacuuggaacgauuuaauccgcuuauguauaauggugggagccaauguauccgaucgaaugggaauggggacaacuuaucuagcauugauggccacauuuaagaugagaccgauguuugcuguuggacugcuauuuaggcgauugacgucgcgugagguacuucuacuuacaauaggccuguccuuaguagcaagcguugaauuaccaaauaguuuggaagaguuaggcgacgggcuggcaaugggaauaaugauguuaaaauuacucaccgauuuucaaucucaucagcuauggaccacccuauuaucccuaacuuucauaaaaacaacucuuucuuuagacuaugccuggaagacaauggcgaugguguuaagcauagucucauuauuccccuuguguuuaaguacaacgagucagaaaacgacauggcuuccuguacuuuuagggucauucggcugcaaaccacugacaauguuucuuaucacggagaauaaaauauggggacguaaaucauggccucuuaaugaaggcauuauggcagugggaauaguaagcauucuuuuaagcucucugcucaaaaacgacgugccucuagcaggccccuugaucgcaggcggaaugcuaauagcauguuauguaauuucagguucaucugcagacuuaucacuagaaagagccgcugaaguaucgugggaagaggaagcagaacauuccggcgcuucacacaauauucugguagaaguacaagaugacgggacgaugaaaauuaaagaugaagaacgagaugauacacuaacuaucuuauuaaaagcaacacucuuagcagugaguggcguguaucccaugucaauacccgcgacucuguuuguaugguauuuuuggcaaaagaaaaagcaaagaucaggcguccuaugggacacgccgucaccaccugaaguugagagggcagugcuagaugauggcauauacagaauacuccagcguggguuacugggaagaucucaagucggugucgguguauuucaagacggaguauuucauacgauguggcacguaacacgcggggcuguuuugauguaucaaggaaagagauuagaaccaaguugggcaaguguuaagaaagaccuaauuucauaugguggaggcuggagauuccaaggauccuggaacacgggagaagagguacaagucauugcggucgaaccagggaaaaauccuaagaauguacaaacaacucccggaacuuuuaaaacgccagaaggcgaaguaggggcaaucgcucuggacuucaaaccaggcacaaguggaucuccaauaguaaaucgcgaagguaaaauaguuggucuguauggaaauggcguuguuacaaccucugguacauauguuagugcaauagcccaggcaaaagcaucgcaggaaggaccauuaccagaaauagaagaugaaguguucaagaaacggaauuuaaccauaauggaccuucacccuggcucugguaaaacacgcagguauuuaccagcgaucguaagagaagcaaucaaaagaaaauuaagaacuuuaauauuagccccaacuagaguaguagcuagcgagauggcggaagccuuaaaaggaaugccgauacgguaccaaacuaccgcaguuaagucggaacacaccgguaaagaaauaguggaccuaaugugccacgcaacauuuacuaugagauuacuuuccccgguaagaguaccuaauuacaauaugauuauuauggacgaagcacauuuuacggacccagcaucgaucgcggccagaggcuacauuuccacucgcguaggcaugggagaagcugcugcaauuuucaugacagcaacacccccagguucugucgaggcuuuuccgcaaagcaacgcugucauucaagaugaagaaagggauauucccgagcgguccuggaacucaggguacgauuggaucacagauuuuccgggaaaaacaguaugguucgugccauccauuaagucuggcaaugauauagcgaacugucuuaggaaaaauggaaaaaggguaauucaguuaagcaggaaaacauuugacaccgaauaucagaaaacuaaaaauaacgauugggauuauguagucacgacugauauuucagagaugggugcuaacuucagggcagacagaguaauugauccacgccgaugccucaagccuguuauuuuaaaggauggaccugagcggguaauucuugcaggcccaaugccagugaccgcugcaucugcagcacagcguagaggacguauugggcgaaaccagaacaaagagggcgaucaauacauauauaugggacagccucuaaauaaugacgaagaucacgcccauuggacagaggcaaagauguuauuggacaacaucaauaccccggaagggauaauucccgcucucuuugaaccugaacgugaaaagagcgcugcaauagacggugaauaccgauuaagaggugaagcacgaaaaacauuuguagaguugaugaggagaggggacuuaccaguuugguuaucuuacaaaguugcuucagaggguuuccaauacagugaucgaagauggugcuucgauggcgaaagaaauaaucaaguacuagaagagaacauggacguggaaaucuggaccaaagaaggugagagaaagaaacuaagaccuagaugguuagaugcacgaaccuacagcgacccgcucgcccuuagggaauuuaaagaauuugcagcuggcaggagauccguuuccggggaucugauauuagaaauugggaaauugccccaacaccuaacacuaagagcccagaaugcucucgauaacuugguaaugcuccauaauuccgagcaaggaggaaaagcauacagacacgccauggaagaauugcccgacacaauugaaacccugaugcuauuggcacuuauagccgucuugacuggaggcgugacucuauuuuucuugagugguaagggacuaggaaaaacgagcaucggcuuauuguguguaauggcgagcucaguucuacucuggauggccuccguagaaccacauuggauagcagcaagcauaauauuagaguucuuuuuaaugguacuacucaucccggagccugauaggcaacgcacaccacaggacaaucaacuugccuacguaguaaucggcuuauuguuuaugaucuuaaccguagcagcgaacgaaaugggucuacuagaaacuacuaaaaaggacuuaggaaucggacauguaguugccgagaaucaccaucacgcaacaaugcuugacauagacuugcacccugcuucugcauggaccuuauacgccgucgccaccaccaucauuaccccuaugaugaggcauacaauagaaaauacuacagccaacauuucacuaaccgccauugcuaaucaagcugcuauacuuaugggccuggauaaagguuggccaauuagcaagauggauauaggcguaccauuauuagcauuaggcuguuacucucaggucaauccguugacgcuaacagccgcugucuugauguuaguugcacauuacgcaauaauagguccuggauuacaagcaaaagcaaccagagaagcucagaaacggacggcagcaggaauuaugaaaaaccccacaguagauggaaucguugcaaucgaucuagaccccguaguauaugacgcaaaauucgaaaagcaacuuggacaaaucaugcucuuaauccucuguacaucacaaauauuauuaaugagaacaacaugggcacuaugugagucaauaacacuagcaacagggccucuaacaacuuuaugggaaggaucgccugguagauucuggaacacaacaaucgccguaucaauggcuaauauauuuagaggcucauacuuagccggugcaggccuugcuuucucauuaaugaaaucuuuaggaggugguaggagagguacaggagcacaaggggagacacugggagaaaaauggaaacgucagcuaaaucagcuauccaaaagugaguuuaauacuuauaagaggagugguaucauggaaguugauagaagugaggccaaagaaggacuaaagcggggagaaacgaccaaacaugcugugucgagaggaacagcaaagcugagaugguuugucgagcgaaaucuagugaaaccagaagguaaagucauagaucuuggauguggcagaggaggguggagcuauuacugugcuggccucaaaaaggugacugagguaaagggauauacaaagggcggaccugggcacgaagaaccaauuccaauggcuaccuacggcuggaauaucguaaaacuacacagcggaagagauguauucuuuaccccgccugaaaaaugugacaccuugcugugcgauaucggcgaaucgaguccuaauccuacaaucgaggagggaaggacauugagagugcuuaaaaugguagaaccuugguuacgaggcaaucaguuuuguauaaaaauccuaaacccauauaugccgagugucguagaaacacuggaacaaaugcaaagaaaacauggaggaauguugguaagaaacccacuaagcagaaacuccacccaugagauguauugggucucauguggaacagguaacauaguaagcgccgugaauaugaccagcaggaugcucuuaaauagguuuacgauggcucaccgcaaaccaaccuaugaaagagaugucgaucugggcgcaggaaccagacacguugcuguagaaccagaaauagcuaaucuagauauuaucggccaacgaauagaaaacauaaagaaugaacauaaaucuacuuggcacuacgaugaggauaauccguauaaaaccugggcuuaccaugguucauaugaaguuaaaccuucaggaucagccucgagcauggucaacggcgucgugcgacuucucacaaaaccaugggacgugauacccaugguuacucaaauugcaaugacugauacaacucccuuugggcaacagaggguguucaaggaaaaaguggauacuagaaccccacguccgaagcggggcaccgcucaaauuauggaaguaaccgcaaaguggcuauggggauuucugucucgaaacaagaaaccccgaauauguacaagagaagaauuuacacgaaaaguacgaaguaaugcagcuauuggugcgguuuuugucgaugagaaccaauggaacucugcgaaagaggcagucgaagacgagagauucugggaccuaguccaucgcgagagggaacuccacaaacagggaaaaugugcuacaugcguauauaauaugaugggaaaacgugagaaaaagcuaggcgaauuugggaaggcaaaagggucgcgagcaauuugguacauguggcugggggcuagauucuuagaauuugaagcucucgguuuuaugaaugaagaccacugguuuucucgggaaaauuccuugucuggaguugaaggggaagggcuacauaaguuaggguacauacuuagagacauaucgaaaauccccgggggaaacauguaugcagaugauacugcaggaugggauacucguauaacugaagaugacuuacaaaacgaagcaaaaauuacagauauaauggaaccggaacaugcguuauuagcaacaucuauauuuaaauuaacuuaccaaaacaaaguggugagaguacaacguccagcuaagaguggaacuguaauggacguuauuucacgcagagaccagcgugguucggggcaaguagguacuuauggacucaacacuuuuacaaacauggaagugcaauuaauacggcaaauggaaucagaagguauuuucucuccaucagaacucgagaacuccaacuuagcagaaagaguacuggauugguuagaaaaacacggaguugaaagacuaaagcgaauggccauaagcggagaugacugcgucgugaagccuaccgaugaucgguuugcaacagcucucacagcgcuuaaugacauggggaaaguucgaaaagacauaccacaaugggaacccuccaaaggauggaacgauuggcaacaaguaccguucuguucucaucacuuucaccaguuaauaaugaaagacggucgcgaaauugucguaccuuguagaaaucaagacgaacuugugggccgcgccagaguaagucaaggugcaggauggucguugagagaaacggcaugccuggguaaaucuuacgcccaaauguggcaacuaauguacuuucaucguagggaccugcgauuagcggcaaaugcuaucuguagugcaguaccggugaauuggguaccaacaucaagaacuacauggucaauacaugcacaucaccaauggaugacgacagaggauaugcuaagugucuggaauagaguauggauugaagaaaauccuuggauggaagauaaaacgcacguuaguaguugggaagauguaccuuaccuaggcaaaagggaggaccaguggugcgguagccuaaucggauugacagccagggcgacgugggcgacgaauauacaaguugccauaaaucaaguacgaagauuaauuggaaacgagaauuaucuugauuacaugacaucgaugaaacgauuuaaaaaugaaucugaucccgaaggagcauuaugguaa

SEQ ID NO: 21121 - RNA, 9879 nt, Artificial Sequence
  derived and/or modified CDS sequence (opt6) from DENV-1__KX380800__SS-prME
uccgugaccauguuacuaauguuauuacccacugcacuagccuuucaccuaacuacuagggguggagaaccgcacaugauuguaucaaaacaagaacgugguaaaucgcuuuuauuuaaaacaucagcuggugugaauaugugcaccuuaauagcaauggauuuaggagaacucugugaagacacuaugacauacaaaugcccgaggauuacggaagcagaacccgaugauguugacugcugguguaaugcaacugauaccugggucacauauggaacuuguucucaaacaggugaacauagaagagacaaaaggucuguagcacuagcuccacacguaggacuuggacuagaaacaaggacugaaaccuggauguccucugaaggagcauggcggcagauucaaaaagucgaaacgugggcuuugagacacccuggcuuuacaguuaucgcgcuauuuuuagcucacgccauugggacaucaauaacacaaaaagguauaauuuuuauauuauugaugcuaguaacaccaagcauggcuaugagauguguuggaauuggcaacagagauuuuguugagggauuaaguggcgcgaccugggucgacguuguuuuggaacaugguucaugcguaacuacaauggcuaaaaauaaaccaacgcuggacauugaacuguuaaaaacugagguaaccaauccagccguacuuagaaaauuauguauagaagcuaaaauuaguaauacaacgaccgauuccaggugcccgacacaaggugaggcuacuuugguagaagaacaagacgcuaacuuuguauguagaagaacauuuguggacagaggauggggaaauggaugcggauuauucggaaaaggaucccuccucacaugugcaaaauucaaaugugucacuaaauuagaagggaaaauaguacaauacgaaaauuugaaauacucggucaucguaacaguacauaccggcgaccaacaucaaguugguaacgagacaacggaacacgggacgaucgccacaaucacaccacaagcaccaacaucugaaauacaauugaccgacuacggagcucuuacuuuagacugcaguccuaggacaggccuugauuucaaugaaaugguacuguuaaccaugaaggagaaaaguugguuaguacauaaacaaugguuccucgaccucccacuuccauggacaagcggggcuagcaccucccaagaaacuuggaauagacaagaccuguuggucaccuucaagaccgcacaugccaagaaacaagaagugguuguuuuagggucccaagagggagcgaugcauacagcucuuacaggagcaacggaaauucaaacgucaggaacaacaacaauauucgcggggcaccucaaaugcagacugaaaauggauaaauugacauugaaagggguuucguauguuauguguacuggcucauuuaaauuagaaaaagaaguagcugaaacucaacauggcacgguccuaguacaaguaaaauacgagggcacugacgcaccguguaaaauaccgaucucuacccaagaugaaaaggguguaacucagaacggccgucugauuacagcaaauccaauaguuacagacaaggaaaaaccagugaauauugagacagaaccaccauuuggggaguccuauauuguaauaggugccggcgagaaagcauuaaaacuaagcugguucaagaaaggaucaucaauaggaaaaauguuugaagccaccgccagaggugcaagacgcauggcuauacuuggagauacugcuugggauuucggauccauaggaggagucuucacaagcguuggcaaguuaguacaucaaguauucggaacugcuuaugggguccuuuucucuggagucaguuggacuaugaaaauaggaauaggaauccuucuuacaugguuaggucugaacagucggaguacuucucugagcaugacauguauagcggucggaaugguuacucuauacuuaggagucaugguacaagcagauucagguugcguaauuaauuggaagggccgagaauugaaaugcgguagcgggauauuugucacuaacgagguccacacauggacagaacaauacaaguuucaagcagauuccccaaagcgcuugucagcagcaaucggaaaagcgugggaagaaggcguaugcgggauacgcagugcaacucgcuuggaaaauauaauguggaaacaaauaaguaacgaacucaaucauaucuuauuagaaaaugauaugaaauucacaguaguagucggugaugccaauggcauccucacucaagguaagaagaugauuagaccucaaccaauggaacauaaguacagcuggaaaucaugggguaaggccaaaauaauuggcgccgacacgcagaacacuacauucaucaucgacggaccagacacuccugaaugcccagacgaucaacgcgcauggaacauaugggaaguugaagauuacgguuuuggaguauuuacuacgaauauaugguuaaaacuccgugacucuuacacucaaaugugcgaucaucgcuugaugucagcugcaauuaaagacaguaaagcgguccaugcagacaugggauauuggauagaguccgagaagaaugagaccuggaaauuagcaagagcaaguuucaucgagguaaagacuuguauauggccuaggucucauacgcuauggucaaaugggguacuagaaagugagaugauuauuccuaaaaucuacggugggccaauaagucaacauaauuaccgaccuggauauuuuacacaaacggcaggaccauggcaucuaggcaaacuggaauuagacuuuaacuuaugugaagguacuacaguggugguagaugagcacugugguaauagggguccaucauuaagaacaacaacugucacaggaaaaauuauccacgaauggugcuguaggucuuguacccuuccacccuugagauuuagaggagaggacggcuguugguaugggauggaaauacgcccuguaaaggagaaggaggagaaucuagugagaucgaugguuucugcagguucgggagaaguugacagcuuuucauugggcuuacucugcguuuccauaaugauugaggaaguuaugcgaucgcgguggagcagaaaaauguuaaugacggggacucucgccauauucuuucugcuaaucaugggccaacugacauggaaugaucuuauaaggcuuugcauaaugguaggggcaaauguuucagauaggauggguaugggaacgacuuacuuggcgcucauggcgacguucaagaugagaccaauguuugcuguaggacuacucuuucguagguugaccagcagggagguuuuauuguuaacgauuggauuaagccuaguugcaagugucgaacugccuaauucuuuagaggaacuaggcgacgguuuagcaauggguauaaugaugcuaaaguuauuaaccgauuuucaaucgcaucaauuguggacaacccuccuuagucucaccuuuauaaagacaacacuaagccuagauuacgcuuggaagacuauggcaaugguacucuccauuguuucuuuauuuccguugugccuaagcacgacaucucagaaaacuacaugguugccuguuuuacuagguaguuuugguugcaaaccucugacuauguuucucaucacggaaaauaaaauauggggucgaaaaucauggccucuuaaugaaggcauuauggcaguuggaauuguuuccauauuacugaguucacuuuuaaagaaugacgugccauuggccggcccuuuaauagcuggagggauguuaauagcuuguuacguuauuucagggaguuccgcugaucucagccuagagcgagcggcugaaguaucuugggaagaagaggcggaacauucuggagcaagccacaauauucuuguugaagugcaggaugacgguacuaugaaaauuaaagaugaggaaagagaugauacuuugacgauauuauuaaaagcgacgcuccuagcaguaaguggcgucuaccccaugucaauaccugcaacguuauuugucugguacuucuggcaaaagaagaaacaacgcagugggguguuaugggacacgcccagcccuccugaaguggaaagagcaguacuugacgaugguauuuaucgaauacuacaaaggggacuauuggggagaucacagguaggaguagggguauuucaagauggaguauuucauacgauguggcacguuacuaggggagcaguccugauguaucagggaaaacgacuagagcccucgugggcuagcgucaagaaagaccuuauuucguauggaggaggauggagauuccagggcagcuggaauacgggcgaagaaguccaagucauagcugucgaaccaggcaaaaaucccaaaaauguccaaacgacucccgggacauucaaaacgccagaaggcgaagucggcgccauugcauuggauuucaaaccagggacgagcgguucaccaauaguuaacagagaaggcaaaauaguaggauuguauggaaauggugugguuacaaccucgggaacuuauguaucagcuaucgcccaagccaaggcaagucaagaaggaccauuaccugaaauugaagacgaggucuucaaaaagagaaauuugacaaucauggaucuacauccagguaguggcaaaacacgcagguaucucccagcuaucguccgugaagcgauuaaaagaaaacuacgcacucuuauccuugcgccaacucgugugguagcuagugagauggcagaagcccuuaaaggaaugccgauacguuaccaaacgacugccguuaaaucugaacauacagguaaagagaucgucgaucucaugugucacgcuacguuuacgaugagacuacuuaguccgguucgcguuccuaauuauaauaugauuauuauggacgaagcacacuuuacagacccggcaaguaucgcggcccgaggguacaucaguacccgcguaggaaugggagaagcagccgcaauauuuaugacugcaacaccacccggaaguguugaggcuuuuccccaaucaaaugcugucauucaagacgaagaacgugauauuccagaaagaaguuggaacagcggauaugacuggauuacagacuuuccagguaaaacaguaugguuuguccccucaauuaagucuggaaaugacauugcaaauuguuuaaggaaaaacgggaaacguguaauacaauuaaguagaaaaacauuugacacugaauaccagaaaacuaaaaacaaugauugggauuaugucguaacuacagacauaagcgaaaugggagcaaauuucagagcugaucggguaauagacccaaggcgcuguuuaaagccaguaauucugaaggauggaccggaacggguaauacuugcaggcccgaugccaguuacagcagccucugcggcacaaaggcgaggacgcauaggaaggaaccaaaacaaagaaggcgaccaauauauauauaugggacagccauuaaauaacgaugaagaucaugcucauuggaccgaagcgaaaauguuguuagacaacauaaacacuccugaaggaauaauaccugcucuauucgaaccggaaagggaaaaaucagcugcuauagauggugaauaucgauugcguggugaagcacgaaagacauuuguugaguuaaugcggagaggggaccugcccguaugguugagcuauaaagucgcgagcgagggauuucaguacagugauagacggugguguuuugauggugaacgaaacaaucagguauuagaagaaaauauggacguagaaauuuggacaaaagagggagaacguaagaaacuuagaccacgcuggcuugaugcaagaaccuauagugauccgcuagcucuccgugaguuuaaggaauuugcagcgggacgcaggagcguuucgggcgaucugaucuuagaaauaggaaaacuuccucaacaucuaacucuuagggcccagaaugcgcuagacaaucucgucauguuacauaacucagagcaagguggaaaggcauauagacaugcuauggaagaacucccagacacaauagaaacauuaauguuacuugcucuaauugccgugcuaacgggugggguuacacuguucuuuuuauccgguaagggauuaggaaaaacgucgaucggauuacuauguguaauggccagcaguguuuuauuauggauggcuucaguagaaccgcacuggauagcugcgucaaucauauuagaauuuuuccuaauggugcuguugaucccagaaccugaccgccaaagaacaccucaggacaaccagcuagcuuaugucgucauaggauuauuauuuaugauauuaacugucgcagcuaaugagaugggcuuacuagaaacgacgaagaaagaccucgguauaggacauguuguugcagagaaucaucaucaugcaacgauguuagacauagaucugcauccugcgagcgcuuggacuuuguaugcaguagccacaacaauuauaacuccaaugaugcgucacacgauagagaacacaacagcaaauauaagccuaacggcuaucgcaaaucaagcagcuauacuaaugggauuagacaaagguuggccaauaaguaagauggauauuggaguccccuuacuggcccuagguuguuacucgcaaguaaauccuuuaacacuuacagcagcuguauugauguuaguagcacauuaugcuauaaucgguccgggacuccaagcaaaagcaacacgggaagcacaaaaacgaacugcagcugguauuaugaaaaauccuacuguagacggaauaguagcaauugaccuagauccgguuguuuacgaugcaaaauucgaaaaacaauuaggccaaauuaugcuacuaauauugugcacaagccaaauacuauuaaugaggacuaccugggcacuuugcgaaucaauuacacuagccacaggcccacuuaccacauuaugggaagguucaccagguaaguuuuggaauacuacaaucgcaguaucaauggccaauauauucagaggaagcuaucucgcgggagccggucuugcuuuuucgcuaaugaaaucucugggcgguggucgacgcggaacaggugcgcaaggugagacucuaggagaaaaauggaaaaggcagcuaaaucaauuaucgaagagugaguucaauaccuauaagaggagcgggauuauggaaguggauaggagcgaagccaaggaaggucuaaaaaggggugaaacuacaaaacacgcaguauccagggguacagcuaaacugagaugguucguggagcguaaccuugucaaaccagaaggcaaggugauugaucuaggaugcggcagaggcgguugguccuacuauugugcuggucuuaaaaaggucaccgaaguuaaaggauauacuaaagggggaccaggucacgaagaaccuauaccgauggcuacuuacggguggaacauagucaaacuucacucaggacgcgauguauuuuucacacccccagaaaagugcgauacauuauugugugauauaggcgagucuaguccaaacccuacgauagaagagggaagaacguugagaguacugaaaaugguagaacccugguuaagagguaaucaauuuuguaucaaaauacugaauccauauaugcccuccgugguugaaacacuggaacagaugcaacgaaaacacggaggaaugcucgucagaaacccccucucaagaaauucaacucacgaaauguauuggguauccuguggaacagguaauaucgugucggcaguuaacaugacaucgcguauguuacuaaaccguuuuacaauggcacacagaaagccuacauaugaacgggauguugaucuaggagccggaaccagacauguugcuguggaaccagagauagcgaacuuagauaucauaggacaacguauugaaaauauaaagaaugagcauaaaucaacuuggcacuaugacgaagacaacccauauaaaacgugggccuaccacggaaguuaugagguaaaaccuucgggaagugcgucaucaaugguuaaugggguggugcgauuguuaacuaaaccgugggauguaauucccaugguaacacagauugcuaugacugacacuacuccauucggacagcagagaguuuuuaaagagaaggucgauacgaggacaccacgaccgaaacgcgguacagcucagauuauggaaguaacagcaaaauggcugugggguuuucuuucuaggaauaagaaaccgcggauuugcacacgugaagaauuuacuagaaaaguaaggucaaaugcagcgauaggugccguuuucguggacgagaaucaguggaacucugcuaaagaggcaguagaagacgaaagguuuugggauuuggugcauagggaaagagagcuucacaaacaaggaaaaugcgcgacguguguuuacaacaugauggggaaaagggaaaagaaguugggugaguucggaaaagcaaaggguucacgagcaauuugguacauguggcucggcgcacgauuccucgaauuugaggcuuuaggguucaugaaugaagaucacugguucaguagggaaaauucacuuucuggaguugaaggagaagggcuccauaagcuaggcuacauacuuagagacaucuccaaaauacccggcggaaacauguacgcagacgacacagcagguugggauacaagaauuaccgaagaugauuuacaaaacgaggcaaagauaaccgacaucauggagccugagcaugcacuucuugcgacaaguaucuuuaaguuaacuuaucagaauaaagucguaagagugcaacgacccgcaaaaagugguacaguaauggacguuauuagcagacgcgaucaacggggcaguggacaaguugggacauacggguugaauaccuuuacaaacauggaaguucaauuaauucgucaaauggaaucugaaggaauauucaguccaucugaacuugaaaauagcaauuuagcagaacgugugcuagacugguuagaaaaacaugggguggaaagacucaaaagaauggcuauuagcggggaugauuguguuguaaagccaacggaugaucguuuugcaaccgcacuuaccgcacugaacgauaugggaaaaguucgaaaggacauaccacaaugggaaccgucuaaaggguggaacgauuggcagcaagucccauuuugcucacaucacuuucaucaguuaauaaugaaagaugguagagaaauagugguaccauguagaaaccaagaugaacuuguagggagggcccgggucagucaaggagcagguuggucacuacgugaaacggcauguuuggguaaguccuacgcacagauguggcaauugauguacuuucauagacgugauuuaagacuggcugcgaaugcuauauguagcgcaguaccagucaauuggguuccaacaucuaggacgacuuggucaauucacgcacaccaccaauggaugacaacagaagauaugcuuaguguuuggaaucggguuuggauagaggaaaauccauggauggaagauaaaacacacguaagcucuugggaagacgucccauaucuugguaagagggaggaucaauggugugguucucuaauuggacucacugcucgggcaacuugggcaaccaauauacagguagcgauaaaucaaguucgucgucuaauagggaaugaaaauuaccucgauuacaugacaucaaugaaacguuuuaaaaaugagucugauccagaaggagcccuaugguaa

SEQ ID NO: 21122 - RNA, 9879 nt, Artificial Sequence
  derived and/or modified CDS sequence (opt6) from DENV-1__KX380802__SS-prME
ucgguuacaauguuauuaaugcugcuuccaacagcucucgcuuuucauuugacaacacgcgguggugaaccucacaugaucguaucaaaacaagaaaggggaaaaucucuguuguuuaaaacaucagcugguguuaauauguguacacucauugcuauggauuuaggggaauugugcgaagacacgaugacuuacaaauguccgaggauuacagaagcagaaccggacgacguggacuguugguguaaugcgacggauacguggguaacuuacggcacauguagccaaaccggggaacacagacgcgauaaacguaguguugcauuagcuccucacgugggauuaggauuagaaacccgcacggaaaccuggaugagcagugaaggcgcuuggaggcaaauacaaaaaguggaaacaugggcguuacgccaucccggauucacaguuauagcauuauucuuagcgcaugcaauaggaacaucaauuacccaaaaaggaauuauauucauucuacuuauguuaguaacgccauccauggcaaugcgcuguguaggaauugguaaucgggacuucguugaaggccuuucaggggccacauggguugaugugguauuggaacauggaucaugcguaacaacuauggccaaaaauaaaccaacauuggauaucgaauuauuaaaaacagaaguaaccaacccagcgguuuugagaaaacuaugcaucgaggcuaaaauuuccaauaccacuacagauagucgaugcccaacacaaggugaagcgaccuuaguagaagaacaagaugcuaauuuuguauguaggaggacuuucguagaucggggcuggggaaacggguguggcuuauucgggaaaggaagccugcugacuugugccaaauuuaaaugcgucacaaagcuagagggaaagauaguccaguaugaaaaccucaaguacagcguuaucguaacagugcacacgggugaucaacaucaaguaggaaacgaaacaacagagcaugguacgauagcgaccauuacaccucaggcgccaacgagcgagauccaauugacugauuauggggcauugacgcuugauuguagucccagaacaggacuugacuuuaaugaaaugguauugcuaacaaugaaagaaaaaucuuggcuaguacauaaacaaugguucuuagauuugccucuaccauggacgagcggagccucuacgagucaagaaacauggaacagacaagaucuucuagucaccuucaagacggcgcaugccaagaaacaagaaguuguagugcuagggagucaggagggugcuaugcauaccgcacucacaggagcaaccgaaauacaaacaucugguacuacaacuauauuugcuggccauuuaaagugucgccuuaaaauggggaaauugacgcucaaaggugucucuuaugucauguguacaggcuccuuuaaauuagaaaaagaaguugcugagacgcaacaugggaccguacuuguacaaguuaaauaugaaggcacugacgcgccuuguaaaauaccuauaagcacacaagaugaaaaaggcgucacgcaaaacgggcgucuuauaacagcaaauccuauaguaacagauaaagaaaaaccgguuaacauugaaacagaaccuccauuuggagaaucauacauaguaaucggagcaggcgaaaaagcacuuaaauuaucaugguucaagaaagggaguucuauugguaaaauguucgaggcaacagcaaggggugccagacgcauggcaaucuuaggugauaccgccugggacuuugguaguaucggcggaguguuuacaaguguaggaaaauugguacaccagguuuuuggcacagcauacggaguuuuauuuaguggaguaucauggacuaugaagauaggcaucggaauauugcucacauggcuaggauugaacucacguucuacaagccuaaguaugacuugcauagcaguuggaaugguuacucuuuaucugggugucaugguacaagcggauuccggaugcguaauuaauuggaaaggcagagaacugaaaugugggagugggauauuuguaacuaacgaaguccacaccuggacggaacaguauaaauuucaagccgacagcccaaaaagacucagcgcagcaauaggcaaagcaugggaggagggagugugcggcauuagaucugcaacuagauuagaaaacaucauguggaaacaaauuucuaaugaacuaaaucauauauuacuagaaaaugauaugaaauucacagugguagucggugaugcuaaugguauacuaacccaaggaaagaaaaugauaagaccacagccgauggaacauaaguauaguuggaaauccuggggaaaagcaaaaauaauuggggcagauacucagaauacgacuuucauaauagacggaccagauacgccggaguguccugacgaucaaagagcguggaauauaugggagguggaggauuauggcuucggggucuuuaccacaaauaucuggcucaaauuaagagauucuuauacacaaaugugugaucacagauuaaugucagcggcaauuaaagauagcaaggcaguacaugcagauaugggauauuggauagagagugagaaaaaugagacauggaaauuagcgagagcauccuuuauugaaguuaagacguguauauggccaagaagccacacuuuauggagcaacggggucuuagaaucggaaaugauaauaccaaaaauauacgguggaccaauaagucaacacaauuacagacccggauauuuuacacaaacugcaggaccguggcaucuaggaaaauuagaauuagacuucaaucugugcgaggguacaacaguagucguggacgaacacuguggaaauaggggaccgucauuaagaacgacaacagucaccggaaagauaauucaugaguggugcugucguaguuguacgcugcccccgcugagguucagaggcgaagauggauguugguaugguauggaaauaagacccgugaaggaaaaagaagagaaucuagucaggaguaugguaucagccggcucuggcgaaguagacagcuuuagucucggucuacuauguguaucaauaaugauagaagaggugaugaggagcagauggagucguaagauguuaaugacuggaacccuagcuguguucuuuuuauuaauaaugggacaauuaacuuggaacgaccuaaucagacuguguauaauggucggugccaacguuucagaucgaauggguaugggaacuacauaccuggcauugauggcgacguuuaaaaugagaccaauguuugccgugggcuuacuauucagaagauuaaccucacgggaaguucuacuucucacuauagggcucucguuaguagccucaguugaauugccaaauucacuagaagaauuaggcgauggauuggcgaugggaauuaugaugcuuaaacuacugacugauuuccaaucucaucaauuauggacuaccuuauuaucauugacuuucauaaaaacgacgcuauccuuggauuaugcguggaaaacgauggcgauggucuuaucaauuguuagucuuuuuccuuuaugccuuagcacgaccucccagaaaacaacauggcuuccagucuugcuaggaucuuuuggcugcaaaccacuuacuauguuuuuaaucacagaaaacaaaauauggggcagaaaaucguggccccuaaaugaaggcaucauggcaguagguauugugagcauuuuauuaucuucuuuguuaaagaacgauguaccacuagcaggaccauugauagcuggaggcaugcuuauagcuugcuacguaauaucgggcucaagugcugauuuaagccuagagcgagcagcagaagugucgugggaagaagaggcagaacauaguggcgcuagucacaauaucuuaguugaaguccaagaugauggaacgaugaaaaucaaagacgaagaacgugaugauacccugacuauccuauuaaaagcaacccucuuagcugucucugggguguauccuaugaguauuccugccaccuuguucguuugguacuucuggcagaagaagaaacagcgaucagggguccucugggauacacccucaccuccagagguagaacgggcaguacucgacgacggaauauacagaauauuacagcgcggguuacugggacgaagucaaguggguguaggaguauuccaagaugguguauuccauacuauguggcacgucaccagaggcgcaguuuuaauguaucagggcaaaagacuagaacccucgugggcuucugucaagaaagaucuuauaagcuacggaggugguuggcgauuucagggauccuggaacaccggugaggaaguacaagucauagcaguggaaccagguaaaaauccuaaaaauguccaaaccacuccuggaacuuuuaaaaccccugaaggugaaguaggugccauagcgcuugauuuuaaaccuggcacaucugggaguccaauugugaacagagaagggaaaaucguaggacucuacggaaauggugucguuaccacauccggaaccuaugugagcgccauagcgcaagcaaaggccucacaagaagguccacuaccagagauagaggaugaaguauuuaagaaaagaaacuuaacgauuauggaucuacacccaggaucaggaaagacaagacgauaucuaccugcaauuguucgugaggcuauaaaaaggaagcuaaggacuuuaauucuagcaccuacacgaguaguagcgucugaaauggcagaggcgcuaaaaggaaugccuauucgguaucaaacaacagccguaaagucggaacauacggguaaagagauuguugacuugaugugucacgcaaccuucacuaugaggcuacuguccccaguucguguuccuaauuauaauaugauuauaauggaugaggcgcauuucacugauccggcuaguauagcugcccguggguauaucaguacgcgaguaggcaugggugaagcagccgccauauuuaugaccgcgacaccgccagggagugucgaggcuuucccgcagucuaacgcgguaauacaggaugaggaaagagauauaccugagcguucauggaacucgggguaugauuggauaacagauuucccaggaaaaacgguuugguucgugccauccaucaaaagcggaaaugacaucgcaaacugucuuagaaagaaugguaagagagucauccaacugaguaggaaaaccuucgauacggaauaucaaaagaccaaaaauaaugauugggacuacguaguaacuacugauaucucugagaugggagcaaauuucagagcagauaggguaaucgacccaagacgcugucuaaaacccgucauucugaaagacggaccugagagaguaauuuuagcaggcccaaugccugucacugcagcgagcgcggcacaaaggcgagggagaauugguaggaaccaaaauaaggaaggagaucaauacauuuauaugggacagccauugaauaaugaugaagaccaugcacacuggaccgaagcuaagaugcuauuagauaacauaaacacuccagaaggaauaaucccagcccuuuuugaaccagaacgagagaaaagcgccgccauagacggugaauaucgacuucgcggugaggcgagaaaaacauuuguugagcucaugcgacggggcgaucucccaguguggcuaucguacaagguugccuccgaagguuuucaauacucugaucgacguuggugcuucgauggagaacguaauaaucaaguauuagaagaaaacauggauguagaaauauggacaaaggagggcgagaggaagaaacuccgaccaagaugguuagaugcacgaacauauucagauccgcuugcuuuaagagaguucaaagaguuugcugcuggacgacguucuguaucaggagacuuaauuuuagagauuggaaaacuaccucagcacuuaacuuuacgagcacaaaaugcuuuagauaacuuagucaugcuccacaauagugaacagggaggaaaagccuauagacaugcaauggaagaacugccagacacgauagaaacgcugauguuauuagcucuaauugcuguuuuaacggguggcguaacacuuuucuuuuugagugggaaaggucucgguaaaacaucaauaggacuacuaugcguaauggcaucaaguguauuacucuggauggccucuguugaaccucauuggauugcugcauccaucauauuagaguucuuuuuaaugguuuuacuaauaccagaaccggauagacaacguacaccacaagacaaccaauuagcauacguagugauagguuuguuguuuaugauccuaacagucgcagccaaugaaaugggccugcuugagacuacaaagaaagaucuaggcauaggacauguuguugcugaaaaccaucaccaugcaacuauguuggauauugaucuacacccggcgagugcauggacacuuuaugcagucgccacaaccauaauuacuccuaugaugagacauacaauugagaacacuaccgcaaauauuagcuugaccgcaauugcuaaccaagcagcaaucuuaaugggauuagauaagggauggccaauuucaaagauggauaucggaguacccuuguuagcacuaggcugcuauagccaagucaacccauuaacacuaacugcagcuguauuaauguuaguagcccauuaugcaaucauaggccccggacuacaggcaaaagcaaccagagaagcucagaaaagaacagcagcggguauaaugaaaaauccuaccguugacggaauaguagcaauagacuuagaucccguuguuuaugacgcaaaauuugaaaagcaauuaggacaaauuauguuauuaauuuuauguacaagucaaauuuuacuaaugcguacaacuugggcacucugugagucaauuacauuagccacugggccauugaccacguugugggaaggcagcccaggaaaauucuggaacacuacaaucgccgucagcauggccaacauauucagaggaagcuauuuggcaggcgcuggauuagcauucucuuugaugaaaaguuuaggcggagggaggcgagggacaggagcgcagggagagacacucggugaaaaauggaagcgccaacuaaaucagcucucuaaaagcgaguucaauacauacaaaagaucaggcauaauggaaguagauagaucagaagccaaggaaggacuaaagagaggagaaacgacaaagcacgcaguuagccgagguacggcuaaacuucgcugguucguagagcgaaaucuuguaaaaccagaggggaaaguaauugacuugggauguggacgcggaggcuggaguuauuauugcgccggacuuaaaaaggucacugagguuaaggguuauacaaaagggggaccgggacacgaggaaccaauaccuauggcuacguacggauggaacauaguuaaacuucauucagguagagaugucuuuuucacgccgcccgaaaagugugacaccuuauugugugacauuggagagucaucaccgaacccuacaauagaagaagggagaacacuaagagucuugaagaugguagaaccaugguuacgaggcaaccaauucuguauaaagauacugaaucccuacaugccaagcgucguagaaacacuggaacaaaugcaaagaaaacauggcggaauguuaguuagaaacccucugagcagaaauaguacgcacgagauguauuggguuucaugugguacaggaaauaucguuucagcuguuaauaugacgagccgaauguuauuaaaucguuuuacuauggcacacaggaaaccgaccuacgaaagggacguggaccuaggggcaggaaccaggcacgucgcuguugaaccggagauagcaaaccucgacaucauagggcaaagaaucgagaauauuaaaaacgaacauaaaaguacauggcacuacgaugaggauaacccauauaaaaccugggcuuaccauggaucauaugaaguaaaacccagcgggucagcuucuagcaugguuaacgguguaguacgauuguuaacgaagccuugggauguuauucccauggugacccaaauagcaaugacggacacaacgccauuuggacaacagcgaguuuucaaagaaaaagucgauaccagaacaccaagaccaaaacgagguacagcccagauaauggagguaacagcaaaauggcuguggggguuccuauccaggaauaagaaaccgcguauauguacaagagaagaguucacuagaaaagugcguuccaacgcugcuauuggagcuguauuuguggaugagaaucaguggaacucagcaaaggaagccguagaggaugaacgauuuugggauuuaguccauagagaacgugaauuacauaaacaagguaaaugcgccacuugcgucuacaacaugaugggcaaacgugagaagaaacuuggagaauuuggcaaagcaaaagguagccgggcaauaugguauauguggcuuggagcuagauucuuagaauuugaagcauuaggauucaugaaugaagaccauugguucucgagagaaaacucauuaucagguguugaaggagaaggguuacauaaguuaggauauauauuacgcgauauuucaaaaauaccaggagguaacauguacgcagaugauacugccgguugggacacucgaauuacggaagacgaccuacaaaaugaagcuaaaauuacugacauuauggaaccagaacaugcgcugcuagcuaccagcauauucaagcuaacauaccaaaauaagguuguuagagugcaaagacccgcaaaaucggguacaguaauggauguaauaagucgcagagaucaacgaggcucuggacaaguaggaacguacggccugaauacuuucacgaauauggaaguacaguuaauaagacagauggaaucagagggaauauuuucacccucugaacuggaaaauaguaaucucgcagaaagaguucuagacuggcucgaaaaacauggaguugaacgccuaaaacgaauggccauuucuggugacgauuguguaguaaaaccgaccgaugaucguuuugccacagcacuaacagcgcugaaugauaugggcaaaguuagaaaagauauuccacagugggaaccaaguaagggauggaaugauuggcaacaaguaccuuucugcagccaucauuuucaucagcuaaucaugaaagauggcagagaaauuguuguaccgugucgcaaucaagaugaauuaguaggccgagcucguguuucacagggggcgggauggagcuugcgggaaacagccugucucgggaaauccuaugcgcagauguggcaacuuauguacuuucacagacgggaucuucgauuagccgcuaacgcgaucuguagugccguuccaguaaauuggguaccaacaucgagaacaacguggucgauccaugcacaucaccaauggaugacuacggaagauauguuaagcguuuggaaucgaguuuggauugaagaaaaccccuggauggaagacaaaacgcauguuuccaguugggaagaugucccuuaucuagggaaaagagaagaucagugguguggguccuugaucgguuuaacugcaagagcuacuugggcaacaaauauacaaguugcaauaaaucaaguaaggaggcugaucggaaaugaaaauuaccuagacuacaugacaucaaugaaaagauuuaagaacgaaagcgauccugaaggggcauuaugguag

SEQ ID NO: 21123 - RNA, 9879 nt, Artificial Sequence
  derived and/or modified CDS sequence (opt6) from DENV-1__KX380797__SS-prME
ucagugacuguuuuacuaaugcuguugcccacugcuuuggcauuccaucuaaccacucgagggggagaaccgcauaugauaguaucgaaacaagaaaggggcaaaagucuuuuauucaaaacaucuacuggagugaauauguguacacuaauagcaauggaucucggcgaauuaugugaagacacgaugacauauaaaugcccccgaauuacagaaacggaaccggacgaugucgauuguuggugcaaugcuacugaaacuuggguaacguauggaacaugcagucaaacaggagaacaucgcagagauaaacgaaguguagcguuggcgccucauguaggacuuggacuagagacaaggacagagacauggaugucuucugaaggugcauggaggcaaauccaaaaaguagaaaccugggcauugaggcauccaggguucaccguuauagcacuauuccuugcucacgcaaucgguacuucaauaacacaaaaaggcaucauuuucauauuacuuaugcuuguaacacccucuauggcaaugcguugcguuggcaucggcaacagagacuuuguagagggauugucaggugcuacauggguugacguuguacucgaacaugguaguuguguaaccaccauggcgaaagacaaaccuacacuagauaucgaacuacuaaaaacggaaguuacuaacccagcaguccuaagaaaacuauguaucgaagcuaaaaucucaaauacaacaacagauucuagaugccccacccaaggagaagcuacucuagucgaagaacaagauacaaacuucgugugcagacggacgcuuguagauagagguugggggaacggguguggguuauuuggaaaagggucccuaauaacgugugcaaaauuuaaaugugucaccaaacuugaagggaaaaucgugcaauaugaaaauuuaaaauauucaguaauaguaacuguucacaccggagaucaacaucaaguuggaaaugaaacaacagaacauggaaccacagcgacuauuaccccacaagcuccaacaagcgaaauucaauuaacggacuauggcgcguuaacuuuagauugcucuccgagaacaggucucgauuucaaugagaugguguugcuaacaaugaaagaaaaauccugguugguacacaaacagugguuccuugauuugccacuuccauggacgucuggagcuaguacaagucaagaaacguggaaccgucaagacuugcuuguaacuuuuaaaacagcacacgcuaaaaagcaagagguaguuguacuaggaucucaagaaggagcuaugcauacugcuuugacgggagcgacugagauacaaacguccggcacgacgacuauauucgcaggucaucuaaaaugcaggcuaaagauggauaaacuaacgcuuaaaggagucuccuauguaaugugcacagggucguucaaacucgaaaaagagguagcugaaacucaacacgggacagucuuaguucaaguaaaauaugaaggcacagaugcacccuguaaaauacccuucaccagccaagacgaaaaaggagucacacaaaauggccgacucauaacagcuaacccgauuguaacggacaaagagaagcccguaaacauagaagcagaaccacccuucggagagucuuauuuaguaguaggcgccggagaaaaagcacuuaaacuguccugguucaagaaagggaguaguauaggaaaaauguuugaagcgacagcaagaggugcacgaagaauggcaauauugggagauacugcaugggauuuugguagcauugguggaguguuuacaucuguagggaaacuuauucaccaaauuuucggaaccgcauacggaguacuuuucuccggagucagcuggaccaugaaaauaggcauugguauauuacucacaugguugggacuaaauaguagaucgacauccuugaguaugacuuguaucgcgguggggaugguaacccuauaccugggaguaaugguccaagcggacucugguuguguaaucaacuggaaaggaagagaguuaaagugcggaucggguauuuucguaacaaaugaaguacauacauggacagagcaauacaaguuucaggccgacaguccuaagagacucucugcugcaaucgggaaggcaugggaagaagggguaugcgggauaagaucagcgacaagguuggaaaauauuauguggaaacaaauuaguaaugagcuuaaucauauacuguuagaaaaugauaugaaauucaccgucgugguuggggacgugaaugggaucuuagcgcaagggaaaaagaugauacgcccacaaccuauggaacauaaauauaguuggaagucaugggguaaagcaaaaguaauuggugcagauguacaaaauucaacauuuauaauugacggacccaacacaccugaauguccagaugaucaacgagcauggaacauaugggaaguugaagacuacgguuucggaauuuuuacaacaaauauaugguuaaaacucagagauagcuauacacaagugugcgaucacagacuuaugagcgcagcaaucaaagacucuaaggcaguacaugccgacaugggauauuggauagagucagaaaagaacgaaacauggaaacuuacccgagccagcuuuauagaagucaaaacaugcguauggccaaaaucucacacauuauggucgaaugggguauuagaaucggagaugauaauacccaaaauuuacgggggcccuauaucgcaacacaauuaucguccuggauauuuuacccaaacagcagguccauggcacuuaggaaaacuugaacuugauuuuggucucugugagggaacuacaguaguaguggacgagcauugcgggaaucgggguccgagccugcgaacuacaaccgucacaggcaaaauaauucaugagugguguugucgaucuugcacuuuaccaccgcuacgguucaaaggagaagacgguuguugguauggaauggaaauccguccaguaaaagaaaaagaggagaaccuaguaaagaguaugguaucugcgggaaguggagagguggacaguuuuucacuugguuuacuuuguauaucuauuaugaucgaagaaguaaugagaaguagguggucuagaaaaauguuaaugaccggcaccuuagcaguuuuccuacuauuaauuaugggucaacuaacauggaaugaucuaauacguuugugcaucauggucggggccaaugcaucggauaaaauggggauggguacaacauaccuagcacucauggccaccuuccgaaugagaccaauguuugcugucggauuacuauucagaagauugacuucacgagaaguacuauuacguaguguugguuugucgcuuguagcuagcgucgagcuuccaaacuccuuggaagaguugggagauggacuugcuaugggaauaaugauguuaaaauugcuaacagauuuccagucacaccaguuaugggcagcuuuacucucccuuacuuuugucaaaaccacauucucauuacauuaugccuggaaaacgauggcaaugauauuaucaauaguuucauuauuuccccucuguuuauccacuacgagucaaaagacaacauggcucccaguacuucuaggaucguuaggauguaaaccgcugacgauguuucuaauuacagaaaacaagauuugggguagaaaaaguuggccccuuaaugaggguaucauggccguuggcauagugucgauacuacuauccagccucuuaaagaaugacgucccacuugcugggccguuaauugcaggagggauguuaauugcaugcuauguaauuucagggucaagugcagaucucagcuuagaaaaagcggcagaaguaucaugggaagaggaggcugagcauagcggugccucacauaauauucuuguggaaguucaggacgacggaaccaugaagauuaaagaugaagaacgcgaugauacccuuacgauuuuacuaaaagcaacuuuacuggcaauuaguggagucuaccccaugaguauccccgcuacucuuuuuguaugguauuuuuggcagaagaagaaacaaagaucagggguucuaugggauacaccuagucccccugaagucgagcgggcaguacuagaugacgggauauacagaauauugcaaagaggauugcuugguaaaagccaaguagguguuggugucuuucaagaggguguauuucacacuauguggcaugugacgcggggugcgguucugauguaucaagguaaacgauuggaacccucaugggcaagcguuaagaaagaucuaauaucuuauggaggaggauggcguuuucaaggaucguggaauacaggggaggagguacaagugauagcgguagagcccgguaaaaacccaaagaauguacagacugcaccagguaccuucaaaacaccagagggagaagucggggcaauagcguuagauuuuaaaccaggaacaucaggaagcccgauuguaaauagagaaggaaaaauagucgguuuauauggaaauggagugguaacuacaagcgguacauauguaucagcaauagcacaagccaaagcaucccaagaaggcccauuaccagaaauagaagacgagguauuucgcaagagaaauuugacaauaauggacuugcauccuggcagcggaaaaacaagaagauaccuaccagcgaucguccgugaagcaaucaagagaaaauuacggacgcuaguauuagcgcccacuagaguaguggcauccgaaauggcugaggcacuuaaaggaaugccaauuagguaccaaacuaccgcuguaaaaagcgagcauaccggaaaagaaaucgucgacuuaaugugucacgccacuuuuacaaugagauuauuaaguccagucagaguaccuaauuauaacaugauaauaauggacgaagcacacuuuacagauccugcuucaauugcagcgcgaggguacaucucuacaagaguaggaaugggagaggcagcugccauauuuaugaccgccacuccuccaggcucgauggaagcauucccucaaucuaaugcagcuauacaagaugaagaaagagauauaccagagcgcucuuggaacucgggauacgauuggaucacugauuucccgggcaaaacuguaugguucguaccaucaauaaagucaggcaacgauaucgcuaauugccuuaggaaaaauggaaaacgaguugugcaguuaucucgaaagacauuugacacugaauaucagaaaacuaaaaacaaugauugggauuacgugguaacaacagacauaucggaaaugggcgcaaacuucagagcugaccguguuauagacccuagaagguguuuaaaaccuguuauucucaaagacggcccugaacgugucauccuagcgggaccaaugccugucaccguagccagcgcggcucaaagacggggacguauugguagaaaucaaaacaaagaaggagaccaguauauuuacaugggacaaccacuaaauaacgaugaagaucacgcacacuggacggaagcaaaaaugcucuuagacaacaucaauacaccggaagggauaauaccagcauuauucgagcccgaacgcgaaaaaucagcagcaauagacggugaauaccgccuacggggugaagcacgaaaaacguucguagaauugaugagaagaggagacuuaccuguauggcuaucuuacaagguagcauccgaggguuuccaauauagugacaggagaugguguuuugauggagaaaggaauaaccaaguucuagaagaaaacauggacguugaaaucuggacaaaagagggugagaggaagaaauuacguccucgauggcucgaugcacguaccuauagugacccauuggcgcugagagaauuuaaagaauuugcagcuggaagacggucagugagcggugaucuaauucuagaaauagggaaacuuccccagcaucuaacccaaagggcccaaaacgcacuggauaaucuggugaugcuacauaauucugaacagggugguaaagcguauagacaugcaauggaagaauuaccugacacgauagagacccucaugcuacuugcgcuaauugcuguacuuacaggcggcgucacguuauucuuucugaguggaaggggccucggaaagacaaguauaggucucuuguguguaauggcuucgucagcguugcuauggauggcaaguguagaaccgcacuggaucgcggcaucgauuauacuagaguucuucuugaugguccuauuaauaccugaaccagaucgucaacggacgccacaagacaaccagcuugcauacguaguaauaggucuacuguuuaugauauugaccguagccgcaaacgaaaugggacuacuugaaacgaccaagaaagacuuagguaucggacauguggcggcugagagucaccaccaugcagcaaugcuagaugucgaucugcacccagcaucagcauggacccuauaugcaguagcuaccacgauaauaacaccuaugaugaggcauacaauagaaaauacuacugcaaacaucagcuuaaccgcaauugcuaaucaagcagcgauacuaauggguuuggauaaaggcuggccaauaagcaaaauggauauaggcgugccgcuauuagcucugggauguuauagucaaguuaauccuuuaacuuuaaccgccgcuguauuaaugcuagucgcacacuaugcaauaauagguccggguuuacaggccaaagcuacacgagaagcucagaaaagaacugcagcaggaauuaugaagaauccuacaguagacggaaucguagcuauagaucuagauccagucguauaugaugcaaaauuugaaaaacaacuaggacaaauaaugcuuuugauauuauguacaagccaaauauuauuaaugcguacaacgugggcuuugugugaauccauaacuuuagccacgggaccuuuaacaacuuuaugggaggguucaccagguaaauucuggaauacuacaauagcaguuucaauggcuaacauauuuagagguaguuaucuagccggugcuggguuagcuuuuucguuaaugaagucccucggaggugggcgucgaggaacaggugcacaaggagagacucucggagagaaauggaaacgccaacuaaaucaauuaacaaaaagugaauuuaauacauauaaacggucagggauaaucgaaguugacaggagugaagcgaaggaagguuuaaaaagaggagaaacgacuaaacaugcaguuagucgagggaccgcaaaacuuagaugguucgucgagcguaacuuagugaagccagaagguaaggucaucgaccuuggaugcggaagaggaggguggucauacuauugcgccggacuaaagaaaguuacagaaguaaaaggauacacuaaagguggcccggggcaugaagaaccaauuccuauggcuaccuacggauggaauuuggucaaacuuuauaguggcaaagacguauucuuuacaccuccugaaaaaugcgauacguuacuaugugauauaggcgaaaguagcccaaauccaacaaucgaggagggaagaacguuaagaguacuaaaaaugguagaacccuggcuucgugggaaccaauuuuguauuaagguacuuaacccauauaugccgucggugguugaaacucucgagcaaaugcaaagaaaacacgguggcaugcuagugagaaauccucucucuagaaacucaacacacgagauguacuggguaaguuguggcacuggaaacauagugagcgcgguuaauaugacaaguagaaugcugcuuaacagauuuaccauggcucaccguaaaccuacuuaugaaagagauguugaucuuggcgcaggaacccgucauguggcaguugaaccagaaguugcgaacuuagauaucauaggucagcgaauugaaaacaucaagaacgaacacaaaucuacauggcauuaugaugaagauaaucccuauaaaacuugggccuaucauggaucuuaugaagucaaaccuucagguuccgcgucgaguaugguuaauggagucguaagauuauuaacaaaaccuugggauguuauaccgaugguuacacaaauagccaugacagauacgacaccguuugggcaacaaagaguauuuaaagaaaaaguugauacucgcaccccaaaggcaaaacgcggcacagcccagauaauggaaguaacugcacgcugguuauggggauucuugagucgcaauaagaaaccacggaucuguacuagggaagaauuuacacgaaaaguacgaucuaacgcagccauuggggcgguguucgucgaugaaaaucaauggaacucagccaaagaggccgucgaagaugaacgauuuugggacuuagugcaucgggaacgagaacuucacaaacaagguaagugugcaacguguguauauaacaugauggguaaaagggaaaagaaacuaggugaguucgggaaagcaaaaggaucgagggcgauaugguauauguggcuuggagcucgcuuucuggaguuugaagcauugggguuuaugaacgaggaucacugguucucacgagaaaauucauugagugggguugaaggugaaggucuucacaagcugggguacauuuuacgugacaucucgaagaucccgggagguaauauguacgcagacgacacagcaggaugggauacccguauaacagaagacgacuuacagaacgaagcuaaaauaacagacauaauggagccugaacaugcuuugcuagcaacuagcauauucaagcuaacuuaccagaacaaaguaguccggguacaacggccagccaaaaacggcacuguuauggauguuauaucccgucgggaccaaagaggaagcggacaaguagggaccuacggacuuaauacguuuacaaacauggaggcacaauuaauuaggcaaauggaaagugaaggcaucuuucuaccaagugaauuagagacuccaaauuuggcagagagaguacucgauugguuagaaaaauauggcaucgagagauuaaaaagaauggcuaucaguggcgaugauugcgucgucaaaccaguggaugaccgauuugcaacagcccuuacagcccugaaugacaugggaaaaguaagaaaggacauaccacaaugggaaccuagcaagggcuggaacgauuggcaacaagucccauuuugcucccaucacuuucaccaacucauuaugaaagacggacgagagaucguagugccuugcagaaaucaagacgagcuaguaggucgugcgaggguaagucagggcgcgggauggucacucagagagacggcaugucugggaaaaucauacgcccagauguggcagcuaauguauuuucaucgacgugaucuucgacucgcggcaaacgccauaugcucggcaguacccguagacuggguaccuacuucacgcacuacauggaguauucacgcucaccaccaauggaugacuacugaagacaugcuuucgguauggaaucgaguauggauagaagaaaauccauggauggaagauaaaacgcaugucucaaguugggaagaugugccguaucucgguaaacgugaggaccaauggugugggucauuaauaggcuuaacggcaagggcaacuugggcuaccaauauucagguagcaauuaaccaaguucgucgcuuaauagguaaugaaaacuaccuggauuacaugacaucaaugaaacguuucaaaaacgaaucagauccagaaggggcauuaugguaa

SEQ ID NO: 21124 - RNA, 9879 nt, Artificial Sequence
  derived and/or modified CDS sequence (opt6) from DENV-1__KX380805__SS-prME
agcguuacuauguuacuaauguuauugcccacugcucuugcguuucaucucacaacacgggguggggaaccgcauaugauuguaucaaaacaagaacguggaaaaaguuuauuguuuaaaaccucugcgggcguuaacauguguacccucauagcuauggaucuaggagaacuaugugaagauaccaugacauauaaauguccccgaauaacugaggcagaaccagaugacguagauuguuggugcaaugcuacggauacuuggguaacuuacggaacaugcucacaaacuggugaacaccgacgagauaaacgaucaguagcucuagcgccacauguaggguuaggauuagagacaaggacugagacuuggauguccucggaaggagcauggaggcaaauacaaaaaguggaaacaugggcacuucggcacccaggcuuuacagucauagcuuuguuuuuagcacaugcgauagggacuucaauuacgcaaaaagguauaauuuuuauacugcuaaugcuugucacgccaaguauggcaaugaggugcguagguauagguaaccgagauuuugucgaaggacugagcggagcaacauggguagaugugguuuuagaacauggaagcugugugacuacaauggccaaaaauaaaccaacauuggacauugaauuacuaaaaacagaaguaacuaacccagccguauuacggaaauugugcauagaagcaaaaauuaguaauaccacgacugacucacgguguccaacucaaggagaggcaacuuuaguagaagaacaagaugccaauuuugugugucgacgcacguuuguugaucgaggcugggguaaugggugcgggcuauuugggaaagggucucuuuugacaugugcaaaauucaaauguguaacuaaacuugaaggaaaaauaguccaauaugaaaaccuaaaauauucggugauuguaacugugcauacuggagaccaacaucaaguuggcaaugaaaccacugaacaugguaccaucgcaaccauaacuccgcaggcaccuacgucggaaauacaacuaacagauuacggugcacuuacccuggauugcagucccagaacuggacuagauuuuaacgaaauggucuugcuuacuaugaaagagaaaagcugguuaguucauaaacaaugguuuuuagaccuuccacuaccuuggacaagcggagcuaguacaucacaggagacuuggaauagacaagaucucuuaguaacauucaaaaccgcacaugcuaagaaacaagaggucguaguuuuagguucacaagaaggugccaugcauacggcacuaacaggugcaacagaaauccagacuucagguacgacuaccaucuucgcgggucacuuaaaaugccgauugaaaauggauaaacuuacguuaaaagguguaagcuacguuaugugcaccggguccuucaaauuagaaaaagagguugcagaaacucaacaugguaccguucuaguacaaguaaaauaugaaggaacugaugcuccguguaaaauucccauuucaacucaagacgaaaaaggaguaacucaaaacggcagauuaauaacugcaaauccaauagugacggauaaagaaaaaccuguuaauauagaaacagaaccaccguucggcgaaucauauauagucauuggagcuggagaaaaagcacuaaaacugucuugguucaagaaaggcuccuccauagggaaaauguucgaagcaacagcacgcggagccagaagaauggcaauccuaggugauaccgcuugggauuuuggaaguauaggcggaguguuuacgucaguuggaaaguuaguacaucaaguauuuggaaccgcauacggcguuuuauuuucuggagugagcuggacaaugaagauagguaucgggaucuuauuaacauggcuaggacuuaauucucgaucaaccucguuaagcaugacauguaucgcuguaggcauggucacacuauacuuaggaguaaugguacaagcagauucagggugcgucauuaauuggaaagggcgugaguuaaaaugcggaucagguauuuucguuacuaaugaaguacauacguggacagaacaauauaaauuccaggcggacucuccaaaacggcuauccgcagcaauaggcaaggcuugggaggaagggguauguggaauacgaagcgcuacccgacuagagaacauuauguggaagcagaucagcaaugaauugaaccacauacuauuggagaaugauaugaaauuuacagucguuguaggcgaugcaaauggaauacuuacacaaggcaagaaaaugaucagaccacagcccauggagcacaaauacucuuggaagaguuggggaaaagcgaagauaauuggagcagacacccaaaacacuacauuuauaauugacggaccugauaccccggaaugcccggaugaucagcgugcuuggaauauaugggagguugaagacuacggguucggaguauucaccaccaauauuuggcuuaagcuccgagacucauauacacaaaugugugaccauaggcuaaugagugcggcgauaaaggacuccaaagcuguacaugccgauauggguuacuggauugaaagcgagaaaaaugaaacguggaaguuagcucgagcaaguuucaucgaagucaaaaccuguauuuggccaaggucacacacucuuuggucaaauggaguuuuggaaagugaaaugaucauaccaaaaaucuacggugggccgauuagccaacauaauuauagaccaggauauuuuacacagacugccggaccauggcaccuaggaaagcuagaauuagacuuuaaucuaugcgaagguacaacuguuguggucgaugagcacuguggaaaccgaggaccuagucucaggaccacuacuguuaccggaaaaauaauccaugagugguguugccgaagcuguacauugccacccuuaagauuccgcggugaagacggauguugguaugggauggaaaucagaccaguaaaagaaaaggaggaaaauuuaguacgaaguauggucucugccgggucgggcgagguggauucuuuuagucugggccuacuaagugucuccauuaugauugaagaagucaugcguucgagauggucaaggaaaaugcuuaugacugggacauuagcuguauucuuuuuacuaaucaugggacaauugacauggaaugaccuaauacgacuguguauaaugguaggugccaacguuagugaccggaugggcauggguacaaccuaccuugcauuaauggcuaccuuuaagaugcgaccuauguuugcgguaggauuauuguuucggagacugacaucgcgugaaguauugcuauuaacuauaggauugucacucgucgcguccguagaacuaccuaauucccuugaggaacuaggagacggacuugcaaugggaauaaugaugcuuaaacuucuaaccgacuuucaaucgcaucaauuauggacgacccuauugucauugaccuucauaaaaacuacacuaucccuagacuaugcauggaagaccauggcgauggugcuaucaauagucucccuauuuccacucugucuaucaacuacgagucaaaagacaaccuggcugccaguucuuuuagguagcuuuggauguaaaccucuaacaauguuccuuaucacggaaaauaaaauaugggguagaaaaaguuggccacuaaacgaaggcaucauggcuguaggaauagugaguauacuuuugaguucacugcugaaaaaugauguaccacuagcagggccacuaauagcaggcggaaugcugaucgccugcuauguuauaagugggucaagcgcggacuuauccuuagaacgggcugcggaagugagcugggaagaagaagcugaacacaguggggcaucacauaauauccuaguagagguccaggaugacgguacgaugaaaauaaaagacgaggagagagacgacacucucacaauacuacuaaaagcaacuuuacuggccgucuccggugucuacccgaugaguauaccagccacacuuuucgucugguauuucuggcagaagaagaaacaacggucgggaguuuuaugggacacgccaaguccuccggaaguugaaagggcgguuuuagaugaugggauauaucgaauuuuacaacgugguuuacuaggacgaagccaggugggcguaggaguauuccaagacggggucuuccauacaauguggcaugugacacgaggagcgguauugauguaucaaggaaaacgacuugagccaucaugggcaagcgucaagaaagaucuuauuucauacgggggagguuggcgcuuucaaggaagcuggaauaccggagaagaagugcaaguaauagcaguggagcccgguaagaaccccaaaaacguucagacaacucccgguacauuuaaaacaccggaaggcgaaguaggagcgauugcacucgacuuuaaaccggggacuucaggcucgcccauuguuaacagagaggggaaaauagucggguuguacggaaauggaguagugacuacaucagguacguauguaucagccaucgcacaggcuaaggcgucgcaagagggaccuuuaccagagauagaagaugagguauuuaagaagagaaacuuaacaaucauggauuugcauccaggaagcggaaaaacuagaagauaucuaccggcuauagucagagaagcuauuaagaggaaauuacgcacccucauauuagcaccaacaagaguaguagcgagcgaaauggcggaagcucuuaaggguaugccaauaagauaccagacuaccgccguaaaaucagaacauaccgguaaggaaauuguggacuuaaugugucacgcgaccuucacgaugaggcuauuaucaccuguaagagucccuaauuauaacaugauuauaauggacgaggcacauuucacagauccagcuucaauagcagcucguggauauauaagcacgagagugggaaugggagaagcugcagccauauucaugacagcaacacccccuggcagcgucgaggcuuuuccgcagucaaaugcaguaauacaagaugaagaaagggacauaccagaaagaaguuggaacaguggauaugauuggauuaccgacuuuccaggcaagacuguuugguucguuccuucuauuaaaagcgguaaugauauugccaacuguuuaaggaaaaacggaaagaggguaauacagcucucaagaaagacuuuugacacagaauaucagaaaacuaagaacaaugauugggauuacguaguaacaacugauaucagcgagaugggggcuaauuuuagagccgacagaguuauugauccaagacggugcuuaaaacccguaauauuaaaagauggacccgagagaguaauccuagcuggcccuaugccaguaacagccgcuucagcggcgcaacguaggggaagaauuggaaggaaccaaaacaaagaaggagaccaauauauuuacaugggucaaccauuaaacaaugacgaagaucaugcgcauuggacugaggcaaaaaugcuguuagacaauaucaacacaccagaaggaaucauaccagccuuauuugaacccgaacgagagaaauccgccgcaauagauggggaauacagacuuaggggagaagcgcgaaagaccuucgucgaauuaaugagacguggagacuuaccuguauggcuuucauacaagguggcaagcgaaggguuccaauacagcgaccgaagauggugcuuugacggugaaagaaauaaccaagugcuagaggagaacauggauguggaaauauggaccaaagaaggagaaagaaagaaacuccgaccaaggugguuagaugcuagaacauacagugauccacuagcgcugagagaauuuaaagaauuugcagccgggagacguaguguaagcggagaucuuauccuagaaauagguaaauugccacagcaucuaaccuuaagagcacaaaaugcauuagacaaucucguuauguuacacaacucagaacaaggugguaaagcauaucgucacgcuauggaggaacugcccgauacaaucgagaccuuaaugcuguuagcacuaauagcaguauuaacaggagggguuacuuuguucuuucuaucagguaagggguuggggaaaacgaguaucggguuauugugcgucauggccucuucuguauuacuuuggauggccucaguagaaccccacuggauugcagcaagcaucauauuggaguucuuuuugaugguuuuauuaauuccugagccugacaggcaaagaacaccacaagauaaucaacucgcguaugucguuaucgguuuacuauucaugauccuaacagucgcagcuaacgagaugggguuacuagagacuaccaagaaagaucuagggauaggacauguuguugcugagaaucaccaccaugcaacaauguuggacauugaucuucauccugcaucagcuuggacauuauaugcuguagcuaccacaauaauuacccccaugaugagacauaccauagaaaauaccacggcgaauaucucgcucacagcuauugcaaaccaagcagcuauacucauggggcuagauaaagguuggccuaucucgaaaauggacauuggcguaccgcuauuagcauuaggaugcuauagccaaguuaauccacuaacacuaacugcugccguauuaaugcuuguugcgcauuaugcaaucaucgguccuggauugcaagcaaaagccacgagagaagcucaaaagagaaccgccgcggggauuaugaaaaaucccaccguagacggaauaguagcuauagacuuggauccaguaguuuaugaugcaaaguucgaaaaacaauuaggacaaaucaugcuuuugauacugugcacaagucaaaucuuacugaugaggacaaccugggcgcugugugagucaauaacuuuagccacaggaccacuaacuacauugugggaagguuccccagguaaauuuuggaauacaacaauagccgucucaauggcuaauaucuuucgagggagcuaucucgccggugcuggacuggcuuuuucucuuaugaaaucauuagggggaggaagaagaggaacaggggcucaaggcgaaacauuaggugaaaaauggaaaagacaacuaaaucaacucucaaagucugaguucaauacguauaaacgauccgggauaauggaaguugacagaagugaagcuaaggaagguuuaaaaagaggggaaacuaccaagcaugccguaagccgcggcacggccaaguuaagaugguuugucgaacgaaauuuagucaagccggaagguaaaguaauugaccuagggugcggaagagggggauggaguuacuauugugcgggucuuaagaaaguuacagagguuaaaggauauacaaaaggaggaccaggccacgaagaacccauaccaauggccacuuacgguuggaacauagucaaacuucauucgggaagagauguuuucuuuaccccgccagagaaaugcgauacacucuuaugugauauuggagagucuaguccuaaccccacuauugaagaggguagaacauuacgcguacugaaaauggucgagccuuggcucagaggcaaucaauucuguauaaaaauacugaauccauacaugccaucaguaguagaaacuuuagaacaaaugcaaaggaaacauggaggaauguuaguuagaaacccucucagccguaacucaacucaugagauguauuggguuucuugugguacagguaacaucguuucagcaguaaauaugacuagccgaaugcuauuaaaucgcuucaccauggcucauagaaaaccaacguaugagcgcgacguggaccuaggagcagguacaagacaugucgcgguagaaccggagauugcuaacuuagacauaauagggcaaagaauagaaaauauuaaaaaugagcauaaaaguacauggcacuaugacgaagauaacccguauaaaacgugggcguaucauggaucauaugaagugaaaccaucgggguccgcgucuaguaugguuaacggcguagugcgacuacuaacaaaaccuugggauguuauaccgauggugacacaaaucgcaaugacugauacgacaccuuucggccaacagagaguuuuuaaagaaaagguagauaccagaacaccccgaccaaaaagaggcacggcccaaauaauggaaguuacagccaaguggcuauggggauuuuugucacguaauaagaaaccccguaucuguacaagggaagaguuuacgcgcaaaguaagauccaaugccgccauaggagcgguuuuuguagaugaaaaccaguggaacucagcaaaagaagcuguggaagaugaacguuucugggaucugguacauagagaaagagaauuacauaagcaaggaaagugugcaacuugcgucuacaacaugauggggaaacgagagaagaaacuaggagaauuugguaaagcaaaggggucacgagccauaugguacauguggcuaggagcgcgguuuuuagaguuugaggcucuaggcuucaugaacgaagaucauugguuuucuagagaaaacucccuaucuggcguagagggugaaggacuucacaaacucggcuauauucuaagagauaucucaaagaucccggguggcaacauguaugcugacgauaccgcaggcugggacacgagaauaacggaagacgauuugcaaaacgaagccaagaucacagauauaauggagccagaacaugcauuauuggcaacaucgauauuuaaacuuacuuaucaaaacaagguugucagggugcagagaccugcaaaaagcggaaccgugauggaugucauaagucgucgagaucagcgaggaucuggacaggugggcacuuauggccuaaauacauuuacgaauauggaaguacagcuuauaagacagauggagucugaagggauauuuucacccucugaacuagaaaauaguaauuuagccgagcguguauuggauugguuagaaaaacauggaguugaaagguuaaaaagaauggcaauaucaggcgacgauugcgugguuaaaccaaccgacgauagauucgcgaccgcgcuuacggcuuuaaaugacaugggcaaaguacgaaaagacauaccacaaugggagcccaguaaaggcuggaaugauuggcaacaaguaccauuuuguucacaccauuuccaucaacuuauaaugaaagacggacgagaaauagucguaccauguaggaaucaagaugaguuggucgggcgagcacgaguuucacagggagcaggcuggucacuaagggaaacugcaugucuugguaaaucauaugcccaaauguggcaacuuauguauuuccauagacgagaucugagacuugccgcuaacgcuauuugcagugcuguuccggucaauuggguaccaacaaguagaacaacauggucuauucaugcgcaccaucaauggaugacaacagaagauaugcuaucagucuggaaccgggucuggauagaagagaauccauggauggaagacaaaacucaugugucaagcugggaagacguaccuuaucuugggaaaagagaagaccaauggugugguucuuugauaggauuaacugcccgggcuacaugggcaacuaauauacagguagcuauaaaccaaguucgacgcuuaaucgggaaugaaaauuacuuagacuauaugacuucaaugaagagauuuaaaaaugaaagcgauccagaaggagcccucugguaa

SEQ ID NO: 21125 - RNA, 9879 nt, Artificial Sequence
  derived and/or modified CDS sequence (opt6) from DENV-1__KX380798__SS-prME
ucuguaacuauguuacuaauguuaaugccaacggcacuagccuuucauuuaacgacgcguggaggugaaccgcauaugauaguauccaaacaagaacgaggaaaaucccuauuauuuaaaaccagcgcgggaguaaauaugugcacgcuaauugcaauggacuuaggagaacuuugcgaagauacuaugacuuauaaauguccaagaauaacugaagcagaaccugaugaugucgauugcuggugcaacgcuaccgauacgugggucacguaugggacauguucgcaaacaggagaacaucgcagagauaaaagaucggucgcacuggcgccgcauguugguuuagguuuagaaacacggacagaaacuuggaugucuucggaaggagcuuggaaacagauucaaagagucgaaacuugggccuuaagacaucccggauucacuguaauugcacuguuuuuggcacaugcgauugguacuucuauaacucaaaaagggauaauuuuuauucuacuuauguuaguuacaccuaguauggcuaugagaugugugggaaucggaucaagagauuucguugaagguuuaaguggugcuacauggguagacguaguguuagaacacggaaguugcguaaccacaauggcuaaagauaaaccgacuuuagacauagaacuauuaaaaacggaagugacaaacccagcaauauugaggaaauuguguaucgaagcaaaaauaaguaauacaacaacagacagucgcugucccacucaaggugaagcuaccuuaguugaagaacaagaugcaaauuucguguguagaagaacauuugucgacagagguugggguaacgggugcggccuauuugggaaagguucccuaauaacaugcgcaaaauuuaaauguguaacaaaauuggaagguaaaauaguacaauacgaaaaucuaaaauauagugugauagucacugugcacaccggugaccaacaucagguggguaaugaaucaacggagcauggaacaacggcaacuauuacaccacaagcaccaacuacagaaauccaacuaacggauuacggagcccuuacccuugacugcucacccagaacgggccuagacuuuaaugagauggucuugcuaacaaugaaagaaaaaucuugguugguacacaaacaaugguuucuugacuuaccucuaccguggacaucuggugcuucuacuucgcaggaaacauggaaccggcaagacuuauugguuaccuucaaaacagcccaugcuaagaaacaggaagucgucguccuaggaagccaagaaggagcaaugcacacugcucuaacaggcgcgacugaaauccaaacaucaggaacgacuacuauuuuugccggccauuugaaaugcagguuaaaaauggacaaacuuaccuuaaaaggcaugucauauguuaugugcaccggcaguuucaagcucgaaaaggaagucgcugagacccagcacgguacugucuuaguacaaauuaaauacgaaggaacggaugcaccuuguaaaauaccauuuucuacccaggacgaaaaaggugugacgcagaacggucgacuaauaacugcuaacccuauaguuacugacaaagagaaaccagugaauauagaagcugagccuccauucggugaaaguuauauuguuauaggugcaggggaaaaggcuuuaaaauuaaguugguuuaagaaaggauccucuauagggaaaauguuugaagcgacggcgcguggggcacggcggauggcgauacuaggugacacugcaugggauuucggauccauaggaggaguguuuacuucuguuggaaaauuaguucaucaaauauuugggacagcauauggcguacuuuucucuggaguuagcuggacaaugaaaaucggaauagguguacuguugacauggcuaggauuaaacuccaggucaacgucuuuaaguaugacaugcauagccgugggacucguaacacuauacuuaggagugaugguucaagcagacucaggauguguuauuaauuggaaaggacgagaacugaagugcggcucgggaauuuucgucacuaacgaagugcacacauggacugaacaguauaaauuccaggcagauuccccaaagagacuaucugccgccauagguaaagccugggaagaagggguaugcggaauacgcucugcgacgcgccuugagaacauaauguggaaacaaauaucaaaugaacuaaaccacauacugcuagaaaacgauaugaaauucacgguaguugugggugauguugccggaauauuagcacagggcaagaaaaugauucgcccccaaccaauggaauauaaauauagcuggaaauccuggggcaaggcaaaaauaauuggggcugauguccaaaauacaacuuucauaauagacggaccaaacacaccagaauguccagacgaucagagggcguggaauaucugggagguugaagauuauggauuuggcauauuuaccacuaauaucuggcuuaaauuaagagauaguuauacccaagucugugaucaucgucugaugagugcggcaauaaaggacagcaaagcaguucacgcagacaugggguauuggaucgaauccgagaaaaacgaaacuuggaagcuagcacgagccucguuuauagaaguaaaaacgugcauauggccaaaaucccauacucucugguccaacgguguccuagaaagugagaugauaauaccaaaaauuuauggaggaccaauuagucaacacaauuaccgaccgggguauuuuacacaaacugccggcccuuggcauuuggguaagcuagaauuagacuuugauuuaugcgaaggaacaaccgucguaguagaugaacacugugggaaucgagggccuucacuacguacaacaacaguaaccggaaaaauaauccacgaauggugcuguaggagcuguacauuacccccucuaagauuuagaggagaagacgguugcugguauggaauggaaauaaggccggucaaggaaaaagaagaaaaucugguaaaaucaauggucucagcuggaaguggcgaaguagauucauucucucuugguuuacucugcauuaguaucaugauagaagaaguuaugcguucgcguuggagccggaagaugcucaugacaggcacucuugcaguuuuucucuuguugauaaugggccaacuuaccuggaaugauuugauccgacuuuguauuaugguaggggcgaaugcaucagauagaaugggaauggguacuacauaucuagcguugauggcuaccuuuaaaaugcgaccaauguuugccgucggacuacuauuucgucguuuaacuucacgggaaguacuacuguuaacgauaggacuaagucuuguagcauccgucgaauuaccaaacucacuugaagaacugggggacgguuuggcaaugggaauaaugauacuaaagcugcucacggauuuucagagucaucagcucugggcaacauuauuaucacugacauuuaucaaaaccacauuuucucuccacuaugcguggaagacaauggcgauggugcugucuauagugagucuauucccacuuuguuugagcacaaccucacagaaaaccaccuggcugccuguacuacuggguucucuuggguguaagccgcuuacgauguuccuuauagcugaaaauaaaauauggggucgucgcaguuggcccuuaaaugaagggauaauggcaguaggaauagucucuauauuguuguccagccuacuuaaaaacgacgugccacuagcugguccacuuauagcugguggaauguuaauagcuuguuauguuauaucugguaguagcgcggaccugagccuugaaaaagcagcugaaguuagcugggaagaagaggccgagcauaguggugcaucacacaacauuuugguugaaguacaagacgacggaacuaugaagaucaaggacgaagaaagagaugauacacuaacaauuuuguuaaaagcuacgcuucuggcagucagugggguauauccucuaaguauaccagcaacucuauuuguaugguauuucuggcaaaagaagaaacaacguuccggaguucucugggauaccccgagcccacccgaaguugaacgcgcaguuuuagacgauggaauauacagaauuaugcaacgcggauuauuagggagaucucaagucgguguaggagucuuucaagagaacguuuuccauacuauguggcauguaacccgaggagcugucuuaauguaucaaggaaaaagauuagagcccaguugggccagcguuaagaaagacuuaaucaguuaugguggagguuggaggcuacaagggaguuggaacacaggugaagagguucagguaauugcagucgaaccaggcaaaaaccccaaaaauguccaaacugccccaggaacauucaaaacgccugaaggggaaguuggagcaauagcauuggauuuuaaacccggaacaucggggucgccuauuguaaacagagagggaaaaaucgucgggcucuauggcaauggaguggugacaacgucuggaacguacgucagcgcgauagcacaggcaaaggcaucgcaagaaggccccuuaccggagauagaagacgagguuuucaggaaaagaaacuugacuauaauggauuuacaucccggaagugggaagacgagacgauaucugccagcgauagugagggaagcaauaaaaagaaaacugcgaacauugaucuuggcuccgacacguguaguugcaucugaaauggcugaagcacuuaaaggaaugccaauuagguaccagaccacagcaguaaaaagugaacacacuggcaaggaaaucguagauuugaugugccacgcgacuuuuacuaugagacucuuaagccccguaagaguuccaaacuacaacaugauuaucauggaugaagcucauuucacagauccaucuaguauagcagcacgaggauauauaucaacuagaguuggaaugggagaagcagcagcaauauucaugacugcuaccccuccaggguccguugaggcuuuuccacaaucaaaugcaguuauccaagaugaagaacgugauauacccgagagaaguuggaacucgggauaugaguggaucaccgacuuuccagguaaaacuguuugguucgucccaucaauaaaaucugguaaugauauugcaaauugcuuacggaaaaacgguaaaagaguaauucaauugucucggaaaacauuugauaccgaauaccaaaagacgaaaaauaacgauugggauuacguagucaccacugauaucuccgaaaugggggcgaauuuucgagcggaucguguaauagacccccgucgauguuuaaaaccaguaaucuugaaagacggcccagaaaggguaauucuagccgguccgaugcccguaacaguggcaucagcugcccagcgaagagguagaauuggucgaaaucacaacaaagaaggcgaucaauacauauacaugggacagccacuuaauaaugacgaagaucaugcgcauuggacagaagcaaagaugcucuuagauaacauuaauacaccggaaggaaucauuccagcauuauucgaaccugaacgugagaaaagcgcugcgaucgacggagaguaccgauuacgcggagaagccagaaaaaccuuuguagaauugaugagacggggagauuugccuguuuggcuuaguuauaagguagccucagaagguuuucaauauagugaucgaagauggugcuuugauggcgaaagaaauaaccagguuuuagaagagaacauggacguagagauauggacaaaagaaggagaacggaagaagcuacgcccucgauggcucgaugcacggacuuacagugacccacuugcguugcgggaguuuaaagaauuugcugcaggcaggcgaaguguaucaggcgaucugauuuuagagauuggcaaacuuccccaacaucuaacacaacgugcacagaacgcacuagauaaccucguaauguuacauaauagcgagcaaggaggcagggcguaucgacacgcgauggaagaauuaccugauacaauagagacccuaaugcuccuggcucucauagccguauugacugggggcguaacauuauucuuuuuaaguggacggggauuaggaaaaacgucaauaggacuacuaugcgucauggcauccagcguacuuuuauggauggccaguguugagccgcauuggauugcugcuaguauaauucuugaguucuuuuuaaugguauuauuaauacccgaaccggacaggcaacguacgccucaagauaaucaacuggcuuauguuguaaucggguuacuauuuaugauacuuaccgucgcugccaaugaaaugggacuucucgaaacaacuaaaaaggaucugggcauuggccacguggccgucggcaaccaucaccacgcagccauguuagauguagaucuccacccugcaagcgcauggacacuauaugccguugcgacaacaaucauaacacccaugaugagacauacuauugaaaauacaacagcaaacaucucuuuaacagcaauugcaaaucaagccgcaauccuaaugggcuuagacaaaggauggcccauaucaaagauggauauaggcguacccuugcuugcucuagguuguuauagccaaguuaauccacuaacucuaaccgcugcagucuuaauguugguagcucacuaugcuauaauaggacccggauugcaagccaaagccacaagagaagcacagaaaagaacagcggcaggaauaaugaagaacccaacagucgacgggauaguagcaaucgacuuagacccgguagucuaugaugcaaaauuugaaaaacaacuaggccaaaucauguuguuaauccuauguacuucacaaauucuuuuaaugagaacgacuugggcuuuaugcgaaaguauuacauuagcaacugguccccucacgacacucugggaaggaucuccgggaaaauucuggaacacaaccauugcaguaucaauggccaacauuuuuagagguucguauuuggcgggagcgggguuggccuuuagucuaaugaaaucuuuagguggggguagacgagggacgggcgcacaaggugaaacacuaggcgaaaaauggaagagacagcuuaaucaacuauccaaaucugaauuuaauacguauaaaagaucugguauaauggaaguugauagaucagaagccaaagagggauugaagcguggagaaacuacuaaacacgccguaagccgggguaccgccaagcuacgaugguuuguagaaagaaaccuaguaaaaccugaaggcaaaguaaucgacuuagguuguggacguggaggauggucauauuacugugcuggucucaagaaagugaccgaaguaaaaggauauaccaaaggaggacccggacacgaagaacccauuccaauggcuacuuauggauggaaucugguaaaacuucauagugggaaagaugucuuuuucauacccccugagaaaugugauacccuacuaugugauauuggagagucaagccccaacccuacaauagaagaaggcagaacuuuaagaguccuuaaaaugguagaaccguggcuucgagguaaccaauucuguaucaagaucuuaaacccauauaugccuaguguuguagaaaccuuagaacagaugcaacguaaacauggugggauguuaguccgaaauccuuuaucacggaauaguacacaugaaauguacugggucucguguggcacuggaaauauagugagcgcaguaaauaugacaagcaggauguuacuuaaccgauuuacgauggcccauagaaaaccgacauaugagagagauguugaucuuggggcugguacgcgccauguagccguagaaccagaagucgccaauuuagacauaaucggacaaaggauugaaaacaucaaacacgaacauaaaucaacuuggcacuaugacgaagauaauccuuauaagaccugggcauaccauggaaguuacgaaguaaaaccgagugggagugcuucaaguaugguaaauggcguaguuaaauugcuaaccaaaccaugggauguaaucccgauggucacacaaauugcuaugacagauacuacuccuuucggacaacaacgcguauucaaagaaaaaguagauacacgaacaccaaaggcaaaaagagguacagcacaaaucauggaagugaccgccaaguggcuauggggcuuucuaucuagaaacaagaaaccuaggaucugcaccagggaggaguuuacucgaaagguacggucgaacgcggcuauuggagcuguauuuguagacgagaaccaauggaauagugccaaagaggccguugaagacgaaagauucugggaccugguucacaaagagagagaacuacauaaacaggguaaaugugcaacauguguauauaauaugaugggaaaacgagagaagaaauuaggggaauuuggaaaagcaaaaggaucacgagcaauaugguauauguggcuuggagcaagauuucuagaauuugaagcacuaggauucaugaaugaagaucauugguuuucgagggaaaacucuuuauccggcguugagggugaaggacuacacaaacuaggauauauuuuaagagauaucuccaaaaucccaggcggaaacauguaugcagaugacacugcaggaugggauaccagaauuacagaggacgaucuacagaacgaagcccgcauuacugacauuauggaaccugaacaugcccuauuagccaaaaguauauuuaaauuaacuuaucaaaacaaagucguucgcgugcaacggccugccaaaaauggcacaguuauggaugucauuucucgacgagaccaaagagggagcggucaaguugguacuuauggcuuaaauaccuucacaaacauggaagcacagcuuauucgacaaauggagucggaaggaauuuucucaccgucagaauuagaaacuccuaauuuagcugaacgaguuuuagauuggcuagaaaaguauggaguagagcgcuuaaaaagaauggcgauaucgggagaugauugcgucguuaagccaauagaugauagguucgcaaccgccuuaacggcucucaacgacaugggaaaaguaaggaaggauauuccucaaugggaaccaucaaagggguggaacgauuggcaacagguucccuuuuguagucaccacuuccaucaacuaauaaugaaagacggacgugaaauugucguaccauguagaaaucaagaugagcuaguuggucgagcacggguaucacagggggccggcuggagucuuagagaaacggcaugcuuagguaaauccuaugcacaaauguggcaauugauguauuuccauaggcgugaccuaagacuugcugccaaugccauaugcagugccguaccgguggauuggauccccacaucaaggacgacauggagcauccaugcucaccaucaauggaugacuacagaagacauguuaucaguuuggaaccgaguauggauagaggaaaauccuuggauggaggauaaaacacauauaagcucuuggggugauguuccguaccuuggcaagagagaagaccaauggugugggagucuuauaggacucaccgcuagagccacgugggccacuaauauccaaguugcaauaaaccaaguaaggagacugauagguaaugaaaauuaucuggacuacaugacuucaaugaagcguuucaagaacgaaucggauccggaaggggcacuaugguag

SEQ ID NO: 21126 - RNA, 9879 nt, Artificial Sequence
  derived and/or modified CDS sequence (opt6) from DENV-1__KJ649286__SS-prME
aguguaacaaugcuguuaaugcuucugccaaccguucuugcauuccaccuaacaacucguggaggagaaccccacaugaucgugacaaaacaagaacguggaaaaucgcuucucuuuaaaacauccacgggggugaacauguguacuuuaaucgcaauggaccucggugaacuuugcgaagauaccaugacguauaaaugcccuaggaucacugaagcagaaccagacgacauagauugcugguguaaugcaacugacacaugggucacuuaugguacuuguucucaaaccggcgaacaucgacgagacaaacggucggucgcacucgcuccucacguagguuugggacucgaaacccgaacagaaacuuggaugucgagcgaaggugcuuggaaacagauacaacgcguagaaacuugggcauuaagacaccccggauuuacugugacagcccuauuccuagcccacgcaaucggaacgagcauuacucagaaaggaauaauauucaucuuacuaaugcuagugacccccaguauggcaaugagauguguggguaucggaaauagagacuucguugaaggcuuaucaggagccacuuggguagacguggucuuagaacacgggucuugcguuacuacaauggcgaaagacaaaccaacacuugacauugaacuuuuaaagacagaagugacaaacccagcaguuuuaagaaaacuaugcauugaagcaaaaauaucuaauacgacaacagacagccgcuguccaacccaaggcgaagccacgcuaguagaagaacaagaugccaauuuugucugcagaagaacauuugucgaucgcggauggggaaauggcuguggacucuuugguaaggggagucuaauaacaugugccaaguuuaaauguguaacaaaauuagaagguaaaauaguacaauacgagaauuugaaauacucuguaauagucacaguucauacaggagaucagcaccagguugguaaugaaucaacugaacauggcacuacagcaacuauuacaccacaggcaccuacuucagaaauccaauugacagauuauggagcuuugacccuagacugcucgccuagaaccggucuggauuucaaugaaaugguguuacuaacgaugaaagagaaaagcuggcuaguacauaaacaaugguucuuggaucuaccccuaccuuggacaaguggggccacaaccagccaagaaacuuggaauagacaagaucugcuaguuaccuucaagacggcacaugccaagaaacaggaagucguuguguuaggaucacaagaaggagcaaugcauaccgccuuaacuggggcgacugaaauacaaacaucugguacaacaaccauauucgcaggucaucuaaaauguaggcuaaaaauggacaagcucacacuaaaagguaugucauaugucauguguaccgguucuuuuaaauuggaaaaagaagucguugaaacucaacauggaacugugcuaguacaaguaaaauacgaagggacagacgccccuuguaaaauaccuuuucucacacaggaugagaaaggagucacucaaaauggacgagugauuacugccaaucccauuguaacagauaaagaaaagccagugaauaucgaagcggagccgccauucggcgaaagcuauauugucguuggagcaggagaaaaggccuugaaguugucaugguucaaaaagggaucuacuaucggcaaaauguucgaagcaacggcucguggagcacgaagaauggcgauuuuaggugacaccgcaugggauuuugguucgauagguggaguauuuacgagugucgggaaacuuguucaccaaauauucggaacagccuaugggguacuauucucagguguuuccuggacuaugaaaauaggcauuggcguauuacuaacaugguuaggacuaaauuccagaucaacgucuuugucaaugacauguauagccgucgggcugguaacacuauacuugggaguaaugguucaagcugauucaggcugcguaauaaauuggaagggucgcgagcucaaauguggguccggcauauucgucacaaacgagguacacacguggacagaacaauauaaauuucaagcggacucaccgaaaagacuaagugcagcaaucgguaaggcuugggaagaaggaguuugcggaauaagaagugcuacuagacuugagaacaucauguggaaacagauaaguaaugagcuuaaucacauccuuuuggaaaaugacaugaaauucaccguaguaguuggcgauguuucugguauuuuggcucagggcaagaaaaugauacggccacaaccaauggaacacaaauauuccuggaaaagcugggguaaagcaaaaauaauaggagcugauguacagaacagcacuuucaucauagauggccccaacacaccagaauguccggaugaccaaagagcguggaacauuugggaagucgaagauuauggcuucggaaucuucaccacuaacaucugguuaaaauuaagagauucuuauacccaagucugugaucacaggcugaugagcgccgcgauaaaagauaguaaagcgguccaugcggauaugggauauuggauagagucagagaaaaaugaaaccuggaagcuagcgagagcuaguuuuauugagguuaaaacguguguauggcccaaaucacacacucuauggucaaacggaguacuagaaucggaaaugauuauuccaaaaauauauggcggaccuauaucacaacauaacuacagaccugguuauuucacucaaaccgcuggcccguggcacuuagguaaacuagaguuagacuuugauuuaugcgaaggaacaacaguggugguagaugaacacuguggcaaucgcggcccaucacugagaaccaccacugugacaggaaaaauuauacacgaauggugcugucguucuuguacucucccuccacuucgauuuaagggcgaggauggcugcugguauggcauggaaaucaggcccguaaaagaaaaagaagaaaacuugguaaaaaguauggucagugcaggcucaggagaaguugacagcuuuagcuugggucugcuauguauaaguauuaugauagaagaagucaugagaagccgcuggaguagaaaaaugcuaaugacgggaacguuagcuguauuucuuuuacucaucaugggccaacugacguggaaugaccuaauuagguuaugcauaauggucggggcuaacgcaucggaucgaaugggaaugggaacaaccuaucuagcguugauggcuacauucaaaaugagaccuauguucgcaguggggcuucuuuucagacgucugacuucgcgugaaguccuccuuuuaaccaucggucugucauuaguagcuaguguagaauuaccgaauagucuugaagaacuaggagacggauuggcgaugggaauaaugauauuaaaacuacuaacagacuuucaaagucaccagcuuugggcagcguuguuaagucucaccuuuaucaaaaccacuugcaguuuacauuacgcguggaagacaauggcgaugguacuuucaauagucucuuuguuuccacuuuguaugagcacaacaucccagaagacgacaugguuaccuguauuauuagggucccuaggauguaaaccacuaacaauguucuuaauagcugaaaauaaaauaugggguagaaaaagcuggccacucaaugaaggcauuauggcaguagggauugugaguaucuuauuaucaucccugcugaagaaugaugugccauuagcgggcccuuuaguugcaggagguaugcuuauagcguguuauguaauaaguggauccucagcagaucuaucucuagagaaggcagccgaagucucaugggaagaagaagcugaacauagcggagcaucccacaauaucuuaguggaagugcaagacgacggcacaaugaaaauuaaagaugaagaaagggaugauacacuaacuaucuuauuaaaagcuacguuauuggcaguuucagggguuuauccauuaucaauucccgcaacacuauuuguaugguauuuuuggcaaaagaagaaacagagaaguggaguuuuaugggauacgccaucgccacccgagguugaaagggcaguuuuggaugacggaaucuaccguauaaugcaacggggacuuuuaggacgcagccaaguaggugucgggguuuuucaagaaaacguuuuccauaccauguggcaugucacaagaggugcaguguuaauguacaagggaaaaagacuagaacccacgugggcuucaguaaagaaagaccugauaucauacggaggaggcuggagauuacaaggaagcuggaacacuggggaagaaguucaaguaaucgcuguagaaccaggcaaaaaccccaaaaaugugcagacagcaccggggacguucaaaacaccugaaggugaaguaggcgcuauugcauuagauuuuaagccaggcacaucuggaucucccauagugaauagggaggggaaaauugugggacuauauggaaauggagucgugacuacaaguggaacauauguuucagcgaucgcucaagcgaaggcuucgcaagaaggcccgcuaccagaaauagaggaugaaguuuuuagaaaaagaaaucuaacaauaauggauuugcauccuggcucagggaaaaccagacgauaucugccagcaauaguaagagaagcaauaaaaagaaaacuccgaacucuuauauuggcuccaaccagaguuguagcaagcgagauggccgaagcacuuaaaggaaugccuauuagauaccaaacuacagcugucaagagugaacacacuggaaaagaaaucguagaucuaaugugccaugcaacauucaccaugcgauuauuaaguccaguucguguaccaaauuacaauaugauuauaauggacgaagcucauuucacagacccgaguucgauugcagccagaggauauauaucgacaaggguaggaaugggugaggcggcugcuauauuuaugacggcaacgccacccgguucgguagaagcguuuccccagaguaaugcaguaauccaagacgaagaaagagacauacccgagcgaucuuggaacucaggauaugacuggauaaccgauuuuccggguaaaacuguaugguuuguuccaucgauuaagucuggaaaugauaucgcaaacugccuucggaaaaauggaaaacgcguaauccaacuuuccagaaaaacauuugauacagaauaucagaagaccaaaaauaacgauugggauuacguagugacaacagacauaagcgaaaugggcgcuaauuuucgcgcugaccgagugaucgaucccaggcgaugccuaaaaccggucauccucaaggacgggccagaaaggguuauacuugcuggucccaugccagucacaguagcuagcgcagcacaacgaagaggucgcauugggcgaaaccaaaauaaagagggcgaucaauauauuuacaugggacagccacuaaacaacgaugaagaucaugcacauuggaccgaagcuaaaauguuguuagauaacauaaacacgcccgaagguauaauaccagccuuauuugaaccugagagagagaaaucugccgcgaucgauggagaauacaggcuaaggggugaagcaaggaaaacuuuuguugaauuaaugagacgaggugacuugccgguuuggcuuuccuacaaaguagcaagcgaaggcuuucaauauagcgaccggagauggugcuuugacggggaaagaaauaaucagguuuuagaggagaauauggauguagaaauauggacgaaagagggugaaagaaagaaauuaaggcccagauggcuagacgcccgcacuuacucugacccuuuagccuugagggaauuuaaggaguucgcugccggacgaagaucggucucaggugacuuaaucuuagaaauagguaaacuuccacagcaucugacucagagagcucaaucagcacuagauaauuugguaauguuacacaauuccgaacaaggaggaagggcuuaucgacaugcuauggaggaauuaccagacacgauagagacauuaauguuguuagcguuaauagcuguccuuacugggggaguaaccuuauucuuucuaucugguaaagggcuaggcaaaaccucaaucgguuuauuaugcguaauggcuucgucaaugcuucucuggauggccuccguagagccucauuggauagccgcuaguauaaucuuagaguucuuucuuaugguacuucuuauaccagaaccagauagacaaaggaccccacaagauaaucagcuagcuuacguaguaauaggauuauuguucaugauuuuaacuguugcggcaaaugaaaugggacuauuggaaacuacaaagaaagauuuaggaauaggucaugucgcaguagaaaaccaucaucacgcgacgauguuagaugucgaccugcauccugcuagcgcuuggacuuuguaugcagucgcaacaacaauaaucaccccuaugaugagacacaccauagaaaauacaaccgcgaauauaagccuaacugcuauagccaaccaagccgcuauacuaaugggcuuagauaagggguggccgauuaguaaaauggacauaggcguaccgcuauuagcgcuaggauguuauucccaagugaacccaaugaccuuaacagccgcaguguuaaugcuaguugcgcacuauacaauaauagguccaggucuucaagcaaaagcaacuagagaagcacaaaaacggacagccgcagguauaaugaagaauccaacggucgacggaaucgucgcuauagaccucgacccuguaguuuaugacgccaaauuugaaaaacaacucggucaaauaauguuacuuaucuuauguacuucccaaauauuauuaaugcgaacgacgugggcgcuaugugagaguaucacccuugcaacaggcccgcuaacaacacuaugggaaggaucaccuggaaaauuuuggaauacuacgaucgcggucaguauggcuaacaucuucaggggaucguaccuugcuggagcgggcuuagcuuucucacuaaugaaaagucugggaggaggcagacgugguacgggugcacaaggagaaacucucggagagaaauggaagagacaacuaaaucaauuaagcaaaucggaguucaacacauauaagcgcagcgguauuaucgaaguugaucgaagugaagcgaaagaaggccucaaacgaggggaaacaacuaagcacgcgguaagccguggaacggcaaaauuaagaugguucgucgaaagaaaccuugugaaaccagaagggaaagugauugaucuaggaugcggaagaggagguuggagcuauuauugugcaggucuuaagaaaguaacugagguaaaaggauauaccaagggaggagcuggucaugaggagccaauaccuauggcuacauacggauggaaccucguaaaguugcacucagggaaagauguauucuuuauacccccagaaaaaugugacacauugcuuugugacauuggugaaucgucgccuaauccuacuaucgaagaaggucgcacauuaaggguauugaaaaugguggaaccguggcuaaggggaaaccaauuuugcaucaagauuuuaaacccuuauaugccuagcgucguagaaaccuuagagcagaugcaacgaaaacacggaggaauguuaguacguaacccucuuucacgaaauaguacucaugaaauguacugggucagcugugggacagguaauaucguuucggcuguuaauaugacaaguagaauguugcuaaauagauuuacgauggcucaucgaaaaccaacauaugaacgagauguagaucucggagcugggacacgucauguugcaguagaacccgagguagcaaaucuugauauaaucggacagcguaucgagaauauuaagcaugaacauaaaucaacuuggcauuacgaugaagauaauccauauaaaacgugggcauaucacgggucuuaugaggucaaaccuucuggcucagcuucaucgauggucaacgguguagucagacuacucacaaaacccugggauguuaucccuauggucacacaaauagcgaugacugacacaacaccauuugggcaacaaaggguauucaaggaaaaaguugauacaagaacaccaaaagcaaagagggggacugcacaaguuauggaaguaacagcuaggugguuaugggguuuucuaaguaggaacaagaagccacggauauguacgcgggaagaguucacacgcaagguuagaagcaaugcagcgauaggggcggucuuuguugacgaaaaucaguggaacagcgcuaaagaagccguagaagacgaacgauuuugggaucuaguucauagagaaagagagcugcacaaacaggggaaaugugcaacaugcguuuacaacaugaugggaaagagagagaagaaacuuggcgaguucgguaaagcgaaaggaucgagggccauaugguauauguggcugggugcgagauuccuagaguucgaggcacugggguucaugaaugaagaccacugguuuucaagggagaauagcuuauccgggguagagggagaggggcugcaccgccuagguuacauauuacgagacauaagcaaaauucccggaggaaauauguaugcagaugauacugcuggcugggauacaaggaucacugaagaugaccuacaaaaugaagcaaaaauaacagauauaauggagccagaacacgcucugcuagcuacgaguauauuuaaauuaacauaucaaaacaaaguugugcgaguacaacgcccugccaaaaacggaaccguuauggauguaaucucaagaagagaccaacgagguucaggacaaguaggaacuuauggguugaauacauuuacuaauauggaagcacaauugauuagacaaauggaaucagaaggcuuguucuccccaucagaacuggagacgcccaauuuggcugagcgaguacucaauugguuagguaaguacggaguggagcguuuaaaaagaauggcaaucaguggagaugauuguguuguaaaaccaaucgacgacagauucgccacagcucucacagccuuaaaugacaugggaaaaguucguaaggauauaccucagugggagccaagcaagggauggaaugauuggcaacaagucccuuuuuguucucaccacuuucaccaacucauuaugaaggacggaagagaaauuguaguccccugucgaaaucaagaugaacuuguagggagggcuagagugagucaaggugcaggauggucauuaagagagacagcgugcuuaggcaaguccuacgcacaaauguggcaacuuauguacuuucaccgaagagacuuacguuuggcagcgaacgcaaucugcagugcagucccggucgacugggugccaacgagcagaacaaccuggucgauccaugcucaccaucaguggaugacgacagaaaacaugcuaaguguauggaaccguguguggauugaagaaaauccauggauggaagauaaaacacauguaaguuccugggaagacguuccauaucuggggaaaagagaagaucaauggugcggaagccucauaggguuaacggcuagagcuacgugggccacaaauauacagguagcgauuaaucaaguccguaaacuuaucggaaacgaaaacuaccuggauuacaugacaucaaugaaaagauucaaaaaugacucugauccugaaggagcacucugguaa

SEQ ID NO: 21127 - RNA, 9879 nt, Artificial Sequence
  derived and/or modified CDS sequence (opt6) from DENV-1__KF887994__SS-prME
aguguaacuaugcuacuaaugcugaugccuacugcucucgcauuccauuugacuacccgcgguggggaaccacauaugauuguaucaaaacaagaacggggcaaaagucuacuauucaaaacgagcgccgguguuaacauguguacauugaucgcaauggaccucggagaacuaugugaagacaccaugaccuauaaauguccaagaauuacugaagcagaaccugaugacguugacuguuggugcaacgcgacggauacaugggucacuuacgggacuugcucacaaaccggcgaacauagaagagacaaaagaucuguugcucuagcuccacacguaggauuaggucuugaaacccgcacagaaacuuggaugagcucagaaggcgcuuggaaacaaauucaaagaguagaaacuugggcucuacgucauccgggauucacugugaucgcuuuguuccuagcucacgcuauuggcaccucaaucacacaaaaaggcauuaucuucauucuguuaauguuaguaacacccuccauggcuaugagaugcguugguauugggucacgcgacuuuguagaagggcuuagcggugcuaccuggguggauguuguauuagaacaugggagcugcgucacaacuauggcaaaagauaaaccgacacucgauauagaacuucuuaaaacggaaguaacgaauccagcaauauuacggaaacuauguaucgaagcuaaaauaucaaacacuacaaccgauucuagauguccgacacaaggggaagcaacgcuaguagaagaacaagacgcaaauuucguauguagaagaaccuucguggacagagguuggggaaacgguuguggacuauuugggaaaggaucgcuuauaacaugcgcaaaauucaagugugugacuaaguuggaggguaaaauuguccaauaugaaaacuuaaaauauucaguuauugugaccguacacacuggcgaccaacaccaaguaggaaaugaaaguacagaacauggaacaacggcuacaauaacaccgcaagcccccaccacagaaauacagcuuacggauuacggugcguuaacucuagacugcaguccuagaacagguuuggacuucaacgagaugguguugcuuacaaugaaagaaaaaucaugguuaguacacaagcaaugguuccuugauuuaccauuaccuuggacaucaggcgcaagcacgagucaagaaacuuggaacaggcaagauuuguuagugacuuucaaaacagcacacgcgaagaaacaagaagucguaguucuagguagucaagaaggggcgaugcauacugcccuuacaggagccacugagauacaaacaagcgggaccacgacuauauucgcaggacaucuuaaaugucggcuuaagauggacaaguuaacguuaaaaggaaugagcuauguaauguguacaggcucauuuaaacuggaaaaagagguggccgaaacgcaacauggaacugucuuaguacaaauuaaauaugaaggaacagaugcuccuuguaagauccccuuuucaacacaggaugaaaaaggaguuacgcaaaauggaagauuaauuacagcuaacccuauuguaacugacaaagaaaaaccugugaacaucgaagcagaaccuccguucggcgaaagcuacauagucauaggagcaggcgaaaaggcucugaaauuauccugguucaagaaagggucuucuaucggaaagaugcuagaagcuacagcccgaggcgcacgaaggauggccauuuuaggagauacagccugggauuucggaaguauuggagguguauuuacaucuguaggcaaauuaguccaucagauauuugguaccgcauauggaguauuauuuagcggcguuucauggacuaugaaaaucgguauaggugucuuauugaccuggcuaggacuuaacaguagaagcacaucacugaguaugacguguauagcagugggccuuguaacacuguacuuaggcguuaugguucaagcagauagcgguugcguuauaaauuggaagggaagagaguugaaguguggguccgguauuuucgucacaaaugaaguacacacuuggacugagcaguauaaauuucaagcagauucuccuaagagauugagcgccgcaauugguaaggcgugggaagaagggguguguggaauacgguccgccacuagacucgaaaacauaauguggaaacaaauuuccaacgaauuaaaccauauucucuuagagaacgauaugaaauuuacggucguaguaggugauguggccgggauucuugcacaaggaaagaaaaugauacgcccccaaccgauggaauacaaauauucauggaaaaguuggggcaaagcuaaaauaauaggugccgacguacaaaacacgacuuucauaauugauggaccgaauacaccugaauguccagacgaucaaagagcuuggaacaucugggaaguagaggacuauggauuuggaaucuucacgaccaacauauggcuaaaacuacgagauucauauacacaggugugugaccauaggcuaaugagugcugcgauuaaagacucaaaagcuguccaugccgacaugggauauuggauagaaagugaaaagaacgaaaccuggaaguuagcgcgugcuucuuuuauagaaguaaaaacuugcaucuggccaaaaagccauacauuaugguccaacgguguacuugaaagugagaugauuauacccaagauuuacggcggaccaauaucgcaacauaauuaccgaccaggguauuuuacacaaacugcuggccccuggcaucucgggaaacucgaauuggauuuugacuuaugugagggaacaacuguaguaguugaugaacauuguggcaaucgcggaccgucauugcggaccacuacuguaacuggaaaaauaauccaugaauggugcuguagaucauguacacuacccccguuaagauuuaggggagaagauggcugcugguauggcauggaaauucggccgguaaaagaaaaagaggaaaauuuaguaaaaaguauggucucugccggauccggagaaguggauucuuucucgcuaggauuacuaugcauuucaauaaugauagaagaaguaaugagauccagauggaguagaaaaaugcuuaugaccggcacuuuggcuguuuucuuacuacuuauuaucgggcaacuaacauggaacgauuuaauuaggcuuugcauuaugguuggagcaaacgccucagaccggauggguaugggcacuacguaucuugcacuaauggcaacuuuuaaaaugagaccaauguucgcugucggacugcuguucagaagauugacaagucgcgaagucuuguuauuaacuaucggauuaucauugauggcuucggucgaguuaccuaacucucuggaggaauuaggagaugguuuagcaauggguauuaugauacuaaaauuauuaacugauuuccaaagucaccaguuaugggcgacccuauuaucucuuacuuuuaucaaaacaacuuuuucacuacacuaugcauggaaaacaauggcaaugguucuaagcauuguaagccuauuuccgcugugccugaguacgacaucgcagaaaaccacguggcugccaguacuccucgguaguuuagggugcaaaccacucaccauguucuuaauugcagaaaauaaaauauggggcagaaggucauggccgcuaaacgagggcaucauggcaguaggaaucguaucuauacuuuuaaguucacuacuuaaaaacgauguuccauuggcaggaccauuaauugcggguggaauguugaucgcauguuauguaauaucuggguccucagccgaucuuucauuagaaaaagccgcugaggucaguugggaggaggaagcggaacacucaggugcaucucauaauauauuaguagaaguacaagaugaugggaccaugaaaaucaaagaugaggaacgagaugauacguugacaauccuucuaaaagcaaccuuacuagccguaagcggaguguacccuuugucgaucccggcgacguuauuuguaugguacuuuuggcagaagaagaaacagaggagcggaguguugugggacacaccaagcccaccggaaguggaacgagcuguuuuggaugaugggauauaucgcauuaugcaaagaggguuauuaggucgaagucaggugggagugggaguauuucaagagaaugucuuucauaccauguggcacguaacaagaggagcuguacuaauguaccaaggaaaaagauuggaacccagcugggcaagugugaagaaagacuuaauuucuuauggaggaggauggcgucuacaaggauccuggaauacaggggaagaaguucaagucaucgcaguugaacccgguaaaaaucccaaaaauguacaaacugcaccaggaacauucaagacgccugaaggagagguaggugccaucgcauuagacuuuaaaccaggaacuucgggaucacccauagucaaccgagaaggaaagauagugggucuguaugguaaugguguaguuacuacaucuggaacauauguaagugccaucgcacaagcuaaggcgagucaggaagguccacuuccagaaauagaagaugaaguauuccgcaaaagaaaucuuacaauuauggauuuacauccugguagcggaaaaacaagacgauaucuacccgcuaucgugcgagaagcaaucaaaagaaagcucaggacauuaauauuagcuccaacgaggguaguugcuucagaaauggcugaagcauuaaaaggaaugccaauaagauaccagaccacugcaguuaaauccgaacacacuggaaaagaaauuguagauuuaaugugucacgcuacuuuuacaaugagauuauugagcccagugcguguaccaaacuauaauaugaucauaauggacgaagcgcacuuuacggauccuuccucaauugcagcucggggauauauaucaacuagagucgguaugggugaagcagcagccaucuuuaugacugcaacaccuccgggaucaguagaagcauuuccucaaaguaaugcagugauucaagacgaggaacgggacauaccggagaggucguggaacucagguuaugaguggauaacggauuucccggggaaaaccgucugguuugucccaucgauuaaaagcggaaaugauaucgcaaauugcuuaaggaaaaacgguaagagaguuauucagcuuagccggaaaacauuugauacugaauaccagaaaacuaagaauaaugauugggacuauguaguuacaacagacauaagugagaugggggcgaauuuccgagcugaccgaguaauagacccacgccguugucuuaaaccggugauacuuaaggacggaccagaacggguaauucuagcaggaccaaugcccgugacaguagcaagugcugcgcaacgaagagggcgcaucgguagaaaccauaauaaagaaggagaucaguacauauauaugggucaaccucuaaacaaugacgaagaucacgcacacuggacagaggcaaaaaugcucuuagacaauaucaauaccccagaggggaucauaccugcacucuuugagcccgaaagggagaaauccgccgccauagauggggaguaucgacugaggggugaagcaagaaagaccuuuguugaacucaugagaagaggagaucuuccagucugguugagcuacaaaguagcuagcgaagguuuucaguauagugaucgaaggugguguuuugacggagaaaggaacaaccaaguguuagaggagaauauggacguugagauuuggaccaaggaaggugagaggaagaaacugcgcccacgcuggcuugaugcuagaacguacagugauccacuugcuuuaagggaauuuaaagaauuugcagcagguagacgaagcguuucaggugauuuaauacucgagauuggcaaacugccacaacauuuaacucagagggcucaaaacgcauuagacaaucuagucaugcuucacaacuccgaacaaggagggagagcguaucgccaugcuauggaggaacuacccgauacuauugaaacccuaaugcuucuagcucucauugccguacuaacaggaggagucacauuauucuuucuaucagggagaggacuuggaaaaacaaguauugguuugcucuguguaauggcuaguaguguguuauuguggauggccaguguagaaccucauuggauagcggcaucuauaauucuagaauuuuuccuaaugguauuauuaauccccgaaccagaucgucagcggacuccgcaagacaaccaauuagcauauguagucaucggauuacuauuuaugauauuaacugucgcagcgaacgagaugggacuguuagagacaacaaagaaagauuuaggaauuggucacguugcuguugggaaucaucaccacgcagcuaugcuggauguagaccuacacccugccucugcauggacguuguacgcuguugccacaacuauaauaacuccaaugaugagacacaccauugaaaauacaaccgcaaauauaucucuaacugccauugcaaaccaggccgcgauacuuaugggccuagauaaaggguggccaauaagcaaaauggauauuggcguuccgcuacuggcauuaggcugcuauucgcaaguaaauccacucacccuuaccgcugcgguguugaugcuuguagcacacuaugcaaucauaggaccaggacuccaagcuaaagcgacucgggaagcucaaaagcggacugcagcggguauuaugaaaaauccgaccguggacggcauaguagcuauagaucucgauccgguuguuuaugaugcaaaauuugaaaaacaauuaggucagauaaugcuccuaauauuauguacgagucagauccuacuuaugcgaaccacgugggcgcugugugaaaguauaacacuggccacagguccucugacaacauugugggaaggaucuccaggaaaauuuuggaacacaaccauagcugugucgauggcuaauauuuuucgaggguccuacuuagcaggggccgggcucgcuuuuucucucaugaagucacuugggggaggacgccgggguacaggagcucaaggcgaaaccuuaggggaaaaauggaagagacagcuuaaccaacucucuaaaagugaauuuaauacguacaaacgcucagguauaauggaagucgauagaagugaggcuaaagaaggguugaaacggggcgaaaccacgaaacaugcaguuucgagaggcaccgccaaguuaaggugguuuguagaacggaacuuaguuaagccagaagggaaaguaauagauuuaggcuguggaagaggaggcuggaguuauuacugcgcaggcuuaaagaagguuacugaagucaaagguuauacaaaaggaggaccuggucacgaagaaccgauaccaauggcaacauauggauggaacuuggugaaauuacacucagguaaagacguguucuuuaucccaccggagaagugugacacacuucuaugugauauaggagaaaguaguccuaacccgaccauugaagaaggacgcaccuuacgaguguugaaaaugguagaaccuuggcuacggggaaaccaguucuguauaaaaauuuugaauccguauaugccaucaguuguugaaaccuuagaacagaugcaaagaaaacacgguggaauguuagucaggaauccgcuaagcagaaauucaacgcaugagauguacuggguuucuugcgguacugggaauauugucucagcaguuaauaugacaaguagaaugcuucugaaucgcuuuacaauggcccaucguaaaccuacuuaugaacgugacguagaccugggagcaggaacgcgccaugucgcagucgagccggaaguagccaaucuugauauuauaggccaaagaaucgaaaauauaaaacaugaacacaagagcacaugguacuaugaugaagacaaucccuacaaaaccugggccuaccaugguagcuacgagguaaaaccuaguggaucagcaaguucaaugguaaaugggguugugaaacuucugaccaaaccuugggacguuauaccuaugguuacacagauagcaaugaccgauaccacuccauuuggucaacaaagagucuuuaaagagaagguagacacccgcacaccuaaagcaaagcgaggaacagcgcaaauaauggaaguaacagcgaagugguuauggggauuucuuucaagaaauaagaaaccccgaaucuguacccgggaagaguucacaaggaaagucaggagcaacgcagccauaggcgcaguuuuuguggacgaaaaccaauggaacuccgcuaaagaggcaguggaagaugaacgauuuugggauuuaguacacaaagaacgugaauuacauaaacaagguaaaugcgcuacguguguauauaacaugaugggcaaaagagagaagaaacugggugaguucgggaaagcgaaaggaagucgugcaauaugguauauguggcuaggagccagguuccuagaauuugaggcauuaggauuuaugaacgaagaucacugguuuucacgggaaaauucauucucagguguugaaggugagggucuccacaaauuaggguauauacuacgugauaucaguaagauaccgggaggaaacauguacgcugacgauacggcaggcugggacacuagaauuacugaagaugauuuacaaaaugaagcccguauaacagacauuauggagccggaacacgccuuauuggcuaaaucaauauuuaaacuuacauaucagaauaaaguugugagaguccagagaccagccaaaaacggaacugucauggacguaguuagucgaagggaccaaagaggaagcggacaaguugggaccuacggacuaaauacauuuacaaacauggaagcccagcuaauaagacagauggaaucggaggguauauucucgccgucggagcuggaaacuccaaaucuagcagaaagagucuuagcuugguuggaaaaauauggaguagaacgauuaaagaggauggcuauaaguggcgaugacugcguagucaagccaauagaugauagauucgcaacagcuuuaaccgcacuaaaugauauggguaagguaagaaaagacaucccacagugggagccuaguaaaggauggaacgauuggcaacaggugccauucuguagccaccacuuucaucaacugauaaugaaagauggaagagaaauuguagugccgugucgaaaccaagacgagcuaguagggagagcuaggguaucacaaggggcaggauggagccucagagaaacggcuugccuaggaaaaaguuacgcccagauguggcaauuaauguauuuccaucguagagauuuaagacucgcugcuaacgccauuuguagugccguuccaguaaauuggauacccacaucaaggacaacuuggucaauucaugcucaucaccaauggaugacuaccgaagacaugcuguccguuuggaauagaguauggauugaagaaaauccuuggauggaggauaaaacacauauuucaucuuggggagacguaccauaccuagggaagagggaagaucaaugguguggaucacucauuggacuaacggcuagggcgacgugggcuacuaauauacaaguagccaucaaccaagucagaaaauuaauagguaacgaaaauuaucuugauuauaugacaucgaugaaacgguucaaaaaugaaucagauccagaaggagcacuaugguga

SEQ ID NO: 21128 - RNA, 9879 nt, Artificial Sequence
  derived and/or modified CDS sequence (opt6) from DENV-1__JQ675358__SS-prME
agcguuacuaugcuccuaauguugcuuccuaccgcucuagcauuccauuuaacuaccagagggggagaaccccauaugauaguaucgaaacaggaaagaggaaagagcuuauuguuuaaaacaagugcagggguaaauauguguacucuaaucgcgauggaccucggcgaauuaugcgaagacacuaugaccuauaaaugcccucaaauuacagaagcagaacccgacgacguagacuguugguguaaugcaacggacaccugggucacauauggaacuuguagucaaacaggagaacauagaagagacaaaagaucgguagccuuagcuccacacgucgggcuaggacuagagacccggacggaaacauggaugucauccgaaggagcguggaaacaaauacaacguguagaaacaugggcacugagacauccuggguuuacgguuauugcauuauuuuuggcacaugcuauugguacaagcaucacacaaaaaggaaucauauucauauuacugauguuagugacaccgucaauggccaugagauguguagguauugguaacagagauuuuguggaaggccuauccggcgcgacauggguagacguaguucucgaacaugguuccugcguaacaacaauggccaaaaauaaaccuacuuuagauauagaauuguuaaaaacagaaguuacaaauccagcaauacuacggaaacuauguaucgaggcgaaaaucuccaauacuaccacagacagucgauguccgacgcagggugaagcaacauugguugaggagcaggacgcuaacuuuguaugucgucgcacguuuguagacagaggcugggggaauggaugcgggcuauuuggaaaagguucauuauuaacgugcgcgaaauucaaauguguaacuaaacuagaagggaaaauugugcaauaugaaaauuugaaauauuccguuauuguaacaguucacacaggugaucaacaccaaguaggaaacgaaacuacugaacacgguacuauugccaccauuacgccccaagcgcccaccucggagauacaacuaacagauuacggugccuuaacgcuggacugcuccccaagaacggguuuagauuucaaugaaaugguucuauuaacuaugaaagaaagaucauggcuaguccauaaacaaugguuucuagauuugccacuaccauggaccagcggggcuaguacgucucaggaaacauggaacagacaggaucuuuugguuacauucaaaacagcacaugcuaagaaacaagaagucguuguauuaggaucacaagaaggagccaugcacacugcuuugacgggugcaaccgaaauucaaaccuccggaacaacuacgauauuugcaggacauuuaaaaugcagguugaaaauggauaaacuaacucuaaaaggaaccucuuaugugauguguaccggaaguuucaaacuagaaaaagagguagccgaaacacagcacgguacgguuuuaguacaaguaaaauaugaagguacugacgcaccauguaagauucccuuuaguacacaggaugaaaaaggugugacccagaauggaagguugauaacugcaaauccaaucgucacugauaaagaaaaaccugugaauauugaaacagaacccccguucggcgaaaguuauauuguagucggagcaggagaaaaggcguuaaaacuaagcugguuuaagaaaggaucuuccauagguaaaauguuugaagcgaccgcaagaggugcgagacggauggcgauacuaggagacacagcaugggauuucgggucaauagggggagucuuuacaucaguaggaaaauugguacaccaaguguucggaacugcuuacgguguacuauuuagcggcgugucuuggacgaugaagauagguauuggaaucuuauuaacuugguugggucuaaauucacgaucgacgucauuauccaugaccuguauagccgucgguaugguaacuuuguaucuaggugugaugguacaagcagauagcgguugcguaauaaauuggaaaggaagagagcuaaaaugcgguagcggcauuuucgucacaaaugaaguacauacauggacggaacaauacaaguuucaggcugauucgccaaagcgauugagcgccgcaauugguaaggcuugggaagagggcguuugcggcauucggagugccaccaggcuagaaaauauaauguggaaacaaauaucaaacgaauuaaaucacauauuauuagaaaaugauaugaaauucacaguuguaguuggcgaugcaaacgggauacuggcucaggggaagaaaaugauccgcccgcagcccauggagcacaaguauucuuggaaaaguuggggaaaagcgaaaaucauaggugcugauauacagaauacuacuuuuauaauugacggacccgacacaccagaauguccagacaaccagcgagcauggaacauaugggaagucgaggacuacggauuugguauauuuacaacaaacauaugguugaaauuaagagauagcuauacucaaaugugugaucaucgauuaaugucagcugcgauaaaagauucaaaggccguccaugcagacaugggauacuggauagaaucggagaagaaugaaacauggaaacucgcuagggcuucguucauugaaguuaaaacaugcacauggccuaaaagucacacauuaugguccaacgguguauuagaaucagaaaugauaauacccaaaacuuacgguggucccaucagucaacauaacuaccguccgggauauuuuacacaaacagcgggcccauggcaucucgguaaguuagaauuagauuuugauuugugugaaggaacaaccgucguagucgacgaacacugcggaaauagaggaccuucauuaagaacgacuacgguuacgggaaaaauuauacacgaauggugcugcagaaguugcacauuaccaccacucagguuucgaggagaagauggaugcugguauggaauggaaauccgaccgguaaaggaaaaagaagaaaacuuaguaagaaguaugguuagcgcuggaaguggagaggucgacuccuucucccuaggcauauuaugugcaucuauuaugauagaagaaguuaugagaaguagauggaguaggaagauguuaaugaccggaacacuagccguauuuuuauuauuaauaaugggucaguugacguggaaugaccuaauaagauuauguauaaugguaggagcaaaugcaucggaucguauggggaugggcaccacauacuuagcauuaauggcaacguuuaaaaugagaccgauguuugcgguugggcuauuauuuaggcgccuuacaucaagggaggucuuacuuuuaacaauaggucuaagccugguugcguccgucgaguuaccaaauucgcuagaggagcuaggagauggcuuagcaauggguauaaugaugcuaaaauuauuaacugaauuucaaccgcaucaacuauggacaacccuccugucguugacauuuauuaagacaaccuugucauuagauuaugcauggaagacaacagcgauggcacuaaguaucgucagucuauuuccauuaugucuuuccacuacuagccaaaagacuacuuggcuaccaguccuccuuggcuccuucgguuguaaaccgcuuacaauguuuuuaauuacagaaaacaaaaucuggggacguaaaucauggcccuuaaaugaaggcauuauggccaucgggauagucaguuugcuacuuagcucauuacugaaaaacgacguaccacuggcagguccuuuaauagcagggggaaugcuuaucgcuuguuacguuauuucgggcaguucugcggacuuaaguuuagaaaaagcggcugaaguaaguugggaacaagaagcggaacacaguggcacgucacacaauauauugguagaaguacaagacgauggaacaaugaagauaaaagaugaggagcgggaugacacgcuuacgaucuuaguaaaggcgacccucuuagccguaaguggaguauauccuaugucgaucccagcaacacuuuucguuugguauuuuuggcagaagaagaaacagagaucugguguucuaugggacacaccuucgccaccugaagucgaacgcgcuguauuagacgauggaauuuaucggaucuuacaaaggggguuacuagggagaucccaaguugguguuggcguauuucaagacggcguuuuccauacuauguggcaugucacaaggggagccguacuuauguaucaaggcaaaagauuagaaccgaguugggccucuguaaagaaagaccuuauuucuuacggaggaggauggagauuucagggaucauggaauaccggagaagagguucaagucauugcuguggaaccucguaaaaauccgaagaacguucagacaacuccgggcacuuuuaaaacgccugaaggugaaguaggagcaauugcguuagacuuuaaaccagguacaucuggaaguccaauuguaaaccgcgaaggaaaaauaguaggacucuacggaaacgggguagucacgacauccgggacuuauguaucggccauugcucaagcaaaagcgagccaagaaggaccauuaccggaaauagaggaugagguguuuaaaaagcgaaaucuaacaauuauggacuugcauccuggcuccggaaaaacaagacguuacuuacccgcgauaguacgcgaagcgauuaaaagaaagcucagaacacugauacuggcaccaacucgggucguagcaucugaaauggcagaagcucuaaaaggcaugcccauuagguaccaaacgacugccgucaagagcgaacauacggggagggaaauuguagaccugaugugccacgcaacauuuacuaugaggcuucuuagucccgucagagugcccaauuauaauaugauaauuauggacgaagcucacuucaccgauccagcgucuauagcagcaagaggauauauuagcacaagaguaggaaugggagaagcugcagcaauauucaugacggccacaccacccggaucaguugaggcuuuuccacagucaaaugccgugauacaagaugaagaaagggauauaccagagcgaucauggaacucaggauaugauuggauuacugauuuuccaggcaaaacuguaugguuuguuccgucaauuaagagcggaaaugacaucgcaaauugccucaggaaaaaugggaaacgugucauacaacugagcagaaaaaccuucgacacugaguaccaaaagacuaagaacaacgauugggacuacgucgucacaacagauauauccgaaaugggggcaaauuucagagcagauaggguaauagaucccagacgcugccuaaaaccugucauccucaaggaugguccugaaagagugauauuggcaggaccgaugccggucacuguugcaagugcagcgcaacgaagaggaagaauaggacgaaaucaaaacaaagaaggagaccaauauguauacauggggcaaccucugaauaaugacgaagaucaugcgcauuggacagaagcaaaaauguuguuagauaauauaaacacgcccgaaggaaucaucccggcucuauuugagccugaacgcgaaaagagcgcagcaauagauggggaauaccgccugcggggcgaagcgcggaaaacuuuuguugaguuaaugagaagaggagacuuaccaguaugguugucuuauaagguugcgucagaaggauuucaguacagugauagacggugguguuuugauggagaacgcaacaaccaaguguuagaagagaauauggauguagaaauauggacaaaggaaggcgaacgaaagaagcuacguccaagaugguuggaugcucguaccuauagugauccgcuugcccugagggaguucaaggaguucgcagccgggcggcgaagcguaucaggagaucucaucuuggaaaucggaaaauugccacagcaucuaacauugagagcgcaaaaugcgcuagacaaccuaguuaugcugcauaauagugaacaaggcggaaaggcuuauagacaugcaauggaggaacuacccgacacuauagaaacauugaugcuccuagcuuuaauagcuguacuaacuggcggggugacgcuauucuuuuuaagcggaaaaggauuaggaaaaaccucaauugggcuuuuaugcguaacugcuucuucugcuuuguuauggauggccucaguugaaccacacuggaucgcagcuucaauaaucuuggaauuuuuccuuaugguuuugcuuauacccgaaccagaccgccaacgaacaccacaagauaaccaacuagcauaugucgugauuggauugcuuuuuaugauacuuacgguugcugcuaacgaaauggggcuccucgaaacaacuaagaaagaccuugguaucggacaugucgcggccgaaaaucaccagcaugcaacaaugcuugaugucgacuugagacccgcuagcgccuggacguuguaugccguagccacaacuguaauuacuccaaugaugagacauacaauagagaacacaacagcaaacauaucauugaccgcgauagccaaccaggccgcaauacuaaugggacuugauaaagguuggccuauaucaaaaauggacaucgguguuccauugcucgcacuugguugcuauucgcagguaaacccacuaacacuaacagcugcuguauuaauguuagucgcacacuacgccauaauaggccccggauuacaagcaaaagcaacuagagaggcacaaaaacguacagcagcagguauuaugaaaaauccgacuguggacgguauaguagcaauagauuuggaucccguaguauaugauacuaaguucgaaaagcaauuaggacaaaucauguuacuaauauuguguacuucacaaauauugcugaugagaacgacuugggcacuuugugaaagcauaacgcuugccacagguccacuaacgacccuuugggaaggaagccccggaaaguucuggaauaccaccauagcgguuucaauggcgaauaucuuuagagguaguuacuuggccggugcgggucucgcuuucucuuuaaugaaaucuguagguggcgggagaagagguaugggcgcccaaggcgaaacgcucggggagaaguggaagagacaacuuaaucagcuaaguaaaagcgaguucaauacauauaaacguucagguauuauggaagucgaccguucugaggcaaaagaagggcuaaaacgaggagaaacaacaaaacaugccguuuccaggggaaccgcgaaacugaggugguuuguagaaagaaauuuagucaaaccagaagggaaagugauagauuuagggugcgggaggggaggauggucuuauuauugcgcgggccuuaaaaagguaacugaaguuaaaggauacacaaagggaggacccggacaugaagaaccuauacccauggcaacauacgguuggaaucucguuaaguuacauagugggaaagacguauucuuuaugccaccugagaaaugugacacacuacuaugcgauaucggugagagcucaccaaauccuaccauagaagagggacgaacauugcggguccugaaaaugguugaaccuugguuacgagggaaucaauuuuguauuaaaauauuaaacccauacaugccaaguguaguugaaacacuggaacaaaugcaaaggaaacauggagguauguuaguccggaauccacuaucucgaaauagcacgcaugaaauguacugggugaguuguggaacaggaaacaucgugucagcagugaacaugacaaguagaaugcucuuaaauagguucacaauggcacauagaaaaccaacuuaugaaagggaugucgaucuuggugcggguacucgucauguagcaguagaaccagagguugcuaaccuggauauaaucggacaacgaaucgaaaacauaaagaacgaacacaagagcacauggcacuacgaugaggacaauccuuacaaaacaugggcauaucaugggucauaugaaguuaaaccuagcggaagugcaagcuccauggucaacggugucguucgacugcucacuaaaccaugggacguaauaccuauggucacucaaauagcuaugacggauaccacaccauucggacaacaacgagucuucaaagaaaaaguugauacacgaacacccagagcuaaacguggaacaacgcaaaucauggaaguuacggcaaagugguuguggggcuuuuugagucguaacaaaaagccaaggauaugcacgagagaagaauuuacgaggaaagucagaucaaaugcagcuauuggggcggucuucgucgaugaaaaucaauggaacucugccaaagaagcaguagaagacgaacgauucugggaucugguacaucgagaaagagagcuacauaaacaaggaaaaugugccacguguguauauaacaugaugggcaaacgggagaagaaauuaggcgaguuuggaaaagcuaaaggaucaagggcuaucugguauauguggcuuggagcccguuuucuggaguuugaagcauuggguuuuaugaacgaggaucacugguucaguagagaaaauagucuaucgggaguagaaggggagggacugcauaaacucgguuauauacuuagggauauaaguaagauuccgggaggcaacauguacgcugaugacaccgcaggcugggacacccggauaacagaagaugaccuucagaaugaagcgaaaauuacagauauaauggaaccggaacaugcucuuuuagcuacaaguauauuuaaauugacauaucaaaacaaaguagugcgcguucaaaggcccgcgaagaauggaacuguaauggauguaauuucgagacgugaccaaagagguuccggccaaguugggacguauggauugcauacauuuacgaauauggaaguucaacugauucgacaaauggaaucagaagguauauuuuuaccuucagaacuagaaacgccaaauuuggcugaaagaguacuagauuggcuagagaagcauggagcagaaaggcuuaaaagaauggcgaucucaggagaugacugcguaguuaagccaauagaugacagguucgcuacagcgcucacugcgcugaacgacaugggaaagguccggaaagacauaccccaaugggaaccuucuaaaggguggaaugauuggcaacaagucccauuuuguucacaucacuuucaccagcuuaucaugaaagacggaagagaaauagucguacccugucgaaaccaggacgaauuaguuggacgagcucgaguaagucaaggagcaggauggucccuacgagaaacagcuugucuuggaaaaucguaugcacaaauguggcagcugauguacuuucaucgaagggaucucagacuagcagccaaugcaauauguucggcgguuccaguggauuggguuccuacaagucggaccacuugguccauccacgcacaucaucaauggaugacgaccgaagauauguuaaguguguggaauaggguguggauugaggaaaauccuuggauggaggacaagacccauguuucaucaugggaagaagucccauauuuaggcaaacgugaggaucaguggugugggucuuuaauuggcuuaacugcgagagcuacaugggcaaccaacauacaaguagcaaucaaucaaguucgccgcuuaauugguaaugaaaacuaccucgauuacaugacguccaugaagcgcuucaagaaugagucagaucccgaaggugcucuaugguag

SEQ ID NO: 21129 - RNA, 9879 nt, Artificial Sequence
  derived and/or modified CDS sequence (opt6) from DENV-1__FJ850070__SS-prME
aguguuacuauguuacuaauguugcuuccgacagcauuggccuuccaucuaacuacccgcgguggagaaccgcauaugauuguuagcaaacaagaaagaggaaagagcuuauuauucaaaacgucggugggaguuaauauguguacgcuaauagcaauggacuuaggcgaacucugcgaagauaccaugaccuauaaauguccaagaauaacugaagccgaaccagacgauguugacuguugguguaaugcaacagacacguggguaacguacggaacuuguucacaaacgggagaacaccggagagacaaaagaucaguagcucuugccccgcacguaggucuaggccuagaaacgcggacagaaacauggaugaguagugagggcgcauggaaacaaauacaaaaaguggagacuugggcauuacgucacccaggauuuacgguuauagcacuuuucuuagcgcaugcaaucgggacuagcauaacccaaaaagguauaauauuuauacuuuuaauguuagucaccccuuccauggcgaugagaugcguuggaaucggaaaccgagauuuuguugaaggacuuucaggagcaacauggguugaugucguauuggaacauggaucguguguaacaacaauggccaaaaacaaaccaacccuugacauagaauuauuaaaaacugaaguuacaaaucccgcuguccuaagaaaauugugcauagaggcaaaaauaagcaauaccacgacugauaguagaugccccacgcaaggugaagcuacccuaguagaggaacaagaugcuaacuucgugugcagaagaacuuuuguagauaggggcuggggaaauggcugcgggcuauuuggaaaagguucguuacuaacaugcgcaaaauuuaaaugcguaacgaaacuggaagggaaaauuguucaauacgagaaccuaaaauacagcguaauaguaacagugcacacuggagaucaacaucaagugggcaaugaaacaacggaacacggaacaaucgcuacaauaacuccacaagcgccaacuucagaaauacaacuuacugacuacggugcacugaccuuagauuguucaccucgcacagggcuugacuucaacgaaaugguacuccuuaccaugaaagagaaaaguuggcuuguacauaagcaaugguuucucgaucugccacucccguggaccagcggagcaucaacaucacaagaaaccuggaaccgccaagaucuccuugugaccuuuaaaacggcucacgccaagaaacaggaaguaguaguauuaggaucacaagagggagcaaugcauacagcauuaaccggugcaacggagauucaaaccucgggaacaaccaccauauucgcggggcaccugaaauguagguugaaaauggauaaacuaacuuugaaaggaaugaguuacguaauguguacuggcaguuuuaagcucgaaaaagagguugccgaaacucagcaugguacagugcucguccaaguaaaauaugaaggaacagacgcuccuugcaagaucccguuucucacacaagaugaaaaaggagucacucagaauggcagacucauuacagcuaacccaaucguaacagauaaagaaaagccuguaaacauagaaacagagccuccuuuuggcgagucauauaucguugucggcgcaggagaaaaagcacugaagcuaucuugguuuaagaaaggguccagcauaggcaaaauguucgaagcgacugcuaggggugccagacgcauggcaauacuaggggauacagcgugggauuuuggaagcauuggagguuuauucacaagugucggaaaacuuauucaccaaguuuuugggacagcauauggaguuuuauuuucgggcguaaguuggacaaugaaaauagguauugguaucuuacucacaugguuaggccugaauagucggucaacgucuuugaguaugacaugcauugccgugggcaugguaacucuuuaucugggagugaugguacaagcagacagugguugugugauuaauuggaaagguagagaacuaaaaugcgguagugguauauuuguaaccaaugaaguacauacauggacugaacaguauaaguuccaagcagauucuccgaaacgacuuucggccgcaauaggaaaggcuugggaagaagggguaugcggaauaaggagcgcgacaagguuagagaauauuauguggaagcaaauuuccaacgaauuaaauuauauccuacuagaaaaugacaugaaauucacaguugucguuggugacgcuaacggcauucuagcacaaggaaagaaaaugauaagaccucagccaauggaacauaaauauagcuggaaaaguugggguaaagcgaaaauaaucggcgcagacauacaaaauacuaccuuuauaauugacgguccggacacuccggaaugucccgaugaccagagagcuuggaacauaugggagguggaagauuacggcuucggaaucuuuacuaccaacaucuggcuaaaacuucgagacucgcacacccaaaugugugaccaucggcugaugagugcugcaauaaaagauagcaaagcuguccaugcugauaugggauauuggauugaaucugagaagaacgagaccuggaaauuggcgcgugcuagcuuuauagaaguuaaaacauguaucuggccaaaaucucauacuuuguggucaaauggagucuuggaaucggaaaugaucauuccaaagauauauggcgguccaaucucgcaacauaacuauaggcccggcuauuuuacgcaaacagcugggccguggcaccuaggaaaauuagaauuagauuuugaucuaugugaaggaacgacagucgugguagaugaacauuguggguauaggggccccagccucaggaccacaacuguaacagguaaaauuauacacgaauggugcugcagaaguugcacauugccuccacuaagauuuaggggugaggauggauguugguauggaauggaaauuagacccguaaaagaaaaagaagagaacuuaguccguuccaugguaucagccgggucgggagaaguagacucuuucucauuaggcauacucuguguaucaauucuuauugaggaaguaaugcguagccgguggucacgaaaaauguuaaugacuggaacguuagcgguauuucuccucuuaauuaugggacaauuaaccuggaaugaucucauacggcuauguauuaugguaggagcaaaugccucagaccgcaugggaauggguacuacauacuuggcucuaauggcaacuuucaaaaugcggcccauguuugcugugggauuguuguucaggcgauuaaccucccgugaaguacuucuuuuaacuauuggccucagucugguagcgaguguagaauuaccgaacaguuuagaagaacuaggagacggccuugcuauggguauaaugauguugaagcuacuuacugauuuccaaccucaucaauuauggacaacguuauuaagucuaacuuuuauaagaacaaguuugucauuagauuacgcauggaaaacaauggcgauggcacuaucaauaguguccuuauuuccucucuguuuguccacaaccagucaaaagaccacuugguuacccguucuguugggaucauuuggaugcaaacccuugacuauguucuuaauuacagaaaacaagauauggggaagaaaaaguuggccaauuaaugaaggaauuauggcgguuggaauagugaguauacucuuaagcaguuuacucaaaaaugauguaccucuagccggucccuugauagcgggaggaaugcuuauugccuguuauguaauaucuggaucaucugcagaccuuucacuagaaaaggcugcugaaguaaguugggaggaagaggcugagcacaguggcaccucccauaauauauuaguagaaguucaagaugacggaacgaugaaaauuaaggaugaggaaagagacgauacauuaacaauauuauuaaaagcaacccuuuuagcagccagcggaguuuacccaauguccaucccagcgacccuauucguaugguacuucuggcagaagaagaaacagagaucaggaguccucugggacacaccuuccccaccagaaguugaaagagcuguucuggaugacggcauuuauagaauccuucaacgggguuuacuaggaagaagucaaguugguguuggaguauuucaggauggcguauuucauacaauguggcacguuacacgcggugccguguugauguaucaaggaaaacgauuagaaccaaguugggcuuccgucaagaaagaucucauaagcuacgggggaggcuggagauuccaggguaguuggaauacuggagaagaagugcaaguaauagccguagaaccagggaaaaaccccaaaaacguucaaacaacccccgguaccuuuaagacaccagaaggugaaguaggagcaaucgccuuagauuucaaaccagggacaucuggaucucccauaguaaaucgagagggaaaaauaguuggcuuauauggaaacggggugguaacaaccaguggaacauacgugucagcuaucgcgcaggccaaagcgucacaagagggaccacucccggaaaucgaagaugaggucuuuaagaaacguaaucuaacgauaauggauuugcauccgggcaguggaaaaacuaggagauauuuaccagcuauaguucgcgaggcgauaaagagaaaauuacgaacccugauacuagcucccacucguguaguagcaagugagauggcggaggcacugaaaggaaugccuauccgauaccaaacaacggcaguaaaaucagaacacacagggcgagaaaucguugaccuaaugugucaugccacauucacuaugcgucuacuuucaccaguucggguuccaaauuauaacaugauaaucauggaugaagcacacuuuaccgauccugcgucaauagcggcucguggauauaucucgacaagaguaggaaugggagaagccgcagcaauuuuuaugacagcuacgccaccgggaucugucgaggcuuuuccacaaaguaacgcggucauucaagaugaagaaagagacauaccggaaagaucuuggaacuccggauacgacuggauuacggacuuuccgggcaaaaccguaugguuuguacccaguaucaagagcggaaaugacauagcgaacugcuuacgaaagaacgguaaaaggguaauccaacuuagcagaaaaacauucgauaccgaauaucaaaagacuaaaaauaacgauugggauuauguuguuacuaccgauauaagugagaugggcgcgaauuuuagagcggacagggugaucgacccuagaaggugucuaaaaccggugauccuuaaggacggaccggaacguguaauccuagccggaccuaugcccgugacuguagccagugccgcucagagaagaggucguauuggcagaaaucaaaacaaagaaggugaucaauacauuuauaugggacaaccacuuaauaaugacgaagaucacgcucauuggacugaagccaagaugcucuuagauaauauuaacacgccagaaggaauaauaccagcgcuauucgaacccgaacgcgagaaaagcgcagcaauagauggagaauaucgauuaagaggcgaagcacgcaagacauuuguagaacugaugaggcggggugaucuacccguuuggcuaucauacaaaguggccagcgaaggcuuucaauauagugaucgucgauggugcuuugacggggaaaggaauaaccaggucuuagaagaaaacauggacguagaaauauggacgaaagaaggagagcgcaagaaacuuagaccccgauggcuugacgcucguacguacucagauccuuuagcacuccgggaauuuaaagaauuugcagcgggaaggagaucugugucaggcgaucuuauuuuagaaauuggaaaacuuccacaacacuuaacucuuagagcucagaaugccuuagauaaucuggugaugcuacacaacagugagcaaggaggcaaggcuuacagacacgcgauggaagaguugccugauacaauagaaacuuugaugcuacucgcacucauagcaguacugacagguggaguaacgcuauuuuuccuaucaggaaaaggucugggcaaaaccucaauaggacuguuauguguaauggcuuccagcgcucuuuuauggauggcgucuguugagccgcauuggauugcagcaucuaucauauuggaguucuuuuuaaugguacuuuugauacccgagcccgaccgacaaagaacuccucaagacaaccaauuggcauauguuguuaucggacucuuauucaugauucuuacuguagcggccaaugaaauggguuuacuugaaacaacuaagaaggaccucggcauaggucauguggccgcggaaaaccaucaucacgcaacaaugcucgaugucgauuuacauccagcaucggcauggacacuauaugccguagcaacgacuguuauaacaccuaugaugagacacacaauugaaaacacaacggcgaauauuucuuugaccgccauagcuaaucaagcagccauucuaaugggccuagauaagggauggccaauaucaaagauggauauaggaguuccucuucuagcgcucgggugcuauucacaagucaacccacuuacucuaaccgcagcgguucuaaugcuaguugcucauuacgccauaauagggccaggccuacaagcgaaggcaacaagagaagcccagaaaagaacugcagcggggauaaugaaaaauccaacugucgaugguauaguuacgaucgauuuagauccugucguauacgacgcaaaauuugagaaacaacuuggucaaauuaugcuauuaauuuuguguaccucacaaauauugcuuaugcgcacgaccugggcgcugugugaauccaucacgcucgcaaccgggccauuaacaaccuugugggaaggaucaccagguaaauucuggaauaccacaauugccguaucaauggcuaacauauucagggggagcuacuuagcaggagcgggauuagcuuucucucuuaugaaaaguuuagggggugggagaagggguacaggggcacaaggggaaacucuaggugagaaguggaaaagacaacuaaaccaacuaaguaagagugaauuuaacaccuauaaaaagucgggcauuauggaaguugauagaucggaggcgaaggaaggguuaaaacgaggagagacaaccaagcaugcgguaucucggggcacagcaaagcucaggugguuuguagaacgcaaccuggucaaaccagaagguaaagugaucgauuugggaugcggccgcggcggauggaguuauuauugugcuggacuaaagaaaguuacagaagucaaggguuacacgaaagguggcccaggucaugaagaaccaauaccgauggcgacguacgguuggaaccuaguaaaauugcacagcgggaaagauguauucuuuacaccgccagaaaaaugugacacacuccuaugcgacauuggagaauccuccccaaacccuaccauagaggagggaagaacauugcgaguuuuaaaaaugguugaaccaugguuaagaggaaaccaauucuguauuaaaauauuaaacccuuauaugccaagugucguggagacuuuagaacaaaugcaaaggaagcaugggggaauguugguuagaaaccccuuaagucgaaauucaacccaugaaauguacugggugagcugcggaacaggaaauauagucagugccgugaauaugacaucuagaaugcuacuaaaucgauuuaccauggcacaucguaaaccaaccuaugaaagagacguugauuuaggcgcaggaacucggcacgucgcggucgaaccggaaguagcuaaccuugacaucauuggacaaagaauagagaacauuaagaaugaacauaaaagcaccuggcacuaugacgaagauaauccguauaaaacaugggccuaccauggaagcuacgagguuaaguccucuggaucugcuucgagcaugguaaacggugucguacgauugcuuaccaaacccugggaugucauaccuauggucacucagauugcgaugacggauacaacacccuucgggcaacaaagggucuuuaaagaaaaaguugauacuagaaccccuagagcgaaacggggaacugcccaaaucauggagguaacugcuaaauggcuauggggauucuuaucaagaaacaagaaaccuagaauuugcacgcgggaggaauuuacaagaaagguaagaaguaaugcagccauuggugcaguauuugucgaugagaaucaauggaacucggcuaaagaagcgguugaagacgaaagguuuugggaccugguacaccgugaaagagagcuacauaagcaggguaaaugcgccacauguguuuauaauaugaugggcaaaagagagaagaaacuuggagaauuuggaaaagcuaaggggaguagagcaauaugguacaugugguuaggugcgagauuucuggaguuugaggcacuaggauucaugaaugaagaucauugguuuaguagagaaaauucucugucugggguugaaggagaagggcugcacaaacuaggcuacauccugagggauauauccaagaucccaggugguaauauguaugcagaugacacggcgggaugggauacgagaauaacagaggaugauuuacaaaaugaagcaaagauuacugauauaauggagccugagcacgccuuguuagcaacaaguauauuuaaacugacauaccaaaacaaaguaguacggguccaacguccagcgaaaagcggcacaguaauggaugugauaucaagaagagaucagcgagguucuggacaaguuggaacuuauggucuuaauaccuucacuaauauggagguacagcucauuagacagauggaaucggaaggcaucuuuuccccuuccgaacuugagacaccuaaucuugcaaagcguguauuagauugguuagaaaaacacggagcugaacggcuuaaaagaauggcaauaaguggagacgacugcguggucaagccuauagaugacagauuugcgaccgcacuuacugcccuaaaugacaugggaaaagucagaaaggacauuccucaaugggagccuucgaaaggcuggaacgacuggcagcaaguaccauuuuguagucaucauuuucaucaauuaauuaugaaggaugguagagagauaguggucccauguaggaaccaagaugagcugguaggcagggccagagucucacaaggagcuggguggucacuacgagaaacugcauguuuagguaaaagcuacgcucaaauguggcaauuaauguacuuucaucguagagaccuucggcuggccgcaaaugcuaucuguagcgcaguuccaguggauugggucccaacuucgagaacaacauggucuauccaugcgcaucaucaguggaugacaaccgaggauaugcucucaguguggaauagaguauggauagaagagaauccuuggauggaggauaaaacacauguuagcagcugggaagaaguaccauaucuagggaaaagagaggaccaguggugcgggucucuuaucggauugacugcgagagcaacuugggcuacgaacauucaaguagcaauaaaucagguucgcagguuaauagguaacgaaaauuacuuagauuacaugacgaguaugaaaagauucaaaaacgaaagugauccugagggagcauuaugguaa

SEQ ID NO: 21130 - RNA, 9879 nt, Artificial Sequence
  derived and/or modified CDS sequence (opt6) from DENV-1__FJ850071__SS-prME
aguguuacuauguuauugauguuauuaccgacggcuuuagccuuccauuuaacgacuagaggaggagaaccccauaugauaguaucaaaacaggaaagaggaaaaaguuuauuauuuaaaacaucagucggagugaacaugugcacacuaauugcuauggaccucggcgaacuuugcgaagauacuaugacauauaaauguccgagaauaaccgaagcugagcccgacgacguugacugcugguguaaugcuacagacaccuggguaacauaugggacgugcucgcaaacaggagaacaucgaagagauaaacgcagcguagcguuagcuccccaugugggcuuaggacuagaaacacgaacggagacuuggaugaguagugaaggcgccuggaaacaaauacaaaaaguagaaacaugggcacuucgacauccugguuuuaccgucauagcuuuguuuuuagcgcacgcuaucgguacaaguauaacucaaaaaggaauaauauucaucuuacuaauguuagucaccccuucgauggcaaugagaugugucggaauagggaaucgcgacuucguugaaggauuaucaggagccacuugggucgauguaguucuagagcacggauccugcguuacuacaauggccaaaaauaaaccaacacuagacauugaacuuuugaaaacagaaguaacaaaucccgcuguacuucgaaaauuaugcauugaagcaaaaauuaguaacacaaccacagacagccgcugcccaacccaaggcgaagcuacucuagucgaagaacaagaugcaaauuucgucugcagacgaacuuuuguagauagaggcuggggaaaugguuguggucuguuuggcaaagguagucuguugacaugugccaaauuuaaaugcguuaccaaacuagaagguaaaauuguacaauacgaaaaucuaaaauacaguguaauugucacaguucauacgggagaccaacaccaaguugggaacgaaacuacagaacauggaacaaucgcgacuauaacaccacaagcaccaacuagcgaaauacaacuaaccgauuauggugcacuaacacuugauugcucaccccguacuggacuagauuuuaacgaaaugguacuacuaacgaugaaagagaaaaguugguugguacauaaacaaugguuucuugaucuacccuuaccuuggaccaguggcgcaucaacaucgcaagaaacuuggaauaggcaagaucuauugguaacauuuaaaacagcgcaugccaagaaacaagaaguugucgucuuaggaagccaagaaggugcaaugcauacugcauugacuggggcaacugaaauccaaacaucggggacaacgacuauuuucgccgggcaucugaaaugcaggcuuaaaauggauaaacugacauuaaaagguaugaguuacguaauguguaccggaucuuuuaaauuggaaaaggaagucgccgaaacucaacauggaacgguucuggugcaaguaaaauaugaagguacugaugcaccgugcaaaauaccuuuucuuacacaagacgagaagggcguaacacaaaauggaagauuaaucacagcaaaucccauagugacugacaaagagaagccuguuaauauugagaccgaaccgccauuuggagaaucuuacauagugguaggagcuggugaaaaagcucucaaguuaaguugguuuaaaaagggaaguucuauugguaaaauguucgaagcaacagcccgcggugcaagacguauggcuauucucggggauacagcuugggauuucggaagcauaggcggucuauucacuucuguaggaaaauuaauccaucaaguguuugggacagcguacggcguacuuuucagcgguguuaguuggacaaugaaaaucggaauuggaauauuauugacauggcuagguuuaaauucgcgcaguacaucauugucuaugacuuguauugccguagggaugguaacacuauaucuaggaguuaugguacaagcggauagugguugugucauuaacuggaagggacgagaacugaaaugcggaucuggcauauuuguuacaaaugaaguacauaccuggacagaacaauauaaauuucaagcagauagcccaaagaggcucagcgcagcaauaggcaaagcgugggaagaaggugucuguggaauacgaagugcgacuagauuagaaaauauaauguggaaacagauaagcaaugagcuaaacuauauccuuuuagaaaaugauaugaaauuuacgguagugguaggagaugcaaaugguauacucgcucaaggcaaaaagaugauacgaccacagccaauggaacacaaguacucauggaaaucauggggcaaagcgaaaauaauuggagcugauauucaaaauacaaccuuuaucaucgacggaccagauaccccagaaugccccgacgaucaacgugcuuggaauauaugggaaguugaagauuauggauuuggcauauuuaccacaaacaucugguuaaaacucagagauucccauacccaaaugugugaucaucgauugaugucagcugcgauuaaagauagcaaagcuguacacgcagauaugggguacuggauagaaagcgaaaagaaugagacuuggaaauuagcacgagcgaguuuuauagaaguaaagacauguauauggccuaaaagccacacauugugguccaaugguguauuagagagugagaugauuauccccaaaauuuacggaggaccuauaucgcagcauaacuauagaccaggauauuucacccaaacagcuggaccuuggcaccucggaaagcucgaauuggacuuugaccucugugaagguacuacaguuguagucgacgagcauugugguuaucgagggccguccuuaagaaccacuaccguaaccgggaaaaucauccacgaauggugcugccguucguguacauugccacccuuacguuuuaggggcgaagauggaugcugguacggcauggagauaaggcccguuaaagaaaaggaagaaaauuugguucgauccauggugagugcagguagcggcgagguagauucauuuagccuuggcaucuuguguguaagcauauuaaucgaggaggugaugagaaguagauggucuagaaaaaugcucaugaccggcacuuuggcagucuuuuucuuauugauuaugggacagcuuaccuggaaugauuuaauaagacuuuguauaauggucggcgcgaacgccagugaucguaugggaauggguacuacauaucuagcguuaauggcaaccuuuaaaaugagaccuauguucgcugugggacuuuuauuucgaaaauuaacgucaagggaaguuuuacuucuaacuaucggauugagccuaguugccucaguagaauuaccuaacucguuagaagaauuaggagacggucuugccaugggaauuaugaugcuaaagcucuugacagauuuccaaccgcaccaauuguggacaacucuccuuaguuuaacuuuuauacgcacaagccucagcuuagacuacgcguggaaaacuauggccauggcguuaucaauuguaucacucuucccacucugccuguccacgacaucacagaaaacaacuuggcuaccuguacuacuugguucguuuggcugcaagccacuaacaauguuuuuaauuacagaaaauaaaaucuggggcagaaagucuuggccgaucaacgaagguauaauggcuguaggaauuguaucuauauugcugucuagccuauuaaagaacgacgugccucuggccggaccguugaucgcaggaggcaugcuaauagcguguuauguaaucucugggagcucagcagauuuaucuuuagaaaaggcagcugaagucucaugggaagaagaggcagaacauaguggcacaagucauaacauacugguagaaguacaagacgacgggacaaugaaaauaaaggacgaggaacgugacgauacacuaacuauacuucucaaagcaacauuauuagcaguaaguggaguauauccgaugucaauacccgcaacacuguucguuugguacuuuuggcagaagaagaaacagagaucuggcguacucugggauaccccuuccccgccagaagucgagagggcagucuuagacgacgguaucuauaggauauugcaaagaggauuguuaggcagaucucaaguaggugugggaguuuuccaagaugguguauuucacaccauguggcauguaacacguggugccguucuaauguaucaagggaaaagauuggaaccuucaugggcgucugucaagaaagauuuaaucucuuauggaggcggauggcgauuucaagguucuuggaauacgggggaagaaguacaaguuaucgcuguggaaccuggcaaaaauccaaagaacguacagacaacgccaggaacauuuaagacccccgaaggggaaguaggagccauugcccuggauuuuaaaccugguacaagugggaguccaauuguaaauagggaaggaaaaauagugggucucuaugguaauggaguagucacaacaaguggaacauacgugagugccauugcccaagcaaaggcaucacaagaagggccucucccagaaauugaagaugaaguauuuaagaaaagaaaucugacaauaauggaucugcauccagggucuggcaaaacgagaagauacuuaccugcuaucguucgcgaagcaauaaaaaggaaauuaagaaccuuaauucuagcuccaacucgcgugguagcuagugaaauggcagaggcguuaaaagggaugccaauaagauaccaaacuacagcagugaaaagcgaacacacuggucgagaaauaguugauuugaugugucaugccacauucacaaugcgccuguugucaccaguaagaguaccgaacuauaacaugauaaucauggaugaggcucacuucaccgacccagcuucgauagcugccagaggcuauauuagcacacgagucgguaugggagaagcggcagcuauuuucaugacugcaacuccgccugguaguguggaggcauuuccacaaucaaaugcaguaauacaagacgaagaacgugauauucccgagcgauccuggaauaguggauaugacuggauuacagacuuuccagguaaaacuguaugguuuguuccgucuaucaagucaggaaaugacauagcaaauugccuucguaaaaauggaaagcgugugauacagcuaaguaggaaaacguucgauaccgaauaucagaagacuaaaaacaaugauugggauuauguagugacuacggauauauccgagaugggggcaaacuucagagcagacagagucauugacccaagaagaugcuuaaagccugugauauugaaagacggacccgagaggguaauuuuagcuggucccaugccgguaacugucgcgagugccgcccaaagacgaggacgaauaggccguaaccaaaacaaggaaggugaccaauacaucuauaugggacaacccuugaauaaugaugaagaucacgcacauuggacagaagcgaagaugcuuuuagauaauauuaauacaccggaaggcauaauaccggcacuguuugagccggaaagggagaagucugcugcuauugauggugaauauaggcuuagaggggaagcaaggaaaacuuuugucgaacuaaugcggaggggcgauuugccaguuugguuaaguuacaagguagcauccgaaggguuucaauauucagaucgacguugguguuuugacggagaaagaaacaaccaaguacuagaagaaaacauggauguggagauauggacgaaggagggugaacgcaagaaauuacgaccucguuggcuugacgccagaaccuauucugacccacucgcguugcgagaauuuaaagaauuugcugcaggcaggagaagcgugagcggcgaccuaauacucgagaucggcaaacugccucaacauuugacauugcgcgcacaaaaugccuuagauaaucuuguaaugcuccauaauucagaacagggugguaaagccuaucggcacgcuauggaagaguuaccagauacaaucgaaacgcuaaugcuguuagcauugauagcaguacugacagggggaguuacauuguucuuucuuucugguaaagguuuagguaagacgucuauagggcuucuuugugugauggcaucuagcgcgcuauuauggauggcaucaguagaaccgcacuggauagcagcaucuauuauccuagaguucuuucugaugguucuucuaauaccggaacccgauagacagcggaccccacaagauaaucaauuagcguacguaguuauaggccuauuguucaugauccuaacaguugcugcgaacgaaauggguuuauuagaaacaacgaagaaagauuugggaaucggacacgucgcggcugaaaaucaucaucaugcuaccauguuagacguagacuugcgaccagcuagcgcuuggacacuuuacgcgguagcaacgacuguaauaacccccaugaugagacacacgauagaaaacacaacugcaaauauaucacuuacugcuauagccaaccaagcggcuauauuaaugggucucgauaaaggauggccaaucucaaaaauggauauuggugucccacuacucgcccucgguugcuacagccaaguuaacccguugacauuaacggcggcuguucucaugcucguugcacauuacgcaauaauugggccagguuugcaagcuaaagcaacaagggaagcacagaagagaacggcagcaggaauaaugaaaaaucccacaguagauggcauuguaacuauagaccuagacccaguaguuuacgaugcaaaguuugagaagcaacuugggcaaauaauguuguuaauucuaugcacaucccagauauuacuaaugcgaacaacaugggcucuaugugaaucaauaacacuagcaaccggaccauuaacuaccuuaugggaaggaucgccaggcaaguuuuggaacacuacaaucgcgguuaguauggcaaacauauuucgagguucauauuuagcuggugcaggacuugcuuuuagccuaaugaaaucuuugggcggaggaagaagggguacuggcgcacaaggagaaacgcucggagagaaguggaagagacaacucaaucaacucucuaaaucugaauuuaauacguauaagaaaagugggauuauggaagucgauagaucugaagcuaaagaaggauuaaaaagaggggagaccacaaaacacgcagucagcagaggcacagcaaaacuucgaugguucguugaaagaaaucuagugaagccugaagggaaagucauagaccucggauguggacgcggagguuggaguuacuauugcgcgggacuaaagaaagucacggagguuaaaggcuauaccaaaggagguccugggcacgaagaacccauuccuauggcuacauauggauggaaucuaguaaaacuucauucaggaaaggauguuuucuuuacaccacccgaaaaaugugacacgcucuuaugugacauaggcgaaucaucgccuaauccaacuaucgaagaggguagaacccuucgaguacuuaagaugguagagccaugguugcgcgguaaucaauucuguauaaagauuuugaacccuuacaugccuagcguagucgagacacuagagcaaaugcaacgcaaacacgguggcauguuaguuagaaacccgcuaucccgaaacucaacccacgaaauguauugggugucuugugggacagguaacaucguuuccgcaguaaacaugacgucucgcauguugcugaaccgcuucacaauggcucaccgaaaaccuacauaugaaagggacguagaucuaggagccgguacuaggcauguggccguagaaccugaaguggcgaauuuagacauaauaggucaacgaauagaaaauaucaaaaaugagcacaaaaguaccuggcauuacgacgaagacaacccuuauaaaacuugggcauaccacgguaguuaugagguaaagccgucugggucugcgucuuccauggucaacggcgucguacggcucuuaacgaaaccaugggacgugauaccaaugguaacacagauugcaaugaccgauacaacgcccuucggacagcaaagaguuuuuaaagagaaaguugauacuagaacaccacgagccaaaaggggaacggcacaaauuauggagguaacugcgaaaugguuauggggauuccuaagucgaaauaagaaaccaaggauauguacccgcgaagaguucacccggaagguaagaagcaacgcagcuauuggagcaguauucguggaugagaaucaauggaacucagcaaaagaggccguagaagacgaacguuuuugggacuuagugcauagagaaagggaauuacacaagcaaggaaaaugugcaacaugcguuuauaauaugaugggaaaaagggagaagaaauugggagaauuugguaaagcaaaggguuccagggcgauaugguauauguggcuaggagccagauuucuagaguucgaggccuuaggauuuaugaaugaagaccacugguucagucgugaaaacuccuuaagcggugucgagggggaaggucuccauaaauugggguauauccuccgggauauuaguaaaauuccuggaggaaacauguaugcagacgauacagcuggaugggauacaagaauuacagaagaugauuuacagaaugaagcaaaaauuacugauauaauggaaccggaacaugcuuuauuggcgacaagcaucuuuaaauuaacuuaucaaaacaaaguaguaaggguccaacgaccugcaaaaucugguacaguaauggacguuauaucaagaagagaucagagaggcagugggcaaguagggacuuacggauuaaauacuuucacaaauauggaaguacaauuaauaagacaaauggaaucggagggaauauuuucaccuagcgaauuggaaacaccuaauuuggcaaaacgcguguuagauugguuggagaaacauggggcggaacgacuuaaaaggauggcaauaucaggcgacgauugcguuguaaaaccaauagacgaucgauuugcuacugcgcuuacugcuuugaaugacaugggcaaaguaaggaaagacaucccacaaugggagccauccaagggauggaaugauuggcagcaaguuccauuuugcucgcaucauuuccaccaauuaauaaugaaagacggacgagaaauagucguaccaugccgaaaucaagaugaacuugucgguagagcacguguaucucaaggcgcuggcuggucucuccgugaaacugcuugucuaggaaaaucauacgcacaaauguggcaacugauguauuuucacaggcgcgaccucagauuggcagcaaaugcaauauguucggcagugccagucgauuggguaccaaccaguaggacgacuuggaguauucaugcccaucaucaauggaugacuaccgaagauaugcuaucgguauggaaucgcguauggauugaagaaaacccguggauggaagauaaaacacaugucuccagcugggaagaaguccccuauuuggguaaacgagaagaucaauggugcgguaguuuaaucgggcuaacugcaagagcaaccugggcgacgaauauacaaguagcuaucaaucaagugcguagacuaauugggaaugaaaacuaucuggauuauaugacaaguaugaagcgcuuuaaaaaugagagcgauccggaaggcgcgcuuugguaa

SEQ ID NO: 21131 - RNA, 9879 nt, Artificial Sequence
  derived and/or modified CDS sequence (opt6) from DENV-1__FJ850073__SS-prME
ucgguuacuaugcuauuaaugcuguuaccuacggcacuugcauuucauuuaacgacucgggguggggaaccgcauaugauaguuucgaaacaagagagaggaaaaucucugcucuuuaaaacaucggcugggguuaauauguguacguuaauagcuauggaucuuggugaacuaugcgaagauacgaugacuuauaaaugcccuaggaucacggaagcagagccugaugauguagacuguuggugcaaugcaacugacacguggguuacauauggaacuuguagucaaaccggagaacacaggagggauaaaaggucgguagcccuugcaccgcacguuggccuuggacuggaaacccgcacugagaccuggaugaguucggaaggagcauggaaacagauucaaaaaguugaaacuugggcguuaagacauccaggguucacuguaaucgcucuauucuuggcucacgcaauaggaacaaguauaacacaaaaaggcaucaucuuuauacuucugaugcucguaaccccgaguauggcgaugcgauguguuggcauaggaaaccgagauuucguagaaggauuaaguggagcaacuuggguagauguuguucuagaacauggcucauguguaacaacaauggccaaaaauaaaccuaccuuagauaucgaacuuuuaaaaacggaaguaacaaauccugcuguucuacgaaaauuaugcauagaggccaaaauuaguaacacaacuacugacucacgcuguccaacacaaggcgaagcaacuuuaguggaagaacaagacgccaacuucguuuguaggaggacuuuuguagauagaggcuggggaaacggcuguggacuauuuggaaaaggaucauuauuaacgugugccaaauuuaaauguguaacaaaauuagaaggaaaaauuguacaauacgaaaaucuuaaauauucuguaauaguaacgguucacacaggggaccaacaucaaguagguaaugagacaacugagcacggaacuaucgcaacuauuacgccacaggcacccacguccgagauucaauugacagacuacggggcgcuuacacucgacuguucaccgcgaacaggauuagauuucaaugaaaugguauugcuaacuaugaaagaaaaaucaugguuaguucauaaacagugguuccuagacuuaccgcuaccguggacaaguggagcgagcacuucacaggaaacuuggaacagacaggauuuguuagugaccuuuaaaacagcucacgccaagaaacaagaagucguaguacuugggucgcaagaaggagccaugcauacugcauuaacgggagccacagagauucaaacaucaggaacuaccacuauauuugcugggcacuuaaaaugucgauugaaaauggauaaguugacacuuaaaggaacuucuuacgucaugugcacaggaucauuuaaacucgaaaaagaagucgcugaaacucaacacgguaccguauuaguucagguuaaauacgaggguacagaugcgccauguaaaauucccuuuaguacucaagaugagaaagguguaacacaaaacggaagacuuauuacagcaaacccaauaguuacugacaaagaaaaaccagucaauaucgaaacugaaccaccauucggggagaguuauauugucgucggggccggagaaaaagcacuaaaauuauccugguuuaaaaaggguuccagcauagggaaaauguucgaagcuaccgcaaggggugcaagacgaauggcuauacuaggagacacugccugggauuuuggaagcauaggagggguuuuuacaagcgucgggaaguuaguucaucaaguauuuggcacagcguauggcguccuguuuagcgggguaagcuggacuaugaaaauaggaauugguauuuuauuaacauggcugggacuuaauucccgaucuaccucucuaaguaugacuugcauagcugugggcauggugacucucuaucuuggaguaauggugcaagccgacagcggguguguuauaaauuggaaagguagagagcuaaaaugcgguagcggaauuuucguaacuaacgaaguacauacauggacagaacaguacaaauuucaagccgacagcccuaagaggcucucugcggcaaucggaagggcaugggaggaaggcguguguggcauacgaagcgcaacccgacuagaaaacaucauguggaaacaaauuucaaaugagcuaaaucacauccuguuagaaaaugauaucaaguucaccguagugguaggcaacgcagauggcauuuuggcacaagguaagaaaaugauacgaccacagccgauggaacacaaguauucauggaagucuuggggaaaggcaaagauaauaggggcagauauucaaaauacgacauuuaucaucgacggaccugauacauuagaauguccggacgaacaacgcgcuuggaauauuugggaaguagaagauuacgguuuugguaucuuuacaacgaacauuuggcuaaaacuacgcgauagcuauacacaaaugugugaucauaggcuaaugucagcugcaauaaaggauucaaaggcuguacaugcugauaugggauauuggauagaaucagagaaaaaugaaacguggaaauuagcccgcgccagcuucauagaggucaagacauguauauggccuaagagucacacccuuuggucaaacgggguauuagaaucugaaaugauaauaccaaaaauguauggaggaccuguuucccaacacaauuaccgucccggguauuuuacacaaacagcuggucccuggcacuuggguaaauuagaacuugauuucgaccuaugugaaggaaccaccgucguaguagaugaacauugugggaguagggguccaucguugagaacaacaacgguaaccgguaaaaucauucaugaaugguguuguagguccugcacauuaccgccguuaagauuuagaggagaggauggcuguugguauggaauggaaauacgaccagucaaagagaaagaagaaaaucucguuagaaguaugguuucugcaggaucuggagaaguagauucauuuaguuuaggcguacucuguguauccauuaugauugaagaaguuaugcgauccagauggagucguaaaaugcuaaugacagguacacuagcaguauuuuuguuacuaauaaugggucaacucacauggaaugaccuaauccgauuaugcauaauggugggugccaacgcaucugacaagauggggaugggcacuacuuaucuagcccuaauggcuacuuucaagaugcggcccauguuugcggucggguuacuuuuuaggcgacuuacuagcagggaaguacuccuacuuacgauaggucucagcuuaguagcuucaguagaauuaccuaacucccuagaggaacuaggagauggucuagccaugggcauuaugaugcuaaaacuauuaacagaauuucaaccacaccaguuguggacgacacuucuaagccuaacguuuauaaaaacaacguuaucuuuagauuaugcuuggaaaacaacagcgaugguccucucaauaguuucucuauuuccuuugugucuauccacgacgucacagaaaacuacuuggcuaccuguuuuguuagggucuuuugguuguaagccauuaacgauguuccuuauaacagaaaaugagauauggggaagaaaaagcuggccauugaaugaaggcaucauggcgauagggauaguaucgauuuuguuaucgucucucuugaaaaacgauguuccacucgcgggaccauuaauugcgggcgguauguuaauugccuguuauguuauaagugguaguagcgccgaccuaucauuagagaaagcggcugaaguaucgugggaagaagaaguagaacauucggguacaagucacaauauccuaguugaaguccaagaugaugguacuaugaaaauuaaggaugaagaacgcgacgacacccugacuauacuacuaaaagcuacacuuuuagcagugucgggcguguauccuaugagcaucccugccacuuuauucguaugguauuuuuggcaaaagaagaaacaacgaagcggaguauuaugggauacuccuucacccccugaaguagagcgcgcugucuuggacgauggcauauacagaauccuccaacggggguuacucggaagaucacaaguaggaguuggaguauuucaagauggaguauuucacaccauguggcacguaacccgcggagcugugcuuauguaucaggggaaacgauuagaaccaaguugggcuucgguaaagaaagaucuuauuucauauggugguggauggagauuccaagguuccuggaacacgggagaagaaguacaaguaauagcuguagagccaggcaaaaaucccaaaaacguccagacgacaccgggcaccuuuaaaacaccugagggagaaguaggagcaauagcucuagauuuuaaaccgggcaccaguggaaguccaauaguuaauagagaaggaaaaauaguuggacuguauggaaacgguguagucacaacgagcgggacauacguaucggcuauugcacaagccaaagccagucaagaggguccacugccagaaauagaagacgaaguauuuaagaaacgaaaccuaacaaucauggauuuacacccaggaucuggaaaaacacgaagauaucuaccagcaaucgucagggaagcuauuaaacgaaaauuacguacacuaauucucgcuccaaccaggguuguagccucagaaauggcggaagcacugaagggaaugccaauucgauaucaaacaacagcgguuaagagcgaacauacaggacgugaaaucguggaccuuaugugucaugcaacuuucacuaugagguuacuaucuccugucagagugccgaacuacaacaugauaauuauggacgaggcucauuucaccgaucccgcaagcauagcugccagaggauauauaucuacucgaguagguaugggagaagcagcagcaauuuucaugacugcgaccccuccaggaucaguggaggcuuuuccccagucaaaugcaguaauacaggacgaagagagagauauuccggagcggucguggaacaguggauaugacuggaucacugauuuuccuggcaagacugucugguuuguuccuaguauaaaaucagggaacgauauagccaacugcuuaaggaaaaauggcaagagggugauacaauuaagucgcaagacauuugauacagaauaucagaaaacuaaaaacaacgacugggauuacgugguuaccacggauauaucggaaaugggagcaaauuuucgagcugaucgugucauagacccacggcgaugccucaaaccaguaauacuaaaggacggucccgagcgcguaauauuagcagguccuaugccaguuacagucgcaucugcagcucaaagacgugguaggauugggaggaaccaaaauaaagaaggagaucaauacgucuauaugggucaaccguuaaauaaugacgaagaccaugcucauuggacugaagcaaagauguuacuggauaacauaaauacaccagaaggaaucauaccugcgcuauucgagccagaaagagaaaaaucugcggcaauagacggugaguaucgucugcgaggugaagcaagaaaaacauuugucgaacuuaugcgacggggugauuuaccaguauggcucagcuacaaaguagcaagugagggauuccaauacucugacagacguugguguuucgacggggaacgcaacaaucaaguacuugaggagaauauggauguagaaaucuggacgaaggaaggcgaaagaaagaaacuucgaccucgcugguuagaugcucguacauacagcgauccucuugcguuacgcgaauuuaaggaguucgcugcagggagacgcucugucuccggagaucucauucuugaaauugguaaauuaccccaacacuugacucuacgcgcacaaaacgcacuagauaaccuaguaauguuacacaauucugaacaaggaggaaaggcuuaucgacacgcgauggaggaauuaccagacacaauugaaacucuaaugcuguuagcuuuaauggcagugcucacggguggggucacauuauucuuucuaucagguaaagggcuuggcaaaacaagcauuggacuauuguguguaauggcuucaagugcauuauuauggauggcaaguguugaaccacauuggaucgcagcaucgaucauucuugaguuuuucuuaaugguuuuacucauaccugaacccgauagacaaagaacaccacaggauaaccaacuagcuuauguaguuauaggucucuuguuuaugauccuuaccguagccgccaaugagaugggucuguuggaaacgacuaagaaagaucuagggauaggacauguggcggccgaaaaucaccaacacgcuacuauguuagaugucgauuuacauccggcaagcgccuggacacuauaugcgguugcaacgacagugaucaccccaaugaugaggcauacaauagaaaauacuacagccaauauaaguuuaacggcaaucgcuaaucaggcggcuauucucaugggauuagacaagggauggccaauaucuaaaauggaccucggaguuccauuacuggccuuagguuguuauagucaaguuaacccgcuaacguugaccgcugcuguacuuaugcuuguugcacauuaugcaauaaucggacccggguuacaagcuaaagccaccagagaagcacaaaaacgaacagcggcaggcaucaugaaaaacccaacaguggaugguauaguagcaauugaucuggacccuguagucuaugaugccaaauuugagaagcaauuaggacagauaauguuacucauacuuuguacgagucagauauuguugaugaggacuacaugggcucuuugcgaguccauaacuuuagcuacagggccucucacuacacuuugggaagguaguccgggcaaauucuggaacacuacuauagcuguaagcauggccaacauauuccgaggauccuauuuagcuggagccggacuggcuuucucauuaaugaaaucucucggcgguggucgaaggggaacaggggcucaaggugaaacacuaggagaaaaauggaaaagacaacucaaucaauuaucuaaaucagaauuuaacacuuauaaaaggucaggcauaauggaaguagaucggucagaggcaaaagaaggccuaaaaagaggcgaaacaacaaaacacgcggucucuagaggaaccgccaaauuaagaugguuugucgaaagaaaucugguuaaaccugaagguaagguaauugaucuaggcuguggacgggguggcugguccuauuauugcgcaggacugaagaaaguaacugaagugaagggauauaccaaaggagggccaggacacgaggagccaaucccaauggcuacauacgguuggaaccuggugaaauuacacagcggaaaagauguuuucuucaugccacccgagaaaugugacaccuuauugugugauauuggcgagucaucuccuaacccgacaauagaggaagguagaacauugagaguucuaaaaaugguagaaccguggcuaagagggaaccaguuuugcauaaaaauccucaauccguauaugccaucuguaguagaaacuuuagaacaaaugcaacgcaaacauggaggaauguuagucagaaauccuuuaucaagaaacaguacucaugaaauguauuggguuaguuguggcacaggcaacauaguuucagcuguaaacaugacaucucguauguuauuaaacagauucacgauggcccacagaaaaccuacauaugaacgcgacgucgaucucggugcuggaacgaggcauguagcgguggaaccugagguggcaaauuuggauauaaucggacaaagaauagaaaauauaaagaacgagcacaaaucaacauggcacuacgacgaagacaauccuuacaagacgugggcauaucaugguucauaugaaguaaaaccuucugguucggcaucuagcaugguaaauggggucgucagauuauugaccaagccuugggauguaauaccaaugguuacacaaauugcgaugacugacaccaccccuuucggacaacagcgaguguucaaagagaaaguugauacucguacuccacgagcuaagaggggaacagcacagauaauggaaguaaccgccaaaugguuauggggcuuccucucuagaaauaaaaagccaagaauuuguaccagggaagaauuuacgcgaaaaguuagaucaaacgcugcaaucggagcgguuuuuguagacgagaaccaauggaacagugcuaaagaagcaguugaagacgaaagauuuugggaccuaguucaucgugaacgggaauuacauaaacaagguaagugugcgacauguguuuauaacaugauggggaaacgggagaagaaacuuggcgaguuugggaaggcaaagggcagccgagcaaucugguauaugugguuaggcgcucgcuuucuggaguucgaagcacuaggguuuaugaaugaagaccacugguuuucaagggaaaacagucucagcggaguugaaggagaagguuuacauaaacugggauauauucuacgcgauauuucaaaaaucccaggaggaaauauguaugcagaugacaccgcuggcugggacacuagaauuacagaagaugacuuacgcaaugaagcaaagauaaccgauauaauggaaccugaacacgcgcuauuagccacaagcauauucaaauuaacguaucaaaacaaaguaguuaggguucaaaggccggcuaaaaaugguacgguuauggauguuauaucaaggagagaucagagaggaucuggacaagucgggacuuacggauugaauacauuuacaaauauggaaguacaacucaucaggcaaauggagucugaaggcauauucuucucgucagaacuugaaucccccaacuuggcagagaggguguuagauuggcuugaaaagcacggagcagaacgucuuaaaagaauggcuauuaguggcgaugacugcgugguaaaaccuauagaugaccgauucgcaacggcccucauugcgcuuaacgacauggguaagguacgaaaggauaucccucagugggaacccucaaaaggcuggaacgacuggcaacagguaccuuuuuguucacaccacuuccaucaacuaaucaugaaagacgggcgagaaauaguaguuccuuguagaaaucaagaugaacuuguaggcagagcaagaguaagucaaggagcgggauggagucuccgggaaaccgcuugccucgggaaaucauaugcacagauguggcaauuaauguacuuucaccgacgggaccuucgacuagcagccaacgcuauuuguagcgcagucccagucgacuggguucccacaagucguacuacguggucuauucacgcgcaucaucaguggaugaccacugaggauauguuaagcguauggaauagaguauggauagaagagaaucccuggauggaagacaagacacacguaucaucaugggaggaaguaccuuaucucggcaaacgugaagaucagugguguggaagucucauuggacuaacagcacgagcaacaugggcuacuaacauacaaguugcuauaaaccaaguacgaagacuaauaggcaauggcaauuacuuagauuacaugacgucaaugaaaagguucaaaaaugaaucugacccagagggagcacuaugguag

SEQ ID NO: 21132 - RNA, 9879 nt, Artificial Sequence
  derived and/or modified CDS sequence (opt6) from DENV-1__FJ850075__SS-prME
agcguuacaaugcuccuuauguuauuaccaacugcucuagcauuucauuuaacaacuagagguggagaaccgcacaugauugugucuaaacaggaaaggggaaaaagcuuacuguuuaaaaccucaguuggugucaauaugugcacacucauagcaauggaccugggugaacuuugugaggauaccaugacguacaaauguccucgaaucacugaggcugaaccggacgauguugacugcugguguaacgcaacggacaccuggguuaccuacggcacauguucgcaaacgggugagcauagacgggauaaacgcucuguagcacuggcuccccacguaggauuaggauuggagacacgaaccgagacuuggaugucgucagaaggagcauggaaacaaauucaaaaaguagaaacgugggcccuacgacacccgggauucacggugauagcucuguucuuggcccaugcaauaggcaccucgauaacacaaaagggaaucaucuucauacuccuaauguuaguaacuccuucaauggcaaugaggugcguggggauugguaaucgagauuuugucgagggcuugaguggggcaacauggguugacguugucuuagaacacgguaguuguguuacuacuauggcaaaaaauaaaccuacacuugauaucgaacuauuaaagacagagguuacgaauccagccgugcuaaggaaauuguguauagaagccaaaaucucaaauaccacuacagauuccagaugcccaacucaaggagaagccacccuugucgaagagcaggaugcaaauuucguuuguagaaggacguuugucgauagaggauggggaaacgguuguggccucuucgguaagggaagucuacugacaugcgcgaaauuuaaauguguaacuaaacuagagggaaaaauuguacaauaugaaaaucuuaaauacaguguuauaguaacgguacacacaggagaucaacaucagguugguaaugaaacuacggaacacggcacaauagcaacgauuacuccacaggcgccaacauccgaaauacagcuaacugacuacggggcuuugacauuagauugcaguccgcguacaggacuggacuuuaacgagaugguucuacuaaccaugaaagaaaaaucauggcuaguacauaaacaaugguuucucgaucuuccccuaccauggacaagcggggcaagcacaucgcaagaaacauggaacaggcaggacuuacuggugacauuuaagacggcucacgcaaagaagcaagaaguuguaguacuuggaucgcaagaaggugcuaugcauacagcauuaacaggagcgacugaaauacagacaucagggacaaccacuauauuugcaggccaucucaagugccgguugaaaauggacaagcuaacgcuaaaaggaaugaguuaugucaugugcacggguucuuucaagcuggaaaaagaagucgccgaaacgcagcacggaacagugcuuguccaaguaaaguaugaagggaccgaugcuccauguaaaauuccguucuugacccaagaugaaaaggguguaacgcaaaauggccgacucaucaccgcuaauccuauuguaacggauaaagaaaaaccuguuaacauugaaacagagccacccuucggggaaucauacauaguagucggagcuggugagaaagcguugaagcuaagcugguuuaagaaaggcuccucaauuggaaaaauguucgaagcuacugcuagaggagcaagaagaauggcgauccugggugauacugcaugggacuuugguucaauagguggacuauucacuuccguugggaaacucauccaucaaguauuuggaacugcuuaugggguacuauucucagguguuaguuggacaaugaaaauaggcauuggaauuuuguugacaugguugggguuaaauagucgaucgacuucacucaguaugacauguauugcaguagggaugguaacuuuguaccuaggaguaaugguucaagcggacucagggugcguuauaaauuggaaagguagagagcugaaauguggaucuggcauauuugugacaaaugaaguacauacauggacugaacaauacaaauuccaggcggacucaccuaaaagacucucggcagcuaucgguaaggccugggaggaaggcgugugcggcaucagaucagcuacgagauuagaaaauauaauguggaaacaaauuaguaaugagcuuaacuauaucuuauuagaaaacgauaugaaauucaccgucguugugggugaugccaauggcauuuuagcucagggcaagaagaugauccguccacagccgauggaacauaaauauucguggaaauccugggggaaggcuaaaauuauuggagcagacauccaaaauacgacuuuuauaauugaugguccggauacaccagaauguccggaugaucagagagcguggaauauaugggagguugaagacuacggguuuggaauauucacgacuaacaucuggcuuaaauuaagagauucacacacgcaaaugugcgaccauagacucaugucggcagcaauuaaagauaguaaagcuguucaugcagauaugggauauuggauugaaagcgagaaaaacgaaacuuggaaacuagcaagagcaucauucaucgaaguaaaaaccuguauauggccaaaaagccauacguuauggagcaaugggguauuagaaucagaaaugauuauaccuaagaucuacggcggaccuauuagccagcacaauuauaggccgggcuauuuuacgcagacugccgggccauggcaccuagguaaauuagagcuugacuuugauuuaugcgaagggacaacuguaguagucgaugaacauuguggcuaccgagggccgagucuacgaacaacuacagugacagguaaaacaauucaugaaugguguugcagaucguguaccuuaccgccguuacgauucaggggagaggacggguguugguaugguauggagaucagacccgugaaggaaaaagaagagaaucuaguacgaucuaugguauccgccggaagcggcgaaguagacagcuuuucauuggguauacuauguguuaguauauugaucgaagaaguaaugcgaagcagauggucccgaaagauguuaaugacagggacacuagcgguauucuuacuccuaaucaugggccaacucacguggaacgauuuaaucagauuguguauaaugguuggagcgaaugcgagcgacagaaugggcaugggaacuacauaucucgcucuaauggcaacauuuaagaugcgaccuauguuugcggugggguugcuauuuaggcgacuaacaaguagagagguucuacuauugacuaucggucuuucacucgucgcaaguguggaacuuccaaacucauuggaggaguuaggggacggcuuggcuaugggaauaaugaugcugaaacuucuaacugauuuccaaccccaucaguuauggacaacgcuuuuaagucucacguuuauucguacuaguuuaucacuugacuaugcguggaagacaauggccauggccuuauccauuguaagcuuguuuccguuaugccuuagcaccacuucccaaaaaacaacuuggcuaccaguauugcuagggaguuuuggcuguaaaccucuaacgauguuuuuaauaacagagaauaaaauuugggggaggaaaagcuggccaaucaacgaagguauuauggcgguaggaauuguuaguauucuauuaucaucucuauuaaaaaaugauguuccucuagcuggcccuuuaaucgcuggaggaaugcuuauagcaugcuauguaauuuccgguucaucugcggacuugucacuggaaaaagcugcggaaguauccugggaagaagaggcugaacacagcggcacaucucauaacauacuaguugaaguacaagaugacgggacaaugaaaauuaaagacgaggaaagagaugauacucuuacuaucuuguuaaaagcaacgcuuuuggcagucucagguguguaucccaugucaaucccagcaacucuuuuuguuugguauuucuggcaaaagaagaaacaacgguccggagucuuaugggauacuccaaguccacccgaagucgaacgggcuguacuagaugaugggauauaucguauacuacaaagaggucuccuaggaaggucucaagugggaguuggaguguuccaagacggaguuuuccauacuauguggcauguaacgaggggagcuguucucauguaucaagggaaaagacucgaaccuucgugggcaucagugaaaaaggacuuaauuaguuacggaggcggauggagguuucaagguucauggaauaccggugaagaaguccagguaauugcuguggagccaggcaaaaacccaaaaaauguucagacaaccccuggaacguuuaaaacaccagaaggagagguaggugcaauagcuuuagauuuuaaaccugguacaucgggaucuccaauuguaaaucgagaagguaaaauaguaggacuuuacgguaauggagucgugacgacuaguggcacauauguuucagcaauagcgcaagcuaaagcaucacaggaaggcccucucccagaaauagaggaugaaguauuuaaaaaaagaaacuuaacaauaauggauuuacauccgggaagcggaaagacacgccgcuaucuuccugccaucguacgagaagcaaucaagaggaaauuacgaacacuaauauuagcgccaacgcgugugguugcuucagaaauggcagaagcacucaaaggaaugccuauaagguaccagaccacagcaguuaaaucagaacacacagggagagagauaguagauuuaaugugucaugcgacuuuuacaaugagauuauuaucaccuguaagagugccaaauuacaacaugauuauaauggaugaagcucauuuuacagacccagcaucaauagcagcuagaggguauaucaguacgcguguaggcaugggagaagcugcggcuauauucaugacggcuacaccuccagguucuguagaggccuuuccgcaaagcaacgccguaauacaagacgaagagagagauauuccugaacgaucauggaacagcggcuacgauuggaucacugauuucccgggaaaaacagugugguuugucccgucaaucaaaucgggaaacgacaucgcuaauuguuuacgaaagaauggaaaacgaguaauacaacucucaaggaaaacuuuugauacugaguaucagaaaacaaaaaacaaugauugggauuacguaguaacaaccgauauaucagaaaugggcgcuaauuuuagggccgacagaguaauugauccgaggcgcuguuuaaaaccugucauauuaaaggacggcccagaacgggugauacuagcaggacccaugccugugaccguagcaucggcggcccaaagaagaggacguauuggaagaaaucaaaauaaagaaggugaccaauauauuuacaugggacaaccucuuaacaacgacgaagaucacgcacacuggaccgaagcuaaaauguuauuagauaauauaaacacuccagaaggaauuauacccgcauuguucgaaccggaacgugaaaagagcgccgcgaucgauggcgaguacaggcuuaggggcgaagcacgaaagacauuuguggaauugaugcguagaggagaucuuccuguuuggcuaucguacaaaguagcgagcgaaggauuucaguauucugaccgacgauggugcuuugauggcgaaaggaauaaccagguauuggaagaaaauauggacguagagauauggacgaaggagggggaaagaaaaaaguuaaggccgagauggcucgaugcgagaaccuauucggacccgcuagcacuaagagaauucaaagaauuugcugcuggccguagaucagugagcggagaccuaauacucgaaaucggaaaacuaccacagcauuuaacguuaagagcacaaaaugcuuuggacaaccugguaauguuacauaacuccgaacaaggaggaaaagcauaccgccacgcaauggaggagcuaccagauacuauugagaccuugauguugcuugcacuaauugcaguccuuacgggcggaguaacccuauuuuuuuuaagugguaaaggacuugggaagaccaguauaggccuccuaugugucauggcaucgucagcuuuauuauggauggcgaguguagaaccccauuggauagcagcaucaauaauccuagaauuuuuucuuaugguacuguuaauacccgaaccagauaggcaacgaaccccucaagacaaccaguuagcauauguaguuauaggguuguuauucaugauacucacugucgccgcaaacgaaaugggucuucuugaaacuacgaaaaaagauuuaggaauaggucacguugcugcugaaaaccaucaccacgcaacuauguuagacguagacuuaagacccgcuagugcauggacacucuacgccgucgcgacuacaguaauaacgccgaugaugagacauaccauagaaaacacaacagcgaauaucaguuuaaccgcuauagcgaaccaagcugcaauacugaugggauuagacaaaggcuggccgauuuccaaaauggauauuggaguaccucuacuggcacuagggugcuacucacaaguaaacccauuaacgcucacagcagcaguacugaugcuuguagcacacuacgcgauaauaggaccugguuugcaggccaaagcuacgagggaggcacaaaagagaacagcugcugggauuaugaaaaauccuacaguugaugguauagugacgaucgaucuagauccaguuguuuaugaugcaaaguuugaaaaacaauugggacaaaucaugcuguugaucuuaugcacaagccagauucuacuuaugagaacaacaugggcucuaugcgaaucuauaacauuagcaaccggaccccuuacuacgcuaugggaggggaguccaggaaaauucuggaauacaaccauagcugugaguauggcuaauauauuccguggaaguuauuuggcaggcgccggucuagcauuuucauuaaugaaaucauuaggaggugggaggcgcggaacuggagcacaaggagaaacauuaggagaaaaauggaaaaggcaacuaaaccagcuaucuaaaagcgaauucaacacauauaaaaaaucaggaauaauggaaguagaccgaucagaagcuaaagaagguuuaaaacguggagagacaacuaaacacgcagucucaagaggcaccgcgaaacuacgcugguucguagaaagaaaucucguaaaaccagaaggaaaaguaauugaucuaggauguggucgaggugguuggucauauuacugcgcaggccugaaaaagguaaccgaagucaaagguuauacuaaaggugggcccggucacgaagagccuaucccaauggccacauauggauggaaucucguaaaauuacauucuggaaaagacguauucuuuacgccgccugaaaaaugcgacaccuuacucugugauauuggcgaaucuagccccaauccgacaaucgaagaaggucgaacacuucggguauuaaaaaugguugagccgugguuacgagguaaucaguuuuguauuaagauauuaaacccauauaugccuagcguaguugagacguuagaacaaaugcagagaaagcauggugggauguuaguuagaaaucccuugaguagaaauaguacucaugagauguacuggguaucuugcggaacagggaacauaguaucagcaguaaauaugacaagucguauguuauuaaaucgauuuaccauggcacacagaaaaccuacguacgagcgugauguugaccucggcgccggaacaagacauguagcaguagaaccagagguagcaaaccuugauauaaucggccaaaggauagaaaauaucaagaaugaacacaagaguacuuggcauuaugacgaggacaacccuuacaagaccugggccuaucacgguucauacgaaguaaaaccaucagggucagcuucaucaauggucaacggaguagugcguuuauuaacgaaaccuugggacgucaucccaauggucacacaaauugcaaugacagauacaacaccuuuuggccagcaaaggguuuuuaaagaaaagguagauacacguacaccaagagcaaaacgcgguacagcgcaaaucauggaaguuacagcaaaaugguuguggggauuuuuaucaagaaauaagaaaccacguauauguacacgcgaggaguuuaccaggaagguacggucaaaugccgcgauaggugcagucuucguagacgaaaaucaauggaacuccgcuaaagaggcaguagaagacgaacgauuuugggacuuaguacaccgagaacgcgaacugcauaagcaagguaagugcgcaaccugcguauacaacaugauggguaagagagaaaaaaaacugggugaguucgggaaggcgaagggaagccgagcaauuugguauauguggcucggagcucguuucuuagaauuugaagcauuagguuucaugaaugaagaccauugguucucaagggagaauucauuauccggagucgaaggugaaggauugcacaaauuaggauauauuuuaagggauauuagcaaaauuccgggagggaauauguacgcagacgacacagcgggaugggauacaagaauaacagaagaugaucuacaaaaugaagccaaaauuacagauauaauggaaccugaacaugcacuacuggccacauccauauuuaaacugacauaccaaaauaaaguuguuagggugcagcguccugccaagaguggaacaguaauggacguaauuucgaggagagaucaacgaggaucuggacaagugggaacauauggccuaaauaccuucacuaauauggaaguucaacugauuagacagauggaaucugaagguauuuucaguccaagcgaacuggagacccccaaucuagcaaaacguguguuggacugguuagaaaaacacgggguagaaagacuaaaaagaauggcaauauccggggaugacugcguugucaagccuauugacgacagauucgccacagcccuaacugcuuuaaaugauaugggcaaaguacguaaggauauaccccaaugggagccgagcaaaggcuggaaugauuggcaacagguucccuuuugcucucaucacuuucaucaacuaauaaugaaagauggccgugagauuguaguacccugucgaaaucaagaugagcuuguuggacgugcaagaguaucccaaggagcgggguggaguuuacgggaaacagcgugccuagguaaaucauaugcacaaauguggcaguuaauguauuuucaucggagggaccuucgccuagcugcgaaugcuauauguucggcgguacccguagauuggguucccacgucaagaacuacuuggagcauacaugcccaucaucaauggaugaccaccgaagacauguuaucgguuuggaaccguguauggauagaagagaacccauggauggaggauaagacgcauguuaguucuugggaagaaguaccguauuuaggcaaaagagaagaucaauggugcggaucucugauugguuugacugcaagagcgacaugggccaccaauauacaaguugcaauuaaccaaguaagaaggcugaucggaaacgaaaacuaccuagacuauaugacaagcaugaaacgauuuaaaaacgaaagcgaucccgaaggagcguugugguga

SEQ ID NO: 21133 - RNA, 9879 nt, Artificial Sequence
  derived and/or modified CDS sequence (opt6) from DENV-1__FJ850077__SS-prME
ucaguuaccauguuguuaauguuauuaccaacugcacuugcauuccaccucacgacgagaggaggagaaccucauaugaucgucucaaaacaagaacgugggaaaucauuacuuuuuaaaacuucaguuggugugaauauguguacccuaauagcuauggacuuaggugaauuaugugaagauacgaugaccuauaaauguccccgaauuacagaaguagaacccgaugacgucgauugcuggugcaaugcaacagacacuuggguuacauacgguaccuguucccaaacuggagaacauagacgugauaaaagaagugucgcacuugcaccucaugugggacuuggauuagaaacacgcacagaaacauggaugucuucugaaggagcauggaaacaaguucaaaaaguagaaaccugggcacugagacaucccggauucacaguaaucgcauuauuccucgcucaugcuaucggaacgucaauuacacagaaaggaaucauauucauauuacugaugcuaguaacgccgaguauggcaaugagauguguaggaauuggaaaucgagauuuugucgaaggauuaaguggugcaacguggguagauguagucuuagaacauggcaguuguguaacaaccauggcgaaaaauaaaccaacauuagauauugaacuucuuaaaacagagguuacuaauccggcuguacuuagaaaacuaugcaucgaagcgaaaauaucaaacacaaccacagacucgagauguccaacucaaggagaggcaacucuaguagaagaacaagaugcaaacuuuguaugcagaaggacauucguugauaggggcuggggaaauggaugcggguuauuugggaaaggcagcuuacugacaugugcuaaauucaaaugugucaccaaacucgaaggcaaaaucguccaauaugagaauuugaaauauagcgugauugucacaguucacacaggggaccaacaucagguagguaaugaaacaacugagcauggaaccauugcaacuaucacuccccaagccccuacgagcgaaauacaacugacagauuauggugcacuaacauuagauuguucaccacgcacaggacuagauuucaaugagaugguacuccuaacuaugaaggaaaaauccuggcuaguucauaaacaaugguuuuuagaccugccgcuaccauggacuucaggugcuaguaccucgcaggagacauggaauagacaagaucuguuaguuacauuuaaaacugcgcaugcuaagaaacaagaaguuguuguccuggggagucaagaaggggccaugcauaccgcacuaacaggcgcaacagaaauacaaaccucagguacaacgacuauuuuugcuggccaucuuaaaugucgacuaaaaauggauaaguugacguuaaaagggaugagcuaugugauguguacaggaucuuuuaaauuagaaaaagaaguggccgaaacucaacauggaaccgugcugguacaagucaaauacgaagggacggacgcgccgugcaagauuccguuucuaacucaggaugaaaaaggaguuacucagaacggaagacuuauaacugcuaauccgauagucacugauaaagaaaaaccagugaauauagaaacagaaccacccuuuggcgaauccuacauuguggucggagcuggagaaaaggcuuuaaaauuaaguugguucaaaaagggcucgagcaucgggaaaauguucgaagccacagcucgaggagcuagaagaauggcaauacugggagauacagcaugggacuuuggcucuauaggaggucuauucacuucagucggcaaauuaauucaccaagucuuuggaacugcauauggagugcucuuuucaggagugucauggacaaugaaaaucgguauagguauacuucucacauggcuaggacuuaacuccagaucgacuucguuaagcaugacuugcaucgcaguuggaaugguaacauuguaucuaggcgugaugguacaggcggauagcgguugcguaaucaauuggaaaggacgugaacuuaaaugcggaaguggaauauuuguuacaaaugaaguacauacauggacugaacaguacaaguuucaagcugacagcccgaaacgacuuagcgccgcgauagggaaagcaugggaagaggguguaugugguauaagauccgcaacccguuuagaaaauauaauguggaaacaaauaucgaaugaauuaaauuacauauuauuagaaaacgacaugaaauuuacuguuguuguaggcgacgcgaauggaauauuaacacaaggcaagaaaaugauuagaccacaaccaauggaacauaaauacucuuggaaaucaugggguaaagcaaaaauaauaggcgcagacauacagaauacuacauuuauaaucgacggaccagacacaccagagugcccggacgaccaaagagcguggaacaucugggaagucgaggauuacggauuuggcauauuuacgacaaacauauggcuuaaauuaagagacaguuacacacaaaugugugaccauagacuuaugucggcagcgauaaaagauagcaaagccguacacgcggauauggguuacuggauagagagcgagaagaaugaaacauggaaauuagcucgagcauccuuuauugaaguuaaaacguguauuuggccgaaaagucauacacuuuggucgaaugguguucucgaaagcgagaugauuauuccaaaaauuuacgguggaccuaccucacaacauaacuauagaccaggauacuucacccaaacggccggaccuuggcauuuagguaaacuggaauuagacuuugauuugugugagggaacaaccguuguaguagaugagcacuguggauaccgugggccaagccuuagaacuacaacagugacugguaaaaucauccaugaauggugcugcagaaguuguacuuuaccaccguugagguuuaggggcgaagacggauguugguacgguauggaaauacgcccagugaaagagaaggaggaaaauuuaguaaggucuaugguaagcgcagguucaggugaaguugacucauuuucucugggaauuuuaugugucaguauuuuaauugaggagguaaugcgcagcagauggagucgaaaaauguugaugacaggaacacuagccguauuucuuuuacucaucauggggcaacuaacguggaaugaucuaauuagauuauguauuaugguuggugcuaacgcaucugauagaaugggaaugggaaccacuuauuuggcauugauggcuaccuucaaaaugcguccaauguucgcgguuggccuucuauucaggaaacuuaccucucgagaaguucuauuacucacuaucggacuuucuuugguugcaucaguagaauuaccgaacucccuugaagaacucggagauggucuggcaaugggaauaaugauguuaaaguuguuaacugauuuucaaccacaucaacuauggacuacuuuacuaaguuuaacuuucauaagaacgucgcuguccuuagauuaugccuggaaaacuauggcaauggcacucagcauuguguccuuauucccacugugcuuaucaacaacgucucagaagacaacgugguuaccuguucuuuugggauccuucggaugcaaaccacuaacaauguuuuuaauuacugaaaacaggauaugggguagaaaaucauggccuaucaacgagggcguaauggcuguugggauaguaaguauauuauuaucaucauugcuaaagaaugaugucccguuggccggaccauuaauugcaggaggaaugcuaauagcauguuacguuaucucugguaguagcgcugaccugagcuuagagaaagcugccgaagugucuugggaggaagaagcagagcacucaggcacuucgcauaacauccuugucgaaguucaagaugacggcacaaugaagauaaaagacgaagaaagggaugauacauugacaauacuauuaaaagcuacacugcucgcuguuucaggaguauauccaaugucaaucccugcgaccuuauuuguaugguacuuuuggcagaaaaagaaacaaagaucaggaguucuaugggauacacccucuccaccagaaguugagagagcaguccuggacgauggcauuuaucgaauccuucagaggggguuguuaggcagaucacaaguuggcgucggaguguuccaagauggaguauuucacacaauguggcauguaacucguggagccguucugauguaccaagggaaacguuuagaacccagcugggccucagugaagaaagacuuaauuagcuacggaggagguuggcgauuucaaggguccuggaacacgggagaagaagugcaaguaauugcuguagaaccaggcaaaaaucccaaaaacguacaaacaacuccuggaacauuuaaaaccccggaaggagaaguuggagcaauugcauuagauuuuaagccgggaacgucagguuccccgauuguaaauagagaaggaaagauaguaggacuguauggaaauggaguaguaacaacuucuggaaccuacguaagugcgauugcacaggcuaaggcgucacaagaaggcccgcuaccugaaauagaagaugaaguauuuaagaaaaggaaccuuacaauuauggauuuacacccugguagugggaaaacgagaagauaccuccccgcaauagucagagaagcaaucaagcguaaacucaggacacuaauauuggccccaacaagaguagucgccagcgaaauggcagaagcacugaaaggaaugccaaucagguaucaaacaacugcgguuaagucggaacauacaggacgagaaauaguagauuugaugugucacgcuaccuuuacgaugcgccucuuaagucccguccguguaccuaauuacaauaugaucauaauggaugaagcacacuuuaccgacccggcaagcaucgccgcuagaggauacauaaguacgcgaguggguaugggugaagcggcagcaauuuuuaugacagcaacuccaccuggaucaguugaggcuuuuccgcaaucgaacgcuguaauucaggaugaagaacgagauauacccgaaagaucuuggaauagcggguacgauuggauaaccgauuuuccaggcaaaacagucugguuuguaccuucaauuaaaaguggaaaugacauagcuaacugucuaaggaaaaaugguaaaagagucauacaauugaguagaaaaacuuucgacacagaauaucaaaagacaaagaacaacgacugggacuauguaguaacaacagacauuucagaaaugggugcgaacuuuagggcagaucgcgugauagauccuagaaggugcuuaaaaccgguaauucuuaaggauggcccugaacgugucauuuuagcgggcccaaugccggugacggucgcuagugcugcucagagaagggguagaaucgggagaaaccagaauaaagagggggaccaauacauauacaugggucaaccccucaauaaugacgaagaucacgcucauuggacugaagcaaaaaugcuuuuagacaauauaaacacuccggaagggauaauuccugcacuauucgaaccugagcgagagaagucagcagcgaucgauggugaauacagacuaagaggugaggcgagaaaaaccuucguggaauuaaugagacgcggagaucuaccgguaugguuaagcuauaaggucgcaagugaaggcuuccaauauucagacagaagaugguguuuugauggagaaagaaauaaucaaguucuagaagagaauauggauguagaaauuuggacgaaagaaggcgagcgcaagaagcuaaggccaagauggcuggaugcuaggacguauagugauccgcuugcauuaagggaauuuaaagaguuugcagcaggacgccguuccguuucaggagaucugauucuugaaauuggaaaacuuccacaacaucuuaccuuaagggcucaaaaugcucuugacaaccugguaaugcuacauaacuccgaacaaggaggaaaagcauaucgucaugcaauggaagaauuacccgauacuauagagacucuuauguuacucgcauuaauugcaguacuuacuggaggcguaacacuuuucuucuuaagcggaaaaggccugggaaagaccucaauuggacuauugugcguaauggcaaguucagcgcuauuauggauggcaucaguugaaccucauuggaucgcagcuucaauaauccuagaguuuuuccucaugguauuguuaaucccagaaccugacaggcagcgaacuccccaagauaaucaauuagcuuauguugucauuggacugcuauucaugauuuugacaguagcagcaaaugagauggguuuauuagaaacaacgaaaaaggaccuaggcauuggccauguugccgcugaaaaccaucaucaugcuacuauguuagauguagauuugaggccagcaucugcauggacccuauacgccguugcuacaacaguuauuacuccuaugaugagacauacaauagaaaauacuaccgcaaauauauccuugaccgcgaucgcaaaccaagcggcaauauugaugggccuagauaaagguuggccaauaucaaaaauggacaucggcguuccacuacuugcguuaggguguuacucacagguaaauccacucacccuuaccgccacuguccuaauguuaguggcucacuacgcaaucauaggaccaggauuacaagcaaaagcgacuagagaagcacagaaaagaacagcggcugguauuaugaagaauccuacuguagauggaaucgucacgauugacuuggauccaguuguauaugacgcuaaauuugaaaaacaacuaggccaaauaauguuauuaauauugugcacaagccaaauucuucuuaugcgaaccacuugggcguuaugugagagcaucaccuuagcaacuggaccucucacaacauuaugggaggggucaccaggaaaguuuuggaacacaacuauagcugucuccauggcuaauaucuuucgagggucuuauuuagcgggagcaggauuagcguucucauuaaugaagucauuaggaggcggaagaagaggcacaggcgcgcagggugaaacucuaggugaaaaguggaagagacaacuaaaucaacucaguaaaagugaguucaauaccuauaagaaaagcgguauaauggaaguagaccgcucugaagccaaagaagguuugaaacggggugaaaccacaaaacaugccgucucacgaggaacagcaaaauuaagaugguucguagaacguaaucuggugaagccugaagguaagguaauagaucuaggcugcggacguggggguuggucguacuauugcgcagggcucaagaaaguuacagagguaaaaggcuacaccaaagggggaccgggccacgaagaaccaauaccaauggcaacauauggauggaaucuagucaaacugcacucgggaaaagacguauucuuuacacccccagaaaaaugcgacacguugcuuugugacaucggcgaaucaucgccaaauccgacgauugaagaaggaagaaccuugagaguacuaaagauggucgagccaugguuaagaggaaaucaauuuuguaucaaaauacucaauccuuauaugccaaguguuguugaaacauuagagcagaugcaaaggaaacacggaggaaugcuggugaggaauccccuuucccgaaauucgacacacgagauguauugggucuccuguggcacggggaacauagugucugcuguaaacaugaccucucgaauguuacuaaaucgguucacaauggcgcaccgaaagccaacauaugaaagggauguagacuuaggagcugguacgcggcacguggcgguagaacccgagguagcgaaucuagauauuauaggucaacgaauagagaacauuaaaaaugaacacaaaagcacauggcacuaugacgaggacaauccguacaaaacaugggcguaccauggaucauaugagguaaaaccgaguggaucugcaucaucaaugguaaauggagucguucgauuacucacuaaaccuugggacguaauuccuaugguaacgcaaauagcuaugacggacacuacccccuucggacagcaacggguuuucaaggaaaagguggacaccagaacaccuagagcuaaaagaggaaccgcucaaauaauggaagucacagcaaaguggcucuggggguuuuugucaagaaacaaaaagccccggaucuguacccgagaagaguucacaaggaaaguuagauccaaugcugcaauaggugcugucuuuguggacgaaaaucaguggaacucugccaaggaagcagucgaagaugaaagguucugggacuuaguucauagggaacgagaauuacacaaacaaggaaagugugcuacuuguguauacaauaugaugggaaaacgggagaagaaauugggagaguucgguaaggcgaaggguucuagagcuauaugguauauguggcuaggagcuagauucuuagaauuugaagcauuagguuucaugaaugaggaucauugguucucucgagaaaacagucuaagcggaguagaaggggaggggcuucauaaguuagguuacaucuuaagagacauauccaagauuccgggaggaaacauguaugcugacgacacagcagguugggacacucgaauaacagaagacgacuuacaaaaugaggcgaaaauuacagacauuauggaaccggaacaugcauuauuggcaacuucaauauucaaacuaacauaucaaaauaagguaguuaggguacagaggccagcaaaaucggguacggucauggacguaauuucaagaagggaucagagggggucuggacaaguuggaacguacgguuuaaacacuuuuacaaacauggaaguccaauuaauacgucaaauggagucugaaggcaucuucaguccuucagaacuggaaacucccaaucuugcuaaaaggguccuagauugguuggaaaaacacggcgcagagaggcuaaaacgcauggcaaucaguggcgaugauugugugguaaaaccaauagacgaccgauuugcgacagcccuuacagcauugaacgauaugggaaaaguaagaaaagauaucccacaaugggaaccaucaaaggguuggaaugacuggcaacaaguaccguuuuguucacaccacuuucaccaacugauaaugaaagacggaagggauauuguaguaccuugucgaaaccaagacgaauuagucgggagagcucguguaucacaaggugcuggauggagucuaagggaaaccgcgugucucggcaaaucauacgcacagauguggcaacugauguacuuucauagaagagaucugagacuugcugcaaaugcaauauguagugcagucccagucgauuggguaccaacuucccgcaccaccuggucgauccaugcacaccaccaauggaugacaacagaagacauguugagcguauggaaucgaguauggauugaagaaaauccuuggauggaagacaaaacacaugucuccagcugggaagaagucccuuaucuagggaagagggaagaccaaugguguggcaguuuaauagggcugacagcgagagcaacaugggccacaaacauccaaguagcuauaaaucaaguacgacgccucauagguaaugaaaacuacuuagauuauaugacaucaaugaaaagguucaaaaacgagucagacccagaaggugcgcucugguaa

SEQ ID NO: 21134 - RNA, 9879 nt, Artificial Sequence
  derived and/or modified CDS sequence (opt6) from DENV-1__FJ850081__SS-prME
agcgugacaauguuguuaaugcuacuuccuacagcacuagcauuucaucuuacuacgcgaggaggugagccacacaugaucgugucgaaacaagaacgagggaaaagucuauuguucaaaacaagcgucgggguaaauaugugcacuuugauugcaauggaucuaggcgaguugugcgaagacacaaugacauauaaaugcccaaggauuacagaagcugaaccggacgacguagauugcuggugcaacgcgacggauacgugggucacuuacggaacuuguagucaaacuggagagcaccgucgagauaaacgcucgguggcacuagcaccacaugucggucucggacucgagacacgaacagagacauggaugaguucugagggagcauggaaacaaauacaaaaagucgagacgugggcucuaaggcauccuggguucaccguuaucgcgcuauucuuagcucacgcgauuggaacaaguauaacccaaaaaggaauaaucuuuauauuacuaaugcuagucacuccuaguauggcaaugagguguguagggauaggaaacagagauuuuguagagggccuaagcggagcaacauggguagacguaguguuagaacauggaucaugcgugacaaccauggccaaaaauaaaccaacauuggauaucgaauugcuaaaaaccgagguuacuaauccugcaguauuacguaaauuauguauugaagcaaaaauaagcaauacgacaaccgacucucgauguccaacacaaggagaggcuaccuugguugaagaacaagacgcgaacuucgucuguagacguacuuucguggauagaggauggggcaaugggugugguuuauuuggcaaagguucauuauugaccugcgcaaaauucaaaugugucacuaaacucgaagggaaaauagugcaauaugagaaucuaaaauauagcguuauugucacgguucacacaggagaccaacaucaaguagguaacgaaacgacugagcaugguacuauagcaacaaucaccccucaagcgcccacuucagaaauacaauuaaccgacuauggugccuuaacucuagacuguucgcccagaacgggcuuagauuucaacgagaugguucuguuaacaaugaaagaaaaaucuuggcugguacacaaacaaugguuucuggaucugccucugcccuggacaaguggagcgucaacuucccaagaaaccuggaauagacaggauuuguuaguaacauuuaaaacugcgcaugcaaagaaacaagaaguaguaguguuagggucacaggagggggcaaugcauaccgcuuuaacaggagcuacagaaauucaaacuucaggaacaacuacuauauuugcaggacaucuaaaauguagguuaaaaauggauaaacuaacacuaaaagggaugucguauguuaugugcacgggcagcuucaagcucgaaaaagaaguagcagaaacucagcacggaacgguacucguacaggucaaguacgagggaacugaugcaccuuguaagaucccauuccuaacacaagaugaaaagggcguaacacaaaauggaagacuuauuacagcuaauccaauagugacugauaaagaaaaaccggugaauauugaaacagaaccaccuuuuggagagagcuacaucguaguaggggcuggagaaaaagcccuaaaacucagcugguucaagaaaggaucgaguauuggaaagauguucgaagcaacggcccguggggcuagacgaauggccauauugggggauacagccugggauuucggcagcaucggaggguuauuuacaucggucgguaaguuaauacaucaagucuucggcacagcauauggaguucuauuuagcggagucagcuggacgaugaaaauagggauuggaauacuacuuaccugguuagggcuaaacagccguucuacaagucuuaguaugaccugcauagcugucggaaugguuacguuguaucuaggagucaugguccaagcagacagcggauguguaauaaacuggaaaggacgagaauuaaaaugcggcagugggauuuucguaacaaaugaaguucauacuuggacagaacaauauaaauuccaggcagauucuccaaaacguuugagugcugcaauaggcaaagcgugggaggagggcgucuguggaauacguucugcaacccgacuagaaaauauaauguggaaacaaauuucuaaugaauuaaauuauauacuucucgaaaaugauaugaaauuuaccguuguugucggggaugcuaacggcauucuugcucaagggaagaaaaugauacgaccgcaaccuauggagcauaaauauagcuggaaaaguugggguaaagcaaaaaucauuggggcagauauucaaaauacaacauuuaucaucgauggccccgauacuccggaaugucccgaugaccaacgagccuggaauauaugggaaguugaagauuacggauucgggauauucacgacuaauauaugguuaaaacuuagagacagucacacacaaaugugcgaucauagguuaaugucagccgcaauaaaagauucaaaagcaguacaugcagauaugggauauuggauagagagcgagaaaaaugaaacauggaaacuagcuagggcuucguuuauugaagugaagacauguauuuggccaaagagccauacuuuauggucaaauggaguguuggagagcgaaaugauuauucccaaaaucuauggagggccaauuucgcagcacaacuaucgaccaggauauuuuacccaaacggcggggccauggcacuuagggaaauuagaacuggacuuugaucuaugcgaaggaacaaccguuguuguagaugaacauuguggauacaggggaccaucacuuaggaccacuacuguaacaggcaaaauuauacaugagugguguugucguagcugcacucuaccaccucucagauucagaggugaagaugggugcugguauggaauggaaauccgcccaguuaaagaaaaagaagaaaauuuaguaagaucgaugguuucagccgggagcggggaaguagauucauuuucguuaggaauauuaugcgucucaaucuuaaucgaagaaguuaugaggucuagauggaguagaaaaauguuaaugacagggacacuggccguuuuucuauuguuaauaauggggcaacuuacguggaaugaccuaauacgauuaugcauaaugguaggagcaaaugcuucagaccguaugggaauggguacaaccuaucuagcccucauggccacauucaaaaugcguccuauguucgcagugggacuauuauucagaagauuaacaucucgagaaguacuauugcuaacaauagguuuaucacucguagcuuccguagaacuaccuaauagcuuagaggaauuaggggacggauuggcaaugggaauuaugaugcuaaaacuuuuaacagacuuccaaccacaccagcuauggaccacuuuacucagcuugaccuuuauaaggaccagucuuagucuagauuaugcuuggaaaaccauggcaauggcauuauccauuguuucauuguucccacucuguuuaaguaccaccucucagaaaacuacauggcuaccuguccugcuuggaaguuucggaugcaaaccccuaacaauguuucuuauaacagagaauaagaucugggguaggaagaguuggccuaucaacgaaggaaucauggcgguaggaauagucaguauccuacugagcaguuugcucaaaaaugauguaccacuagcaggaccauugauagccggugggauguuaaucgcauguuacguaauaaguggaagcagcgccgaccuaucacuagaaaaggcugccgaaguaucgugggaagaagaagcagaacacucuggaacgucacacaauauacuugucgaggugcaagacgauggaacuaugaaaaucaaggacgaagaaagggaugauacauuaaccauauuauuaaaggcuacgcuucuagcuguuucaggagucuauccaaugucaaucccagcuacacuauuuguaugguauuucuggcagaagaagaaacaaaggucaggaguacucugggacacaccuucgccaccggagguagaacgugccguguuagaugacgguauauaucgaauuuuacaacgaggacuacuaggccgaucacagguaggugugggaguguuccaagaugggguguuucacacgauguggcaugucacccgaggugcuguccugauguaucaggguaagaggcuggaaccuucuugggcaaguguaaagaaagaucuuauaucguacggggguggcuggcgguuucaaggaaguuggaacacaggcgaagaagugcaaguaauagcgguagagccggguaaaaaucccaaaaauguucaaacaacgccagguacauucaaaacucccgagggggagguuggugcaauagcgcuugacuuuaaaccggguacaaguggaaguccaauuguaaaucgagaaggaaaaauaguaggacuauaugguaauggugucguuaccacaucggggacauaugucagcgcaauagcacaggccaaagcaagccaagaagggccucuucccgagauugaagaugaaguauuuaagaaacgaaaccuaacuauaauggacuugcaucccggaagcggaaaaacaagacgguaucugccagcaauaguacgagaggcaauuaaaaggaaacugcguacccuuauuuuagcuccaacucgaguaguggccagcgaaauggccgaagcccuuaaaggaaugccaauuagguaccaaaccaccgcaguaaaaucugagcacacaggccgcgaaauugucgaucucaugugucaugccacuuucacaaugagacuuuuaagccccguucguguaccaaauuauaacaugaucauaauggacgaagcgcauuuuacggauccugcaucaauugcagccagggguuauauaaguacucguguaggcaugggagaagcugcggccauauuuaugacagcgacaccuccaggaagcgcagaagcauuuccacaaaguaacgcgguuauacaagacgaggaacgagauauccccgaacgaucuuggaacucaggauaugacuggauuacagauuuuccaggcaaaacuguuugguucguaccaagcauaaagagugguaaugacauugcuaauugucucaggaaaaaugguaagaggguuauccaguuguccagaaaaacauuugauacagaguaucagaaaacgaaaaacaacgauugggacuaugugguuacaacagacauauccgaaaugggugcaaauuuccgugcagacagagucauagauccucgucgaugcuuaaaaccugucauccugaaggauggaccugaacgagugauacuagcaggcccaaugccgguuaccguagccagugcugcacaaagaagagguagaaucggacguaaucaaaacaaggagggagaucaguauauauauaugggacaaccacuuaauaaugacgaagaucacgcacacuggacagaagcaaagauguuacuugacaauauuaacaccccagaaggaauaauaccagcuuuauucgagccugaacgagaaaagucugcagcgauagauggagaauacagacucagaggagaggccagaaaaacauucguugaacuaaugcgcagaggagauuuacccguauggcuuaguuacaaaguagccucagaaggauuccaguauagugaucgaagaugguguuucgacggcgaaagaaacaaucagguacucgaagaaaauauggacguugaaauuuggacuaaagagggugaacgaaagaaacucaggccaagguggcuugaugcucguacauauucggauccacuugcccuucgugaauuuaaggaguuugcugcaggacggagaucaguaucuggagaccucauccuggagaucggaaaacuuccgcaacaccuaacgcuacgugcacagaaugcacuagauaaucuaguuaugcuccacaacucagaacaaggugguaaagcauaucgucacgcuauggaggaacuaccggauacaauagagacuuuaaugcucuuagcacucauagcaguacuuacuggagggguaacccuauucuuucuaucggguaaaggauuagguaaaaccaguauagggcuuuuauguguaauggcaucauccgcacucuuauggauggcgucaguggagccacacuggauagcugcaucaauuauccucgaguucuuucucaugguauuauuaauuccagaaccggacagacaaaggacgccacaagauaaucagcuugcauacguaguaauuggcuuguuauucaugauucucacgguggcggcaaaugaaaugggguuacuugaaacuacaaagaaagaucucggcauuggacauguagcagcugaaaaucaucaucaugcaaccaugcuggauguagaucuaagaccugcuucagcguggacuuuguaugcaguggcuacuaccguuauaacuccaaugaugcgccacacaauagagaauacgacugcaaauauaagccugacagcgauagcaaaccaagcugcaaucuuaaugggccucgacaaaggauggccuauaagcaaaauggauaucgggguaccauugcuugcauuagggugcuauagccaaguaaaccccuugacucuaacagccgcaguauuaaugcuaguagcucauuaugcaauaauuggaccaggauuacaagccaaagcuacuagagaagcucagaaaagaacugcugcugggauuaugaaaaaccccacugucgacgggauagugacuauagaucuugaucccguuguauacgaugcuaaguuugaaaaacaguuggggcagauuauguuauuaauacugugcacuagccagauucugcuuaugagaacuacuugggcuuuaugcgaaagcaucacucuagccacuggaccgcucacuacauugugggaaggaaguccugguaaauucuggaauacgacuauagcgguuucaauggcaaauaucuucagaggcuccuacuuagcaggcgcuggucuugcauuuagcuuaaugaagaguuuaggaggaggaaggagaggcacuggggcgcaaggugaaacgcuaggggaaaaauggaagagacaacuuaaccaauuaucaaagucugaauuuaauacauauaagaaaucagguauuauggagguggacaggucagaggcgaaagaaggucuuaaaagaggagagacgacgaagcacgccgucagcagagggaccgccaaauuaaggugguucgucgagcgcaacuuaguaaaaccagaaggaaaggucauagaccuagguuguggacgaggcggauggucauacuacugugcgggcuugaagaaagucacugagguaaaagguuauacuaagggaggcccuggucacgaggaaccaauaccaauggcuacguaugguuggaaccuuguaaaacugcacuccggaaaggacguauuuuucacuccaccugaaaaaugugauacauugcuaugugacauuggugaaucaucgccaaaccccacuauagaagaggggcguacccuaaggguucuaaaaaugguagaaccauggcuccguggcaaccaauucugcauaaaaauacuaaauccuuacaugccguccguaguagaaacguuagaacaaaugcaaaggaaacauggcggaaugcuagugcgaaauccccuaagcagaaauucaacccacgaaauguauuggguaucuuguggaacagggaauauuguuucagccguuaauaugacaagcagaauguuauugaauagguuuacuauggcacacagaaaaccuacuuaugaacgggauguagaucuaggugcggguacuagacauguagcagucgaaccggaaguggccaauuuggauauuauaggacagcgaauugaaaacauaaagaaugaacacaaaucgacguggcauuacgaugaagacaacccauauaaaacgugggcguaucaugguucauacgaaguuaaaccuagcggaagugcaaguucuaugguuaauggaguagugagauuacuuacaaaaccaugggacgugauuccgaugguuacacaaauugccaugacugauacuacaccauuugggcaacaaagaguuuuuaaagagaaaguagauacgaggacuccacgagcaaagagagguacugcucaaauaauggaaguuacagcuaaaugguuauggggauuccuaucaagaaauaagaaaccaagaauaugcacuagagaagaauuuacucgaaaaguaagguccaaugccgcaauaggcgcuguuuuuguugaugaaaaucaauggaacucggcgaaagaagcaguagaggacgaacguuuuugggacuuaguccacagggagagggaacuacauaaacaaggaaaaugugcgacuugcguguacaacaugaugggcaagagagagaagaaacuaggagaguucggaaaagcaaaaggaagccgagcaauaugguauaugugguuaggggcacgguuucuggaguucgaggcauuagguuuuaugaacgaagaucauugguucagucgcgaaaauucacucucuggaguugaaggagaaggacuacacaaacugggauauaucuuaagggacaucaguaagaucccaggcggaaauauguaugcagaugauacugcaggcugggauacaaggauuacagaagaugaccugcaaaaugaggccaaaauuacugacauaauggaaccugaacaugcacuacuagcaacgucuauauuuaagcuaacauaucaaaauaaagucgugagaguucaaaggccagcaaagagugggacuguaauggaugugauaagcaggagagaccaaagaggaaguggucagguaggaaccuauggacucaauacguuuacaaauauggaaguccaauuaauaagacaaauggaaucggaaggaauauuuucgcccuccgaauuggaaacuccaaauuuggcuaaaagaguacuggacugguuagaaaaacauggagcggaaagauugaaacguauggcgauaucuggugaugacuguguagugaaaccaauagacgaucgcuucgcaaccgcacuaacugcuuuaaaugacaugggaaaaguaagaaaagauauuccgcagugggaaccgagcaaaggcuggaaugauuggcaacagguaccuuuuuguucacaccauuuucaucaacuaauuaugaaagacggacgugaaauaguggucccaugccgcaaccaagaugaacuuguaggaagggcuagagucucacagggugcaggguggucucuaagagaaacugcgugccuugguaagagcuaugcacaaauguggcaacugauguauuuucaucgccgagaccuaagacuugcagcaaaugcaauuuguuccgcagugccuguagacugggucccaacuucaagaacaacuugguccauacaugcucaccaucaauggaugacuaccgaggauauguuaucagucuggaaucgaguuuggaucgaggaaaauccuuggauggaagauaagacacaugugucgucaugggaagaaguaccauacuuaggaaaacgagaagaccaauggugcgguucgcuaaucggauuaacagcacgugcuacaugggccaccaacauacaaguagccauaaaucaaguaagaagauugauagguaacgagaauuaucuagauuacaugacaaguaugaaacguuucaaaaaugagucagauccugagggugccuuaugguaa

SEQ ID NO: 21135 - RNA, 9879 nt, Artificial Sequence
  derived and/or modified CDS sequence (opt6) from DENV-1__FJ850084__SS-prME
aguguaacgaugcuacugaugcuacuaccaacagcucucgcguuccauuuaacaacgcgagggggagaaccccauaugauugugucaaaacaagagagaggaaaaagccuacuuuucaaaacgagugucggagugaacauguguacacuaaucgccauggaucucggagaacugugcgaagacacaaugacauauaaauguccgagaauuacagaaguugagccugacgaugucgacuguugguguaacgcaacugauacaugggugacguauggaacgugcucucaaacaggcgaacauaggcgggacaagaggucgguugcacuggcaccccacgugggguuaggacuagaaacacggacggaaacauggaugagcagcgaaggggccuggaaacaaauacaaaaaguagaaacaugggcuuuacgacauccugguuuuacagucauagcccucuuucuagcccaugcgauaggaacuagcauaacacaaaaaggcaucauauucauacuucuaaugcuuguaacaccaucaauggcuaugagaugugucgggauuggaaaccgcgauuuuguugagggauugucuggugcgaccuggguugauguuguacuggagcauggcucuugcguaacaacuauggcuaagaacaagcccacauuggauauugaauuguugaaaacggagguaacgaacccugcaguguuaagaaaguugugcauagaagcaaaaauaucuaauacaacgacagacucaagauguccaacacaaggcgaagcuacguuaguagaagaacaagaugcuaacuuuguuugcagaagaacauucguagacagaggaugggguaacggcugugguuuauuugggaaaggaucccucuuaacuugcgcaaaauucaagugcguaaccaaacuggaagguaagauaguccaauacgaaaaucugaaguacucuguaauagucacagugcauaccggagaucagcaccaaguugguaacgaaacuacagaacauggaacuauugcuacaaucacaccucaagcuccaacuucggagauccaacucacagauuauggagcauugacgcuagauuguaguccacgaacaggccuugauuuuaacgagaugguauuacugacuaugaaagaaaagucauggcucgugcacaagcagugguuuuuagaccucccacuaccauggacaaguggcgcaucuaccucgcaggaaacauggaaccgccaggaucugcuaguaacguuuaaaacugcucacgcaaaaaagcaagaaguuguaguccuagguagucaagaaggggcuaugcauaccgcacuuacuggugccacagagauacaaacaucagguacaacgacuaucuuugcagggcacuugaagugucgccuuaaaauggacaaacuaacccugaaaggaaugagcuacguaauguguacaggguccuucaagcuggagaaggaagucgcagaaacacaacauggcacugugcuaguucagguuaaguacgaagguacagaugcacccuguaagauuccguuuuuaacccaggaugaaaaaggggugacucaaaacggaagauugauaacugcaaauccuauugugacugauaaggaaaaacccguaaauauugagacagaaccaccauucggggaguccuauauaguuguuggagccggugaaaaggcgcuaaagcuaaguugguuuaaaaaagggucaucaauuggaaaaauguuugaagccacagccaggggggcaagacggauggcgauacucggugauacagcuugggauuuuggaucgauaggaggccuauuuacuucaguagggaaguuaauacaccaggucuuuggggcugcauacgguguauuguuuuccggcguaucauggaccaugaaaaucggcauaggcauacuauuaaccugguuagggcuuaacucacguucuacgucccuuaguaugacaugcauugcuguagguaugguaacauuauacuuagguguuaugguccaagcggauucaggauguguuauaaacuggaagggaagagaauuaaaguguggaagugggauauucguaaccaaugaaguacauacauggacugaacaauauaaguuucaagccgacaguccuaaacgacuaagugcagcaauagggaaggcaugggaagaaggaguuuguggaauaagaucagccacaagguuagaaaacaucauguggaagcaaauauccaaugaguuaaauuacauacuuuuagaaaacgauaugaaguucaccguuguagugggugacgccaacgguauucugacacaagggaaaaagaugauccguccucagccaauggaacacaaauauucauggaaaaguugggguaaagcaaaaaucauaggagccgacauacaaaacacaacuuucauuauugauggccccgauacuccggaaugcccagacgaucagcgcgccuggaauauaugggaaguagaggauuacggcuucggaauuuuuacaacaaacauauggcuaaaauuacgagacucguacacgcagaugugcgaccaccgauugaugagugccgcaauaaaagauucaaaagcaguacaugcagauaugggauacuggauugaaucagaaaaaaacgagaccuggaaacucgcacgagcaagcuucauugaagugaaaacaugcauauggccuaaaagucauacuuuguggaguaacgggguauuagagucugaaaugauaauaccaaagauuuacgguggcccgacuucgcaacacaauuauagaccuggauauuuuacucagacugcuggucccuggcaucuagguaaauuagaacuggacuucgaccuuugcgaaggaaccaccgugguaguugaugaacauuguggauauagaggaccaagucuaaggaccacuacugucacggggaaaauuauccaugaguggugcuguaggaguuguacccuacccccucucagauuuagaggcgaagauggaugcugguauggcauggaaauaaggcccgucaaagaaaaagaggagaaucuugugaggucgaugguaagugcgggaucugccgaaguagacaguuucaguuuggguauacuaugugucucgauucuaaucgaagaaguuaugaggagucgcuggucuagaaaaaugcuuaugaccggaacgcucgcaguauuccuuuuguugauaauggggcaauuaacuuggaaugaccuuauuagauuauguaucaugguuggugcuaaugcauccgauagaaugggaaugggcaccaccuaucuagcacuaauggcaacguucaaaaugcguccgauguucgcaguagggcuauuguuccggaaacuaacaaguagggaaguuuuacucuuaacuauaggccugucauuggucgcaaguguagaacuuccaaauucgcuugaagaacuuggggauggccucgcuaugggcauaaugaugcuaaaauugcuaaccgauuuucaaccucaucaacucuggacuacgcuacugucacuuacauuuauaagaacaucguugagccucgacuaugcauggaaaaccauggcaauggcauugagcauaguaucauuguucccacuauguuuaaguacaacaucucagaagacaacauggcuacccguccucuuaggguccuucgggugcaaaccucuaacaauguuucugauaacagaaaauaaaauuugggggcggaaauccuggcccauaaacgaggggaucauggcaguagguauugugucaauuuuauuaucuagccuucucaaaaacgauguuccacuggccggcccucuaauagcgggagguauguuaauagcauguuacguuaucucagguagcucugccgacuuaucauuagaaaaagcagcugaagucuccugggaagaggaggcagaacauucagguacaucacacaacauacucguggagguacaagacgauggaaccaugaagauuaaagaugaggaaagagaugacacuuuaacaauacuacuaaaagcgacguuacuagccgugagcggcguauaccccaugucuauuccggcaacguuauuuguaugguauuucuggcaaaaaaagaagcaaagaagcggaguauuaugggauacaccaagcccaccagaagucgaaagagccgucuuagaugacgggauuuaccggaucuuacaaaggggccuauuaggacguucacaaguugguguaggaguguuucaagacgggguauuucauacgauguggcacguaacucgaggagcgguuuuaauguaucaaggaaaacggcucgaaccaucgugggccucaguaaaaaaagaucuaauaaguuacggcgggggauggcgauuucaagguaguuggaauacaggugaagaaguacaaguaaucgcuguugaaccagggaaaaacccgaaaaaugugcaaacaacaccuggaacuuuuaaaacaccagaaggugagguuggagcuaucgcacucgauuuuaagcccgggacaaguggcagcccaauugucaauagggaaggaaagaucguaggucuauaugggaacgggguggugacuaccagcggcacauacguaucggcuauagcacaggcuaaagcgagucaggaaggaccuuuaccggaaaucgaagaugaaguauucaagaaaagaaaccuuacuauaauggaucuucacccugguucaggcaaaacaagacgguaucuaccggcaauaguaagggaagccauaaaaagaaaacuacgcacuuuaaucuuagcaccuacucgggugguagcaucggaaauggccgaggcuuuaaaagguaugccaauucgguaccaaacaaccgcaguuaaaagcgagcauacaggaagagagauaguagaccuaaugugucaugcuaccuuuacuaugcgauuacucucaccuguaagagucccaaauuauaauaugaucauaauggaugaagcacauuucacagacccagcuaguauagcagcaagaggauauauaucuacaaggguggguaugggugaagcagcagcaauuuucaugacugcaacaccgccagguaguguugaggcauuuccucaaucaaacgcgguaauacaagacgaagaaagagauauaccagaaaggucauggaacagcggcuaugauuggauuacugacuuccccggaaaaacaguuugguucgucccaucgauuaaaaguggcaaugauaucgcaaauugucugcgaaaaaauggcaaaagagucauccaacuaagucgaaaaacuuucgacacagaauaucaaaagacuaaaaacaacgauugggauuacguuguuacaacagauauaagcgaaaugggagccaacuuucgcgcugaucgaguaauugacccaagaagaugucucaaaccagugauucucaaagaugguccggagcgaguuauucuagcggggccaaugccagucaccguugcaucugcugcucaacgacgagguagaauaggccggaaccaaaauaaagaaggcgaccaauauauauacaugggucaaccauuaaauaaugaugaggaucacgcucacuggacggaagcgaaaaugcuuuuagacaauauaaauaccccugaaggaauaauuccagcacuauuugagccugagagagaaaaaagcgccgcuaucgacggagaauacagguugagaggugaggcaaggaaaaccuuuguagaacuaaugaggcguggugauuuacccgucuggcucaguuacaaaguggcuagugaaggcuuucaguacagcgaucgcagauggugcuucgacggagaaagaaacaaccaaguucucgaagagaauauggacguugaaauauggacuaaagagggugaaagaaaaaagcucagaccaagguggcucgaugcacguaccuauagugauccauuggcauuacgagaguucaaagaauucgccgcaggaagaagaagugucuccggagacuugauauuagaaaucgguaaauugccccagcacuugacguugagagcacagaacgcccuagacaaucucguaauguugcacaauucugaacaagguggaaaggcuuaucgccaugcaauggaagaauugccagauacaauugagacuuuaauguuauuagcacuaauagcaguucuaacaggaggcguuacucucuucuuucucucuggaaaaggacucgguaaaacuuccauaggauuauugugcgucauggcuagcucggcuuuacuauggauggcgaguguugagccacacuggauagcugcuucaaucauauuagaauucuuuuuaaugguauugcucauaccagaaccagaucgacagcguacaccacaggauaaccaacuggcauauguuguuauuggccugcuuuuuaugauacuaaccguagccgcaaaugagaugggauuauuagaaaccacuaaaaaagaucuaggaauaggccaugucgcugcagaaaaucaucaucacgcuacaaugcuggacguagaucuuagaccagcaucagcguggacguuauacgcugucgcgacaaccgucauaacaccuaugaugagacauacgauugaaaauacuacugcaaacauaucacugacagcaauagcaaaucaggcagccauauugauggggcucgauaaaggauggccaauuagcaaaauggauauuggaguaccauuauuagcauugggauguuacucacaagugaacccacugacacugaccgcuacuguacuaauguuaguggcgcauuacgccaucauaggccccggauuacaagcaaaagcaacaagagaggcccagaaaagaacugcagcuggcauuaugaaaaauccaaccgucgaugguaucguuacaauagauuuagacccuguaguuuacgaugcuaaguuugaaaaacaguuaggccaaaucaugcugcuuauccuaugcacgucacagauucuauuaaugcgaacgacuugggccuuaugcgaaucaaucacuuuagcuacuggccccuuaacuacuuuaugggaaggaagcccaggaaaauuuuggaacacuacaauugcuguuucuauggccaacaucuucaggggaucuuacuuagcuggcgcuggauuagcuuucagcuuaaugaaaagcuuaggcgguggccguagaggaacuggcgcccaaggagaaacauugggugagaaguggaaacgucaauuaaaucagcuuaguaagagugaauuuaacaccuacaaaaaaucagguauaauggaaguagaccguucagaagcaaaagaaggucuuaaacguggagaaacuacaaagcaugcgguaucacgagggacugcuaaacugagaugguuuguagaaagaaaucuuguaaagccggaaggaaaaguaauugaccuaggcuguggacgaggaggguggucguacuacugugcagguuuaaaaaaaguaaccgaggucaaagguuauacuaaaggaggcccgggucacgaagaaccgauccccauggcgacauauggauggaauuuagucaaacuucauuccggaaaagacguuuuuuuuacucccccggaaaaaugcgacacacuucuuugugauauaggagaaucuuccccaaaucccacuauagaagaggggaggaccuugagaguucuuaaaaugguggaaccauggcuaagagguaaccaauuuuguauaaaaauauugaaucccuauaugccaaguguagucgagacacuugaacaaaugcagcgcaaacacggagguauguuagucagaaacccucugucccguaauagcacgcacgaaauguauuggguuucaugcgggacaggcaauaucguauccgccguaaauaugacaucacgcaugcuauuaaaucgguuuaccauggcacaucguaaaccuacauacgaaagagaugucgaucuaggcgcaggcacacgccacguagccguugagccggaaguagcaaaucuagacauaauaggucaaaggauugagaacauaaaaaacgaacauaaaagcacuuggcacuaugaugaagacaaucccuacaaaacaugggccuaccauggaaguuaugaaguuaaaccaagcggcagugcgucaagcauggucaacgguguaguacgucuucuuacgaaacccugggacguaauuccuaugguaacccaaauagcaaugacagacacaacaccauuuggacaacaaaggguauuuaaagaaaaaguugauacucgaaccccaagggcuaaacguggaaccgcacaaauuauggaaguaacagcaaaaugguuaugggguuucuugucgcgaaauaaaaaaccgcgaauuugcaccagagaagaauuuacuagaaaaguacggucaaaugcggcaauaggugcaguuuuugucgaugaaaaccaauggaauucagccaaggaagcaguagaagaugagagauucugggaucuuguucauagagaacgugagcuacauaagcagggcaaaugugcaacuugcguuuauaauaugaugggcaaaagagaaaaaaaacuaggugaauuugguaaagcaaaagguagucgagcaauaugguauaugugguuaggggcgcgauucuuagaguuugaggcacuagguuucaugaaugaagaucauugguucagucgagaaaauucacuuucaggugucgagggagaaggacuucauaaguugggcuacauacuaagagauauuucaaaaauucccggaggaaacauguaugcggaugauacagccggaugggacacucgcauaacagaagacgauuuacaaaacgaagcaaaaauaacagauauaauggaaccagaacaugcccuauuagccacaucaauuuuuaaacuuaccuaccagaauaaaguagugagaguccagaggccagccaaauccgguacugugauggacguaauuucucgacgugaucaacgagggucaggccaaguaggaaccuacggcuuaaacaccuuuacgaacauggagguucaauuaauuagacaaauggaaucagaaggaauauucucaccuagcgaacuagaaacaccuaauuuagcuaagcgaguccuagauuggcuugagaaacacggugcugagcgacucaaacggauggcuaucucaggcgacgacugcgugguaaagccaauagacgauagguucgcaacggcccuaaccgcacuaaaugauaugggcaagguaagaaaagacauuccccaaugggagccaagcaaaggauggaacgauuggcaacaagugccuuuuugcagucaucauuuucaccaacuuaucaugaaagaugggcgugauauagucguaccaugucgaaaccaagacgaauugguaggaagagccagaguaucucaaggagcgggcuggucauuacgugagacugccuguuuagggaaaaguuacgcacagauguggcaacuuauguacuuucacagacgcgauuuaagacuagcugcaaaugcuauauguucagcugucccaguggauuggguaccgacgucuagaacaacauggagcauacacgcacaccaucaauggaugacaaccgaagacaugcucuccguuuggaaccguguguggauugaggaaaaccccuggauggaagauaagacacacgucucaagcugggaagagguucccuauuuagguaaaagggaggaucaaugguguggaagcuuaaucggacuuaccgcaagagcaacaugggcuacaaauauucaaguugcuauuaaccaaguaagaagauuaauugggaaugaaaauuaucuagacuauaugacuucaaugaagcgauucaaaaacgagucagauccugaaggcgcgcuaugguaa

SEQ ID NO: 21136 - RNA, 9879 nt, Artificial Sequence
  derived and/or modified CDS sequence (opt6) from DENV-1__FJ850087__SS-prME
agcguaacuaugcuccuaaugcuauuaccgacugcgcuugccuuucaccugacaacuaggggaggagaaccucauaugauuguaucaaaacaagaacgaggaaaaucauuacuauuuaaaacuuccguuggaguuaauauguguacucucaucgcuauggaucuaggugaacuaugugaagauaccaugacuuauaaauguccgagaauuaccgaagcagaaccugaugacguagauugcuggugcaacgccacggauacuugggucacuuauggaacuugcucacaaacaggagaacauagaagagauaaacgcucaguagcacuugcaccccacguaggauuaggauuagaaacacggacggaaaccuggaugucgucggaaggagccuggaaacaaauacaaaaagucgaaacuugggcacuaagacauccagguuucacuguaauagcacuauuuuuagcucaugcaauuggaacuucaaucacacaaaaaggcaucaucuucauauuauuaauguuagucacaccgucuauggcaaugagauguguuggcauaggcaaccgggauuucguugaaggcuugaguggugcaacuugggucgacguagugcucgaacauggaucauguguaacgaccauggcuaaaaauaaaccuacguuagacauugaacuacuuaaaaccgaagugacuaacccugcuguccuuagaaaacucuguauagaagcaaaaauaagcaacacgacaacagacagucgauguccaacgcaaggcgaagcuaccuuaguugaagaacaagaugcaaacuuuguguguagaaggacuuuugucgacagaggcuggggcaauggauguggguuauuugguaaggguaguuugcuaacaugcgcgaaauucaagugcguaacgaaacuggagggaaagauuguccaauaugagaaucuaaaguauucugucaucgucacgguucauacuggagaccagcaucagguuggaaacgaaacaaccgagcacggaacuauagcaacgauuaccccucaggccccaacaucagaaauacaauuaacggacuauggagcguuaacauuagacugcaguccucguacuggcuuagauuuuaaugaaaugguuuuauuaacaaugaaggagaaaagcuggcuaguucacaaacaaugguuucuugaucuuccccuuccauggacaaguggggcaagcacaagucaagaaaccuggaauagacaagaccuauuggucacuuuuaaaaccgcucacgccaagaaacaagaaguaguuguauuaggaagccaagaaggugccaugcauacugcuuugacgggagcaacagaaauucagacaaguggaaccacuacuauauuugcuggccaccuuaaauguagauuaaaaauggauaaguuaacucuaaaggggaugucuuauguaaugugcacgggcucguuuaaacuugagaaggaaguugcugaaacucaacauggaacagugcuuguacaaguaaaauacgaagggaccgacgcaccauguaagaucccguuucugacacaggaugaaaaaggaguaacgcaaaauggccgccucaucacugccaauccuauaguuacugauaaagaaaaaccagugaacauagaaacagaaccaccguuuggagaaucauauauugucguuggugccggugaaaaagcacuuaaacuaucuugguuuaaaaagggaucgagcauaggcaagauguuugaagcuacagcaaggggugcgcgcaggauggcuauauuaggugacacugcuugggacuucggaagcauaggcggccuguucaccagugucggaaaauuaauacaucaaguauuuggaacagcauacggcguccucuucucuggggugucguggacaaugaaaauaggaaucggaauuuuacugaccugguugggacuaaauucaagaucaacuucauuaucuaugacguguauagcaguuggaauggucacauuguaucuagggguaaugguccaagccgauaguggcuguguaauaaacuggaaaggaagagaauugaaguguggaagcgggauauuuguaaccaaugagguccauacauggacagagcaguauaaauuccaagcagauuccccaaaaagacucucagcagcuaucggaaaagcaugggaagaaggagucugugggauaagaucagcaacacgacuagaaaauaucauguggaagcaaauaaguaacgaguugaauuacauacuauuggaaaaugauaugaaguuuacaguuguaguaggggacguaaauggaauauuagcucaagggaagaaaaugauacgaccacagccaauggaacacaaauauaguuggaaauccuggggcaaggcaaaaauuauuggagcggacauccagaacaccacauucauuauagauggaccagacacaccugaauguccagacgaccagagagcguggaauaucugggaaguggaagacuauggauucgguaucuucacuacaaauaucugguuaaagcuaagggauucgcacacacaaaugugcgaccacaggcucaugucagcugccauaaaagauucaaaagcaguccaugcugauauggguuacuggauagaaagugagaaaaaugaaacauggaagcucgcucgagccucguucauagaagucaaaacuugcauauggccuaaaagucacacacucuggucuaaugguguauuagaaucagaaaugguaauaccgaaaauuuacggagggccuauaagccagcacaauuaucgaccaggguacuuuacacagacagcgggcccuuggcauuuaggaaaauuagaacuagacuuugauuuaugcgagggcaccacagucguaguagacgagcauugcggguauagggguccaucccuuagaacuacgacaguaacaggaaaaauaauucacgaaugguguuguaggucguguacuuuacccccacuacgauuuagaggugaagauggaugcugguaugggauggaaauucguccgguuaaagagaaagaagagaaucuuguuagaucaaugguuagcgcaggaucgggagaaguugacucuuuuucccuagggauucuaugugugucgauacuuauagaagaggucaugagaucucgauggucacguaagauguuaaugacuggaacauuaguaguguuuuuacuacuaauuauggggcagcuuaccuggaaugacuugauuagauuguguaucaugguaggagcgaaugccagugacagaauggguauggggaccacguaccucgcucuuauggcaacuuucaagaugcgaccaauguucgcaguaggacuacuauuuaggcgacuuaccagcagagaaguauugcugcucaccguaggcuuaaguuugguagcaucaguugagcuacccaauaguuuagaagaauuaggagauggacuggcgaugggaauaaugauguuaaaauuacugacugauuuccagccccaucaauuauggacgacauuauugucucuaacauuuauuagaacaagucuaucguuggauuacgcauggaaaaccauggccauggcacucucuauugugagccuauucccgcuuugccuuaguacuacaagucagaaaacaacauggcuacccguccuauuagggaguuuugggugcaaaccucuaacaauguucuuaauaacggagaauaagauauggggucgaaaaaguuggccaauaaaugaaggaauaauggcaguaggaauaguuucaauacuuuuaucaucacucuugaaaaacgacguuccgcuagcuggaccauugauagccggaggaauguuaauugcuuguuaugucauaucuggaucgagugcggacuugagccuagagaaagcagccgaggucaguugggaagaggaagcugaacauucaggaacaagucacaauauucucguagagguccaagaugaugguacgaugaaaauuaaagaugaagaacgugacgacacacuuacaauacucuuaaaggcuacgcuauuagcaguaagcgguguauauccaaugagcauaccagcgacucuauuugucugguacuuuuggcagaagaagaaacaacgaagcggaguuuuaugggauacaccaucaccaccugaaguagaaagagccguguuggaugauggcauauaccguauucuacaaagagggcuauuagguagaagucaagucggaguagggguacugcaagauggugucuuucacacuauguggcauguuacgagaggcgccguacucauguaucaggggaaaagauuagaaccaucaugggcgucggucaagaaagauuuaauaucauauggcggaggguggcguuuucaggggagcuggaauaccggggaagaagugcaaguuauagccguugaaccgggcaaaaauccuaaaaauguacaaacuacgccuggaacguucaaaaccccugaaggggaaguaggagcaaucgcacuagauuuuaaaccgggaacaagcgguucgccgauugugaauagagaaggaaaaauuguagguuuguacggaaacgguguuguuacaaccagcggaacuuacguaucagcaauagcgcaagcaaaggcaacccaagagggaccgcuacccgaaauagaagacgaaguauuuaaaaagcgaaacuugacaauuauggauuugcauccugguaguggcaagacgcgaagauaucuuccugcaaucguaagagaagcaaucaagagaaaauugcguacacuaauccuagcuccaacuagaguaguagcuuccgagauggcagaagcucucaaaggcaugccuauacgcuaccaaacuacagcugucaagucugagcauacaggccgcgaaaucguugacuuaaugugucaugcuacauucaccaugagauuacucagcccaguaagaguaccaaauuauaauaugauaauaauggacgaagcacauuuuacagacccugcaaguauugcagccagaggauauaucucaacaagagugggaaugggugaagcggccgcaauauucaugacugccacgccgccgggaucagucgaagccuuuccacagaguaacgcggucauucaagacgaagaaagagacauuccugaaaggucguggaacucaggguacgacuggauuacugacuucccggguaaaacuguaugguuuguccccaguauaaagagcgguaacgauaucgcaaacugcuuaagaaagaauggaaaaagagugauacaacuaucaaggaagacauucgauacggaauaucagaaaacuaaaaauaaugauugggauuacgucguuacaacggauaucagcgaaaugggugcuaauuuuagggccgauaggguaauugauccaagaagauguuugaaaccggugauauugaaggaaggaccagaacgcguaauucuagcugggccaaugccaguaacuguggcuagugccgcucaacgccgggguaggauaggaagaaaccaaaacaaggaaggagaucaguauaucuacaugggucaaccgcuuaauaaugacgaggaucacgcacacuggacagaggcaaaaauguuauuagauaauauaaacacaccagaaggcauuauuccggcauuauuugaaccugaacgagaaaagagcgcugccauugauggggaauaucgauuacguggugaagcaagaaaaacauucguggaacuuaugcggcgaggggaccuaccugugugguuaucguacaaaguagcaucugagggauuccaauacagugaccgccgaugguguuuugauggugagagaaacaaucaaguucuugaagaaaacauggacguggagauuuggacaaaggaaggugagcgaaagaaauuacgcccgaggugguuggaugcacgcacuuauuccgacccgcuggcgcuuagagaguuuaaagaguucgcggcagggagacgaagugugaguggcgacuuaauacucgaaauagggaaacugccccaacauuuaacucuuagggcucaaaacgccuuggauaaccuaguuaugcuucauaauagugagcagggcggaaaagcauauagacaugcuauggaagaauuaccagauacgauagagacauuaauguuacuagcucuuauugcaguucucacgggugggguuacacuauucuuccuauccgggaaagggcuuggaaaaacaucgauagguuuacucuguguaauggcuuccucagcauuacuguggauggcaucuguugaaccgcauuggaucgcugcauccauaauuuuggaguucuucuuaaugguacugcuaauaccugagccagacagacagagaacgccccaagauaaucaauuagcauacguuguaauaggucuguuguucaugauccugacgguugcugcaaaugaaaugggacuuuuggaaacgacgaagaaagaccucggaauuggucauguggcuguagaaaaucaccaccacgcgacuauguuagacgucgacuuaaggccagccagugccuggacgcucuacgccgucgccacaaccgucauuacgccuaugaugcgccacacaauagaaaauacaacagcuaacauaucauuaacugcgauagcaaaucaagcagcgauacuuaugggguuggauaaaggauggccaaucuccaaaauggacauuggcguaccgcuacucgcauugggauguuauucucaggugaacccuuuaacauuaacagcugcuguccuuauguugguggcucauuaugcuaucauugguccuggucuucaagcuaaggccacucgcgaagcacaaaagaggacagcugcggggaucaugaaaaacccaacaguagaugggaucguaacuauugacuuagacccagugguguacgacgcaaaauuugaaaagcaauuagggcaaauuauguuauuaauccugugcacuucacaaauccuacucaugagaaccacaugggcuuuaugugagucuauaacuuuggcgacaggaccuuuaacgacauuaugggaaggcagcccaggaaaauuuuggaauacaacaauagcuguuaguauggcuaacauauuucguggcucguaucuagcuggggcaggcuuggccuuuagucucaugaaaucgcuugguggaggccgaagggguacgggggcacaaggagaaacucuaggcgaaaaauggaaaaggcaguuaaaccagcuaaguaagucggaguucaacacauacaagaagucagguauaauggagguagaucguucagaagcaaaagaaggucuuaaacgaggugaaacuacaaaacaugccguuagcaggggaacugcaaaacucagaugguucguagaacggaaucucguaaaacccgagggaaaagucauagaccuaggaugugguaggggaggguggagcuauuauugcgcggggcugaaaaagguaacagagguaaaagguuacacgaaaggaggcccagggcacgaagaaccaaucccaauggcuaccuaugguuggaauuuaguuaaguuacauucggguaaggauguguuuuucacuccaccagaaaaaugcgacacucucuugugugacaucggagagucuagcccgaauccaacaauagaagaaggcaggacucuaagaguacuaaaaauggucgagcccuggcugagagggaaucaauuuugcauaaaaauacugaacccauacaugccuaguguaguggaaacguuagaacaaaugcaaagaaaacacggcgggaugcugguaaggaacccguuaucacggaacucuacucacgagauguauuggguaucauguggaacggguaauauaguuagugccguaaacaugaccucaagaaugcuauugaaucgauuuacaauggcucaccgaaagcccaccuaugaaagggauguagaccugggagcgggcacucgucacguggcgguugaacccgaaguagcuaauuuagauaucauaggacaaaggaucgagaacauaaagaacgagcauaaaucgacuuggcacuaugaugaagauaaccccuacaaaaccugggcauaucauggaucauaugagguuaaaccaagcgggagcgcaucgaguaugguaaacggagucguaagacuguugacaaaaccgugggacgucauuccaaugguuacccagaucgcaaugaccgacacaacaccuuucgggcaacaaaggguuuuuaaggagaaaguggauacuagaaccccucgagcaaaaagagguacugcucaaaucauggaaguaacagccaaguggcuuuggggcuuucuaaguagaaacaaaaagccaagaauauguacgagagaagaguuuacccgaaaaguaaggaguaaugcagcuauuggagcuguauuugucgaugaaaaucaguggaacucagcaaaggaggcaguagaagacgaaagguuuugggacuugguucacagagaaagggaauugcauaaacaaggaaagugcgccacguguguuuauaacaugaugggcaaacgagagaagaaacucggugaguuugggaaagcuaaagguucuagagccauaugguauauguggcuaggcgcgagguucuuagaguuugaagcauugggcuuuaugaaugaagaccauugguuuucuagagaaaacaguuuaagugguguagaaggagagggucuccacaaacucggauacauacuaagagauauaaguaaaauaccgggagggaacauguaugcugacgauaccgcagggugggacacacguaucacagaagaugacuuacaaaaugaagcuaaaauaacugacaucauggaaccagaacacgcauuacuagccaccaguauauuuaaacuaacuuaccagaauaaagucgugagagugcagagaccagcuaaaucaggaacagugauggauguaauaucgcgaagagaucaacgaggaaguggucaggucggaacguaugguuuaaauacauuuaccaacauggaaguucaacuuauacgacaaauggaaucugaggguauuuucagcccuagugaauuagaaacccccaaccuagcuaagaaagucuuggacuggcuugaaaaacacggugccgaacgacucaaaagaauggcaauuucaggagaugacuguguuguaaaaccuauagacgaucgauuugcgacggcgcuaacagcacuuaacgauaugggaaaaguacguaaggauauaccgcagugggaacccagcaaaggauggaaugacuggcagcagguaccuuuuuguucucaucauuuccaucaauuaauuaugaaagacgggagagagauagucguaccuugccguaaucaagaugaauugguaggucgggcacgugugagccaaggagcgggcuggucucuaagagaaacugcaugucucggaaaaaguuacgcacaaauguggcaauuaauguacuuccauagaagagaccucagguuagcagcgaaugcaauauguucagcaguuccaguagacugggugccaacaucaagaacgaccuggagcauucaugcgcaucaucaauggaugacuacggaagacauguuaucaguauggaaccgagucuggauugaagaaaauccauggauggaggauaaaacccacgucaguucaugggaagaaguuccuuauuuaggcaaacgcgaggaccaguggugcgggagccuuauaggauuaacugcacgagcaacgugggccacuaauauucaaguugcgauuaaucagguuagacggcuaauuggaaaugagaacuacuuagacuacaugacaucuaugaaacguuuuaaaaacgaaucggacccggaaggagcucuuugguaa

SEQ ID NO: 21137 - RNA, 9879 nt, Artificial Sequence
  derived and/or modified CDS sequence (opt6) from DENV-1__FJ850090__SS-prME
agcguaacaauguuacuuaugcuccuaccaaccgcauuagcauuccauuuaacuacccguggaggagaaccgcauaugauaguuagcaaacaagaacgagguaaaucguuacuauuuaaaacaagcguuggcgugaauaugugcacacuaauugcuauggaccuuggagagcucugugaagacaccaugacuuauaagugcccuaggauaaccgaaguagagcccgaugauguagacugcugguguaacgccacggauacgugggugacauacggcacaugcucacaaacaggagaacaucgacgagacaaacgguccguagcacuagcaccgcauguuggauuggguuuagaaacaagaacagaaaccuggauguccucagagggagcauggaaacaaauccaaaaaguugaaacuugggcacuacgucacccaggguuuacaguaauugcccuguuucuggcacaugccaucgggacaucaauaacccaaaaaggaaucauauucauauugcucauguugguuacuccuucaauggcuaugcgaugcguggguaucgguaauagagacuuuguagaggguuuaaguggagcuacuuggguagacgugguccucgaacauggaucaugcguaaccaccauggcuaagaauaaacccacauuagauaucgaacucuuaaaaacugaaguaacuaauccggcgguucucagaaaacuuugcauagaagccaaaauaaguaauaccacaacggacaguagaugcccgacucaaggagaagcaacuuuaguugaggagcaagacgccaacuucguuugccggagaacauuuguggaucguggguggggaaacggauguggauuauucgguaaaggcucacuacuaacgugcgcgaaauuuaaaugugugacaaaacuggagggaaagauaguacaauaugagaacuugaaguacucuguuauugucacuguucauacgggagaccagcaucaaguuggcaacgaaacuacugaacauggcacuauagcgacaauuacuccgcaagcaccaaccucggaaauacaacuaacugauuauggugcacugacauuggauugcaguccaagaaccgguuuggacuuuaacgagaugguauuguuaacaaugaaagagaaauccugguuagugcauaaacaaugguuucuagaucucccauuaccauggacuucaggugcgaguacaucacaagaaacguggaaccgccaagauuuauuaguaacguuuaaaaccgcgcacgcgaaaaagcaagaaguaguaguacuggggucacaagaaggagcaaugcauacugcacuuacuggagcaacugagauacaaacgucaggcacaacgacaauuuuugcuggucaccuaaaaugcagacuaaaaauggacaaacuuacauuaaaagggaugucauauguuauguguacgggaaguuucaaacuggaaaaagaagucgcugagacgcagcaugguaccguauuaguucaaguaaaguacgagggaaccgaugcaccauguaaaauuccauuccuaacccaagaugaaaaagguguaauacaaaacgguagacugauaaccgcaaauccuauagugacagauaaagagaaaccaguaaauauagaaaccgaaccgccauucggcgaauccuauauuguaguaggggccggagaaaaagcacuaaaacugucaugguuuaaaaagggcucuaguaucggaaagauguuugaagcaaccgcacgaggcgcaaggcgcauggcgauucuaggggauacugcaugggauuucggaaguaucggaggacucuuuacuucggugggaaaacuuauccaucaaguuuuuggcacagcuuauggggugcuauuuuccgggguaucauggaccaugaaaaucggaaucggaauccuccuaacguggcugggauuaaauagcagaucaacgagccuaaguaugacguguauagcaguugguaugguaacccuuuacuugggcguuaugguucaggcagauucagguuguguaauaaauuggaaagguagagaguuaaaaugcggaucaggaauuuucguuacuaacgagguacacacauggacagaacaauacaaauuucaggcugauucccccaagagguugucugccgcaaucggcaaggcuugggaggaaggaguaugugggauacgcucugcgaccagacucgaaaauauaauguggaaacagauaucaaaugagcuaaacuacauccuccucgagaacgauaugaaguucaccgugguggucggagaugcuaacgguauucugacucaaggaaagaaaaugauacgaccgcaacccauggagcauaaguacuccuggaagucaugggguaaagccaaaauaauaggcgcugacauacaaaacacuacguuuauuauagacggaccggauacgccugagugcccugaugaccaaagagcuuggaauaucugggaagucgaggacuacggguucgguauauucacaacuaacauuuggcuaaaacuccgggauucacauacccaaaugugcgaccaucgguuaaugagugcugcgauuaaagauucuaaggcuguacaugccgauaugggauacuggaucgaaucagagaaaaaugagacguggaagcucgcgcgcgcuaguuuuauagagguaaaaacuuguauauggccaaaaucucauacacuauggucgaacgguguucuagaaucagaaaugauaauuccuaagaucuacgguggaccuacaagucaacacaacuauagaccuggcuauuuuacucagacugcaggccccuggcaccuaggaaaacuagaacucgauuuugaccuuugcgaagguacgacgguaguaguagaugaacauugcggauacaggggaccaucucucagaacuaccaccguuacuggaaaaauuauucacgaaugguguuguagaagcugcacucugccgccacuccgauuuagaggugaggauggcuguugguacggaauggaaauacgaccaguuaaagaaaaggaagaaaaucuugucagaucuaugguuagugcagggucgggagaagucgacaguuuuucgcuaggaauacuuugcgucucaaucuuaauagaagaaguaaugcguaguagauggucuaggaaaauguuaaugaccgguacauuagcgguauuuuuacuauugauaaugggccaauugacguggaaugaucuaaucagacuuuguauaauggucggugccaaugcgucggaccguauggggaugggaacaacauacuuggcucugauggcgacauuuaaaaugcgaccuauguucgcugucgggcuauuauuuagaaaacuuacaaguagagagguacuacuacuaacgauaggauuaucucuaguagcaagugucgaauuacccaacucacuugaagaauuaggcgauggacucgcuauggguauuaugaugcuuaaacuccuuacggauuuccagccacaucaauuauggacaacauuacuaucucuuacauucauaaggacgucacuauccuuagauuaugcuuggaaaacaauggcaauggcacuuucuauagugucgcuguucccacuaugucuuucgacaacaucccaaaagacgaccuggcuacccgucuuguuagguuccuuugguugcaaaccacuaacuauguuccugauuacugagaauaaaauuuggggaagaaaaagcuggccaauaaaugaagguauaauggcaguagguaucguaucuauacuacugucaucgcuacugaaaaaugauguaccacuagcgggcccguugauugccggagggaugcuaauagcauguuauguuaucagcggcagcuccgccgacuuaagccuggaaaaagcggcggagguuaguugggaggaagaggcggaacauucaggaacaucacauaauauacugguugaaguccaggacgaugguacaaugaagauuaaagaugaagaacgcgaugauacauuaacuauucucuuaaaagcaacucugcucgcugugagcggcguguacccaaugucaaucccagcgacacucuuuguuugguacuucuggcagaaaaagaaacaacgaaguggaguucugugggauacacccucgccacccgagguagaacgugcaguuuuagacgauggcauauaccguauauuacaacgaggucuacuaggucgcucacaaguuggggugggaguauuucaggacgggguauuccacacgauguggcaugucacgcgcggagcaguuuuaauguaucaaggaaaacgacuugaaccauccugggcaucugucaagaaagacuuaaucagcuacggcggaggauggagauuucaggggagcuggaauacaggagaagaaguucaaguaauagcaguagaaccagguaaaaauccuaaaaacguccaaacuacaccggggacuuuuaaaacuccagaaggugaaguuggcgcuauagcacuugauuucaaaccaggcacuagcggaagcccuauaguuaacagagaagguaaaauuguaggguuauacgguaacggagucguaacgacuucaggaacauacguuagugcaauagcacaagcgaaagccagccaagaaggaccccuaccugaaaucgaagaugaaguauuuaagaaacguaaucuaacaauaauggaucuacacccugguuccggaaaaacgcgcagguaccuuccagcaauuguccgugaggcaauaaaacguaagcuaaggacacuaauucuugcuccaacgagaguaguagcgagugagauggcggaagcgcuaaaaggaaugccgaucagauaucaaacaacagcaguaaaaucggaacacacaggcagagaaauaguggauuuaaugugucacgcaacguuuacgaugagauuauuaaguccagugcgcguuccgaacuacaauaugauuauaauggacgaagcgcauuucacggaccccgcaucaaucgcugccagagguuauauaucaacuagaguuggaaugggugaagcugcagcgauauucaugaccgcgacgccaccaggaagugucgaagcauuuccacaaaguaacgcggucauacaggaugaagaacgggauauaccagagagaucauggaacucgggguacgacuggauuacagacuucccuggaaaaacaguuugguucguaccuucuauaaagucuggaaaugauaucgccaacugccuaaggaaaaaugggaaaaggguaauacaacucucacgcaagacauucgacacggaauaucaaaagacuaaaaauaaugacugggauuauguagugaccacagacauaucagaaaugggagcuaauuucagagcugauagagucaucgauccuagaagaugucuuaaaccaguaauauuaaaagaugggccugaaagaguaauuuuagccggaccuaugcccguaacaguggcuagcgcagcccaacgaagaggaagaauagguaggaaccagaacaaagaaggagaucaauauaucuauaugggucaaccccugaacaacgaugaagaucaugcgcauuggacagaagcgaaaauguuauuagacaauauuaacacaccggaaggcaucauaccagcuuuauucgaaccagaaagagagaaaucugcagcaauagauggcgaauacaggcuaagaggcgaagcaagaaagacguuugucgaauuaaugagaagaggcgaccuuccgguuuggcuuucauauaaaguagcuucagaaggcuuucaauacuccgaucguagauggugcuuugacggcgaaagaaauaaccagguacucgaagaaaacauggacguagaaauauggaccaaagagggggaaaggaagaaacuacggccgcguuggcuagacgcaagaacauauucugauccacuggcucuacgagaguuuaaagaauuugcagcagggcgucgaucggucaguggcgauuugauucuagaaauaggaaaacuuccacaacaucuaacauuacgagcccagaaugcucuggacaaucuuguuauguuacacaauagugaacaaggcgggaaagcauauagacacgcuauggaggaauuaccugacacuaucgagacacucaugcuauuagcauuaauugcgguacuaacagguggcguuacucuguucuuccuauccgguaaagggcuaggaaaaacaaguauaggacucuugugcgucauggcaaguucugcauuacuauggauggcuuccguugaaccacacuggauagcggcuaguauuaucuuagaauuuuuccuaaugguguuguuaauaccugagcccgaccgucagagaacaccacaagauaaucagcuugcuuacguaguaaucggcuuauuauuuaugauucucacaguugcagcaaacgaaaugggacuacuagaaacaacuaagaaagaccuaggaaucggccauguagcggcagagaaccaccaucaugcaacgaugcuugauguagacuugagaccugccucugcuuggacucucuaugcagucgccacaacaguaaucacaccgaugaugcgacacacgaucgaaaacaccaccgccaauaucuccuuaacggcaauagcgaaccaagcggcuauacuaaugggucuggacaaggguuggccaauaaguaaaauggacauuggaguaccccuacuagcauuaggcugcuacagccaaguaaacccacucacucucacagccacaguacuaaugcuaguugcacauuacgccauuauuggaccgggacugcaagcaaaagcuacacgagaagcgcaaaaacgaacagcagcggggauaaugaaaaauccaacaguagauggcauaguaaccauugaucuugaucccguaguauaugaugcuaaguucgaaaagcaacuuggacaaauaauguuacucauauuaugcaccucucaaauacuguuaaugcguacaaccugggcccucugugaaucuauaacacuagcaacaggaccguuaaccacauuaugggaaggcuccccaggaaaauuuuggaauaccacgauugcaguaagcauggcaaacaucuuucgaggauccuacuuggcuggagcgggauuggcauuuagccugaugaagucuuuagguggugguaggagaggaaccggagcgcaaggggaaacacuaggggaaaaauggaaacgacaacuuaaccaauuaaguaaaucugaauuuaacacguacaagaaaagcggcaucauggagguugauagaagcgaagcaaaagaaggcuugaagcguggagaaacuacuaagcacgcaguuucgcgggggacugcaaaauuacguugguucguggaacggaauuuagucaaaccggagggaaaaguuauagaucuuggauguggaaggggaggaugguccuauuacugugcuggacuuaagaaaguaaccgaagugaaagguuacacaaagggagggccagggcacgaagaaccaaucccaauggccacguauggauggaaccuggucaaauuacauucaggaaaagauguauucuuuacaccgccggaaaaaugugauacacucuugugugauaucggagaaagcagcccaaacccuacgaucgaagaaggaagaacauuaagagucuuaaaaauggucgaaccauggcuuaggggcaaucaauuuugcauuaaaauucucaauccuuacaugccaaguguaguagaaacuuuggaacaaaugcaacgaaaacacggaggaauguuaguaagaaacccuuuaucaagaaacucaacacacgaaauguacuggguuucuuguggcacaggaaauaucguaucagcaguuaauaugacaucaagaaugcuuuuaaauagauuuacuauggcgcacagaaaacccacuuaugaacgagauguggaucuaggggcaggaacuagacauguggcuguugaaccagaaguagcaaauuuagauauuauuggacagcggauagaaaacaucaaaaaugaacacaagaguacauggcacuaugacgaggacaaccccuauaaaacaugggcauaucacggcaguuacgagguuaaaccgucaggaagcgcauccuccaugguaaacggggugguacgauuacucacuaagccaugggacguuauaccaaugguaacgcaaauagcaaugacugauacuacaccuuuuggccaacaacgggucuucaaggagaaggucgauacaagaacccccagagcaaaacgcggaaccgcacaaauaauggaaguaacagcgaaauggcuaugggauuucuuaucaaggaacaaaaagccaagaauaugcaccagagaagaguucacccgaaaaguaagaaguaaugcugcgauuggugcuguauuuguggaugagaaccaauggaacucagcgaaagaggcugucgaggaugagcguuuuugggauuuaguacauagggaacgagaguuacacaaacaaggaaaaugugcgacaugcguauacaauaugauggguaagcgugagaagaaacuuggggaauuugguaaagcgaaaggaaguagagccaucugguauauguggcucggagcccgauuucucgaguucgaggcuuuaggauuuaugaaugaagaucacugguucucaagggaaaauagucuauccggugucgaaggagagggcuugcauaaacuaggauauauacuacgugauauuuccaaaauaccugggggcaauauguacgcggaugauaccgcaggaugggacacucguauaacagaggaugaucuccagaacgaggcgaaaauuacagauaucauggaaccagaacaugcauuguuggccacgaguaucuucaaauuaacauaccaaaauaagguaguaagagugcagaggccugccaaaaguggaaccguaauggauguuauaagucgacgcgaucaaaggggcuccggccaaguuggaacuuauggacugaauacuuucacaaauauggagguucaauugauaaggcagauggaaagugaagguaucuucuccccgagugaauuagaaaccccuaacuuagcaaaaaggguauuggacuggcuagagaaacauggagcagaacgcuuaaaaaggauggcuaucagcggagacgacuguguaguaaaacccauagaugaccgguuugcgaccgcauugacugcccugaacgauauggggaagguucgaaaagauauaccacaaugggagccaaguaaagguuggaaugauuggcagcaagucccauucuguucacaucauuuccaucaacuaauuaugaaagaugggcgugauauaguagugccuuguaggaaccaagaugaacuugucgggagagcgagagugucacagggcgcaggauggagucucagggagacggcauguuuagguaaaucauacgcccaaauguggcagcuaauguacuuucauaggagagaucugcgucucgcagcgaacgcaauuuguuccgccgugccaguugacugggugccuacgucaaggacuacuuggagcauccacgcacaccaucaauggaugacaacagaggauaugcucucgguuuggaauagaguauggauagaagaaaauccauggauggaagacaaaacacacguaucuucaugggaagaagucccauacuuggggaagagagaagaucaaugguguggaucauugauaggucuaacugcccgggcaacuugggcuaccaacauccagguagcaauaaaccagguuagaagauuaauagguaaugaaaauuaucuugacuacaugacauccaugaagagauuuaagaaugaaucugauccagaaggagccuugugguaa

SEQ ID NO: 21138 - RNA, 9879 nt, Artificial Sequence
  derived and/or modified CDS sequence (opt6) from DENV-1__FJ850093__SS-prME
ucugugaccauguuguuaaugcucuuaccgacagcucuggcauuucauuuaacuacacgcggcggagaaccgcacaugaucgucuccaaacaagaacgagguaaaagucucuuauuuaaaacaagugcugguguuaacauguguaccuuaauagccauggauuuaggagagcucugugaagauacgaugacauacaaaugcccuagaaucaccgaagcugagcccgacgauguagauugcugguguaaugcgacugauacguggguaacauauggaacuuguagccaaacuggcgaacaccgacgagauaaaagaucgguugcauuagcuccccauguuggucucgguuuggagacaagaacagagacauggaugucaagugaaggggcguggaaacaaauucaaagagucgagacaugggcucuaagacacccagguuuuacaguaaucgcucuauucuuagcacacgcaauagguacgucaauaacucaaaaaggaauuauauucauacuauugauguuaguuacacccucuauggcuaugcgauguguugggauagguaauagagauuuuguggaagguuuaucaggcgcuaccuggguugacgucguuuuggaacaugguucaugcgugacuacaauggcuaaaaacaaaccuacacuagauauagaacugcuuaaaacugaagucaccaauccagcuguucuacguaaacucugcauagaagcaaaaaucagcaauacuacuacugauucacgaugucccacccaaggcgaagcaacucuaguagaggaacaagacgcaaacuucgucugucgcagaacuuuuguagaccgaggauggggaaacggcuguggucuauuugggaaaggcucauuacuaacuugcgccaaauucaaaugcguuacuaaguuagaagggaaaauaguacaauaugagaaccugaaauacagugugauugucacaguacauacaggugaccaacaccaaguaggaaaugagacaacagaacauggcacgauugcaacuauuacaccgcaagcuccgacuuccgaaauacaacuaacagacuauggugcacuuacgcucgauuguaguccaagaacuggguuagauuuuaaugaaaugguauugcugacgaugaaggaaaagucauggcugguacacaaacaaugguuccucgaucugccucuaccauggaccagcggggcaucuaccagccaagaaacuuggaaccggcaagaucuauuaguaacguucaaaacggcgcacgcuaagaaacaagagguggucguauugggaucacaagagggagcaaugcacacagcacuuacaggcgcuacagaaauucaaacaaguggaacaacaacgauauuugcaggacaucuuaagugccgacucaaaauggacaaacuuacccucaaagggaugagcuauguaaugugcacagguucuuuuaaacucgaaaaggaaguagccgagacgcaacauggaacugucuuaguccaaguaaaguacgaagggacagaugcaccauguaagauaccauuuuccacacaagaugaaaaaggugugacacaaaauggccgacuaauaacagccaauccuauuguuaccgauaaagaaaagccugugaacaucgaaacggaaccacccuuuggugaaaguuacaucgucgucggugccggcgaaaaagcauuaaaauuaucaugguucaaaaagggauccucuauugguaaaauguuugaagcuacugcaagaggggcucgaagaauggcgauacucggagacacagccugggauuuugguaguaucggaggaguuuuuaccucaguuggaaaauuaguacaccaaguguuugggacagcauacgguguguuauucucaggaguaaguuggacuaugaaaauaggaauagguauacuauugaccuggcugggacuaaauuccagauccacaagucuuaguaugaccuguauugcuguugggauggucacucuauaucuaggaguaaugguucaagcggacuccggauguguuauuaauuggaaaggcagggaguuaaaaugugguagcggcauuuucguaaccaaugaaguccauacauggacggagcaauauaaauuccaagcagauaguccgaagagacuuagugcagcaaucgggaaggcuugggaggaggggguuugcgguauaagaagcgcaacaagauuagagaauaucauguggaagcaaauaucgaacgaauugaaccacauccuucuugaaaaugauaugaaguuuaccguaguugugggugaugcaaauggaauauuagcccaaggcaaaaagaugauccgaccacaacccauggaacacaaauacucauggaaaaguugggguaaagccaaaauuauuggagcagauauacaaaauacuaccuuuaucaucgaugguccugacacuccggagugcccggacggacaaagagcauggaacauuugggagguugaagacuauggauucggcauuuucacuacaaacauauggcugaaguuacgcgauaguuauacgcaaaugugcgaucacaggcucaugucugccgcaauaaaagacaguaaggcuguacaugcagauauggguuauuggauugagagcgaaaagaacgagacauggaaauuagcgagagcuagcuuuaucgaagucaaaaccugcacauggccaaaaucacauacauuaugguccaauggcguauuagagucugaaaugauaauuccaaaaaucuacggaggaccaauaagccaacacaacuaucguccuggauauuucacgcaaacagccgggcccuggcauuuaggaaaacuugaauuagacuucgaccugugugaaggaacuacuguagucgucgaugagcauugugggaacagggggcccagucuacggacaacuacaguaaccggaaaaauaauucacgaaugguguugcagaaguugcacacuaccaccccuucgauuucgcggcgaagauggauguugguacggcauggaaauuagaccaguaaaagagaaggaagaaaaucuaguaagaucuaugguuucggcaggaucaggagagguagauagcuucucauuaggaauacugugugucucaaucaugaucgaagaagugaugaggucaagauggucccgaaaaaugcuuaugacuggaacuuuagcagucuuuuuacuucuaauaaugggacaacuaaccuggaaugaccuaauuagacuuuguauuaugguaggugcaaaugcaucagacaggauggguauggguacgacacauuuggcacuuauggcuacguucaagaugcgcccuauguucgcgguuggccugcucuuuaggcgcuuaacaucuagggaagucuuacuacuaacuauaggacuaucuuuaauggcuucaauggagcuuccaaauagcuuagaagaacuaggagauggacuugcuauggggauaaugauguuaaaacuguuaaccgaguuucaaccccaccaauuguggacaacuuugcuaucucuaacauuugugaaaacgacgcuauccuuagauuaugcuuggaaaaccacggcuaugauuuuaucaaucguaucacucuucccacuaugucuuucgacgacaagccagaaaacgacuugguuaccaguauuguuagggucguuuggauguaaaccucucacgauguucuuaauaacggaaaauaaaauauggggaagaaaaucauggcccuuaaaugaagguaucauggcgauaggcauagucucgauacuauugaguagucuccuuaaaaaugauguaccucuugcgggaccccuuauagccggagguauguuaauugcaugcuauguaaucuccgguucauccgcggauuuaucacuagagaaagcugcggaggugucaugggagcaagaagccgaacacucaggagccucacauaacauccucguggagguccaagacgacgggacuaugaaaauaaaagaugaagaacgagaugacacgcucacgaucuuguuaaaagcgacauuauuggccguaagcggaguauacccaaugaguauuccagcuacguuauuugugugguauuucuggcagaagaagaaacaacgcucuggaguccuuugggauacuccuaguccgccagagguagaaagagcaguauuggacgaugggauuuaccgaauacuacagagagggcuccugggaaggucgcaaguaggggucggugucuuucaggacgggguauuucauacaauguggcacgucacacguggagcaguacuaauguaucaaggaaaaagauuagaaccaucaugggcgagcguuaagaaagaucugaucucauaugguggaggauggcgauuccaaggcaguuggaauacaggagaagaaguucaagucaucgcaguagagccuggaaagaauccuaaaaauguacaaacaacuccuggaaccuucaaaacaccggaaggagaaguuggcgcgauugcauuagacuuuaaaccaggcacauccgguaguccgauaguaaaucgggagggaaagauaguuggacuguacgggaauggaguggucacaacaucagguacauacguuagugcuaucgcucaagcgaaagccucgcaagaggggccacuuccggaaauagaggacgaaguauuuaagaaacguaaucuaacgauaauggauuuacacccugggucaggaaaaacaagaagauaucugccagcgaucguccgagaagcaauaaaacguaagcuaagaacucugauacuagcaccaaccagagucguggcuagugaaauggcggaagcccugaaagguaugcccauuagauaucaaacuacugccguaaagagcgagacgaccggacgagagauuguugauuugaugugccacgcaacuuuuacaaugagguuacuaucgccaguacgugugcccaauuacaacaugauaauaauggaugaggcccauuucacagacccagcgagcauugcugcuagagguuacaucucaacacguguaggaaugggugaagcagccgcaauuuucaugacagcuacacccccggguagcgucgaagcguuuccucagucgaaugcaguuauacaagacgaagaaagagauauccccgaacgauccuggaacucagguuacgacuggauuacagacuuuccggguaaaacaguaugguucgugccuuccauaaaaagcgguaacgauaucgcaaauugccuuagaaagaauggaaaaagagucauucaauugucacgcaagaccuuugacacagaauaucagaaaacuaaaaacaacgacugggauuacgugguuacuacagauaucucagaaaugggcgcaaacuucagagcagauagaguaauagacccucggagauguuugaaacccgucauauuaaaggaugguccagagagagucaucuuagcgggaccuaugccaguaacaguggcaucugccgcacagagacgcggccgaauagguagaaaucaaaauaaagaaggugaucaauauguuuauaugggacagccuuuaaacaacgaugaagaucaugcgcacuggacugaagcaaagauguugcuggauaacauuaauacaccugaagguauaauuccagcauuguucgaaccugaacgugagaaaagcgcagcgauagacggugaauaccgguuaagaggagaagcucgaaagacauucguugaacugaugaggaggggcgaucuaccuguaugguuaucguauaaggucgcuucagaaggauuccaauauagugacagaagaugguguuucgacggagaacgcaacaaccaggucuuggaggaaaauauggacguugaaauauggacuaaagaaggagaacggaagaaacuuagaccuagaugguuagacgcaagaacauauucugauccuuuagcccuucgagaauuuaaagaguuugcugcugggcguaggagugugaguggagaccuaauccuugagaucggaaaauuaccucaacauuuaacgcuucgcgcccaaaaugccuuagauaauuuaguaauguugcauaacucagaacaaggggguaaagcguacagacaugccauggaagaacuacccgacacuaucgaaacucucaugcuucuugccuuaauugcuguacuaacaggaggcgucaccuuauucuuucugucagggaaaggccugggaaaaacaagcauugguuuacuuuguguaaccgccucgagugcauuacuauggauggcaucaguagaaccacauuggauagcagcgucgauuauauuggaguucuuuuugauggugcuucuaauuccagaaccggaucgacagagaacaccacaggacaaccaacucgcauauguuguaaucggauuauuauucaugauucugacaguagcggcaaaugagaugggauugcucgaaacaacaaagaaagaucucggaauagguuauguggcggcagaaaaucaucagcaugcuaccaugcuugaugucgaccuacguccugccagugcauggacccucuacgcgguagcuacaacagucauuacacccaugaugcgccacacuaucgaaaauacgacagcaaauaucuccuugacagcaauagcuaaccaagcggcgauucucaugggucucgauaaaggcuggccaauaaguaaaauggacauaggcgugccuuuacuagcauuagguugcuacagccaaguaaacccguuaacauuaacugcagcagugcugaugcuagucgcacauuacgcuauuaucggaccagguuuacaagcuaaggcaacccgugaagcacagaaaagaaccgcggcaggcaucaugaaaaauccuacaguagacggaaucgucgcuauagacuuagauccagucgucuacgaugcaaaauuugaaaaacagcuuggucaaauuaugcuacucauauugugcacgucacaaauuuugcuaaugcgaaccacgugggcucuaugcgaaucuaucacacuggcuaccgggcccuuaacuacacugugggaagggagcccuggaaaauucuggaauacgacgauagcaguuuccauggcaaauauauuucgaggaucuuaucuagcaggagcaggauuagcauuuaguuuaaugaagucauuaggaggagggcgaagagguacgggggcucaaggggaaacauugggagagaaauggaaaaggcaguuaaaucaguuaagcaaaagcgaguucaauacuuacaagcgaaguggaauaauggaagucgaccgaucugaagcgaaggaaggacuuaaacgaggagaaacgacuaagcaugcuguaucucgagguaccgcgaaauugcgaugguuugucgaaagaaaucuuguaaaaccugaaggaaaggucauagauuugggaugcgguagaggaggauggaguuauuauugugcaggucuuaaacggguaacugaaguaaaagguuauacgaaagguggaccuggacacgaggaaccaauaccgauggcuacauacggauggaauuugguaaagcuacauucaggaaaagauguauucuucaugcccccagaaaaaugugacacauuauugugcgauaucggggaauccaguccuaauccaacaaucgaagaaggucgcacguuaagaguccuaaagaugguagaaccauggcuuaaaggaaaccaauuuugcauuaaaauccuaaauccguauaugccgucuguaguggaaacacuagagcaaaugcaaagaaagcauggggguaugcuaguacgcaacccauugagcagaaauaguacacaugaaauguauuggguaaguuguggaacaggaaacauaguaucggcgguuaauaugacaagucguauguuacuaaauagauuuacaauggcccacaggaaaccuacuuaugagcgagacguugaucugggagcaggcacaagacauguagcaguagaacccgaaguugcuaaucucgauauaauuggucaaagaauugaaaacauuaaaaacgaacauaaaucaacuuggcauuaugaugaagauaauccuuauaagacaugggccuaucauggauccuaugaggugaagccaagcgguagcgcuaguaguauggugaacggaguaguacgacuacuaacaaaacccugggaugugaucccaaugguaacacaaauagcaaugacugauacaacucccuuuggacaacaaagaguuuucaaagaaaaaguagauacacgaacuccuagagccaaaagagguacgacgcagaucauggaaguuacugcgaaaugguuaugggguuuccuaucaagaaauaagaaacccagaaucuguacccgagaagaauuuacucgaaagguacggucaaacgcugcuauaggagcgguuuucgucgacgaaaaccaauggaacucagccaaggaagcaguugaagaugagagauuuugggaucugguccauagagaaagggaauuacauaagcaagggaagugugcgaccuguguguauaacaugauggggaaaagagaaaagaaacuuggagaauuugggaaagcuaaagggagccgagcgauaugguacauguggcucggagcuagauuccuugaauuugaagcucugggauucaugaaugaagaucauugguucucaagggaaaacagucugucggguguggaaggagaagguuuacacaaacuaggauauauucuccgagauauuucuaaaauaccaggggguaacauguacgccgaugacacagccggaugggauacuagaauaaccgaggaugaccugcaaaacgaggcaaaaauuaccgauaucauggaaccagagcacgcgcuauuagcaacgucaauauuuaaauuaacuuaucaaaauaaagucguuagagugcagaggccugcgaaaaauggcacaguaauggacguaauaagcagacgagaucaaagaggaucaggacaaguugguaccuauggcuugaauacauucacuaauauggaaguccaauuaauucgacaaauggaauccgaaggcauauuucucccuagugaacucgaaacuccgaaucuggccgagaggguacuugauuggcuagaaaaacacggugccgaaagacuuaaaagaauggcuauaaguggugacgacugcguuguaaaaccgauagaugaucguuucgcuaccgcacuuacagcccuuaaugauaugggaaaaguacgaaaggauauuccucaaugggagccuucaaaaggauggaaugauuggcaacaggugccuuuuugcucucaccacuuucaucaguuaauuaugaaagauggcagagaaauaguaguaccuuguagaaaccaagacgaacuuguaggaagggcuagagugucucaaggcgcuggguggucccuuagagaaacggcauguuuaggaaaaucauacgcccaaauguggcaacuaauguauuuucaucgaagagauuuaagacuagccgccaacgcuauauguucagcaguaccgguagauuggguuccaaccucgcguacaacguggagcauucaugcgcaccaccaguggaugacuacugaagacaugcuuaguguauggaacagaguauggauugaggaaaacccauggauggaagacaaaacacaugugaguaguugggaagaaguaccauaccuaggaaaacgugaagaucagugguguggcagucuuauaggacuaacugcucgagcuacaugggcaacgaauauacaagucgcuauuaaucagguaagacgucuuauaggaaaugaaaauuauuuagacuacaugacuucaaugaaaagauuuaaaaacgaaucagauccagagggcgcucuuugguaa

SEQ ID NO: 21139 - RNA, 9879 nt, Artificial Sequence
  derived and/or modified CDS sequence (opt6) from DENV-1__GU131863__SS-prME
agcguuaccaugcuccuaaugcuucuaccaacugcucuggcuuuucacuuaacuacaagaggaggcgaaccucauaugauuguuucgaaacaggaaaggggcaagagcuuacuauuuaaaacgagcguugggguaaacauguguacacuaauugcaauggaucuuggcgaacuaugugaagacacuaugacguauaaauguccaagaauuacagaagcggaaccugaugacguggauugcuggugcaacgcaaccgacacuugggucacauauggaacguguucucaaaccggagaacaucgacgcgauaaaagauccguagcacuagcgccacaugugggccuaggguuagaaacgaggacggaaacauggaugucaagugaaggagccuggaaacaaauacaaaaagucgaaaccugggccuuaaggcaucccggauucacaguaaucgcacuauuucuggcccaugcgauuggcacaucgauaacccaaaaagggaucauuuuuauacuauuaaugcuagugacgccaagcauggcaaugagaugugucgguauuggaaauagagacuucguugagggccuuucuggggcaacguggguugauguaguauuagagcaugggagcugugugaccacgauggccaaaaacaaaccaacauuagauauagaacuuuuaaaaacagagguaacuaacccagcaguccucagaaaauuauguauagaagcuaaaauaaguaauaccaccacagauuccagauguccuacucagggagaagcuacuuugguugaagaacaagacgcuaacuuuguauguagacgcacuuuuguugacagagggugggguaaugguuguggauuguuugggaaaggaucguugcuaaccugugcaaaauuuaaaugugucacaaaauuggaagggaaaaucguacaauacgagaaucuaaaauauucgguaauuguaacgguacauaccggagaccaacaccaaguaggaaacgaaaccacggagcacggcacgaucgcaacgauuacgccgcaggccccuacaucagagauacagcugacugacuauggggcuuugacgcuagauuguucaccacgcaccggcuuagauuuuaacgagaugguccugcucacaaugaaagagaaaagcuggcuaguacauaaacaaugguuccuagaucuaccacuaccuuggacuucaggggccucaaccagccaggaaacguggaauagacaagaucuacuuguuaccuuuaaaacagcacaugcgaagaaacaagaaguuguuguacuggggucacaagaaggugccaugcacaccgcacucacaggagcuaccgaaauucaaacaucagguacaaccacuauauuugcaggucacuugaaaugucgacucaaaauggauaaacuaacgcuaaaaggaaugagcuauguaaugugcaccgguucauucaaacuggagaaagaaguggcugaaacucagcauggaacagugcuuguacaagugaaauaugaaggaacagacgcuccauguaaaauuccauuuuugacccaagaugaaaaaggugugacacaaaacgggcgauuaauaacagcaaauccuaucguaacagacaaagaaaaaccagucaauauagaaacagaaccgccauucggggaaucguacauugucguaggugccggggaaaaggcuuuaaaacuauccugguucaagaaagguaguaguauagguaaaauguuugaggcaacugcgagaggagcacgaagaauggcuauuuuaggagauacugcaugggauuucgguaguauaggggguuuauuuaccuccguuggaaaauugauucaccaaguuuuugggacggccuauggaguccuauuuagcgguguaagcuggacaaugaaaauugguauaggaauuuuacuaacuuggcuaggccugaacaguaggucaacuucacuuucuaugacaugcaucgcaguagguauggugacguuauacuuaggagugaugguacaagcugacuccgguugcguaauaaauuggaaagguagagaguuaaaaugugguucaggaaucuucguuacaaacgaaguacacacauggacagagcaguauaaauuccaggccgacaguccaaaaagguuguccgcagccauaggaaaggcuugggaagaaggaguaugugguaucagaagcgcaacaagauuagagaauauaauguggaaacaaauuucuaaugagcuaaauuauauccuauuagaaaacgauaugaaauuuacagucguaguaggggacaucaauggcaucuuagcucaaggcaagaaaaugauacggccucaaccaauggaacacaaauacaguuggaaaaguugggguaaagcaaaaauaauaggugcugauauucaaaauacgacauucauuauagacggaccagauacacccgaguguccagacgaccaacgcgcuuggaauauaugggaggucgaagauuauggguuuggaauuuuuacuacuaauauaugguugaaacuuagagacagucacacccaaaugugugaccacagauuaaugucggcagcgauuaaagauagcaaagcuguacacgcggacaugggguauuggaucgagagugagaaaaaugagaccuggaaauuagccagggcgucauucauagagguuaagacauguauauggccaaaaagccauacauuauggucgaacggaguucuugagucugaaaugguuauaccaaaaauauacggagguccgauaagucaacacaauuaucguccaggauauuuuacacaaaccgccgguccauggcaccuuggaaaacuggaguuggauuuugaucuuugugagggaacaacuguaguugucgaugaacacugcggauacagagggccuucacugcggaccacaacaguaacagguaaaauaauucacgaguggugcugccggagcuguacgcucccuccccuuagguuccguggugaagaugggugcugguacggaauggagaucagaccaguaaaggaaaaggaagaaaacuuaguacgaaguaugguuagcgcagguaguggagaaguggauuccuuuagucuugggauauuauguguaucaauacuaauagaagaaguuaugagaucucgguggaguagaaaaaugcuaaugaccggcacauuagcuguauuccuucucuugauaaugggccaauuaaccuggaaugaucuaauuagacuuuguauaaugguuggcgccaaugcaagugaucguaugggaaugggaacaacuuaucuggcacugauggcaacauucaaaaugagaccaauguucgcagucgggcugcuauuccgaagguugacgagucgcgaggucuugcucuugacaguaggacugagcuuaguagcgucaguggaauuacccaauucuuuagaagaauuaggagacggacuagcaaugggcaucaugaugcuuaaacuuuuaacggacuuucaaccgcaucaacuuuggacgacguuacucaguuuaacauuuaucagaacaagucucucuuuggacuaugcauggaagacgauggcaauggcacuaucuaucguaaguuuauucccacuauguuuaucaacgacaagccagaaaacuacauggcugccuguguuacuuggaucauuuggaugcaagccacugacuauguuuuuaauaacugagaacaagauuuggggacgaaaaucauggccuauaaacgaagguauaauggcaguaggcaucguaaguauucugcucucaucguuacuaaagaaugacguaccauuagcggggccucuaauugcuggaggaauguuaauugcuugcuacguuauuagugggucuucagccgaucucaguuuagaaaaagcagcugaaguaucuugggaagaagaagcugaacacaguggaaccucacauaauauuuuaguugaaguccaagacgacggaaccaugaaaauaaaggaugaagagagggaugauacacuuaccauccuacuaaaagcaacccugcuagcugugucaggaguguauccaaugaguaucccagcaacacuuuucguaugguauuucuggcagaagaagaaacagagaagugguguacucugggauacccccucaccacccgagguagagagggcaguguuggacgaugggauuuaucggauacuccaacgagggcuucuaggccgaucacaaguugggguaggcguuuuucaagaugguguauuucauacuauguggcauguaacuaggggagcgguacuaauguaucaaggaaaacgacuagagccuucaugggccagcgugaagaaagaucucauuaguuacgggggcggauggagauuucaagguucauggaauacaggagaagaagugcagguaauagcaguugaacccgguaaaaaucccaaaaacguucaaacuacaccagguacuuuuaaaacuccagagggagagguaggggcaauagcacuagauuucaaaccaggaacaagcgguuccccuaucguaaauagagagggaaaaauagugggcuuauaugguaacggugugguaaccacuucgggaacuuacgugagcgcaauagcucaggcaaaagcgacucaggaaggaccauuacccgaaauugaagacgagguauuuaagaaacggaauuuaacgauuauggaucuucauccugggucgggcaaaacacgaagguauuuaccagcgauaguuagggaagcaauuaaaagaaaauuacggacccugauccucgcuccaacacgcguaguggcgagugagauggccgaagcucuaaaagguaugccaauucgguaccagacgacagccguaaaaucagaacauacaggucgagaaauagucgauuuaaugugccaugcuacauuuaccaugcguuuacucucucccguacgagugccaaacuauaauaugauuauaauggaugaagcacacuucacugauccugcuucaaucgcagcacgagguuacaucucaaccagaguagguaugggagaagcagcagcaaucuucaugacagcaacgccgccaggauccguugaagcguuuccucaauccaaugcuguaauucaagaugaagaacgagauauaccugaaagaucauggaacagcggauaugauuggauuacagauuucccuggcaagacgguaugguuuguuccaucuaucaaaucaggcaacgacaucgcaaauugccuaaggaaaaacggcaagagaguuauacaacuaagucgaaaaacguuugauacagaauaccaaaagacgaaaaacaacgacugggacuauguggugacaaccgauaucagcgaaaugggagccaacuuuagggcggauagaguuauagacccaagacgauguuuaaaaccaguaauacugaaagaaggacccgaacggguaauauuggcugguccuaugccuguuacgguagcauccgccgcccaaagacgcggucguauaggccgaaaucaaaauaaggaaggcgaucaauacaucuacauggggcaaccuuuaaauaaugacgaggaucaugcgcauuggaccgaggcaaaaauguuauuagacaauauaaauacgccagaaggaauaauuccagcgcuuuuugaaccagaaagagaaaagucagcagcuauugauggggaauaccgacuccgaggagaagcuaggaaaacuuucguagaacucaugagacguggagaccucccaguuuggcuaucauauaaaguagcaagcgaaggauuucaauacagcgauaggcgaugguguuucgauggcgaaagaaacaaccagguacuugaggagaacauggacguggaaaucuggacuaaagaaggagaaaggaagaaauuacgacccagauggcuugaugcucgcacauacagcgauccccuagccuugagagaauuuaaagaguuugccgcaggcaggagaagcguaucaggugaucugauauuggaaaucggaaaacuuccucaacaucuaacauuaagagcucaaaaugccuuagacaacuuggucaugcuacauaacagugagcaaggagggaaggccuaucgacaugccauggaagaauuaccugacaccauagagacccucaugcugcucgcauuaauagcuguuuuaacgggagggguuacccuuuucuuccuuagugguaaaggauuagguaaaacaaguauuggauuacuuugcgucauggcaucaucagcuuugcuauggauggcaaguguugaaccucacuggauagcggcaucaauuauauuggaguucuuuuugaugguucugcuuauuccagagccagaucgacaaagaaccccacaggacaaccaauuagcauaugucguaauaggacuacuuuuuaugauauugacggucgcggcaaacgagaugggccuauuggaaacaacuaagaaggacuuaggaaucggccauguggcuguugagaaucaccaccacgcaacuaugcuugacguugacuugcggccggccagugccuggacucuauaugcuguagccaccaccguaauuacaccaaugaugcgacacacgauagaaaacacgacugcuaacaucucacuaacugcuaucgcuaaccaagcagcaauauuaaugggucuagacaaaggcuggccuaucucuaaaauggacauagguguuccauuguuggcguuaggguguuacagucaaguaaacccacuuacucuaacagcugcaguccuuaugcuaguugcucauuacgcaauaauaggucccggauuacaagcaaaagccacgagagaggcacagaaaagaacugccgccggaauaaugaagaauccaacgguugaugggauagucacaauugacuuagauccggugguuuacgaugcuaaauucgagaagcaacuuggccaaauaaugcuacucauuuuguguaccucucaaauccuucuuaugcgaacuacuugggcccuaugugaaucuaucacauuagcaacuggaccgcuuacgacuuugugggaggguucacccggaaaauuuuggaacacaacgauugcagucaguauggcgaauauauuccguggaucuuaucuggcuggagcaggacuggcguucucacugaugaaaucacugggcggcgguagaagagguacaggagcacaaggagaaacguuaggugaaaaauggaaaaggcaacugaaucaauuaaguaaauccgaguucaauacguacaagaaauccgguauaauggaaguugaucgcagugaggcaaaagaggguuuaaaaagaggcgaaacuacaaagcaugcaguauccagggggacggcaaaauuacguugguucguggagaggaauuuggucaaacccgaagggaaagugauugaccuugguugcggaagagguggcuggucauauuacugugcaggccugaagaagguuacugaaguaaaggguuauaccaaaggugguccgggucaugaagaaccuauuccaauggcuacauauggguggaaucucguuaaacuacacuccggcaaagauguauucuuuacgccaccagaaaaaugcgauacauuacucugcgauauuggagaaagcaguccuaacccuacaauugaggaggguaggacacucagaguauuaaaaaugguagaacccuggcuacgaggcaaccaauuuuguaucaaaauacuaaacccauauaugccgaguguaguugaaacauuggaacaaaugcaacgaaaacauggaggcaugcuagucagaaauccuuuaagcagaaauagcacacacgaaauguauuggguuucuuguggaacuggcaauauugugucggccguuaacaugacuucaaggauguuauuaaacagauucaccauggcucacaggaaacccacauaugaaagagacguugacuuaggggcagguacaagacacguagccguagaaccggagguagcaaacuuggauauaauagggcaacgcauagagaauauuaagaacgagcacaaaaguacuuggcauuaugacgaagauaauccauacaaaacuugggccuaucacggaucauacgaaguaaaaccaucaggaucagcgucauccaugguaaaugguguaguacgacugcuuacuaagccaugggaugucauaccuaugguaacacaaaucgcuaugacagauaccacgcccuuugggcaacaacgaguguuuaaggaaaaagucgacacaagaaccccacgagcaaaaagaggaacagcgcaaauuauggaaguaacggccaaauggcuauggggcuuccuaucaagaaauaagaaaccaagaaucuguacuagagaagaguucaccaggaaagugaggucgaacgcugcuaucggggcuguuuucguugaugaaaaccaauggaacucagcaaaggaggcaguagaagacgaacgauuuugggaucuaguucaucgagaaagagaacuccauaagcaagguaaaugugcuacuuguguuuauaauaugauggguaaacgagagaaaaagcuaggagaguuugguaaagcgaaaggaucucgagcuauaugguauauguggcuaggagcaagauuucuugaguuugaagccuugggauuuaugaacgaagaucauugguuuucucgugaaaauaguuuguccggaguugaaggcgaaggauuacauaaguuaggauacauauuacgggacauaucaaagauacccgguggcaacauguacgcagacgauacagcgggcugggacacucgcaucacagaggaugauuugcagaacgaggccaagauuacagauauuauggaaccagaacaugcguuguuggcaacaaguauauuuaaacuuacauaccaaaauaaaguaguucgaguacaaagaccugcgaaaucgggcacugugauggaugugauaagccgacgagaucagagaggaucaggacaaguagggacauauggacuaaacacauucacaaacauggaagugcaauugauuaggcagauggaaagugaagggauauuuaguccuagugaauuagaaacccccaaccucgcaaagaaaguacuagauugguuagagaaacacggugcggagcgccuuaaaagaauggcuauaucaggugacgacuguguaguuaaaccuaucgaugaucgauuugcgacagcucuaaccgcucuaaacgacaugggaaaaguaagaaaggacauaccacaaugggaacccucuaaaggguggaaugacuggcaacaaguuccuuuuuguucucaccacuuucaucaguuaauaaugaaagaugggagagaaauaguaguacccuguaggaaccaagacgaauuaguagggagagcacgaguaucccaaggagcuggauggagcuugagagaaacagcuugucuaggaaaaucuuacgcacaaauguggcaguugauguauuuccauagaagagaucucaggcucgcagccaaugccauuuguucagcuguucccguagacugggucccuacaaguaggacuacauggucuauccaugcccaccaccaauggaugacaacggaggacaugcuaaguguuuggaaucgaguguggauugaagaaaauccuuggauggaggauaagacgcauguaucgaguugggaagaaguacccuacuuagguaagagagaagaucagugguguggaagucugauaggacuaacagcgagagcgacaugggcuaccaauauacagguagccauuaaucagguuaggagauuaauaggaaaugaaaacuaucuugacuauaugaccagcaugaaaagguucaaaaaugaguccgauccugaaggugcucucugguaa

SEQ ID NO: 21140 - RNA, 9879 nt, Artificial Sequence
  derived and/or modified CDS sequence (opt6) from DENV-1__GQ868559__SS-prME
uccgugacaaugcuucuaaugcuucuacccacagcauuagcuuuccauuugacaacacgcggaggugaaccacauaugauaguuaguaaacaagagagaggcaaaucucuacuguucaaaacaucugcaggcgucaacaugugcacauuaauugcuauggaucuaggagaacuaugugaggacacuaugacauauaaauguccaagaauaacugaagcggaaccagaugacgucgauugcuggugcaaugcaacagauacauggguaacuuacggaacauguagccaaacaggggagcacagaagagauaaaagaucgguugcgcucgcaccgcaugucggauuaggauuagagacacgaaccgaaacuuggaugagcagcgaaggagcauggaaacaaauccaaagaguagaaacaugggcauuaagacauccuggauuuaccgugauugcgcuauucuuagcacaugcaauaggaacaucgauaacgcaaaaaggcauuauuuuuauacuccuuaugcugguuacaccaagcauggccaugagaugcguaggcauaggcaaucgugauuuuguagagggguuaaguggugcaacauggguagacguaguauuggaacacggcaguuguguuacaacuauggccaaaaacaaaccgacccuagauauugaacuacugaagacggagguuacaaaccccgcuguacuacgaaaguuguguaucgaagcaaaaaucaguaacaccaccacagacuccagaugcccgacacaaggugaggcuacauuagucgaagaacaagacgcaaacuucguauguagacgaacuuucguagaccguggcuggggaaauggauguggucucuucgggaagggcagccuccuaacaugugcaaaauuuaaguguguuaccaaauuagaaggaaaaauuguacaauacgaaaauuuaaaguauucggugauugugacagugcacacaggagaucaacaccaaguugguaacgagacuacugagcaugguacaauagcaacaauuacaccacaagcgccaacaucagaaauacaauuaacugauuauggagcgcugacccucgacuguucaccaagaaccggccuagauuuuaaugaaauggugcuacugacaaugaaggagaaaaguugguuagugcauaaacagugguuccuugauuuaccccuaccguggaccaguggagcuaguaccucacaggaaacauggaaucgccaagaucuguuaguaacauuuaaaacagcacaugcgaagaagcaagagguggucguauuaggaucucaggaaggagcgaugcauaccgcgcucacuggugcaacggaaauacaaacaucggguaccacuacuauauuugcuggucaucuaaaaugcaggcuuaaaauggauaaacuuacucuaaaggguaugucauauguuauguguacagggagcuuuaaacuagaaaaggagguagcugaaacacaacacggcacaguccucguccaagugaaguaugagggaacggaugcuccaugcaaaauaccuuucucuacacaagacgaaaaaggaguuacacagaauggaagguugaucaccgcuaauccaaucguuacagacaaagaaaaaccaguaaauauagagacagaaccuccguucggcgaaucauauauuguugugggggcaggcgaaaaagcccucaaauuaaguugguucaagaaagggucuagcaucgggaaaauguucgaagccacugcucgaggggcuagaagaauggcuauuuuaggagacaccgccugggacuuuggaucgauaggagguguguuuacuucgguagggaaauugguucaucaaguuuuuggaacugcauacggugucuuauucagugguguaagcuggacuaugaaaauuggaauugguauucuucuaaccuggcucggacuuaauagcagaucuacaucguugucuaugaccugcaucgccguuggcaugguaacauuauauuuaggcguaaugguccaggcggacucuggcuguguuauuaacuggaaagguagagaacugaaaugcgggagugguauuuuuguaacuaaugaaguucacacuuggacggaacaauauaaguuucaagccgacucacccaagagacugucagcugcuauaggaaaggcaugggaggagggagucuguggaauacguagcgcaacgcgauuagaaaauauuauguggaaacaaauaaguaacgaauuaaaccauauacuuuuagaaaacgauaugaaguuuacaguuguuguaggcgaugcuaacgguauacuagcacaagggaagaaaaugauaagaccccagccaauggaacauaaauauucguggaaaucauggggcaaagccaaaaucauaggcgcagauauucaaaauacaacuuuuauaauagauggaccagauacaccggagugcccggauggucaaagggccuggaauauaugggaaguugaggacuacgguuuuggcauuuucacuacgaacauuuggcuaaaacuuagagacucauacacucaaaugugcgaucaucguuuaauguccgcugcuauaaaggacagcaaggcggugcaugcagauaugggguacuggauugaaucagagaaaaacgagacauggaaguuggcaagagcaaguuuuauagaagucaagacuuguacuuggccuaaaagucauacccuguggaguaacgguguuuuagaaucagaaaugaucaucccaaaaauuuacggcggacccauaucacaacauaacuacaggccuggcuauuuuacucaaacagcugguccauggcaucucggaaaauuggaauuagauuuugauuuaugugaaggcaccacaguaguaguggaugaacauugcgguaaucgaggccccagcuuaagaacaacuaccguaacgggaaaaauaauacacgaauggugcuguagaaguugcacucucccaccuuuacgauuuagaggagaagauggcugcugguauggaauggaaauccgccccguaaaagaaaaagaggagaaucuuguccgcaguaugguaagcgcagguaguggugaagucgauucuuucucucuugguaucuugugugucuccaucaugauagaagaaguaaugaggucaagauggucaagaaagauguuaaugacaggaacuuuagcuguuuuccuacugcuuauaaugggccaacuuacguggaaugauuuaauaagacucuguauuaugguaggugcgaaugccagcgacagaaugggaaugggcacuacauaccuugcuuugauggcgaccuucaaaaugcgucccauguuugcuguaggcuuauuguuuaggagacuuaccucgagggaaguacuguuacuaacaaucggauugucguuaguagcgaguguagaacuaccuaauucacuugaagaguuaggcgacggacuagcaaugggaaucaugauguuaaaacuacuaacagaauuucaaccccaccaacuauggacaacuuuacuaaguuugacauucguaaaaacuacgcuuagcuuggauuaugcauggaagacaacggcaauggucuuaagcauaguaaguuuauuuccguuguguuuauccacuacgucgcaaaagacaacuugguuaccaguauuacuaggaaguuucgguuguaaaccuuuaacaauguuccuuauuaccgaaaauaagauuuggggacguaagagcuggccgcuaaacgagggaauaauggcgauaggaauaguaucaauccugcucucuucauuacuuaaaaaugauguaccacuagccggaccccuaauugcgggagggaugcugaucgcauguuacguaaucucaggguccucagcagaucucucauuagaaaaggccgccgaaguaucuugggagcaggaggcugaacauucgggcgcaagucacaacauccucguggaagugcaggaugauggaacaaugaaaauuaaagaugaggaacgagaugacacacuuaccauuuuauuaaaagcaacauuauuagccgugucagggguuuaccccaugucaauaccagcaacacuauuuguaugguacuucuggcagaaaaagaaacagagaucugguguguuaugggauacccccaguccaccggaaguggagagggcuguauuagaugaugguauauaucguauccugcagagagguuuacuagguagaagccaaguaggaguuggcgucuuccaagaugggguauuucauacaauguggcauguuacacgaggugcgguuuuaauguaucagggaaaaaggcuagaacccagcugggcuagcguuaagaaagacuugauuucguauggagguggauggagauuucaagguucauggaacacaggugaagaaguccaagugauugcuguagaaccaggcaaaaauccgaagaauguacaaacaacaccuggaacauuuaagacaccagaaggagaggucggagcaauagcucuagacuuuaaaccaggaacaucagguucaccaauaguaaaccgagaaggaaaaaucguaggucuguaugggaacggcgucgugaccacaagcggaacguauguuagcgcgauagcccaggccaaagcaucccaggaaggaccacucccugagauugaggaugagguauucaagaaacgcaacuugacgauuauggauuugcauccagguagcgggaagacacgaagguaccuacccgcgauuguacgagaagccauaaaacgcaaauuaagaacucuuaucuuagcacccacacgcguaguugcuagcgaaauggcagaagccuuaaaaggaaugccaauucgguaucaaaccaccgcugugaaaucagagcauaccggcagagagauaguagaucucaugugucaugccacauucacaaugcgccuacugagccccgugagaguuccaaauuauaacaugaucauaauggacgaagcccacuuuaccgacccagcaucaauagccgcaagaggguacauuagcaccagagugggcaugggagaagcagcagcuauuuucaugaccgccacaccgccugggagcgucgaggcuuuuccacaaagcaacgcaguaauacaagaugaagagagagacaucccagagagaagcuggaacucaggauaugacuggauuacugauuucccgggaaagacaguuugguuugugccaaguaucaaaagugguaacgauauugcuaauugccuaaggaaaaauggcaaacgcgucauccagcuaucacgaaaaaccuuugacacagaguaucagaaaaccaaaaauaacgauugggacuaugugguuacuaccgauauaucagaaaugggagcaaauuuuagagcagacagaguaaucgauccaagaagaugccuaaaacccgugauucuaaaggacggucccgagagggugauuuuagcgggccccaugccagugaccguggcuucggcagcccaacguagaggaagaaucggcagaaaccagaauaaagaaggagaccaguaugucuauaugggucaaccguuaaauaaugaugaagaccaugcacacuggacagaagccaaaauguuacuggacaacauuaauacaccggaaggaaucauuccagcguuauuugaaccagagcgggaaaaaucagcagcuauagacggagaauacaggcuuaggggugaagcaagaaaaacauuuguagaacuaaugagacguggugaccucccgguauggcuuucuuauaagguggcaucagaaggguuccaauauucagaccgaagauggugcuucgauggagagagaaauaaucaaguucucgaagaaaauauggauguagaaauauggacuaaagagggagaaaggaagaaacuucgaccaagguggcucgaugcaagaacuuacuccgacccacuugcacuccgagaguuuaaagaguuugcugcuggcaggcgaucaguaucuggagaccugauuuuggaaauaggaaaacuuccacaacaccugacacuaagggcacagaaugcauuagauaaccuggucauguuacauaauucggaacaaggagguaaagcauaucgacacgcaauggaagaacuacccgacacaauagaaacguugaugcuacuagcgcugauugcgguacugacagggggaguuacgcucuuuuucuuaagcggaaaaggauuagggaaaacgaguaucggauuauugugcguuaccgcaucuucagcacuucuuuggauggcuucuguagaaccucauuggauugccgcuagcauaauuuuggaguucuuuuugaugguguuauugauaccagaaccugaccgucaaagaaccccgcaagacaaccaauuggcuuacguaguaauaggauuacucuuuaugauacuuacaguugcagccaaugaaaugggguuauuagaaacaaccaaaaaggaccuaggcauagguuaugucgcagcggaaaaucaucagcaugcuacgauguuggauguagaccuacgaccagcuagcgcauggacgcucuaugcagucgcaacaacugugaucacaccaaugaugcgacauaccauagaaaauacaacugccaauaucucucuaaccgcaauagcgaaccaagcagccauauuaaugggcuuagacaaaggauggccaauuaguaaaauggacauaggaguaccucuauuagcacugggauguuauucgcagguaaacccguuaacauuaacugcugccgucuuaaugcuagucgcgcauuaugcuauuaucggcccuggacuucaggcgaaagccacucgagaggcucaaaagaggaccgcagcgggaauuaugaagaacccaacaguagauggaaucguggcaauugaccuagaccccgucgucuacgacgcaaaguucgaaaagcaauuaggucaaauuauguuauugauccuaugcacuucacaaauacuccuaaugcgcacuacgugggcacugugcgagaguauuacucuggccacuggcccacugacuaccuugugggaggguucaccugguaaauuuuggaauaccaccauagcgguaaguauggcuaauauuuucaggggcucuuaucuagccggugcggggcuagcauuuagcuuaaugaaaagccuaggaggagguagaaggggaacaggagcucagggagaaacccuuggugaaaaauggaaacgucaacuaaaucagcuaucuaaaucagaauuuaacacauauaaaagaagugggauaauggagguagaucgaucugaagccaaagaaggauugaagagaggggaaacaacuaaacaugcuguaaguagagggacggcaaaacuaagaugguuuguagagcgaaaucuagugaaaccggaagguaaaguaaucgacuuggggugcgguagggguggcuggaguuacuauugcgccggucucaagaaaguuacggaaguaaaaggauauacaaaaggcggacccggacaugaagaaccaaucccuauggcaaccuauggauggaaccuuguaaaacuucauaguggaaaggauguauuuuucaugccgcccgaaaaaugcgacacacuccuaugcgacauaggggaauccagcccaaacccuacgauugaagaaggaaggaccuugagaguauuaaaaaugguagaaccguggcuaaggggcaaucaguucugcauaaaaauacucaauccguauaugccuaguguugucgaaacacuggagcaaaugcaaagaaagcauggggguaugcuggugagaaacccucuaucucguaauucaacccaugagauguauuggguaucuugcgguacaggcaauauuguuucagcuguaaacaugacuagccguauguuacucaaccgauuuaccauggcacaccgaaagcccaccuaugaacgagauguggaucuaggggcaggaacuagacacguggcgguagaaccugaggaggccaauuuagauaucauaggacaacgaauagagaacauaaagaacgaacauaagucaacauggcacuacgaugaagauaaucccuauaagaccugggcauaccacgguaguuacgagguuaagccaucggggagcgcaaguaguaugguaaacgggguaguuagguuauugacaaaaccgugggacguuauaccgaugguaacacagauugcuaugacagacacaacaccuuuugggcaacaaagaguauuuaaagaaaaaguagauacacgaacaccaagagccaaaagaggcacuacucaaaucauggaagucacugcaaaguggcuauggggauuuuuaagucgaaacaagaaaccacgaaucuguacgagagaagaauuuacacggaaaguuagaaguaacgcggcaauuggagcaguguuuguugacgaaaaucaauggaacucagcaaaagaagccguagaagacgaacgauuuugggauuuaguccaccgagaaagagaacugcauaaacaaggcaagugugcaacgugcguauauaauaugauggguaaacgugagaagaaauuaggcgaauuugguaaagcaaaaggcagcagagcaauaugguauaugugguuaggggcucgguuuuuggaguuugaagcacuaggcuuuaugaacgaagaucacugguuuaguagagagaauaguuuaucggguguugaaggagaaggauuacacaaauugggauacauucuccgugauaucagcaagauucccgguggaaacauguaugcugacgauaccgccggaugggauaccaggauaacagaggaugaucuucagaacgaagcaaagauuacagauauuauggaaccugagcacgcauugcuagcaacgaguauauuuaaauuaaccuaucaaaauaaagucguaagaguacaacgaccggcuaaaaacggaacaguaauggaugucauauccaggcgugaccaacgcgguagcggccaaguagggacuuacgguuuaaacacauuuacaaauauggaaguccagcuaauacgacaaauggagucagagggcauauuuuuaccaagcgaacuugaaacuccgaacuuagcugagcgaguacuggauugguuggagaaacacggggcggaaagauuaaaaagaauggcgauaucaggugacgacugcgucgugaaaccgauagaugauagauuugcuacugcucuuacagccuuaaaugauaugggaaaaguuagaaaggauaucccucagugggagccgagcaagggguggaaugauuggcaacagguaccguuuuguagccaccauuuccaccagcuaauaaugaaagauggccgugaaaucguggugcccugucggaaucaagaugaguugguaggacgagcucggguuucccaaggagcugguuggucguuaagagaaaccgcaugccugggaaaaucauaugcucaaauguggcaacucauguauuuccacagaagagaccuacgauuagcagccaaugcaauuugcucagcaguuccuguggauugggucccaacuagccgaacaacauggagcauacaugcacaccaucaauggaugacuaccgaagauauguuaucuguauggaauagaguguggauagaagagaaucccuggauggaggacaaaacacauguuaguagcugggaagaagucccauaucuuggaaaaagagaggaccaaugguguggaucucuuauuggcuuaacugcgagagccaccugggcaacaaauauacaaguagcaaucaaccaaguaagacgccuaauuggaaacgaaaauuauuuggacuacaugacuucaaugaaaagauuuaagaaugaaucugauccagaaggagcgcuuugguga

SEQ ID NO: 21141 - RNA, 9879 nt, Artificial Sequence
  derived and/or modified CDS sequence (opt6) from DENV-1__GQ868560__SS-prME
agugucacuaugcuccucaugcuucuuccaacggcauuagcauuucauuugaccacuagagggggcgaaccucacaugauuguuucuaaacaagaacgagguaaaucauuauuauuuaaaacaagugcgggcguuaacaugugcacauuaauugcuauggauuuaggcgaacuaugcgaagacacgaugacauacaaauguccacguaucacagaggcagagccagaugaugucgauuguugguguaaugcaacugauacauggguaaccuauggcacaugcucacagacgggagagcaucggagggacaaaagaucaguagcauuagcgccacauguaggacucggccuugaaacuaggaccgagaccuggaugucaagugaaggcgcauggaaacaaauacaacgaguugagacaugggcacugcgucacccaggauuuacaguaauugcuuuguuucuagcacacgcaauugguacaucuauaacacagaaaggcauaauauucauuuuguuaaugcugguuaccccuuccauggcaaugagaugcguuggaauuggaaaucgcgacuucguggaaggcuugucaggagcgacauggguugacgucguguuagaacacgguucaugcgugacuaccauggcuaaaaacaaaccgacacuggauauagaguuacuuaaaacugaaguuacgaacccugcaguauugcgaaaacucuguauagaggccaaaauaagcaauaccaccaccgauucaagauguccuacccaaggcgaagcuaccuuggucgaggagcaagaugcuaauuucguaugucgacguacauucguugaucgcggauggggaaauggaugcggacuauucgguaaagguaguuuacuaacaugugcuaaauucaaaugcguaaccaaacuagaagguaaaauaguacaauaugagaaucuaaaauauucuguaaucguaacuguacacacuggcgaucaacaucaaguugguaaugaaacuacagaacaugggacaauugcaaccauuacuccccaagcuccuacaagugaaauucaacucacggauuacggugcauuaacgcuagacuguucuccacguacgggucuggacuuuaaugaaaugguauuauugaccaugaaagagaaaucauggcuaguacacaaacaaugguuccuugaucuuccacuaccguggaccucuggagcgucaacgucgcaggaaacuuggaacagacaagacuuacucguaaccuuuaaaaccgcucaugccaagaaacaagaaguaguaguucuaggaagucaagaaggugcuaugcauacggcuuuaacaggcgcgacagagauacaaacaagugggacaacaacgaucuuugcaggacaccuuaaguguagacuuaagauggauaaacuaacuuuaaaagguaugucuuacguaauguguaccgggagcuuuaaacuagaaaaagagguugccgaaacccaacauggaacgguguuagugcaaguuaaguaugaggggacggacgccccauguaagauucccuucucuacccaagaugaaaaaggagugacucaaaauggacgccuuauuacugccaauccuaucguaacggacaaagagaaaccagucaauauagaaacugagccgccuuuuggugaaucauauauaguaguaggugccggugaaaaagcauuaaaacuuaguugguuuaagaaagguaguaguauagggaaaauguucgaggcuaccgcccguggagcuagaagaauggcuauuuuaggugacaccgccugggacuuuggcagcauagggggaguuuucaccagugugggaaaauuaguacaucaaguauuuggaacggcauauggaguacuuuuuaguggcguaucauggacaaugaaaauagguauuggaauauuauuaacaugguuggggcuaaauucacgaaguacuucauuaucaaugaccugcauagcuguugguaugguuacacucuacuuaggcguuaugguacaggccgauagcggcuguguaaucaauuggaaggguagagaacuuaaaugugguucgggaauauuuguaacaaaugaaguccauacauggacggaacaauauaaauuucaagcggacagcccuaaaagacucucagcggcaauagguaaagcaugggaagaaggcguauguggcauucgaucugccacaagacuugaaaauaucauguggaaacaaaucucuaacgaacuuaaccauauuuuauuggaaaaugauaugaaauucacaguaguuguuggcgacgcaaaugggauacucgcacagggcaaaaagaugauacgcccucagccaauggaacauaaguacaguuggaaaucauggggcaaagcuaaaaucauuggugcagauauacagaacacaacauucauaauagacgggccagauacuccggaguguccugacggacagcgagcuuggaauauaugggaaguggaggauuauggguucggaauauucacuacaaauauaugguuaaaguugagagauucuuauacccaaaugugugaucaccgacuaaugucagcggcaauuaaagauucaaaggcagugcaugcugauauggguuacuggaucgaaucagagaaaaaugaaacauggaaauuagcccgcgccucauuuauagaaguuaaaacuugcacauggccaaagagucauacacuuuggucaaacggcguguuagaaucagagaugauaauuccgaagauuuacggggguccaauuagucaacauaauuaccguccaggcuauuuuacacaaacagcggguccuuggcauuuagggaaacuagaguuggacuuugacuuaugcgaaggaacuacuguagucguugacgaacacugcggcaaccguggaccaucauuaagaacuacgacuguaacagggaaaauaauacacgaaugguguugucguuccuguacacuacccccacuacgguuuaggggugaggaugguuguugguaugggauggagauacgaccuguuaaagaaaaagaggaaaaucuugugagaagcaugguuucagcagguucaggagaaguagauaguuucagucuagguauccucugcgucaguauaaugauagaagaaguuaugcgaaguagguggucccgaaaaaugcuuaugaccgggacucuagcgguuuuccuacucuugaucaugggacaacuaacuuggaaugaucugauuagacuaugcauaauggugggugcgaaugcgucagauagaaugggaauggguacuacguaucuugcacuaauggcaacguucaaaaugcggccaauguuugcaguaggacuacuauuucgccgucuaacuucgcgugaaguacuuuuacuaacaauaggauuaucauuaguagcaagcguggaauuaccgaauagcuuggaagaacugggagacggccuagcaauggggauuaugauguugaaguuacucacugaguuccaaccgcaccaauuauggacaacacucuuaagccuaacuuuuguaaaaacuaccuugagccuagauuaugcauggaaaacuacggccaugguacuaucaauaguuucauuauuuccuuuauguuuauccaccacaagucaaaagacaacaugguuaccgguacuacuaggcagcuuuggauguaaaccacuaaccauguucuuaaucacagaaaacaagauauggggacgaaaaucguggccuuugaaugaaggaauaauggcaauaggcauugugagcauacucuuaucaagucuacuaaagaacgacgugccguuagcaggaccuuuaauagcuggggguaugcuaauagcaugcuaugucauuucaggcagcucagcagauuuauccuuagagaaagcagcugagguaucuugggaacaagaagcugaacauucaggggcaucccauaacauacucguagaaguucaagacgacggaacuaugaaaauaaaagaugaagaacgagaugauacucuuaccauuuuacuaaaggcaacucuucucgcaguaucaggagucuacccuaugucaaucccggcuacauuguuugugugguacuucuggcagaagaagaaacaaaggaguggaguacuuugggauacuccaagcccuccagaaguggaacgggcuguucuagaugacgguauauacagaauauugcaaaggggguuauuagggagaucccagguaggcguagggguauuucaagauggagucuuucauaccauguggcaugucacacgaggggcaguuuuaauguaccaagguaagcguuuagaacccucaugggccucgauaaagaaagaucuaauaagcuauggaggaggauggagguuccaaggaaguuggaauacuggagaagaaguucaaguuauagcuguagaaccggguaaaaacccuaaaaauguacagacuaccccuggaacauuuaaaacaccggaaggcgaagugggagcuaucgcguuagauuuuaagccagggacgagcggcucccccauagucaaucgggaaggaaaaaucguggggcuguauggcaauggaguuguuacgacuucagggaccuauguaucagcgauagcacaggcaaaggcuucucaagaaggcccucugccagagauagaagacgagguuuuuaagaaacgaaacuuaacgauuauggaccuacauccugggagcgguaaaaccagaagguauuuaccagcuaucgugcgagaagcgauaaagcguaaguugaggacacuuauacuagcacccaccaggguaguagcuagcgaaauggcagaagcccugaagggaaugccgauaagauaccaaaccacagcugugaaaagugaacacacgggccgagagauaguugaucugaugugucaugcaacauuuacgaugagguuacucuccccuguucgaguaccgaauuauaauaugauaauaauggaugaggcucauuuuacagauccagcaucaauagcagcacgaggguacaucaguaccaggguaggaaugggagaggccgccgcaauauuuaugacggcaaccccaccagguaguguggaggccuuuccucaaaguaacgcgguaauacaggacgaggagagagauauuccugaacggucauggaacagcggauacgauuggauaacagauuuuccaggaaaaacaguaugguuugucccaaguauaaaaagcggcaacgauauagcuaauugucuaaggaaaaacggaaaacgaguaauacaacugucgagaaaaacauucgauacggaauaccaaaagacuaaaaauaacgauugggacuacguaguaaccacagauaucagcgagaugggcgcuaauuuuagagcggaccggguuauagaccccagacguugucuaaaaccaguuauauuaaaagacggaccggaaagaguaauuuuagcaggucccaugccgguaacuguagcuagcgcagcucaacgucguggacgaauugguagaaaccaaaauaaggaaggagaccaauacguauacauggggcagccacuuaauaaugacgaagaccacgcccacuggaccgaggcaaaaaugcuucuugacaacauaaauacuccagagggaauuauuccggcucuauuugaaccagaacgagaaaagagcgcggcaauagauggagaguaccgucuaaggggagaagcaaggaagacguuuguugaacuaaugcgucgaggcgauuuaccuguaugguugucguauaagguagcaucggaaggauuccaauauucagauagacgguggugcuucgacggagagcggaacaaccaaguauuggaagagaacauggauguagagauauggacuaaagaaggcgaacgaaagaaguuacgaccgcgauggcucgaugcaaggaccuacucggacccauuggcauuaagagaguucaaagaauuugcugcagguaggcgcagcguaucaggggaucuuauacuagagauaggaaaauuaccgcagcaccuuacccuuagagcucagaacgcguuggauaacuuagugauguugcauaauucugaacaaggugguaaagccuaccgacaugcgauggaagaacucccagauacaaucgaaacauuaaugcuauuagcccuuaucgcagugcuaacagggggcguuacuuuauuuuucuuguccggaaaagggcuagggaaaacauccauaggguuacucugcguaacagcuucaagugcucucuuauggauggcuucaguagaaccccauuggauagcagcgucaaucauccuugaguucuuucuaaugguacuacuaauaccggagccugauaggcagagaacaccacaagauaaccagcuagcauauguuguuauuggcuuacuauuuaugauucuaacuguggccgcuaacgaaauggggcugcuugaaacaacuaagaaagaucuaggaauaggguauguggcagcggaaaaucaccaacacgcaacuaugcucgacguagaucucagaccggcaagcgcuuggacauuauacgcgguagcaacaacaguaauaacaccuaugaugcgccauacgauagaaaauaccacggcgaacauuagccuuacagcuauagcaaaccaagcagccauuuugaugggacuagacaaaggauggccaaucagcaaaauggauaucggcgugccuuuacuagcacuugguugcuauucccaagucaacccccugacacucacggcugcuguacuaaugcuaguggcccacuaugcaauaauaggaccgggacuacaagcaaaggcgacaagagaagcacagaaaagaacugccgccggaauuaugaaaaauccuacggucgaugguauugucgcgauagaucuagacccagugguauaugaugcgaaguuugaaaaacaauuaggacagauaauguuauugauauuguguacuagccaaauacuauuaaugagaaccacuugggcguuaugcgaauccauaacguuggccacuggaccucuuacaaccuuaugggaagguucaccaggaaaguuuuggaauacaaccauagcuguuucuauggcaaauaucuuucgugggucuuaucucgccggugcgggauuagcauuuucccuaaugaagaguuuaggugguggaagaaggggcacuggagcacagggagaaacauuaggggagaaauggaagagacaacucaaccaauugagcaaaucagaauuuaauacauauaagaggucugguauuauggaaguagaucgauccgaagcaaaagaaggauuaaaacgaggcgaaaccacaaaacaugcgguaucuagaggaaccgcaaaacuucgaugguuuguugaaagaaaucuuguuaaaccugaggggaagguaauugauuuagguugcggaagaggagguuggucauauuauugugcaggacuaaagaaaguuaccgaaguaaaaggauauacgaagggaggcccaggccaugaggaaccuauacccauggcuacauauggguggaaucugguaaaacugcauucaggaaaagacguguucuuuaugccgccugaaaagugugauacgcuauuaugugauauaggugaaucaucaccaaauccaacaauugaggaaggaaggacacuccgcguguuaaaaaugguagaacccugguuaaggggaaaccaauuuuguaucaaaauacuuaacccauauaugcccucugucguggagacauuagaacaaaugcaacgcaaacauggaggaaugcugguuaggaauccacuuagccguaacucuacucacgagauguauuggguuaguuguggcacaggcaauauuguaagugcugucaacaugacuagcagaaugcuauuaaacagguuuacaauggcucacagaaaaccaaccuaugaaagagacguggacuuaggugcggggacuagacacgucgcaguugagcccgaagaagcaaaccucgauauaaucggucaaaggauagaaaauaucaagaaugaacauaaaucuacuuggcauuaugaugaagauaauccguauaaaacgugggcuuaucacggcuccuacgaagucaaaccaagcggaagcgccagcaguaugguaaacggcguaguucgacuuuuaacaaaaccaugggauguuauaccaauggucacucaaauugccaugacagauacaacaccguucggucagcagagaguuuuuaaggagaaaguagacacaaggacuccccgagccaaaagaggaacuacucagaucauggaaguuacagcaaaauggcucuggggguucuuaucgaggaauaaaaagccaagaauaugcacuagagaggaguucacacgcaaagugcguagcaaugcugcuaucggagcuguguucguggacgaaaaucaauggaacucggcuaaggaagccgucgaagacgaacgauuuugggaucuggugcaucgugaacgugagcuacauaagcaagggaaaugcgcgacuuguguauauaauaugaugggaaaaagggagaagaaacuaggggaauuuggaaaagcaaagggaaguagagccauuugguauauguggcuaggcgccagguucuuagaauuugaagcacuuggauuuaugaaugaagaucauugguucuccagagaaaauucccuaucaggaguugaaggugaaggucuacacaaauuagguuacauacuaagagacauaucaaaaauuccaggaggaaauauguaugcggaugauacugcagggugggacacucgaauaacagaggacgauuuacaaaaugaagcaaaaauaacggauauuauggaaccagaacaugcuuugcucgcuaccaguauauuuaaacucaccuaccagaacaagguaguacgaguucagcggccugcuaaaaacggaacagugauggacguaauuucaagaagggaucagcguggguccgggcagguaggaacguacggcuugaacacguuuaccaauauggagguccaacuaauacgccagauggaaagugaaggaaucuuuuuaccgagugaauuagaaacacccaauuuagcagaacgggucuuagauugguuggaaaaacauggcgcggaacguuuaaaaagaauggcuauaucuggagaugacuguguuguaaagcccaucgacgaucguuuugcaaccgcacugacugcucugaacgauaugggaaaaguccguaaggauauaccucagugggaaccuucaaaaggguggaaugacuggcaacaggugccauucuguucucaccacuuucaccaguuaauaaugaaagaugguagagaaauaguuguaccuugucgaaaccaagacgaauuagugggacgagccagagucagucaaggcgcaggguggucacuacgggaaacugcgugccucggaaaaucauacgcgcagauguggcagcuuauguauuuucaucggagagaccugaggcuggccgccaaugcaauaugcagcgcgguaccaguagauuggguaccaacaucucgaaccaccuggaguauccaugcucaccaucaauggaugacaacggaagauaugcuuucuguauggaaucgcguuuggauagaagagaauccauggauggaggauaagacacauguaucaagcugggaggaaguuccauauuuagguaaacgugaggaucaguggugugguagccuaauaggucuaacagcacgcgcgacuugggcuacuaauauucaaguagcuauaaaucagguaaggcgacuuaucggaaacgaaaauuauauagauuauaugacaucaaugaagagauucaaaaacgaaucagacccagaaggcgcauugugguga

SEQ ID NO: 21142 - RNA, 9879 nt, Artificial Sequence
  derived and/or modified CDS sequence (opt6) from DENV-1__GQ868561__SS-prME
ucaguaacuaugcuuuugauguuguuaccgacggcgcuugcauuccaucuuacaacucgagguggagaaccgcacaugaucguuucuaaacaagaacgcggaaaaaguuugcuauuuaaaacaucagcuggugugaacaugugcacauuaauugcaauggaucuaggugaauuaugugaagauacaaugacauauaaaugcccucgaaucacagaagcagaaccugaugacgucgauugcugguguaacgcgacagacacaugggugacguauggaacauguucacaaacaggagaacauagacgggauaaaaggaguguagcauuagccccucauguaggguuaggucuggaaacccguacagaaaccuggaugagcuccgaaggagccuggaaacaaauucagagaguagaaacaugggcccuuaggcaccccggauuuacaguaauugcauucuuuuuggcacacgcaauuggaacgaguauaacucaaaaaggcauuaucuucauacuuuuaauguugguaacacccagcauggcuaugcgcugcgucgguauagguaauagagacuuuguagaagguuuauccggagcgacguggguagauguagugcuugagcacggcucuugcguaaccacaauggccaaaaauaaaccaacacuagacauugaacucuuaaaaaccgaagugacaaacccagcgguguugaggaaacuauguaucgaggcaaaaaucaguaauacaacaaccgauucccgcuguccuacccaaggggaagcgacguugguugaagaacaagaugcuaacuuuguuugucguaggacguucguagacagagguuggggcaaugguugcggauuauucgguaaagggucacuuuuaacaugugcgaaauuuaaauguguaaccaaacucgaagguaaaauuguacaauaugaaaacuuaaaauauaguguaauuguuacuguucacaccggggaccaacaucaggucggaaacgagacaacagaacacggaacaauugcaacuauaacuccucaggccccgacaagugaaauacaauuaaccgauuacggagcacuaacuuuggauuguucuccacggacaggacuggacuucaaugaaauggugcuucucacgaugaaagagaaaaguugguugguacacaagcagugguuuuuggauuuacccuugccauggaccagcggagcuaguacaucacaggagacuuggaauagacaggaccuguuaguaacauucaaaacugcucaugcaaagaaacaagaagucguaguacucggcucgcaagagggagcgaugcauacugcacuaaccggagcaacugaaauucaaacgucagguacaacuacaauauucgcaggacaucuuaaaugcagacuuaaaauggauaaacuuacgcugaaaggcaugucuuaugucauguguacggguucuuucaaacuggaaaaagaaguggcugaaacucaacauggcacgguccuaguacaaguuaaauacgaaggaacagacgcuccaugcaaaauaccguuuagcacucaggaugaaaaagguguuacgcaaaacggucgguuaauuacugccaacccuaucguaacugauaaagaaaaaccgguuaauauugaaacagaacccccauuuggagaaucguauaucgucgucggugcaggagaaaaagcauuaaaacuuucuugguucaagaagggcaguaguauaggcaaaauguuugaagcaacugccagaggugcuagaagaauggcuauauuaggcgauacggcaugggauuucggauccauaggagguguauuuacaaguguagguaaguuaguacaccagguauuugguacugcauauggaguccuauuuucugggguaagcuggacuaugaagauagggauagggauuuuacucacuugguugggccuuaacaguagaucaacaucccuuaguaugacaugcaucgcaguaggaaugguuaccuuauaucuagguguaaugguacaagcugacuccgguuguguaauaaauuggaaaggucgggaacucaaaugcgguucgggaauauucguaacaaaugaaguacauaccuggaccgaacaguacaaguuucaagcggauucucccaaaagauuaagugcagcaauuggcaaggcuugggaagaaggcguaugcgggauccgcagcgcaacaagauuggaaaauauaauguggaaacaaaucucaaaugaguugaaucauauuuuauuagagaaugacaugaaauucacaguaguagugggggacgcgaacggaaucuuagcacaggguaagaagaugaucagaccccaacccauggaacacaaauauuccuggaaaucguggggcaaagcgaaaauuauuggagccgacauucaaaacacuaccuucauuauagauggcccagauacgccagaauguccagacggacaaagagcuuggaacaucugggaaguagaagauuacggcuucggaaucuucacaacaaauauauggcuaaaguuaagagacucauacacacagaugugugaucaccguuugauguccgcagcgauaaaagauuccaaagcaguccacgccgacaugggauauuggaucgaaucagagaaaaaugagacauggaagcucgccagggcgagcuuuauagaaguuaaaacuuguacuuggccaaaaucucauacacuguggucaaacgguguacucgaaagcgagaugauuauuccaaaaauauauggaggaccaauaagucagcacaauuauagaccgggauacuuuacacaaacagcagguccauggcaucucgguaaauuagaauuagauuuugauuugugugaagggaccaccguaguuguugaugaacauugcggaaauaggggaccgaguuuaagaacaacgacgguuacgggcaagaucauccaugaauggugcugcagaaguugcacauuaccaccacuacgcuuucgaggggaagacgguuguugguaugguauggagauuaggccagugaaagaaaaagaggaaaaccuuguaagaagcauggugagugcaggguccggagaaguagauucauucagcuuagguauacucugcgucuccauaaugaucgaagaagucaugcgaaguagguggucuaggaaaauguuaaugacggggaccuuagcaguauuccuauuauugauuaugggacagcuaacuuggaacgaccuaauaagauuauguauaauggugggugcaaaugcaagugauagaauggguaugggaacuaccuaccuugcccuaauggccacauucaagaugaggccaauguucgccguaggacuccuguuucgccgacugacaagccgagaagugcugcuacuaacuauaggauuauccuugguggcaaguguagaauugccaaauucgcuagaggaacuuggagaugggcuugcaauggguauaaugauguugaaauugcuaacagaauuucagccucaucaacuauggaccaccuugcuaucuuuaacuuuugugaaaaccaccuuaucguuagauuacgcguggaaaacgacagccaugguauugaguauuguuagccuguuuccuuuguguuugaguacgacuagccagaaaacgacaugguuaccuguguuguuaggcucuuuuggaugcaaaccguuaacuauguuuuugauaacagaaaauaaaauauggggcaggaaaucauggcccuuaaacgaagguauaauggcaauugguauaguauccauucuacuaucaucacugcucaaaaacgaugucccucuggcugguccucuuauugcgggagguaugcuaauagcauguuauguuauuagugguucgucagcugaccuauccuuagaaaaagcugcagaaguuagcugggaacaagaggccgaacauuccggagcuucacacaauauacugguagagguacaggacgacggaacuaugaaaaucaaagacgaagagagagacgauacucuaacuauuuuguugaaagcaacuuuacuugcagugucaggugucuacccuauguccaucccagcuacguuguuuguuugguacuucuggcagaagaaaaagcaaaggagcggcguacuuugggauaccccaagucccccggagguagaaagagcgguauuagacgauggaaucuaucguauccuucaaagaggacuauuagggcgcucgcaagugggugucgguguauuucaagauggagucuuucauacaauguggcauguaacccguggagcuguauuaauguaucaaggaaaacguuuagagccuucaugggcgaguguuaagaaagauuuaauaaguuacgguggaggauggcgguuccaaggaagcuggaauacaggagaagaaguccaagugaucgcaguagaaccuggcaaaaauccaaagaaugugcagacaacacccgggaccuuuaaaacacccgaaggugaggucggcgccauugcauuagauuucaaaccaggcaccaguggaaguccaauagugaaccgagaagguaaaauuguagggcuuuaugguaauggaguaguaaccacgucgggcacuuauguuucggcaauugcucaagcaaaggcuucccaggagggaccucucccggaaauugaagaugaagucuucaagaaaagaaauuugacaauaauggaccuacacccaggaucggguaaaacacguagguaccucccugcaauagucagagaggccauuaaacgaaagcuacgaacucuaauacuagcuccuacuagaguggucgcaagcgagauggcagaggcguugaaggggaugccuauuagguaucagacaacagcuguuaaaucugaacacaccgggagagaaauaguagaucuaaugugucacgcuacauuuaccaugaggcuacuaagcccaguucgaguaccuaauuauaauaugaucauaauggacgaagcacauuucacugacccagcuucaauugccgccagagguuacauaaguacaagaguggguaugggggaagcagcugcuauauuuaugacggcaacgccgcccggaagcguagaagcguucccccaaucaaaugcggucauccaggaugaagaaagagauauacccgaaagaucguggaacuccggauacgauuggauaacugauuucccgggaaaaacaguuugguucguaccuaguauaaaaaguggcaaugacauugcuaauugcuuaaggaaaaauggcaaacgggugauucaacuaagucgcaagacuuuugacaccgaauaucagaaaacuaagaauaaugauugggacuauguaguaacaacagacauuucagaaaugggagccaacuuuagggcagauagaguaauagauccaagaaggugccuuaaaccaguuauauuaaaagacgguccugagcgcgucauccuugcaggaccgaugccugugacgguugcuagcgccgcacaacguagaggcaggauaggaaggaaucaaaauaaggagggagaucaauauguauacauggggcaaccacuuaauaaugaugaagaucaugcacacuggacagaggcgaaaaugcuccuugauaauauaaauacaccagagggcauaauaccagcucucuucgaacccgaaagagagaaaagugcagcgaucgacggcgaauaccgucuccguggagaggcacguaaaacuuucguagaauuaaugcgccgcggagaucugccgguuuggcugucauacaaaguggcaagugagggauuucaguauucggauaggcgaugguguuuugauggagaacgcaauaaccaaguuuuggaagagaacauggauguagaaauauggacaaaggagggagaaagaaagaaauuaaggccacgauggcuggaugcacgcaccuauucagacccauuagcguuacgagaguuuaaagaauuugcggcggggagaaggucuguuagcggggaccuaauauuagagauagggaaauuaccucaacacuugacguugagggcacagaaugcguuggacaaccuaguaaugcuacauaacucagaacaaggagguaaagccuacagacacgcuauggaagaacucccagacacaauagaaacacuuauguuguuagcuuugauugccguauugaccggaggaguuacccuauucuuuuuaucaggcaagggcuuaggaaagacaucaaucggacuacuuuguguaacugcaaguagugcccugcuauggauggcaucuguugaaccacacuggauagcagcauccauaauacuagaguucuuuuuaauggugcuccugaucccagaaccagauaggcaaaggacgccccaggauaaccaacuggcauacguggugaucggacuucuuuucaugauuuugacaguugcagcaaaugagaugggccugcucgaaacgacuaagaaggaccugggcauaggguaugucgccgcagagaaucaccagcaugcaacaaugcucgauguagacuuaagacccgcaagugcauggacuuuguacgcuguugcaacaacagucauuacucccaugaugagacauaccauugagaauaccaccgcaaacauaucucugacugccauagcgaaccaggcagcuaucuuaaugggacuagauaagggguggccaaucucaaagauggauaucggcguaccuuuauuggcucuugguugcuauagucaaguaaauccauuaacuuuaacggcugcaguucucaugcucguggcacacuaugcuauuaucggaccgggacuacaagcuaaagccacuagagaagcccaaaagaggacugcugccggaaucaugaaaaauccgacaguugauggaauugucgccaucgaucuagacccagucguguaugaugcaaaauuugaaaagcaauuaggacagauuauguuacuaauauuauguacgucacaaauacuacuuaugcguacuacaugggcauuaugugaaucaaucacacucgcgacuggcccauuaacuaccuuaugggaaggaagucccggaaaauuuuggaacaccacaauagcaguaucuauggcaaacauauuucgcggcagcuauuuagccggggcuggacuagcguuuagucuaaugaagucauuaggaggugggagaagaggaaccggugcacaaggagaaacacuuggagaaaaauggaaaagacaauuaaaucaguugagcaagagcgaauuuaacacguacaaaaggucaggaaucauggaaguugaucggucugaagcaaaggaaggucuaaagcgcggagaaacaacaaaacaugcaguaucccgcggaacggcgaaacuuaggugguuuguugagaggaaucuaguuaaaccugagggaaaagugauagauuuaggauguggacguggaggauggucuuauuacugcgcaggacugaagaaagucacagagguaaaggguuacacuaaaggaggucccggacaugaagaaccuauaccaauggcgacauauggauggaacuuaguaaaacuacauucugguaaagauguauucuucaugccaccagaaaaaugugacacgcuauuaugugauauaggugaauccucaccaagucccacaauagaagaggggagaacauugaggguacuaaagaugguugagccuugguuacgagguaaccaauucuguaucaaaauucuuaacccauacaugccuaguguuguugaaacccuagaacaaaugcagcggaagcauggagguauguugguucguaacccauugucaagaaauuccacucacgaaauguauuggguuucguguggaacgggaaacaucguguccgcaguuaacaugaccucacgaauguuacucaacagguuuacaauggcccauagaaaacccacauaugaaagagauguggauuuaggugcaggaacucgucacguagcuguggaaccagaagucgcaaauuuggacauaauaggucaaagaauagaaaacauaaagaaugaacauaaaagcacauggcacuaugacgaggauaauccauauaaaacgugggcuuaccauggaagcuacgaagucaagccaagcggaucggcgucaaguauggucaacggaguaguuagacugcuaacuaaacccugggacguuauaccaaugguuacacaaauagcaaugacugacacaaccccuuuuggacaacaacgaguauucaaagaaaaaguugauacccgaacaccaagagcaaaacggggaacuacacagauaauggaagugacggcgaaguggcuuuggggcuuccuaucaagaaacaagaaaccgcgaauaugcacacgagaagaguucacuagaaaaguccguaguaaugcagccauaggagccgucuuugucgaugaaaaucaguggaacuccgcuaaagaggcugucgaagacgaacguuucugggaucugguacacagagaacgagaacuucauaagcaagguaaaugugccacuugcguauacaacaugaugggaaaacgggagaagaaacuuggcgaauuugguaaagcuaaaggaucucgugcuaucugguacauguggcugggagcucgauuccuagaguucgaagcccuggguuuuaugaaugaagaccauugguuuucaagggaaaacagcuuauccggaguugaaggggaagguuugcauaagcuaggauacauauuacgggacauaucgaagauaccagguggaaacauguaugccgacgacacugccggaugggauacuagaauaacagaagaugauuugcagaacgaggcaaaaauuacugauaucauggaaccagaacacgcauugcucgcuacuucaaucuuuaaacuaaccuaucagacaaaagugguuagaguccagcguccugccaaaaaugguaccguaauggaugucauauccagacgggaccaaagagguucgggucaagucggcacuuauggacugaauacguucacaaacauggagguacaauuaauucgucaaauggaauccgaaggcauuuuccuuccuuccgaauuagagacuccaaaccucgcagaaaggguacuagauuggcuugaaaaacacggcgcggaacgccuaaagcgaauggcaauaaguggggaugauugugucguaaaacccauugacgaucgauuugcgacagcacuaacggccuuaaaugacaugggaaagguaaggaaagauauaccacaaugggaaccaaguaaaggauggaaugauuggcaacaaguccccuucuguucgcaccauuuucaucagcucauaaugaaagauggcagagaaauuguugucccuuguagaaaucaggaugaauuaguagggcgagcacggguaucccaaggagcaggauggagccuacgagaaacagcauguuuagggaaauccuaugcucagauguggcaauugauguauuuccaccguagggaccuacguuuagcagcaaacgcaauauguagugccguaccgguggauugggucccgacgucaaggacuacuuggaguauucaugcucaccaucaauggaugacgacagaagauauguugagcguauggaauagaguauggauagaggaaaacccuuggauggaagauaaaacucacgucucuucuugggaggaaguuccauauuuggguaagcgggaagaucaaugguguggcucccuaauuggauuaacugccagagcaacuugggcuacaaacauucagguggcaaucaaccaagugcgucgacugauugguaaugagaauuauuuggacuauaugaccaguaugaaacgauuuaaaaaugaaagcgacccugaaggugcacuaugguaa

SEQ ID NO: 21143 - RNA, 9879 nt, Artificial Sequence
  derived and/or modified CDS sequence (opt6) from DENV-1__GU131948__SS-prME
ucaguuacuaugcuuuugaugcuguuaccuacugcucuagcguuccacuuaaccacucguggaggugaaccacacaugauugucaguaaacaagaaagaggaaaaagccuauuauucaaaacuagcgcuggagugaauauguguacacucauagcaauggauuuaggggaacuuugugaagacacuaugacguacaaauguccacgaaucacugaagcugaacccgacgacgucgauuguugguguaaugcgacagacacuuggguaacguacgggacuuguucacaaacaggugaacaucgaagagauaaacguaguguagcacuugcuccacaugucggccuggggcuugaaacacguaccgaaacauggauguccucagaaggggcauggaaacaaauucaaagaguggaaacaugggcgcucagacacccggguuuuacuguaauagcgcuuuuccuggcucaugcaauagguacaucaauaacccaaaaaggaaucaucuuuauacuacucauguuaguaacgccaucgauggcuaugcgaugugucggcauugguaauagggauuucguggaaggauuaagcggggcuacauggguugaugugguauuagaacacggaagcugcguuacaacgauggccaaaaauaaacccacauuagacauagaauuacuuaaaacugaaguuaccaacccagcaguguuaaggaaacugugcauagaagcgaaaauaucaaauacgacgacggacucacgguguccaacucagggagaggcuacacuuguggaagaacaagacgcgaauuuuguuugucgaagaaccuuuguagauagaggaugggguaauggauguggacuuuuugguaaaggcagucuauuaaccugcgcaaaauuuaaaugcguuaccaaacuugaaggaaagauuguacaauaugaaaaccucaaauacucagucauaguaaccguccauacuggcgaucaacaucaagucgggaacgaaacgacagagcacggaacgauugcgacuaucacaccgcaagcaccuacgucagagauucaauuaacagauuacggugcauugacuuuggauuguagcccucguacuggccuugauuuuaaugaaaugguucuauugacuaugaaagagaaaagcuggcuaguucauaaacagugguuuuuagacuuaccgcuuccauggaccagcggggcuucaacuucccaagaaaccuggaaucggcaagauuuauuaguaacuuucaaaacugcacaugcaaagaaacaagaagucguuguuuuaggcucacaagaaggggcaaugcacacagcacuuacaggugcaacagaaauacaaacgucaggaacaacaacuaucuucgcagggcauuuaaaguguagacugaaaauggacaagcuaacacuaaagggaaugucauauguaaugugcacaggaucauuuaaauuggaaaaagaagucgcagagacgcagcaugggacuguccuuguccagguuaaauaugaggguacggaugcaccaugcaagauacccuucaguacucaagacgaaaagggaguuacgcaaaacgguagauuaauaacagcaaauccaauaguuaccgacaaagaaaagccuguaaacauagaaacagagccaccauuuggagagaguuauauuguuguaggagccggugaaaaagcacuuaaacugucaugguuuaagaagggaaguucaauagggaaaauguuugaggcaacagcacgaggcgcuagacgaauggcaauucugggagauacagcaugggauuuugguagcauaggcggggucuuuacaaguguaggcaaacucgugcaccaaguauucggaacagcuuaugguguucuauucagcggaguuucguggaccaugaaaaucggaauuggaaucuuauuaaccugguuagggcuaaacucaagaucaacaagucugaguaugacuuguauagcugugggcaugguaacucuauaccuaggaguaaugguccaagccgacuccgggugcgucauaaauuggaaaggaagggaacucaaguguggaucggguauuuuuguaacaaaugaagugcauacauggacagagcaguauaaauuucaagcagacucaccuaaacgauuaucagcagcaaucgguaaggcaugggaggagggagucugcggaauacgaucagcuacaagguuggaaaacauuauguggaagcaaauuucaaacgaacuuaaccacauacuccuagagaaugacaugaaauucacuguagucgugggggaugcuaauggaauacuagcgcaaggcaagaaaaugauucguccacagccgauggaacauaaguacucauggaaaucguggggcaaagccaagauuauaggugcugauauucaaaauacaacauucauuauagaugggcccgacaccccagaaugcccagauggucaacgagcguggaauauaugggagguggaagauuauggcuuuggaaucuuuaccaccaauaucuggcuuaagcucagagacucauacacucaaaugugcgaccaccggcuaaugagugcugcaaucaaagauucuaaagcaguccaugcagauaugggcuauuggauagagagugagaaaaacgaaacguggaaguuggcucgugcaucuuucauugaagucaaaacaugcacauggccaaaaucucacacccuauggagcaauggagugcucgaaucugaaaugauaauaccaaaaauauacggaggacccaucucucaacauaauuauagaccuggauauuucacacaaacugcagguccguggcaucuaggaaaacuggaacuagacuucgacuuaugugaagguaccacaguaguggucgacgaacacugcgggaauagagguccaaguuugagaacaacaacugugacugguaagaucauacaugagugguguugucgauccugcacauuacccccacuuagauuucgaggggaagacgggugcugguauggaauggaaauaagacccguaaaagaaaaagaagagaacuuaguucgauccaugguaucagcuggaucuggagaaguggauuccuucucuuuagguauacucugcguuucaauaaugauagaagaaguaaugcgaucacgauggucgagaaaaauguuaaugacuggaacccuagcaguuuuucuauuauuaauuaugggacaacuaacauggaacgaucucauucggcuauguauuaugguaggagccaaugccagcgaccguauggguauggguaccacguacuuagcauugauggcgacauuuaaaaugcguccaauguucgcugugggauuacuuuuucggcgucuaacgagucgugaaauucuacuuuugacaauuggacuuaguuuaguagcaucgguugaacuaccaaacucguuagaagaacuaggcgauggacuggcaaugggaauuaugauguuaaagcuacuaaccgaauuucagccccaccaacucuggaccacuuuacucucuuuaaccuucguuaaaacaacacuaucucuugacuaugcuuggaagaccaccgcgauggucuuauccaucguaucucuuuuccccuuaugcuuaaguaccacaagucagaaaacaacuugguuaccuguuuuacugggaucuuucggcuguaagccgcuaaccauguuuuuaauuacagagaacaaaauuuggggcaggaaaucauggccucuaaaugaggguaucauggccauaggaauagucucgauucuacucagcucuuuauugaagaaugacgugccgcuggccggcccauugauagcuggugguaugcucauagccuguuacguuauaucugggagcagcgcugaucuuucuuuagaaaaagcggcagagguuagcugggagcaagaagcugaacauucaggagcaagucacaauauuuugguagaaguccaagaugacggaacuaugaagauaaaagacgaagagagagacgauacccuaacaauccuacucaaagcaacacuccuggcggugucaggaguguauccuauguccauaccggcuacucuuuucgucugguacuuuuggcagaagaagaaacaacgaagcggcguuuuaugggauacaccgaguccucccgaaguagaacgcgccguacuggaugacgggauauauagaauuuuacaaagagguuuguuagguagaucucaagugggggugggaguguuccaagaugguguauuucacaccauguggcaugucacaagaggggcaguccuuauguaccaggguaaacgucuagagccuucaugggcaagcguuaaaaaggauuuaauuucguaugggggaggcuggcguuuucaggguagcuggaauacaggagaagagguacagguaauagcugucgagccaggaaagaaccccaagaauguacagacgacaccuggaauuuucaaaacuccugaaggcgaaguuggagcuaucgcucuagacuuuaaacccggaacuuccggaucgccaauaguaaauagggaaggaaagauuguuggacuuuacggaaacggcguggugacuaccucaggaaccuacguuucggcaauugcucaagcaaaggcuucacaggaagguccauuaccggagauagaagaugaaguauuuaagaaaagaaaucucacaauaauggauuuacacccggguucagggaaaacccggcgauaucucccagcaaucgugcgggaagcuauaaaacgaaaguuacgaaccuugauucuugcuccaacucggguuguugcuuccgaaauggcugaagcgcuaaaaggaaugccgauacguuaccagacaaccgccguuaaaagugagcauaccggccgcgaaauugucgauuugaugugucacgcuacuuuuaccaugcgauuacucagcccugugagaguaccuaacuauaauaugauuauuauggaugaagcgcauuucacagacccagcaucaauagcagcuagaggauacauaaguacgagaguaggaaugggagaagcagcggccauuuuuaugacagcaacuccaccggguucgguggaagcauucccccaaucaaaugcaguaauacaggacgaagagagagacauaccggaacgaaguuggaacucuggcuaugacuggauuacagacuuccccggaaagacaguaugguucguuccgucaauuaaguccgguaaugauauugcuaauugccuccgcaagaaugguaaaagagugauacaguuaaguagaaaaacauuugacacagaauaccagaaaacuaaaaacaaugauugggacuaugucguuacgacagauauuucugaaaugggagcaaacuuuagagccgacagagugauagaccccagaagaugucuuaaaccuguaauccucaaagauggaccagaacguguaauauuggcuggaccgaugccagucaccgucgcuagcgccgcacaaaggagaggacgaauuggacgcaaccaaaauaaagaaggagaucaauauguuuacauggggcaaccucuuaauaaugacgaagaucacgcacacuggacugaagcuaaaauguuauuggacaauauaaacacaccugaagguauaauuccugcauuauucgaaccagagcgagaaaaauccgcugcuauagacggagaauauagacuccgcggugaagcaagaaaaacauuuguugagcuaaugaggaggggagaccucccaguauggcucaguuauaagguggcuucagagggauuucaauauagugauagaagaugguguuuugacggagaacggaauaaccaagucuuagaagaaaacauggacgucgaaauauggacaaaagaaggagaaaggaagaaauuacgaccaagaugguuggaugcaagaacauacucugacccguuagccuugagagaauuuaaggaguucgcagcgggacggagaaguauuucaggggauuuaauuuuagagaucggcaaguuaccacaacaccuuacacuacgcgcucaaaacgcauuggacaauuuagugauguugcacaauucagaacaaggagguaaagcauaucgacaugcuauggaggaacuaccugacacuauugaaacucugaugcuauuagccuugauagcgguauuaacaggugguguaacccuauuuuuccugaguggcaaagguuuggguaaaacgucgauuggccuacuuuguguuaccgcaucaagcgcgcuacuuuggauggcuucgguugaaccacacuggaucgcugcuucgauaauacucgaguucuuuuugaugguuuuacuaauaccagaaccagacaggcaaagaacaccucaagacaaucaauuagcauauguagucauuggccuauuguucaugauacuuacuguagcagcgaaugaaaugggccuguuagaaacuacaaagaaagaucuugggauaggauauguggcagccgaaaaucaucagcaugcaaccaugcucgauguagaucuacgcccagcaagugcauggacgcuauacgccguugccaccacuguuauaacucccaugaugagacauacaaucgaaaacacaacugcaaacauaagucuaaccgcaauagccaaucaagcagcaauauugaugggucucgacaaaggauggccaauaucaaagauggauauuggggucccccuacuugcauuaggauguuauagucaggucaauccacuaacacuuacagcugccguacuaauguugguagcacauuacgcaauuauaggacccggguuacaggcuaaggcaacucgagaagcucaaaagagaacagcggcugguauaaugaaaaauccaacaguagaugguaucguggcgauagacuuggacccuguuguauaugacgccaaauuugaaaaacaacuaggacaaaucaugcucuuaaucuuaugcacaucacaaauauugcugaugcgaacaacuugggcauugugcgaguccaucaccuuagcgacaggaccacugaccacauuaugggaagguucuccagguaaauuuuggaacacaacgaucgccguuaguauggcgaauauuuuuagagggagcuaucucgcuggggccggccuggcauucucgcuaaugaaaucuuuaggugggggaaggagagguacuggugcgcagggcgaaacauugggcgaaaaguggaaaagacagcucaaucaauuaucuaaaucagaauuuaauaccuacaaaagaucugguauaauggaaguugaucguagcgaggcaaaagaaggccuuaaaagaggcgaaacaaccaaacacgcaguaaguaggggcacagcaaaauuaaggugguuuguagaacgaaaucuggucaaaccagaagggaaaguaauagaccugggaugcggcagaggcggcuggaguuacuacugcgcaggccucaagaaaguaacugaagugaaaggcuauacaaaaggggguccuggacaugaagaaccaauacccauggccacguauggcuggaaccuuguuaaacuucacucugggaaggauguguucuuuaugccgccggaaaagugugauacacugcuaugcgacaucggugaaucuaguccuaauccuacaauagaagaaggacgcacacucagaguccuuaagaugguagaacccuggcuuagaggaaaccaauucuguauuaaaauccuuaauccguauaugccaucuguaguagaaacauuagaacaaaugcagagaaaacaugguggcaugcuggucagaaauccuuuaucaagaaacaguacucaugaaauguauuggguaucaugugggacaggaaacauugugagugccguaaacaugacaucacguaugcucuuaaauagauuuacgauggcgcauagaaaaccaacauaugaacgagacguggauuuaggagcaggaacaagacauguugcuguugaaccagaaguagcaaaucuugauauaauugggcaaagaaucgaaaauaucaaaaacgaacauaaaucaacauggcacuaugaugaagauaauccauauaaaaccugggcauaucacggcucuuaugaaguaaaaccgucaggaucagcuucaagcaugguuaaugggguagugagacuauuaaccaagcccugggacguuaucccaaugguaacucaaauagcaaugacggacacgacaccauucggacaacagcgaguauucaaagaaaaaguugauacaagaacaccucgagcuaaaagaggaacaacucaaauuauggaaguuaccgcaaaguggcuauggggauuucuuucacguaacaagaagccucgaauaugcaccagggaagaguucacacguaaaguaagauccaaugcagcgauaggugcuguuuucguagaugagaaucaauggaacucugcaaaggaggcuguggaagaugaaagauuuugggaucuagugcaccgugagagggagcuccauaaacagggcaaaugcgcaacuuguguguauaacaugaugggaaaacgagaaaagaaacuuggagaauuugggaaagccaaagggucucgggccauaugguacauguggcuaggggcaagauuuuuagaguucgaagcauuagguuucaugaaugaagaucauugguuuagucgagaaaauaguuuauccggcguagaaggugaaggauuacacaaacuggguuauauacucagagacauuucaaaaauaccaggaggaaacauguaugcggaugauacggcgggaugggacaccagaauaacagaagaugauuugcaaaaugaagcaaaaauaacugauaucauggaaccagaacaugcauuauuggcuacgucuauuuuuaaauuaaccuaucaaaauaaaguaguccggguacaaagaccagcuaaaaaugguacaguuauggacguaauaucgcgcagggaucagcgcggaucaggccaaguggguacauaugguuuaaauacauucacaaauauggaaguccaguuaauacgacaaauggaaagugaagggauauucuugccgagugaauuagagacuccaaauuuggcagagagagucuuagauuggcuugaaaaacauggagcagaacgucugaaacgcauggcaauaucuggggaugacuguguugugaaaccgauagaugacagauuugcaacggcccucaccgccuuaaaugauaugggcaaagugcgaaaggacacuccccaaugggagccaagcaaaggauggaaugauuggcaacaaguaccuuucuguagucaucauuuucaucaguuaauaaugaaagaugggcgagaaauaguuguaccuuguagaaaucaagacgaauugguagggcgcgcgcgagucagucaaggcgcaggauggucauugcgggaaacagcuuguuuaggcaaaucuuaugcacaaauguggcagcuuauguacuuucacaggcgcgaucuuagguuggcagcgaacgccauauguagugccgugccgguggauuggguuccaacuucccgaacaacauggaguauccaugcccaccaccaauggaugacgaccgaagauauguuaucaguuuggaaccgagucuggauugaggagaacccauggauggaagauaaaacacacguaagcucaugggaagaagugcccuauuuaggcaaaagagaggaccaguggugugguagcuuaauuggacuaacggcacgcgccacgugggcuacaaacauucagguugcuauuaaccaaguccgcaggcuaaucggcaacgaaaauuauuuagacuacaugacuagcaugaaaagguucaaaaacgaaucugacccugagggagcacuaugguag

SEQ ID NO: 21144 - RNA, 9879 nt, Artificial Sequence
  derived and/or modified CDS sequence (opt6) from DENV-1__GQ868562__SS-prME
agcguaacuauguuauuaaugcuucugccuacggcgcuugcguuucaucuaacaacaagaggaggggaaccccacaugauaguguccaaacaagaaagaggaaaaagucuauuauuuaaaacaagugcgggaguuaacaugugcacgcuaauugcgauggaucugggagaacuaugugaagacaccaugacauauaaaugcccccgaauuaccgaagcagaacccgacgauguagacuguugguguaacgcaacagauacguggguaacauauggaacguguucucaaaccggagaacacagacgagauaaaaggucuguagcucucgcaccgcacguaggacugggauuagaaacuagaacugaaacauggaugagcagcgaaggggcguggaaacaaauucaacgaguagagaccugggcccuaagacacccugguuuuacuguaauugcauuauuuuuggcacacgcaauagguacauccaucacucaaaaagguauaauuuucauacuucuaaugcuaguuacuccgucuauggccaugagauguguuggaauaggaaaucgugauuucguggaaggucuuaguggagcaacuuggguugacguaguauuagaacacggcucaugcgugaccaccauggcgaaaaacaaaccgacucucgauaucgaauuauugaaaacagaaguaacgaacccagcaguccugcgaaaacuuugcaucgaagcaaaaauaucaaauacuacuacugauagcagauguccuacacaaggagaggcaacccuuguagaggaacaagaugcaaauuucguaugcaggaggaccuuuguggaccgaggcuggggcaauggcuguggccuguucgggaaaggaucccuauuaacaugugccaaauucaaauguguaacaaaauuagaagguaaaauaguacaacaugagaaucugaaauacagcguaaucguaacuguacacacuggcgaccaacaucagguuggaaaugaaacuacggagcauggcacuauagcgacaauaacaccucaggccccgacgucugaaauccaauuaacagacuauggugcacuaacucuagauuguucuccaagaacaggauuggacuucaacgaaaugguauuguugacaaugaaagaaaaauccugguuaguacauaaacaaugguuuuuggaccuucccuuaccguggacaucuggagcuucaacaagucaagagacauggaauagacaagacuugcuagugacuuucaaaacagcacaugcaaagaaacaagaagucguuguuuugggaucacaggaaggagcuaugcacacagcauuaacaggggcgacagaaauccaaacaucugggacuacuaccauauucgccggccauuugaaauguagauugaaaauggauaaauuaacccuaaaaggcaugagcuacgugauguguacagguagcuuuaaacuagaaaaagaaguggcagaaacacaacauggaacaguccuaguacagguaaaauaugaaggaacagaugcuccgugcaaaaucccguuuucaacccaagaugaaaaagggguaacucaaaacggacgucucauaacagccaacccaauaguaacagauaaagagaaacccguuaacauagaaacagagcccccauuuggggaaagcuacauuguaguaggggcuggugaaaaagcacuuaaguuaaguugguuuaagaaaggaucuucuauaggaaaaauguucgaggcgaccgcacgcggcgcgagaagaauggcaaucuugggcgauacggcaugggauuuuggcagcauugguggcguguucacaaguguagguaaauugguacaucaagucuuuggaacggcauacggaguacuguuuucagguguaucauggacaaugaaaauaggaauuggaauuuuacuaacuuggcuaggucucaauucgagaaguacaagccucucaaugacaugcaucgcuguuggaaugguuaccuuauauuugggaguaaugguacaagcugauucgggcuguguuaucaacuggaagggaagagaauuaaaaugugggucuggaauuuucguaacaaaugaggugcauacauggacagaacaguacaaauuucaggcugauucuccuaaaagauuaucagcagccaucgggaaggcuugggaagagggcgucugugguauaagaucagccacgcgacucgaaaacauuauguggaaacaaauuucgaaugaacuuaaucauauacuacuugaaaaugacaugaaguuuacaguaguaguuggagaugcgaauggcauauuagcgcaggggaagaaaaugauacgcccgcagccaauggaacauaaauacaguuggaaaucuuggggaaaggcaaaaauuauaggagcagacauacaaaauacuacguucauaauagaugggccugauacgcccgaaugcccagacggacagcgugcauggaauauaugggagguugaagacuacggauucggaauauuuacaaccaauauuugguuaaaacugcgagacagcuauacacaaaugugugaucaccgucuuaugucugcagcaauuaaagauucaaaagcuguacaugcagauauggguuacuggauagaaucugagaaaaaugagacauggaaauuagcacgagcaucauuuaucgaggucaagacaugcacuuggccuaagucacauaccuuauggaguaauggaguacuggaaagcgaaaugauaauaccgaaaaucuauggaggcccuaucucucaacauaauuaccgaccgggauauuucacacaaaccgcgggaccauggcaucucggaaaauuggaacuggacuucgaucucugugaaggaacaacugugguaguagacgagcacugugguaacagaggaccuucccuacgcacaacuacuguaacaggaaaaauuauacaugaguggugcugcaggucauguacacuaccaccgcuaagguuucgaggcgaggacggcuguugguaugguauggaaauacgucccguuaaagagaaagaagaaaacuuaguuagaucuaugguuuccgccggaagcggcgaaguagauaguuuuagucugggaauccuaugugucagcauaaugauugaagaagucaugagaagucgcuggagccgaaagauguugaugacagguacauuagcaguuuucuuacuccuaaucaugggucaguuaacguggaaugaccuuauucgucuauguaucauggugggggcgaaugcaucugacagaauggggaugggaacaacacauuuagccuuaauggcaaccuuuaaaaugcggccaauguuugcgguggguuugcuauucagaagauuaacuucgcgggaagugcuacuucuaacaauaggucuuucuuuaguagcgagcguugagcuacccaauagccucgaggaauuaggugauggccuggccaugggcauaaugauguuaaaacucuuaacggaauuucaaccucaccaacuguggacaacucuauugucacugaccuuuguuaaaacuacguuaucacuagauuaugcuuggaaaacaacugcaaugguacucaguauuguaagucuguuuccgcugugucuuucaacaaccagccagaagacgacgugguuaccggugcuacuaggaucguuugguugcaaaccacucacaauguucuuaauuacggagaauaaaaucuggggucguaaaagcuggccucuaaacgagggaauuauggcuauagggauagucucaauucuacuaucauccuugcuuaaaaaugaugucccccuugcagggccgcuaauagccgguggaaugcuuauugcaugcuaugugaucaguggaucaucagccgaucuaucgcucgaaaaagcagcagagguaucaugggaacaagaagcagagcauucuggagccucacauaauauccuaguagaaguccaagacgacggaacuaugaaaaucaaagacgaagaaagagaugacacacuuacuauauugcugaaagccacccuauuagcaguaaguggugucuacccaaugucuauuccugcgacacuguuugucugguauuuuuggcagaagaagaaacaacgcucuggcguucugugggauacaccaucacccccagaagucgaacgagcaguccuagaugacgguauauacagaauuuuacagcgcggauuauuggggcgaagccaagucgguguaggaguuuuucaagacggaguguuccacacaauguggcaugugacgcguggagcagugcuuauguaucaaggaaagaggcuugaacccagcugggcaucaguaaagaaagacuuaaucucauauggcggcggguggagauuucaagggaguuggaacacaggagaggaaguccaagucauagcugucgaaccaggcaaaaaucccaaaaauguacaaacaacacccggaacauucaagacuccugaaggagaagucggugcaauagcacucgacuucaaaccgggaacaagcggaucgccaauaguaaauagggaagggaagaucguugggcucuauggcaauggaguagugaccacaaguggaacauauguuucagccauagcacaagccaaagcuagucaagaagguccccugccagagauagaagaugaaguauuuaagaaacguaaccuaacuauaauggaucugcaucccggcucgggaaagacaagaagauacuugccugccauaguacgggaagcaaucaagcgaaaauugagaacuuuaauauuagcccccacaagggugguagcuagcgagauggcagaggcuuugaaaggcaugccaaucagauaccagacaaccgcugucaaaucggaacacaccggcagagagaucgucgacuuaaugugccaugcuacguuuacaaugcgucuauugucaccuguaagaguaccaaauuacaauaugaucaucauggaugaagcucauuucacugauccggcgucuauagccgcaagaggcuauauaucaacgagaguaggcaugggagaagccgccgcuaucuuuaugacugcaacaccuccagggaguguggaagcguuuccccaaucaaaugccgucauacaagaugaggaacgggauauacccgaaagaagcuggaacuccggauacgauuggauaacagauuuuccuggcaaaaccguaugguucguuccuaguauuaaaucagguaaugauauugccaauugcuugaggaaaaaugggaaaagggucauccaguugucaagaaaaacauuugauacugaauaccagaaaaccaaaaauaaugauugggacuacguugucacaacggacauuucagaaaugggugcgaauuuucgggcugauagaguuauugaucccagaaggugucuaaaaccgguuauauugaaggacgguccagagagaguaauauuagcaggaccgaugccggucacaguugcuuccgcugcccaacgaagggguagaauugggagaaaucaaaacaaagaaggagaccaauacguauauauggggcaaccauuaaacaacgaugaggaucaugcgcauuggacagaagcaaagauguugcuagauaauaucaacacgccagaaggaauaauccccgcguuauucgaaccagaacgagagaaaucugcagcuaucgauggagaauaucguuuaagaggggaagcgcgaaaaacauucguugaacuuaugcgcagaggagauuuaccaguauggcuaaguuauaagguagcaucagaggguuuucaauauagugauagaagguggugcuuugacggagaacgcaauaaucaaguacuugaggagaauauggacguggaaauauggaccaaagaaggagaaagaaagaaguuacgaccgaggugguuggacgcgaggacauauagugaucccuuggcucuaagagaguucaaagaauuugcagcugguagaagaagcguaaguggcgauuuaauauuagaaauaggaaaacuaccucagcaccuuacguuacgagcccagaaugcacuagauaauuuaguaauguugcauaauagugaacaaggaggaaaagcguaccgacaugcaauggaggaacuuccagauacgauugaaacauuaauguuauuggcgcuaauugcuguccugacaggaggugcaacuuuguucuuucucuccgggaaaggguuggggaaaaccaguauaggccuacucugugucacagccuccagugcacuccuauggauggcaucgguagagccccacuggaucgcggcgucuauuauauuagaauuuuuccucaugguauuacuuauaccggagcccgacagacaaagaaccccacaagacaaccaauuggcauauguaguaauuggacuacuuuucaugauucuaacuguugccgcaaacgaaaugggacuguuagaaacgacuaagaaagauuuagggauaggcuacguagccgccgaaaaucaucagcaugcaaccaugcuugacgucgacuugagaccggcgagcgccuggacucuuuacgcuguagcaacgacagucaucaccccuaugaugagacauacaauagaaaacacgacagcgaacauaagccugacagccauagcgaaucaagcagcaaucuuaaugggacucgauaaaggauggccaauaagcaaaauggauauaggaguuccuuuauuggcauuaggauguuauucgcaagugaauccacuuacacuaacagcugcuguucucaugcuagucgcccauuaugcgauuauaggacccggacuccaagcuaaagccacgagagaggcacagaaaagaacggcugcggggauuaugaaaaauccgacaguugauggaauaguggcuauagaucucgauccuguugucuacgaugccaaguuugaaaaacaauuaggccaaauuauguuguuaauacuuuguacaagucaaauacuucuaaugcgaacuacgugggcauuaugugaaucaauuacacuagcuacuggcccucucacuacucuuugggaaggaucaccgggaaaauuuuggaauacaacaauugccguuagcauggcaaauauauuuagagguucguacuuagcgggugcaggacuugcauucucccuaaugaaaucccuaggcggaggcaggcgggggacaggcgcacagggagagacuuuaggcgaaaaauggaagagacaauuaaaccaacucucgaagucugaauuuaacacauauaaaagaucaggcauuauggaaguggaccgaagugaagcaaaagaaggccuuaaacgaggagaaaccacaaaacaugccguaucgcgaggaacugcaaaauugcgaugguuuguggagagaaauuugguaaagccagaaggaaaagucauugacuuagguuguggcagagggggauggucuuauuacugcgcaggucugaagaaaguaacagaagucaaaggguacaccaaggguggaccgggacacgaggaaccaauuccaauggccacguauggauggaaccuagucaaacuucacaguggaaaagauguguucuuuaugccaccagaaaaaugugauacccuacuuugcgacaucggagaaucuucgccaaauccuaccauagaagaaggacggacgcugcgaguauuaaaaaugguagaaccauggcuaaaagguaaucaauucugcauaaaaauauugaauccauauaugcccagcguugucgaaacgcuagaacaaaugcaaaggaaacauggggguaugcucgucagaaaucccuuaucaaggaacucuacacacgaaauguauugggugucgugcggaacuggcaacauaguuucugcagucaacaugacgucccguauguuacuaaauagauuuacgauggcucaucgcaagccuacuuaugagagagauguugaccucggugccggaacuaggcaugucgccguagagccggaaguugcaaauuuggacauaauaggacaacgcauugaaaauaucaaaaaugaacauaagucaacauggcauuaugaugaggauaacccguacaaaacgugggcauaccauggauccuacgaaguaaaaccuucagggucugcaagcucuauggucaaugguguaguccguuuacugacaaagccaugggauguuauaccuauggucacccaaauugcaaugacagacacaaccccguucggacaacaaagggucuucaaggaaaaaguugacacucgaacuccccgagccaaaagagguacuacgcaaauuauggaaguaacggcuaaaugguuguggggauuuuugaguagaaacaagaaacccagaauuuguacaagagaggaauuuacuaggaagguucggaguaaugcagcaaucggggcuguauuuguugaugagaaccaguggaacucagcuaaagaggccguagaagaugaacgcuuuugggaucugguucacagagaaagagaacuacauaagcagggcaaaugcgcuacuugcguauacaauaugauggguaaacgagagaagaaauuaggagaauuuggcaaagcaaaaggaagcagagcaauaugguauaugugguuaggagcgagguucuuagaauuugaggcauugggguuuaugaacgaggaucauugguuuaguagggaaaacucccuuuccgggguugaaggagaggggcuacacaaacugggguacauccuacgugauaucagcaaaaucccagggggaaacauguacgcagaugacacggccgggugggauacacguaucacagaagaugaucuucaaaaugaggcaaagauaacugauauaauggaaccugaacaugcacuacuggcaacuagcaucuucaaacucacauaucagaacaaaguagucaggguacagcgucccgccaaaaacggaacugugauggacguaauaucacgaagggaucaaagaggauccggucaaguugggacauauggauuaaacacuuuuacuaauauggaagugcaacuaauaagacaaauggagucagagggaauauuccuuccgagugaauuagagacacccaauuuggcagaaagaguacuagacugguuagagaagcacggagcggagagguuaaagaggauggcaaucagcggugaugacuguguugugaaaccgauagaugaucguuuugcaaccgccuuaacagcucugaaugacaugggaaaagugagaaaggauauuccacaaugggaaccuucuaagggguggaacgacuggcaacagguuccauuuuguucacaucacuuucaccaauugauuaugaaagaugggcgugaaauagucguaccaugucguaaucaagaugaauuaguaggcagagcuagaguaucgcagggugccggauggagccucagagaaacagccugcuuaggaaaaaguuaugcccagauguggcaauugauguauuuucaucggagagaucuucggcuagcugcaaaugcuauuuguucagccgugccuguagacuggguuccuacgucacggaccacuuggucaauacaugcccaucaucaauggaugacgaccgaggauauguuaucugucuggaacagaguguggauugaggaaaaucccuggauggaagauaaaacucauguaagcucgugggaggaaguaccauaucuagguaaaagagaagaucagugguguggaagccuaauaggauugacugccagggcaaccugggcuacaaacauucagguagcaauaaaucaagugagacgacuaauaggcaaugaaaauuaucuagauuacaugaccaguaugaagcguuuuaaaaacgagucagauccagaaggagcgcuaugguaa

SEQ ID NO: 21145 - RNA, 9879 nt, Artificial Sequence
  derived and/or modified CDS sequence (opt6) from DENV-1__GQ868563__SS-prME
ucuguuacgauguuacuuaugcuucuaccgacugcauuagcauuucacuuaacuacucgagguggagaaccacacaugauaguuagcaaacaagaacguggaaaaucucuacuuuucaagacuagcgcaggaguuaacaugugcacgcucauugccauggaucuuggagaacuaugugaagauacuaugacuuacaaaugcccucgaaucacagaagcagaacccgaugacguugauugcugguguaaugccaccgacacauggguaacauauggaacuuguagucaaacgggagaacaccguagagauaaacgaucgguugcucuggcgccccaugugggucugggacuugaaacacguaccgaaacauggaugucaucagaaggcgcuuggaaacaaauucaaagaguugaaacgugggcacuucgccacccaggcuuuacugucauagcauuauuuuuagcacaugcaauuggaacuucaaucacucaaaagggaauaauauucauauuacucauguuagucacgccgucuauggccaugagauguguugguauaggaaacagagacuuuguagaaggacucagcggagcaacauggguugacgucguacucgaacacggaagcugcguaacuacuauggcaaagaauaagcccacacuagauauugaacucuuaaaaaccgaaguaacgaacccugcuguucugcgaaagcugugcauagaagccaaaauaaguaacacaacgacagacuccagauguccuacacaaggagaagcgacuuuaguugaagaacaagacgcaaacuuugucugcagacgcacauucguagaucgaggauggggcaauggguguggucuuuuugggaaagggaguuuauuaacuugcgcaaaauuuaaaugugucacuaaacuagaaggcaaaauuguacaauaugaaaauuugaaauauaguguaauuguuacuguccacacaggggaucaacaccaaguagguaaugaaacgacugaacauggaaccauagcuacuauuacuccacaagcaccgacaucagagauucaguuaacugauuauggggcauuaacacuugacugcucaccaagaacggggcuugacuuuaaugaaaugguucuacuaacaaugaaagagaaaaguuggcuaguacacaagcaaugguuucucgaucuaccacuaccguggaccucaggagcaucuacaagucaagagacauggaaucgccaagaucuucucgugaccuucaaaacugcacacgcuaagaaacaagaggugguagucuuggggucucaagagggcgcaaugcauacagcacuaacuggagcgacugaaauccaaacuucuggaacuacaaccauuuuugcaggucaucuaaaaugccgacugaaaauggauaaacuaacauuaaagggcaugucauacguaaugugcacaggaucauuuaagcucgagaaagagguagcggaaacacaacauggaaccguauuaguacaaguaaaauaugagggcacagacgcacccuguaaaauaccuuucagcacacaagaugagaaaggaguaacacaaaauggccgguuaauaaccgcaaacccaauaguaacagauaaagagaaaccuguuaauauagaaacggagccaccuuuuggagaaucuuauauugucguaggagcuggugaaaaagcguuaaaacuuucgugguuuaagaaaggcagcagcauuggcaaaauguuugaggcuacagcaagaggagcaagaagaauggcaauuuuaggugacacagcaugggauuucggcaguauaggaggcgucuucaccucuguuggaaaacuugugcaucaagucuucgggacugcauauggggugcuguuuucaggcgucucuuggaccaugaaaaucgguauagguauucugcuaacguggcuugggcuuaauucaagaucuacgucauugagcaugaccuguaucgcaguggguaugguaacauuguacuuaggaguuaugguacaagccgacucagguugcgucaucaacuggaagggacgagaauuaaaaugugguucuggcauuuuuguuaccaacgagguacauacauggaccgaacaauauaaauuccaggcggacucaccaaaacgucuauccgcagccaucggaaaagcgugggaagaaggcguaugcgggauaagaagcgcgacaagauuagagaacauuauguggaaacaaauaucuaaugaauuaaaccacaucuuauuggaaaacgauaugaaauucacugucguuguaggagaugccaauggaauauuagcacaaggcaagaaaaugaucagaccucaaccaauggaacauaaauauaguuggaaaucauggggcaaggccaaaauaauaggcgcagauauccagaaugcuacauuuauuauugacgguccagauacacccgagugucccgauggccaacgugcuuggaacaucugggaagucgaagacuauggcuuugguauauuuacaacuaauauuugguuaaaacuucgagauaguuauacccagaugugugaucauagacuuaugucagcugccauaaaggacagcaaagcggugcaugcagacaugggcuacuggauugaauccgagaaaaacgaaacauggaaauuggcuagagcuucuuucaucgaaguaaaaacaugcaccuggccgaagucacacacucuauggaguaacggagucuuggaaucagaaaugauaauacccaagauauaugguggacccaucagucaacauaauuaccgaccuggauacuuuacccaaacagccggccccuggcacuuaggaaagcuagaauuagacuuugaucuaugcgagggaacuacaguaguuguugaugaacacugugggaaucggggacccagucuucgaacuacgacagugacgggcaagauuauucaugaauggugcugucgcucguguacucuuccuccccugagauuccgaggugaagauggaugcugguaugguauggaaaucagacccgucaaagaaaaggaggaaaauuugguacgaucaaugguaucagcaggauccggagaaguggauaguuuuucacuggguauacucuguguuucuauaaugauagaagaaguaaugaggucgagauggucccgaaaaaugcucaugacaggaacccucgccgucuuuuuauuguuaauaaugggucaauuaacauggaaugacuuaacccgauuauguaucaugguaggcgcuaaugcaucagacaggaugggaauggguacaacauauuuagcacuuauggcaacuuuuaaaaugaggcccauguuugcuguugggcuauuauucagacgucuaacaucacgagaaguacuccugcuuacaauaggauuaucauuaguugcaucaguagaauuaccuaauagcuuagaggaacuuggagacggauuagcuauggguauaaugaugcuuaaacuucucacagaauuucaaccccaccaauuauggacaacucucuuaucucuaacuuuuguaaagacaacguuaucucuugauuaugcauggaagacgaccgcaaugguauuguccauaguuagccuguucccucuauguuuaaguacgaccagucagaaaacuacaugguuaccgguccugcugggcuccuucggguguaagccuuuaaccauguucuuaauuaccgagaauaaaaucuggggacggaaaaguuggccacuaaacgagggcauuauggccauuggaaucgugucgauucugcugucaucccuacuuaaaaaugacgucccucuugcaggaccuuugauagcgggagggaugcucaucgcauguuacgucauuucagggucuagcgccgacuuaucauuggagaaagcugcagagguaucuugggaacaagaagcagaacauucaggggcuucacauaacauuuuagucgaaguacaagaugauggcacaaugaaaauuaaagacgaagaacgugacgacacacuaacaauuuuauuaaaagccacguugcuggcagucucuggaguuuacccgaugucaauuccggcaacucuauuugugugguacuuuuggcaaaagaagaaacaaaggucuggaguuuuaugggauacuccaucucccccagaagucgaacgagcuguccuagaugaugggauauaucguauuuuacaacggggcuugcuugguagaucacaaguaggaguaggggucuuucaggacgggguauuccacaccauguggcacguaacgaggggagcuguauuaauguaccagggaaaacggcuugaaccgucaugggcaagcgucaaaaaggaucuaaucaguuauggaggggguuggcgguuucagggccucuggaacaccggagaagaaguucaaguuauugcagucgaaccaggcaaaaauccuaagaauguucaaaccacgccgggcaccuuuaaaacacccgaaggagaagucggugcgauagcauuagauuuuaaaccaggaacaagcggaucaccaauaguuaauagagagggaaaaauagugggucucuaugguaacggaguggugacuacgucagguacauaugucucagcaauagcucaagcaaaggcaucucaggaaggaccccucccagaaauagaagacgaaguuuucaagaagagaaaccugacaauuauggauuugcacccagggaguggcaagacuaggcgauauuuaccagcuauugucagagaagcuauuaaacgaaaacuccggacccuaauacuagccccaacucgaguaguagcaagugagauggcggaagcccuaaaaggaaugccaauaagauaccaaacaacggcaguaaaaagcgagcauacaggucgagaaauagucgauuuaaugugucaugcgacuuucacuaugcgauuauuaucuccggucagagucccaaauuauaacaugaucaucauggacgaagcgcauuuuacugauccggccucgauugcugccaggggcuacauauccacuaggguugguaugggcgaagcagcagcaaucuuuaugacugcaacaccaccgggaaguguugaagcauuuccgcaaagcaaugcgguaauacaggaugaagaaagagacauaccugaaagaucauggaauaguggauacgauuggauaacagacuucccagggaaaacaguaugguuugugccaucaauuaaaagugggaaugacauagcuaacugcuugaggaagaaugguaaacgaguaauacaacuaagucgaaaaacauuugauacggaauaucagaaaacuaagaauaaugacugggacuauguuguuacuacugauauuucggaaaugggugcuaauuucagggcggaccgaguaaucgauccccgacgguguuuaaaacccguaauccucaaagaugguccagaaagggucauuuuggcgggcccaaugccgguaacaguggcaucagcugcacaacgaagaggacguauuggcagaaaucagaacaaggagggugaucaauacguguauaugggacagccucucaauaacgaugaggaucacgcucauuggacagaggcuaaaaugcuucucgacaacauuaacacuccugagggaauaauccccgcucucuuugaaccagaaagggaaaaauccgcagcuauagacggagaguaucguuugcgaggcgaagcacgaaaaacauucguagaacuuaugagaagaggagauuuaccugucuggcugucuuauaaaguggcaucagagggcuuccaauacucggaccgaaggugguguuucgacggagaaagaaacaaccaagucuuagaggaaaacauggacguagaaaucuggaccaaagagggggaaagaaagaaauuacgaccuagaugguuagaugcuaggacuuauucagauccccucgccuuacgugaguucaaagaauuugcagcuggaagacgaagcguuaguggggaccuaauccuugagauagguaaauuaccacaacaccuaacgcuucgugcgcaaaacgcuuuagauaacuuagugaugcuacacaauagcgagcagggagguaaagcauaucgacaugcaauggaagaauuacccgauacaauugaaacauuaauguuauuggcguuaauugcuguguuaacgggagggguaacucuguucuuccuuucgggaaaaggucuaggaaaaacuucaauaggacuacuauguguaacggcaagcucugcccuguuauggauggccucaguagaaccucauuggauugcagcguccauuauauuggaguucuuucuaaugguacuucuaaucccagaaccagauagacaacgaacaccacaagauaaucaauuagcuuauguaguaauuggauuacuauuuaugauucuuacuguugccgcaaaugaaaugggacuccucgagacgacuaaaaaggauuuaggcaucggauacgcggccgcggaaaaccaccaacacgcuacaauguuagacgucgaucuucgacccgcaagugcauggacguuauaugccguggcuacaacgguuauaaccccaaugaugaggcauacgauagaaaacacaacagcaaauauuagucucaccgcaaucgcgaaucaagcugccauauuaaugggauuagauaaaggauggccuauaaguaaaauggauauaggugugccccuuuuggccuuaggcugcuacagucaagucaauccguugacucugacugcagcaguccuaauguugguagcucacuaugccauuauaggaccaggauuacaagcgaaagcgacgagggaagcgcagaaaagaaccgcagcugggauaaugaagaaccccacuguagauggaauuguugcaauugaccuugaucccgugguauaugacgcaaaguucgaaaaacaacucgggcagauuaugcuacuaauacuguguacuucacaaauacuucuaaugcgcacaacaugggcucucugcgagucgauuacacuagcuacaggaccucuaacuacuuuaugggaaggcucuccggggaaauuuuggaacacuacaaucgcggugucuauggcgaauauuuuuagagguaguuaccuggcaggggcaggccucgcuuuuaguuuaaugaaaucgcuaggagggggacgacgaggaaccggcgcucagggugaaacauuaggagaaaaauggaaacggcaacuaaaucaguugucgaagucugaguucaacaccuauaaacgcagcgguauaauggaaguagaucguucagaggccaaagagggauugaaacgaggugagacuacaaagcaugcgguaagucgaggaacagcaaaacucagaugguucguugagagaaaccucgucaaacccgagggaaaaguaauagaucuuggcugcggaagaggaggauggucauacuauugugcuggccuaaagaagguaacugaggugaagggauauacgaaagggggaccaggccaugaagaaccaaucccuauggccacguauggauggaaccuugugaaauuacauagcggcaaagaugucuuuuucaugccgccugaaaaaugcgacacccucuuaugcgauauuggagaaucaagcccaaauccgacgauagaagagggaagaacccuuagaguauugaaaaugguugaaccaugguugcgcggaaaccaauucuguaucaaaauucucaauccauauaugcccucaguaguagaaacacuagaacaaaugcaacgaaaacauggugguaugcucgugagaaauccccuuaguagaaauagcacacacgagauguauuggguuagcuguggaacaggaaauaucguuagugccgugaauaugacaagcagaaugcugcucaaccgcuuuacaauggcucaccgaaaaccuacuuacgagcgugacguugaccucggugcgggaacgagacaugucgcgguagaaccggaggugccaaaucuugacauuauaggacagcgcaucgagaauauuaaaaacgaacauaaaucaaccuggcauuacgaugaggauaauccauacaaaaccugggcuuaucacggcaguuaugagguaaaaccuucagguagugcuucgucuaugguuaacggagucguacgacuucuaacgaagccaugggaugugaucccuaugguaacgcaaauagcaaugacugauacaacuccauuuggacaacaaagggucuuuaaagagaaagucgauacuagaaccccucgagcaaaaagggguaccacccaaauuauggaaguaacugcaaaauggcucuggggauuuuuaucgagaaacaagaaaccuagaauuugcaccagggaagaauuuacgcgaaaggugaggucaaaugcggcaauaggagcaguauucguagaugaaaaccaguggaauagugcuaaagaagccguagaagacgaacgauucugggacuuaguacauagggaacgugagcugcacaagcaagggaaaugugccacaugcguauauaauaugauggguaaaagagagaagaaacuaggugaauuugggaaagcgaaagguagucgugccauaugguauauguggcuaggugcgagauuucuagaguuugaagcacuaggguuuaugaaugaagaucacugguuuucgcgugaaaacucacugucuggaguggagggugaaggucuccacaaacuggguuacauucuaagagacauaucaaaaauuccaggcggaaauauguacgcugacgauacggcagguugggauacacggauuacugaagaugaucuacaaaacgaagcaaaaaucaccgauauaauggaaccagaacacgcucuacuagcaacaaguauuuuuaaacugacguaccagaacaaaguuguacguguacaaagacccgccaagaacgguacgguuauggacguuauaucccguagagaucagagagguucaggucaaguuggaacauacgguuuaaauacuuuuaccaacauggagguacaacucauucgacaaauggaaucagaaggaauauuuuugcccagcgaauuggaaacaccaaauuuagcagaaaggguacuugauugguuagaaaaacauggcgcagagcgacuaaaacgaauggcaauaucuggagaugacuguguagugaaaccaauugacgacagguucgcuacagcucuaacagcccugaaugauaugggaaaaguacguaaagacauaccacaaugggagccaagcaagggauggaaugauuggcaacaagucccauuuuguagccaucauuuccaccaacugauaaugaaagacggccgggaaaucgucguaccuugcagaaaucaggaugaacuugugggaagggcuaggguuucacagggagcuggauggaguuugagagaaacagccugucucggaaaaucuuacgcccagauguggcaacucauguauuuccaucgaagagauuugagauuagcagcgaaugcaauuuguucagcugucccuguagaauggguaccuacgucucguaccaccuggagcauccaugcccaucaucaguggaugacaaccgaagauaugcucaguguuuggaauagaguuuggauagaagagaauccuuggauggaagacaaaacccaugugucgagcugggaagaaguuccauauuuagguaaacgagaggaucaauggugugguucucuuauuggacuuacggccagagcgacaugggcaacuaauauucaaguagcaauaaaucaaguccguagacugauagguaacgagaauuaucuagacuauaugacaucuaugaaaagauuuaagaaugaaucggacccggagggugcacuuugguaa

SEQ ID NO: 21146 - RNA, 9879 nt, Artificial Sequence
  derived and/or modified CDS sequence (opt6) from DENV-1__GQ868564__SS-prME
ucuguaacuauguuacuaaugcuauugccuacagcacuagcguuccauuuaacuacucggggcggagaaccccauaugauagugucaaaacaagaacgaggaaaagcacuuuuauucaaaacaagugcaggagugaacauguguacgcucauagccauggaucugggcgaacuuugugaagauacaaugacauacaaauguccgcgaaucacagaagccgaaccagacgaugucgauuguugguguaacgcuacagacacguggguaacauacgggacuuguagccaaacuggugaacaucgacgagauaaacgaagcgucgcguuagcuccgcacguuggucuaggacuugaaacucgaacagaaaccuggaugagcucggaaggagcguggaaacaaauccaacguguggaaacgugggcgcuccgucauccuggauuuaccguaauagcauuguuuuuagcgcaugcuauagggacguccaucacccaaaaagggauaauauuuauuuuacuuauguuagucacuccauccauggcaaugcguuguguugggauuggaaacagagauuucguugaaggucuaucaggugcaaccugggucgauguaguacuagaacauggaucuugugucacaacuauggccaaaaacaaacccacgcuugauauugaauuauugaaaacagaaguaaccaacccugcagucuugcguaaauuaugcauagaagccaaaauaucaaauacaacaacagauucucgauguccuacacagggagaagcaacgcuaguagaagaacaagaugcaaauuuuguuugccgacguacauuuguagauaggggcuggggaaaugggugcggauuauuuggaaaggguaguuuauuaacuugcgcaaaauucaagugugucacaaagcuagaaggaaaaaucguccaauacgaaaaccuaaaguacucuguaauuguaaccguacauacuggggaccagcaucaaguuggaaacgaaacuacugaacaugguacaaucgcaaccauuaccccacaagcgccgacuucagaaauucaguugaccgauuacggagcacugacauuagauugcucaccucgcaccggacuagacuucaaugaaauggugcuacucaccaugaaagaaaagucuugguugguccauaaacagugguuucuugauuugccgcugccauggacaucuggagcauccacaucucaagagacauggaaucgccaagaccuguuaguaacauuuaagaccgcucaugcgaagaaacaggaaguuguaguuuuggguagccaggaaggagcaaugcacacagcguuaacaggugcgacagagauacagacgucugguacuacaacaauauucgcaggacauuugaaaugcagacuaaagauggacaaguuaacacuuaaaggaaugucauacguaauguguacaggaucuuuuaaauuggagaaagaaguugcggaaacgcaacauggaaccguuuuaguucaaguuaaguaugaggggacagacgcaccuugcaaaauuccauucaguacucaagacgaaaaaggaguuacucaaaacggaagacugauaacugcaaauccgauaguaacugacaaagaaaagccaguaaauauagagaccgagcccccauucggugaaucuuacauaguuguaggcgcaggagaaaaagcacugaaacugucaugguuuaagaaagguucaaguaucgguaaaauguucgaagccacagcaagaggugccagacguauggcgauacuuggagacacugcaugggauuuuggaucuauaggugggguguuuacgucgguuggcaaauuaguccaccagguuuuugguacagccuauggcguucuguuuaguggaguaagcuggacaaugaaaauagggauaggaauauugcucacaugguugggacuuaacucacgaucaacaaguuugagcaugacaugcaucgcaguuggaaugguuaccuuauaucuggggguaaugguacaagcugauaguggcugcguaaucaauuggaaaggacgagaacuaaagugcgggagcggcauauuuguaacaaaugagguccacacauggacagagcaauauaaauuucaggcagauagcccgaagcguuuauccgcagcaauagguaaagcgugggaagaagggguaugugggaucaggucggcgacaagacuugagaauauaauguggaaacaaauaucuaaugagcuaaaucacauacuuuuagaaaacgauaugaaauuuacaguaguaguaggugacgcgaauggaauauuagcacagggcaagaaaaugauuaggccgcaaccuauggaacacaaguacuccuggaaaagcuggggaaaggccaaaaucauuggagcugauauccaaaauacuacguucauaaucgaugguccugauacaccagagugcccugauggccaaagggcuuggaauauaugggaaguugaagacuaugguuuuggaauuuucacuacuaauauaugguuaaaacuuagagauagcuauacacaaaugugcgaccaucgcuuaaugucagcggcaauuaaagauaguaaagcagugcaugcugacaugggauacuggauagaaagcgagaaaaaugaaacuuggaaacuagcacgcgcuuccuuuauagaagugaaaacauguacguggccaaagucucacacguuguggaguaacgggguacuggaaagcgaaaugauaauaccaaaaauauaugggggcccaauuucgcagcacaauuauagaccgggcuauuuuacucaaacagcaggacccuggcaccugggcaaacuggaacuagauuucgauuugugugagggcacgacuguuguuguugaugaacacuguggaaauagaggucccucauugcguacgaccacaguuacggguaagauaauucaugaguggugcugccgcaguugcacuuuaccuccauugcgcuuuagaggcgaagacggcugcugguauggaauggaaauaagaccagugaaagagcgcgaagaaaaucuugugcgaucaaugguaucggcaggaaguggagaagucgacucuuucagucuugguauacuaugcgugaguauaaugauagaagaagucaugagguccagauggucaagaaagaugcuaaugacugggacguuggcaguguucuuacuucuaauuaugggacaauugacauggaaugauuuaacacgacuaugcauuaugguuggcgcaaacgcauccgacagaaugggaauggggacuaccuaccucgcguugauggcaacauucaaaaugcgcccuauguuugcuguuggacuucuauuucguagauuaaccaguagggaaguccuacucuuaaccauaggcuugagucuuguugcaucaguagaauuaccaaauagcuuagaagaguugggcgauggacuagcuaugggcauaaugaugcuaaagcuguuaacagaguuccaaccgcaccaacuauggacuacuuuacucaguuuaaccuucguaaaaaccacacucucguuagauuacgccuggaaaacaacagcaaugguuuugucuauagucagcuuguuucccuuaugcuuaaguacaacuucacagaaaacaacuugguuaccaguguugcucggcaguuuuggaugcaaaccacucacuauguuuuuaaucacggaaaauaaaauauggggacguaagucuuggccauugaaugaaggaaucauggcgaucggaauaguguccauucuuuuguccucacuccugaaaaacgaugucccacuagccggaccacuuauugcuggagggauguuaauugcguguuacgugauuucaggaucaagcgcggauuuaucauuagagaaagcugcggaaguuaguugggaacaugaagcagagcauucgggagcuucacacaauaucuuaguggaaguccaagaugaugguacaaugaagaucaaagacgaagaacgagaugacacgcuaacgauuuuauuaaaagcagcacucuuagcuguaucaggaguauauccgauguccauaccggcaacacuauuuguuugguacuucuggcagaagaagaaacaaagauccggaguucucugggauaccccaaguccgccagaaguugaaagggccguccuugaugaugggauuuacagaauacuacaacggggcuuacuaggcagaucucaaguaggugucgggguguuucaagaugggguauuucauacuauguggcauguaacucgcggugccguucuaauguaccaaggcaagagacuagagcccucaugggcuucggucaaaaaggaccuaauaucguauggagguggauggagauuucaagggaguuggaacacuggcgaagaaguucagguaauagcagucgaacccgguaagaaccccaaaaaugugcagacuacaccaggaacuuucaaaacaccagaaggugaagucggagcuaucgcauuagacuuuaagcccgguacuagcggaagcccaauuguaaaucgagaggguaaaauugucgggcuguacgggaauggaguuguaacgacaucagguacuuauguuagcgcaauagcacaagcaaaagcaucgcaagaggguccguugccggaaauagaggacgaaguauuuaagaaaaggaaccuaacuaucauggauuuacauccuggcagugguaagacgagacgauaucuuccagcaauuguacgugaagccauaaaaaggaaacucagaacauuaauacucgcgccaacgcgaguaguugcgagcgaaauggccgaagcucuaaaaggaaugccuauaagauaccaaacaacggcugucaaaucagagcacacaggaagggagaucguugauuuaaugugccaugcuaccuucacaaugcgacuacuaaguccaguacgagugccuaacuauaauaugauaauuauggacgaagcacauuuuacugauccugcaucgauugcagcacggggcuauauaucaacucgagucgguaugggagaggcagcugcaauauucaugaccgcaacaccaccuggcucuguagaagcauuuccacaaucuaaugcugucauacaggacgaagaacgagauauucccgaacgaaguuggaacagcggauacgauuggaucacagacuucccaggcaaaacaguaugguuugugccaucuauuaaaucaggaaaugauauugcgaacuguuuacgcaaaaauggaaaacgagucauacaguuguccagaaaaacauucgacacggaauaucaaaagacaaagaauaaugauugggauuacguaguaacaacagauauaucagagaugggagcaaauuuucgugccgacagagucauagacccucgacguugccuaaaaccgguaauacugaaggaugguccagagagggucaucuuggcuggaccuaugccggucacuguagcaucugccgcucaacguagggguagaauugggcggaaucaaaauaaggaaggagaccaauacguuuauauggggcaaccacucaauaacgaugaagaucaugcacauuggacagaagcaaaaaugcuauuagauaacauaaacacgccugaggguaucauaccugcgcuuuucgaaccugaaagggaaaaaucugccgcuauugacggagaauauagauuaagaggugaagcaagaaaaacguucguagaauuaaugcgucgaggugaucuaccugucuggcucagcuacaaaguggcauccgaaggauuucaauauucagacagacgcuggugcuuugacggcgaaagaaauaaucaaguccuagaagaaaauauggauguggaaaucuggacuaaagagggagaacgaaagaaauuaagaccccggugguuggacgcaagaacguacucagauccauuagcguuaagagaauuuaaagaauuugcugccgggagacgaucaguaucuggcgaccucauacucgaaauaggaaaacuaccacagcaccuuacacuaagagcccaaaaugcucuugauaacuuaguuaugcuucauaacucugaacaagggggaaaagcguacagacaugcgauggaagaacucccagauacuauagagacacucauguuauuggcauuaaucgcaguacugacaggagguguuacacuauuuuucuuaaguggcaaaggauuagguaaaacaaguauuggacuucucugcguaacugcuucuucggcacuauuauggauggccaguguugaaccgcauuggauugcugcgucuauuauucuggaguuuuucuugaugguucuucucauaccagaaccugacagacaacgaacaccgcaagauaaucaacuagcuuacguaguaauaggauuacuauuuaugauacucaccguagcugcuaaugaaaugggccuauuagaaacuaccaagaaagaccuuggcauuggucauguugcugcagaaaaucaucaacaugcgacuaugcuagacguagaucugagaccugcuagcgcuuggacucuauaugcaguagcaacaaccgucauuaccccaaugaugcgucacaccauagaaaacacgacugcaaacauuucccuuacggcuauagcgaaucaagcagcuauacuaaugggauuagauaaaggauggccaauuuccaagauggauauaggaguaccacuuuuagcauuagguugcuacagucaaguuaacccucuaacgcucacugcagcaguauugauguugguugcgcauuacgccaucauugggccuggguugcaagcaaaggcaacccgcgaagcgcagaaacguacagcagcuggaauuaugaagaacccaacuguugauggaauugucgcaaucgaccucgacccaguuguguaugacgcgaaauucgagaaacagcucgggcaaauaauguugcucauuuuguguacgucucaaauccuucuuaugagaacaacaugggcgcuaugugaaucaauaacauuggcuacuggaccacuaacuacucucugggaagggucaccaggaaaguucuggaacaccacuauagcaguaaguauggcuaauauuuuuagaggauccuaucuagccggugcuggacuagcuuuuucauuaaugaaaagccuugggggaggaaggagaggaacgggcgcucagggagaaacacugggagaaaaguggaaaagacaguuaaaccaacugucuaaaucagaguucaauacauauaaaaggucagggauaauggaaguagauagaagugaagcgaaggaaggucuuaaaagaggggaaaccacgaaacaugcaguuagccgcgguacagcaaaauuaagaugguucguagagcgaaaccuagucaaaccggaaggcaagguaauagaccuaggauguggacguggcgguuggagcuauuacugcgcaggauugaagaaaguaacugaggucaaaggauauacaaaagggggcccuggacacgaagaaccgauaccgauggcaacauauggguggaaccuaguaaaacugcauucuggaaaagauguguucuucaugcccccugaaaaaugugacacgcucuugugcgauauaggugagucaucaccaaauccgacuauagaagaaggcagaacucugagaguauuaaaaaugguagaaccuugguuaagaggcaaccaguucugcauaaaaauucugaauccuuacaugccaagcgucguugagacguuagaacaaaugcagagaaaacacgggggaauguugguaaggaacccauuaagcaggaacucaacgcaugaaauguauuggguaucaugcgggacaggaaacaucguaucugcgguaaauaugaccucucgaaugcugcucaauagauucacaauggcucaccguaaaccaacuuacgagcgagacgucgaccuaggagccgguacacgacacguggcugucgaaccggaagucgccaaucuugacauuauaggucagaggauugaaaacaucaaaaacgaacacaagucaacuuggcacuaugaugaagacaacccuuacaaaacgugggcauaucauggcucauacgaagucaaaccgucgggcuccgcaucuucaaugguuaacggagucguacgauuacucacaaagccaugggauguuaucccaaugguuacccaaauagccaugacugacacaacaccauucgggcaacaaagaguuuuuaaagaaaaaguugauacccgaacuccaagagcuaaaaggggaacaacacagauaauggaagugacagcuaaauggcuuugggguuucuuaagucguaauaagaaaccaagaauuugcacacgcgaagaauuuaccaggaaagugagaucgaaugccgccaucggagcuguauucgucgaugagaaccaauggaacucagccaaagaggcaguagaagaugaaagauuuugggaucuaguacacagggaaagagagcuacauaaacaaggaaaaugugcuaccugcguauacaauaugaugggaaaaagagagaagaaacuaggugaguuuggaaaagcaaagggcagucgugccauuugguacaugugguuaggugccagauuuuuagaguucgaagcacuaggauuuaugaacgaagaucacugguucucucgagaaaauucacuuucuggaguggaaggagaggguuuacacaaauugggauauauauugcgagauauuucuaagaucccaggggguaacauguaugcggacgacaccgccgguugggauacucgcaucacagaagacgauuuacaaaaugaggcgaaaauaaccgauauaauggagccagagcaugcucuacuagcgacaaguauuuuuaaauuaacauaccagaauaaagucguucgcguccagaggccugcaaagaauggaacggugauggacguuauuucaaggcgugaucaacguggaucuggccaggucgggacuuacggucugaacacauucacuaauauggagguacaacucaucagacaaauggaaagugaaggcauuuuccugccuucagagcuugagacgccaaaucucgccgaaagaguacuugauugguuagaaaaacacggagcagaacgccuuaaaagaauggcuauaucgggggaugauuguguuguaaaaccuauagaugacagauuugccacagcccucacggcacuuaacgauaugggcaaaguccgaaaggacaucccccaaugggaacccuccaaaggguggaaugacuggcaacaagugcccuuuugcagucaucacuuccaucaacuuauaaugaaagaugguagggaaauaguaguccccuguagaaaccaggacgaguuaguaggcagagccaggguaucgcaaggagcaggguggagcuuaagggaaacugcauguuuggguaagaguuacgcgcaaauguggcaguugauguauuuucaccgcagagaccuaaggcuagccgcaaacgcaauauguagcgcggucccuguagaguggguaccaacgaguaggacgacauggaguauacaugcucaccaucaauggaugacgacagaagauaugcuuucagucuggaacagaguauggauagaagagaacccuuggauggaggauaaaacacauguuaguagcugggaagaaguaccauaucuuggaaaaagagaagaucaauggugcggaaguuugauugguuuaacagccagagccacaugggcaacaaacauacaaguagccauuaaccaaguaaggagauugauugguaacgaaaauuaucuugauuacaugacuucuaugaaacgguuuaaaaacgagucugauccagaaggugcuuuaugguag

SEQ ID NO: 21147 - RNA, 9879 nt, Artificial Sequence
  derived and/or modified CDS sequence (opt6) from DENV-1__GQ868565__SS-prME
ucugugaccauguuauuaauguuacuuccaacggcgcuagcuuuucaucuaacuacaagagguggggaaccucacaugaucguuucgaaacaagaaagaggaaagagcuugcucuuuaaaacgagcgccgguguuaauaugugcacacucauagcaauggaccugggagaacuuugugaagacacuaugacauauaagugcccacgaauaaccgaagcagaaccagaugauguagauuguugguguaaugcgacagauaccuggguaacuuacgguaccugcucacaaacgggugagcaucgccgcgauaaacgaaguguagcgcuugcaccacacgucggauugggauuggaaacucgaaccgaaacuuggaugaguagugagggggccuggaaacaaauacaacgcguugaaacuugggcuuuacggcacccgggcuuuacuguuauugcacuauuuuuagcacaugccauagguacuucaauaacccaaaaggggauaauauuuauacuacuuaugcuuguuacccccagcauggccaugcguuguguagguauaggaaaccgggauuuugucgaaggauuaucuggcgcgacguggguggacgucguucuggaacauggaaguugugucacuaccauggcuaaaaauaaaccuaccuuagauauugaauuguuaaaaacugaaguuaccaacccugcaguauuacgaaagcucuguauagaagcuaagauuaguaacacaacaacugacagccgauguccaacccagggagaagcuacccucgucgaagaacaagacgccaauuuuguaugcagacggacguuugucgauagaggcuggggaaacggaugcgggcuauucggaaaagggagucuauugacaugcgcaaaguucaaguguguaacuaagcuagaagguaaaaucguucaauacgaaaaccuaaaauacucuguuaucgucacgguacacacaggugaccaacaucaagugggaaaugaaacaaccgaacauggcacuauugcgacaauaacuccacaagcuccgacaucagaaauacaauugacggauuacggugcacuuacguuggauuguagcccuagaacaggacuagauuucaaugaaauggucuuacucacaaugaaagaaaaaucuugguuaguccacaagcaaugguuucuggaucuaccgcuucccuggacaucaggcgcgucuacaagucaagaaaccuggaacagacaagauuuauuagugacuuuuaagacagcccacgcaaagaagcaagaaguaguaguacuuggaucucaagaaggugccaugcacacagcucuaacuggagcaacagaaauucaaacaucaggaacgacuacuauauuugccggccauuuaaaaugccgccuaaaaauggauaaacuaacacuaaagggaaugaguuacguuauguguaccggcaguuuuaaguuggaaaaagaaguagcugaaacgcagcauggcacuguccucguucaagucaaauacgaaggaacagaugcacccugcaagauaccauuuagcacucaagacgaaaagggcguaacacagaacggccgccuaauuacagccaacccuauuguaacagacaaggaaaaaccagucaacauagaaacggaacccccguucggcgagagcuacaucguagugggagccggugaaaaagcguuaaaauuaucgugguuuaaaaaggguaguuccaucgguaagauguuugaggcuacugcgagaggagcgcgccgaauggcgauucuuggcgauacagcgugggauuuugguuccauuggaggagucuuuacuucagucggaaaauugguacaccagguuuuuggcacggcauaugguguauuauuuucgggaguuucauggacaaugaaaauaggaauaggaauauuguugacgugguuaggacuaaauagucgaucgacaucguuaucaaugacauguauagccguagguauggucacgcucuaucuuggcguuaugguacaagccgauucuggcugcgucauaaacuggaaaggucgugaauuaaaguguggcagugguauauucgucacuaacgaaguucauacauggaccgaacaauauaaauuccaggcagacaguccuaagcguuuaucggcugcaauaggaaaagcgugggaagaggguguuuguggcauucgaucagcuacucgauuggaaaauauaauguggaaacagauaucaaaugaacugaaccacauuuuacuugagaaugacaugaaauucacgguaguggucggugaugcaaacgguauacuggcgcaaggaaagaaaaugauaagaccacaaccgauggaacauaaauauaguuggaaaagcugggguaaagccaaaauaauaggugcagauauucaaaaugcaacuuuuauaauagacgguccagauacucccgaaugucccgacgggcaacgagccuggaauaucugggaaguagaagacuacggauuuggaauuuuuacaaccaauaucuggcuaaaguuaagggauucauacacccagaugugugaucacagacuuauguccgccgcgauuaaagauaguaaagcaguacaugcugacaugggcuacuggauagaaagcgagaaaaaugaaaccuggaaauuagccagagccaguuuuaucgaaguaaaaacuuguacguggccaaaaucacacacacuuugguccaaugguguauuggaaucagagaugauaauuccgaagauauauggagguccaauuucccaacacaauuaccggccugguuacuucacucaaacagcgggaccauggcauuugggaaaauuagaguuggacuucgaccucugugaagguacaacagucguuguugacgaacauugugguaaucgaggacccagucugcggacaacuaccgugaccgggaaaauaauacaugaaugguguugccgaaguuguacacugccuccucugagauucaggggcgaagaugggugcugguacggaauggaaauaagaccuguaaaagaaaaagaagaaaaucugguaaggucuaugguuucggcgggguccggagaaguagacucauucucacuaggaauacuuugcguaagcaucaugaucgaagaggugaugcgaaguagauggagucgaaaaauguuaaugacaggaacauuagcaguauuuuugcuucuuauuaugggucaauugacguggaaugaucuaacucgacuaugcauaauggucggagccaaugcuucagaucggaugggaaugggaacaacuuauuuagcucucauggcaacuuuuaaaaugaggccaauguucgcuguaggacucuuauuucguaggcuaacaucuagagagguguuacuauuaacuauugguuuaucauuaguugcaucuguagagcuacccaacagcuuagaagaauuaggagaugguuuggcuaugggcauuaugauguugaaacuccuaaccgaauuucaaccucaccaacuauggaccacacuauuaagucuaacuuuuguaaaaacuaccuuaaguuuggauuaugccuggaaaaccacagcaaugguacuaucuauaguaucucuguuuccucuuugucuaagcaccacaucucagaaaacaaccugguuaccaguacuuuuaggaucguucgguuguaaaccuuuaacgauguuucuaauaacugaaaauaagauuugggguagaaaaucauggccauuaaaugaaggaaucauggccauagggauuguaucgauauuguuaucaucuuuacucaagaacgacgucccucuggcggguccuuugauugccggagguaugcucaucgcauguuauguuauaaguggaucaucggccgaucuaucucuagaaaaggcugccgagguaaguugggaacaggaagcagaacacagcggagcuucccauaacauacucguggaaguucaagaugauggaacuaugaaaaucaaggacgaggagagagaugauacuuuaacgauauuacuaaaagcaacuuuauuagcggugucugggguuuaccccaugucaauuccugcaacauuauuuguaugguauuuuuggcagaaaaagaaacaaagaucagggguuuuaugggauacaccaaguccaccagaaguagagagggcugucuuagacgacgguaucuacagaauuuugcaacgaggauuauugggacgcagucaaguagggguugggguauuucaagaugggguauuucacacuauguggcaugucacgagaggagcagugcuaauguaucaaggaaaacgacuugaaccaucaugggcauccguuaaaaaggaccuaauuucauauggggguggguggcgcuuucagggacuguggaacacgggggaagaagugcagguuaucgcuguugaaccagguaaaaacccuaaaaauguucaaacaacgccagguacuuucaaaacccccgaaggcgaaguuggcgcgauagcacuugauuuuaaaccggguacaagcggguccccaauagucaaccgagaaggaaaaauagugggguuauacgguaauggcguaguaacuacgucggggacauacguaucagcgauagcucaggcaaaagccucacaagaaggaccauugccagaaauugaggacgaaguguuuaagaaaagaaauuugacuauuauggaucugcacccagguaguggaaaaacacgucgcuaccuaccagcaauagugagagaagcaauuaaaagaaaacugagaacauuaauuuuggcgcccacgcgaguuguggcaucagaaauggcagaagcauuaaaagggaugccaaucagguaucagacaacagcgguaaaaucugaacauacuggucgcgaaaucgucgaccuaaugugccacgcuacauuuacaaugaggcuuuuauccccuguacgaguuccgaauuauaauaugauaaucauggaugaagcucacuucaccgauccugcuuccauagcugccagaggcuauauaucgacgaggguugggaugggagaagcugcggccauuuuuaugaccgcaacaccaccugguaguguagaggcuuuuccucaaucaaaugcggugauacaggacgaggaacgcgacauaccggaaaggaguuggaacucagguuacgauuggaucacagacuuucccggcaaaacggugugguuugucccgaguauuaaaucugggaacgacauugcaaacugccuuaggaaaaauggaaaacgggugauacagcuuagcaggaaaacuuucgauacggaauaucaaaagaccaaaaauaaugacugggauuacguaguaacuaccgacauaucagagaugggcgcgaauuuccgcgcggauagaguaaucgacccucggcgcuguuuaaagccugucaucuugaaagaugguccagaacgagugauauuagccgguccgaugccaguuacaguagcuagcgcagcacagaggcgugggcgaauugggcgcaaccaaaacaaggaaggagaucaauauguauauaugggacaaccauuaaauaacgaugaggaccaugcucacuggacagaagcuaaaaugcuucuugacaacauaaauacaccugaaggaauaauacccgcguuauucgagccggaacgugaaaagucagcagccauagacggagaguaucgccuacguggagaggcgagaaagaccuuugucgagcuaaugagacgcggcgaccucccagucuggcuuucuuacaaaguugcuagcgagggguuucaauauucagaucgcagaugguguuuugauggugagcgaaacaaucagguucucgaggaaaacauggauguagaaauauggacaaaagaaggggagaggaagaaacuuagacccagaugguuggacgcaaggaccuauucagacccguuagcauuacgugaauuuaaggaguucgcagcuggacgccgaucuguaagcggagauuuaauccucgagaucgguaaacugccacaacaucuaacacuuagggcucaaaacgcacuagauaaucuaguaaugcuucacaauucugaacagggagggaaggcuuacaggcaugcuauggaagaauuacccgauaccauugagacgcuuauguuauuggcgcuaaucgcuguucucacuggaggcgucacccuauucuuucugucagggaaaggauuaggcaaaaccucaauagggcuauuauguguaacugcgaguucagccuugcuguggauggcgagugucgaaccucauuggaucgcagcaagcaucauccuugaauuuuuccuaaugguauuguuaauucccgaaccagaccgucagcguacuccacaagacaaccagcuagcauaugucgucauagguuuauuauuuaugauuuuaaccguugcugcgaaugaaaugggauuacuggaaacuaccaagaaagaucuaggaauagguuaugcugcugcugaaaaccaucagcacgcuacaaugcuagauguagacuugagaccugcaucagcguggacacuauacgcaguagcgacgacugucauaacaccgaugaugcgacauacuauugaaaacaccacagcgaacaucucacugacagcuaucgcaaaucaagccgcuaucuugaugggauuggacaaaggauggccaauaucaaaaauggauaucggaguaccguuauuagcacuaggauguuacucucaggucaauccauuaacacugacugcagcgguacugauguuaguagcccacuaugcgauuauugguccugggcuacaagcuaaagcgacuagggaggcacaaaaacgaaccgccgccgguauuaugaagaauccuacuguagaugguauagucgcaauugaccuggauccggugguauacgaugcaaaauuugaaaaacagcuaggucaaaucaugcuuuugauacuuugcacaagccaaauuuuacuaaugcguacuacuugggcacucugcgaauccauuacacuagcuacgggacccuuaacaacacuaugggaagggucaccugguaaguuuuggaauacuacuauagcaguaucaauggcaaauauuuuucgaggaucauaucucgcuggggcaggauuagcguuuaguuuaaugaaaagccuuggagguggccgaagagggacgggagcgcaaggagagacuuuaggagaaaaauggaagagacaacuaaaucaacuauccaaaagcgaauuuaauacguauaaaagauccggcaucauggaaguugaccgaagugaggccaaagaagguuuaaaacgcggagaaacaacaaaacacgcaguaucgagagguaccgcaaaacugcgaugguuuguugaacgaaaucuuguaaagcccgaagggaaaguuauagacuuggguugcggacgaggaggcuggaguuacuauugugccggucucaagaaagucaccgagguaaaaggcuacacaaaagguggcccaggacacgaagaaccgaucccaauggcgacuuacggauggaaucuaguuaaacuccauagugguaaagauguauucuuuaugccaccugaaaaaugugauacauugcuaugugauauaggugaaagcuccccaaauccaaccauagaagaaggaagaacgcuuagaguauuaaaaaugguggaaccauggcuaagggggaaucaauuuugcauaaaaaucuuaaacccuuauaugccaaguguuguagaaacuuuagaacaaaugcaacguaaacacggaggaauguuggugcguaacccuuuaagucgaaauucaacacacgaaauguauuggguuucaugcggcacggguaacauaguuucugccguaaacaugacuagccgaaugcuacugaaucgauuuacuauggcacauagaaaaccuacauaugagagagacguugaccuaggcgcagguacuaggcauguugcgguugaaccagaagucgcaaaucucgauauuauuggccagaggauagaaaacauuaagaaugagcauaaaucuacauggcauuacgaugaggauaauccauacaaaacaugggcuuaucauggaaguuaugagguaaaaccgaguggaagcgcuucgucgauggucaauggagucguaagacuccuuaccaaaccgugggaugucauacccaugguaacucagauugcgaugacagacacaacgcccuuuggucagcaaagaguauuuaaagagaaaguagauaccagaaccccgcgugccaaaagaggaacaacucaaaucauggagguaacagccaaguggcuuuggggguuccugucucgaaauaagaaaccuagaauuugcaccagggaagaguucacccguaagguuagaucgaacgcugcuauaggagcagucuucguugaugagaaccaauggaacuccgcaaaggaggcuguagaagaugaacgauucugggaucugguucaucgggaaagagaacuccauaaacaggggaagugugcaacuuguguuuauaacaugauggggaagcgagaaaagaaguuaggugaguucggaaaggccaaaggaagucgcgccaucugguacauguggcugggugcaagguuucuagaguucgaggcacugggauuuaugaacgaagaucauugguuuucacgggagaacucgcuaucuggaguggagggugaagguuugcauaaauugggguacauacucagagacauaaguaaaauuccaggagggaauauguaugcugaugauacggcaggaugggauacucgaauuacggaagaugauuuacaaaaugaggccaagauuacagauaucauggaaccugaacacgcccuguuagccaccaguauuuuuaaacugacauaucaaaacaaagugguaagagugcaaagacccgcuaaaaacggaacugucauggauguaauaucgagaagagaccaacgaggaucuggucaaguuggaaccuauggucuaaauaccuucacaaacauggaaguucaauuaauuagacaaauggaaagcgaaggaauuuuucucccaagcgaauuagagacuccuaacuuggcagaacguguucuagacuggcuggaaaaacauggagcggagcguuugaaacgaauggcaaucucaggagacgacugugugguuaagccaauagacgauagauuugccacugcuuugacagcgcuuaacgacauggggaaagugcgaaaagauauuccacaaugggagccauccaaaggguggaaugacuggcaacaaguaccauuuuguucucaccauuuucaccaguuaauaaugaaagauggacgugaaauaguaguaccaugucgaaaucaggaugaauuaguugggagagcaaggguaucccaaggggcugguuggagucuuagggagaccgcaugccuuggcaaaucguaugcacagauguggcaacugauguacuuccauaggcgcgauuugagacuugcagcaaacgccauuuguagugcaguaccugucgaguggguacccaccucacggacuaccuggucaauacaugcccaucaucaguggaugacaacagaagauaugcuaucaguguggaauagaguauggauugaggaaaaccccuggauggaagacaaaacucaugugaguucaugggaggaaguaccuuaucuaggaaagcgagaagaucaaugguguggaagucugauuggauuaaccgcucgagcuacaugggcaaccaauauacaaguugcaauaaaucaaguuagaagacuaauugguaaugagaauuauuuagauuauaugacaucgaugaagagauuuaagaaugaaucagauccagaaggugcuuugugguga

SEQ ID NO: 21148 - RNA, 9879 nt, Artificial Sequence
  derived and/or modified CDS sequence (opt6) from DENV-1__GQ868568__SS-prME
uccguaacuaugcuauuaaugcuacuucccacugcacuugcauuccacuuaaccacuagagggggagaaccacauaugauaguuaguaaacaagaacgcgguaaaaguuuauuauuuaaaacaucagccggugucaauauguguacguugauagcaauggaucuaggugaacuuugcgaagauacuaugacuuacaaaugcccuagaaucacugaagcugaaccagacgacguagacugcugguguaacgcuacugauacuugggucacauauggcacuuguucacaaacaggcgaacaucgccgugauaaacgcucaguagcgcuugcaccccaugucggccuaggauuggaaacucgaaccgagacauggaugaguucagaaggggcauggaagcaaauacaaaggguagaaacuugggcuuuaagacauccaggcuuuacaguaauagcauuauuuuuggcgcaugugauaggaacaucaauuacacaaaaaggaauaauauuuauauuacuuauguuaguaacuccaucaauggcaaugcgguguguaggcauagggaauagagauuucguagaaggacuaaguggagcgacauggguagauguuguccuagaacauggaucauguguuacuacgauggccaaaaauaaaccgaccuuagacauagaacuccuaaaaacagaaguaacgaacccggcaguuuuacguaaauuguguauagaagcaaaaauauccaauacaacaaccgauucucgaugccccacacaaggagaagcgacgcuggucgaagaacaagacgcaaauuuuguuugucgacgaacguucguugauaggggguggggaaauggguguggacuuuuugggaaagguaguuuauuaacgugugcuaaauuuaaauguguaacaaaauuagaagggaaaauuguccaauacgaaaauuugaaauauucggucauaguuacagugcauacgggggaccaacaucaaguggggaacgaaaccacagaacauggaacaauagcuacaauuacaccacaagcgccaacaucagaaauacaacuaacugacuacggggcuuuaacucuagacugcaguccaaggacaggacuagauuuuaaugaaaugguacuacuuaccaugaaagaaaaaucuuggcuaguucauaaacaaugguuucuggaccuuccacuuccuuggacaucaggugcaucuacuucgcaagagacguggaaucgccaagaucuauuaguuacuuuuaaaaccgcacaugcaaagaaacaagaagugguagugcugggcucccaagagggugcuaugcauaccgcacuuacuggagcaacagaaauacaaacaucagguacuaccaccauuuucgcaggucaucucaaaugccgauuaaaaauggauaaguuaacacucaaaggaaugaguuacgugauguguaccggaaguuucaaauuagaaaaagaagucgcagaaacacaacaugguacuguuuugguucagguuaaauaugagggaaccgaugcaccuuguaaaauaccguuuucuacacaggacgaaaaaggugugacacaaaacggcagacuaauaacagcgaauccuauuguaacagauaaggaaaaacccgucaauaucgaaaccgaaccaccauuuggagaaagcuauauaguaguuggagcaggggaaaaagcauuaaaacuaucuugguuuaagaaagggucauccaucggaaaaauguucgaagcuaccgcacggggugcucgcagaauggcgauccuaggagauaccgcgugggauuuuggcucuauuggugguguguucacaaguguuggaaaauuaguacaucaaguauucgggacugcauacggaguucuuuucagcgguguuucauggauaaugaagauagggauaggcauucugcuuacuuggcuaggauuaaauucacgaaguaccagccuaagcaugacguguauugcuguagguauggucacuuuauacuuaggaguaaugguacaagcagacucugggugugugauaaacuggaaagggcgagaauugaaaugcggaucaggcauuuuuguuacaaacgaaguccacacuuggacugagcaauacaaguuucaagccgauagcccuaaaagacuaucagccgcuauugguaaagcgugggaagaaggggugugcgggauacguucagccaccaggcuagaaaauaucauguggaaacaaauaaguaacgaacuuaaucacauucuguuggagaacgauaugaaguucacaguaguagucggggacgcgaaugguauccuugcacaagguaaaaagaugauuaggccccaaccuauggaacacaaguacagcuggaagaguuggggaaaagcaaagauuauaggagcugauacacagaacacgacguucauuaucgacggcccagauacaccagaaugcccagauggacaaagagcauggaauauaugggagguagaggauuacggauuuggaauauucacgacaaacauauggcuaaaauuacgagauagcuacacacaaaugugugaccacagacuaaugucagcagcgaucaaggacagcaaggccguccaugcagauaugggguauuggaucgaaagugagaaaaaugagacauggaaacucgcuagagcuagcuuuaucgaaguaaaaacuugcacauggccaaaaucacacacuuuauggaguaacggagugcuagagucggaaaugauuauuccuaaaauauacggaggaccuaucagucagcacaauuaucgcccuggauauuuuacucaaacggcgggaccguggcauuuaggaaaauuagaacuagauuuugaucuaugcgagggcaccacugucguugucgaugaacauuguggaaacaggggccccagcuuaaggacuaccacggucacgggaaagaucauacaugaaugguguugucgaucauguacuuugcccccacuaagguuucgcggagaagacgguugcugguacggaauggaaauacguccagugaaagaaaaggaagagaauuuaguaagaucuauggucucggccggaagcggcgaaguagauucguuuucacuagguauacuguguguaucaauuaugauagaagaagucaugcggucgcgcuggucacggaaaauguuaaugaccgguacucuugcaguauuccuuuuacuuauaaugggacaacuaacauggaaugaucuuacacgacuaugcauuaugguuggugcaaaugcuuccgacagaauggguaugggaacaacguauuuggcuuugauggcuaccuucaaaaugcgaccaauguucgccgugggcuuauuguuuagacgacuuacgagucgagaaguucuucuauuaacuauaggauuaagucuaguagcgucagucgagcucccuaacagccuagaagaauugggagauggguuagcaauggggauaaugauguuaaagcuacuuaccgaguuucaaccacaucaacuauggacuacgcuccuuucauuaacguuuguaaagaccacauugucacuagauuacgccuggaagacaacagcuaugguucuuaguauagugucacuguuucccuuaugcuugaguaccacgucccagaaaacgacaugguuaccugucuuacucgggucauuugguugcaagccuuuaacaauguuuuugauaacugaaaauaaaaucuggggacgaaaaaguuggccuuuaaaugaagguauaauggccaucggaaucguuagcauauuguuaucaagucuacucaaaaacgauguacccuuggcagguccuuuaauagccgguggaauguuaauagcaugcuauguuaucagugggucaucagcagaucuaucccucgagaaagcagcugaaguaucaugggaacaagaagcugagcacucgggagcaucacacaauauccuagucgaaguucaggaugaugguacaaugaagauaaaagaugaagaaagagacgauacccuaacuauacugcuuaaggcaacacuacuagcuguaucgggaguauacccaauguccauucccgccacauuauuuguaugguauuucuggcagaagaagaaacaacggaguggaguauuaugggauacuccuucuccaccagagguugaaagagcuguacuagaugauggcauauaccgcauauuacaacgaggccuauuaggaagaucccaaguaggagucggaguauuucaagacggugucuuucacacaauguggcauguaacgagaggagcagugcuaauguaucaaggcaaacgauuagaacccucaugggcaagcguuaagaaagaucuaauaucauauggagggggcuggagguuccagggcucuuggaauacgggagaagaaguccagguaauagcagucgaaccagggaagaauccgaaaaacguucaaacuaccccgggcacuuuuaaaaccccggagggcgaaguaggggcaauagcccucgacuuuaaacccgggacaagcggauccccuauaguuaauagagaagguaaaauuguaggccuuuacggaaacggaguaguuacaacgaguggcacuuaugugagugcaauugcucaagcaaaagcaucacaggagggaccucucccagaaauagaagaugaaguauucaagaaaagaaauuugacaaucauggaccuacaccccgggaguggaaaaacgaggcguuauuuaccagcuauuguccgagaagcuauuaaaagaaaauuaagaacccuuauacucgcuccuacacggguaguagccagcgaaauggccgaagcacugaaaggaaugccaaucagauaccaaacaaccgcuguuaagagcgaacacacuggaagggaaauuguagacuuaaugugccaugcuaccuucacgaugagauuguuaucgccggugaggguaccgaauuauaacaugauaaucauggaugaagcucacuucacugaccccgcaucaauagcagcaaggggcuauaucucaacaagaguaggcaugggcgaagcagcagcuaucuuuaugacagcaacaccaccaggauccguagaagcauuuccccagucaaaugcaguuauccaagacgaagaacgcgauauaccugaaagaucuuggaacucggguuaugacuggauuacagauuuuccaggaaaaacuguaugguucguuccaucgauaaagucgggcaaugacauagcgaauugccuccgaaagaacgggaaacgaguaauacaauugagcaggaaaacauucgacacagaauaucagaaaaccaaaaacaaugacugggauuauguagucacuacagacauaucugaaaugggcgcuaacuuuagggcugaucgaguuauagacccuagaagaugucuuaaaccagucauacucaaagaugggccggaacgaguuauccuugcugggcccaugccuguuacgguagcaucagcagcccaacgucgagggagaauugggagaaaucaaaauaaggagggugaucaauacguguauaugggacaaccauuaaauaacgaugaggaucaugcacauuggacggaagcgaaaaugcuacuagauaacauaaauacgccggaggguauaauaccggccuuauucgaaccagaaagggaaaaaucugcagccguagacggagaauauagacucagaggggaagcgcgaaagacuuuuguagaauugaugcgccgaggcgaucugccuguaugguugucauauaaagucgccuccgaaggauuucaauauucugaucgcagaugguguuuugauggagaacggaacaaucagguccuggaagaaaauauggauguagaaauuuggacuaaggagggagaaaggaagaaacuuagaccaagaugguuggacgcucguacauauagugacccucuagcacuacgcgaauuuaaggaguucgcugccgguaggcguaguguaagcggugaucucauccuagagauagguaagcucccccaacauuuaacacuaagagcacaaaacgcacucgauaaucuuguaaugcugcauaacagcgagcaaggcggaaaagcauauagacaugcuauggaggaguuaccugauacaaucgaaacguuaaugcuucuggcucuaauugcuguacugacuggcggcgucacacuauuuuucuuaagcgguaaaggguuggguaagacuucuauaggauuacugugcgugacagcauccucugcacuucucuggauggcaucaguagagccacauuggauugccgcuaguauaauauuagaguucuuccugaugguacuauuaauaccggaaccggaucggcaaaggacaccacaagauaaccaauuggcauaugucgucauaggucuauuguuuaugauucuuacuguagcagcaaaugaaaugggccugcuagagacaacuaagaaagaucuaggaaucgguuauguggcagcggaaaaccaucagcacgcgacuaugcucgacguagaucucaggccggcuagcgccuggacauuguacgcaguggcaaccacgguaaucacaccuaugaugcgucauacaaucgaaaacacaacagcuaacauuucauuaacugcuauagcuaaccaggcagccauacuaaugggauuagacaaaggauggccaauuucaaaaauggacauaggaguuccacuacuagcuuuaggaugcuacagccaaguuaacccacuaacacuaaccgcggcaguacuaaugcuaguugcacacuaugcuauaauuggaccggguuuacaagcaaaagcaacgcgagaagcucaaaagagaacggcugccgggauuaugaaaaauccuacaguugacggaauuguagcaauugacuuagaucccguagucuaugacgccaaauuugaaaagcaauuaggacagauuauguuauuaauacugugcaccagucaaauauuacuaaugaggacuaccugggcuuuaugcgaaagcauaacgcuugcaacagguccguuaaccacccuuugggaggguaguccuggaaaguucuggaauacgacuauagcaguaucuauggccaacauauuucggggcaguuaucuggccggggccgguuuggcauuuucucugaugaagucucuagguggcggucggaggggaaccggcgcucaaggagaaacccuuggcgagaaauggaaaagacaauuaaaccagcuauccaaaucagaauuuaacacuuauaaacguucaggcauaauggaaguagauagaagcgaggcaaaagagggcuuaaagagaggagagacuacgaagcaugcugucucucgugguacugcgaaacuaagaugguuuguagaaaggaauuuaguaaaaccagaaggaaaaguaauagacuugggauguggucguggagguuggagcuauuauugugcaggacucaagaaaguuacagaaguaaagggguauaccaaaggaggcccaggucacgaggaaccgauaccgauggcaaccuauggauggaaucuaguaaagcuacauucuggcaaggacgucuucuuuaugccuccagaaaaaugugauacauuacuuugcgauauaggagaaagcucaccuaacccaacuauagaggaggggagaacucugcguguuuugaaaaugguagaacccuggcuuagaggaaaucaguucuguaucaaaauauuaaaucccuacaugccaaguguuguugagacgcuagaacaaaugcaaagaaaacauggcgguaugcuaguaaggaauccuuuaaguagaaacucgacucaugaaauguacuggguaucuugugguaccggcaacauugucagugccguuaacaugaccucacguaugcuucucaauagauucacaauggcacauagaaaacccacuuacgagagagauguagauuugggugcaggaacuagacauguggccguagagccggaaguagcgaaucuagacauuauuggacagagaauagaaaacaucaaaaacgaacauaaaaguacguggcauuaugaugaagauaacccuuauaagacaugggcuuaucacgguucauaugaagugaagccaucgggcucagcgucaucaaugguuaacgguguggugaggcuuuugaccaaaccuugggacgugauaccuaugguuacccaaaucgcuaugacggacaccacucccuucggacaacaacgcguuuuuaaagaaaaaguagacacacgaacaccacgagcgaagaggggaacaacgcagauaauggaaguuacugcaaagugguuguggggcuuccuaaguagaaauaaaaagccaaggauaugcacccgggaagaauuuacacguaaaguaagaucaaaugcagcaauaggagccgucuucgucgaugagaaucaauggaauagugcuaaggaggcagucgaagacgaaagauuuugggauuuaguccaccgugaacgugaacuccacaagcaggggaaaugcgcgacauguguauacaauaugauggguaaaagagagaagaaacugggggaguucggcaaagcgaaagguucaagagcuaucugguacauguggcucggugcuagauuuuuagaauuugaagcucuuggcuucaugaaugaagaccauugguucaguagagaaaauaguuugagugggguggaaggagaaggacuucauaaauugggguauauucuaagagauauaaguaaaauuccuggcggaaacauguacgcagacgauaccgcggguugggacacgaggauaaccgaagaugauuuacaaaacgaagcgaaaauaacagacauaauggaacccgaacacgcgcuuuuagcgacaagcauuuucaaauuaacauaucagaauaaagugguuagaguccagaggcccgccaaaaacggaacggugauggaugucaucucgaggagagaccaacgaggaucuggccaaguagguacauauggacucaacacuuucacgaauauggaagugcagcuaauaaggcagauggaauccgagggaaucuuuuuaccauccgaauuggaaaccccuaaucucgccgaacguguacuagauuggcuggaaaaacauggugcggagagauuaaaaagaauggcaaucagcggugaugacuguguaguaaagccaauugaugacagauuugccacagccuugaccgcucucaaugauaugggaaaaguaaggaaagauaucccucaaugggagccgagcaagggauggaacgauuggcaacaaguacccuuuuguucacaccacuuccaucaauuaauaaugaaggauggcagagaaauaguuguuccuugccgcaaucaagaugagcuaguggggagagcgcgaguuucacaaggugccggauggaguuugagagaaacagcaugccuggggaaaucauaugcccagauguggcaacucauguauuuccacagacgugaucucagacucgccgcaaacgccauauguagcgcgguaccaguagaaugggucccuacaagucgaacuacauggucgauucaugcacaucaucaauggaugacuaccgaagauaugcuaucggucuggaacagggucuggauugaagaaaacccauggauggaagauaaaacgcauguuucgagcugggaagaggucccguaucugggaaagcgagaagaccaaugguguggaagccuaauaggccucacagcccgugcaacuugggcuacuaauauucaggucgcaauuaaucaaguuagacgacucauaggaaacgaaaauuaccuagauuauaugacaaguaugaaacgguuuaagaacgaaucugacccggaaggagcgcuuugguaa

SEQ ID NO: 21149 - RNA, 9879 nt, Artificial Sequence
  derived and/or modified CDS sequence (opt6) from DENV-1__GQ868569__SS-prME
uccguaacaaugcuauuaaugcuacuaccaacagcucuagcauuucauuuaacaaccagagggggagaaccacauaugauugugucuaaacaagaaagaggcaaaucuuuacuauuuaaaacuucagcaggggugaauauguguacucugauagcaauggacuuaggugaacucugugaggauacuaugacuuacaaaugcccaagaauaaccgaagcugaaccagaugacgucgauugcuggugcaaugcaacugauaccuggguaacauaugggaccuguagccaaacuggugaacaccgccgagauaaacguaguguagcacuagcaccacauguggguuuaggacuagaaaccaggaccgagacuuggaugucuucagaaggagcauggaaacaaauucaaagaguagaaacaugggcacuacgccacccuggcuuuacuguuauagcguuauuucuagcucaugcuauugguacaucaauuacccaaaaagggauaauauuuauucuacuaaugcucgugacgccaagcauggcgaugagauguguggguauuggcaauagagauuuugucgaagggcucagcggggcgaccuggguggacguugugcuagagcacgguuccugcguaacuacuauggccaaaaauaaaccaacacuagacauugagcuguugaaaacugagguagcaaaucccgcuguguuaagaaaacuuugcauugaagcgaaaauuucgaacacaacaacugacagccguugcccuacacagggggaagcuacucuagucgaagaacaggaugcuaauuuuguuugccgucguacguuuguugacagaggaugggguaacggauguggacuauuuggaaaagggagccuauugaccugcgcgaaauuuaagugcguaacuaaauuagaagggaaaauuguucaguacgaaaauuuaaaauauucgguaauuguaaccguucauacuggcgaccaacaucaggugggcaacgaaacuacagaacauggcacgauugcuacgauaacaccgcaagcucccaccucugagauacaacugacggauuauggcgccuuaacauuagacugcaguccacgaacuggccuagauuucaaugaaauggucuuauugacuaugaaagaaaaguccugguuaguccauaagcaaugguuucuggaucuacccuuaccuuggacaucaggagcaagcacuucccaagaaacauggaaccgacaggaucuccuaguaacguuuaagacggcucacgccaagaaacaagagguaguaguauuaggaagucaggaaggagcaaugcacacagcucugacuggggcaaccgaaauacagacuucugguacuacaacuauauuugccggacauuugaaauguagguugaaaauggacaaauugacauuaaaaggcaugaguuaugucauguguacuggaucauucaagcuagaaaaggagguagcagaaacucaacaugguaccguacuugugcaaguaaaguacgaaggaacagaugcaccuuguaaaauuccuuuuucuacacaagaugaaaaaggaguaacacaaaauggacggcuuauuacugcaaauccgauuguuacagauaaagagaaaccaguaaauauagaaacagaaccaccguucggagaaucguauauaguuguaggugcgggagagaaggcucucaaauugagcugguucaagaaaggcucgaguauaggcaaaauguuugaggcuacugcgcguggagcucggaggauggcaauacuuggugacacugccugggauuuuggcagcauuggaggggucuuuacaaguguggguaagcugguacaucaaguauucgguacagcuuacggaguuuuauuuaguggaguaaguuggacaaugaaaauaggaauagggauccuuuuaacuugguuaggcuuaaauucccgaaguacuagccugucaaugacauguauagcggugggaaugguuacucuauauuuagggguaaugguacaagcagacagcggguguguaauaaacuggaaaggaagagaacuaaaaugcggcaguggaauuuucguaacuaacgaagugcauacauggacagaacaauacaaguuucaagcagacucaccuaagagguuaucggcagccauuggaaaagcaugggaagaaggcguguguggaauacgcagugcaacuagauuggaaaauauuauguggaaacaaauuaguaaugaauuaaaccauauacuccuagagaacgauaugaaauuuacagucguagucggugacgcaaacgguauuuuagcucaaggaaagaaaaugauacguccccaacccauggaacauaaauacucuuggaagucauggggaaaggcuaagauuauuggagcugauauacaaaacgccacuuuuauaauagacggcccggacacgccggaaugcccagauggacaaagagcuuggaacauaugggaaguagaagacuauggcuuugggauauucacaaccaacaucuggcucaaguuacgagauaguuauacacaaaugugugaccaccgauuaaugagugcggcuauaaaggauucgaaagcaguucacgcugauaugggguauuggauagagucggagaagaaugaaacauggaaauuagcgagggccaguuucauugaggugaaaacaugcaccuggccuaaaucucacacucuauggagcaacggaguucuugaaagcgaaaugauuauaccuaaaauauacggcgguccaauaagccagcacaauuauaggccaggauauuuuacacagacugcaggcccguggcauuuagguaaacuggaacuugacuuugauuuaugcgagggaacaacagucguaguagaugaacauugugguaacaggggcccgucucugagaacaaccacuguuaccgguaaaauuauccacgaaugguguugccgaucauguacuuuaccuccauuaagauuucgaggagaggacggcuguugguauggaauggaaauaagacccgugaaagaaaaagaagaaaaucuaguacgaucuaugguuagugccgguucuggugaaguggauucguucucccucgguauucuaugcguaucuauaaugaucgaagaaguuaugagaucgcgcuggagccguaagauguugaugacaggaacccuagcaguguuccuacuauuaaucaugggacaauugaccuggaacgauuugacucgucucuguauuaugguaggggcuaaugcaagcgauagaaugggaaugggaaccaccuaccuagcauuaauggcaacauuuaaaaugagaccaauguuugcuguaggacuucuguucaggagguuaacaagucgugaagugcuguuacuaacaauaggccuaaguuuaguggccagcguugaauugcccaauaguuuggaagaacuaggagauggauuagcaaugggcauaaugaugcuuaagcugcuuacagaguuccaaccucaucaauuauggacgacccuuuuaucacuaacguuuguuaaaacaacccucucccuugacuacgccuggaaaacaacggcgauggugcuaucaauaguauccuuguucccucuuugccuuucaacgaccucucagaaaacaacauggcuuccaguacuacuuggaaguuuuggcugcaagccauuaaccauguuccuuauaaccgaaaauaaaauuugggguagaaaauccuggccacuaaacgaagggauuauggcaauaggcaucguaucuauccuuuuaucaucauuauuaaagaaugacguuccacuugcaggaccccucaucgcuggugguaugcuaauagcaugcuacguuauaagcggaaguagugccgaucuaucgcuagaaaaggcagcagaggucaguugggaacaagaggcugaacauagcggcgcgagucacaacauacugguagaaguacaagaugauggcacuaugaaaauaaaagaugaggaacgagacgauaccuuaacgauauuacuaaaagcaacacugcuggcaguaucagguguuuaucccaugagcaucccugcuacucuauucguaugguauuuuuggcagaaaaagaaacaaagauccggaguauuaugggauaccccaucaccacccgagguagagcgcgccgucuuagaugauggaauauaucggauacuacaaagagggcuacuugggcgcucacaaguuggcguggguguuuuccaggauggaguauuucauacuauguggcacguaacacggggagccguacucauguaucaaggaaaaagacuggagcccagcugggccagugucaagaaagacuuaauuucguauggcggcggauggagauuccagggcuuauggaacaugggcgaagaaguacaaguaauugcgguagagccuggcaaaaacccuaggaauguccaaacaacuccagguacguucaagacuccagaaggagaaguaggugcgaucgcauuggauuuuaaaccgggcacuucaggaagcccgauaguaaaucgggaagguaagaucgugggauuguaugggaauggagucguuaccaccucaggaacauacguaucagcaaucgcacaagcaaaagcgagucaggaagggccgcuaccagaaauagaagacgaaguuuucaagaaacgaaacuuaacuauuauggaccuucauccaggcucggguaaaaccaggagauaccuucccgcuauaguucgagaggcuaucaaaagaaaacuucgaacacuaauuuuggcaccaacucguguuguggcgagugaaauggcagaagcacuuaaaggaaugccgauucgguaucaaacaaccgcgguaaaaucggaacacacaggcagggaaauaguagaucuaaugugccaugccacauucacuaugaggcuacugucuccaguccgagugccaaacuauaauaugauaaucauggacgaagcgcacuuuacugacccagccucuauagcugccagaggauacauaagcacacgaguugggaugggugaagcugcagcaauauuuaugacagccacuccuccugguuccguggaggcuuuuccacagaguaaugcuguaauacaagaugaagagagagauauaccugaaagaucuuggaacucgggauaugacuggauuacugacuuuccaggaaagacgguaugguucguaccuucaauuaagagcgggaaugauaucgcuaauugccuaaggaaaaaugggaaacgaguuauucaauugagucgcaagacguucgauacagaguaucagaaaacuaaaaauaacgauugggauuaugucguuaccaccgauauaucagaaaugggugccaauuucagggcagauaggguaaucgauccaagaagauguuuaaaaccagucauauuaaaggauggaccagaacggguaauauuagcaggucccaugccagugacaguagcuucugcagcccaacgucgaggacguaucggucguaaucaaaauaaagaaggcgaucaauacguuuacauggggcaaccacuuaauaaugaugaagaucaugcucacuggacagaagcaaaaaugcuacuagauaauauuaauaccccagaaggaauaaucccagcacuuuucgaaccggagcgagagaaaagcgcugcuauugauggugaguaccgcuuaagaggagaagcacgaaaaacauuuguagaacuuaugagaaggggugaucuaccaguguggcuaaguuacaagguugcaagugagggauuucaauauucagacagacguugguguuuugauggagaacgaaacaaccagguucuagaggaaaauauggaugucgaaauauggacuaaagaaggagagaggaaaaaguuacgcccuaggugguuagacgcuaggacguacucggauccacuagcucuuagagaguucaaagaguuugcggccgggaggcgaucuguaaguggggacuuaauauuagaaauuggcaaacuuccgcagcauuuaaccuugagggcgcaaaaugcuuuggacaaucuaguuauguuacauaauucagaacaaggugguaaagccuaucgacaugcaauggaagaauuaccggacacaaucgaaaccuuaaugcuacuagcccugauugcagucuuaacaggaggaguuacacuauucuuuuuauccggaaaagggcuggguaaaacuucaauuggacuuuuauguguaacggcaagcucagcauugcuauggauggcgucugucgaaccacauuggauagcagcaucaaucauauuagaauuuuuccuaaugguacuacuuauaccagaaccugauagacaacguacaccacaagacaaucaauuagcauacguggucaucggguuauuauuuaugauacucaccguggcagccaaugaaaugggauugcuugagacgaccaagaaagaccuugguauugguuacgcagcugcugaaaaucaucagcaugcaacaaugcuugauguugaucuucgacccgcuucagcauggacauuauaugcaguugcaacaacuguuauuacccccaugaugagacacacaaucgagaacacaaccgcaaauaucagcuuaaccgcgauagccaaucaagcggcaauauuaauggggcuagacaaaggcuggccaauaucaaagauggauauaggaguccccuuauuagcccuuggaugcuacagucagguaaauccacugacauuaacugcggcuguccuuaugcuggucgcacauuaugccauuaucgggccgggacuucaagcgaaagcaacucgagaagcgcagaagcguacagccgcuggaauaaugaaaaauccgaccguggaugguauaguagcuauagaucuugauccaguggucuaugacgcgaaauuugaaaaacaacuagggcaaauaaugcuacucauauuaugcacaucccaaauccugcuaaugcguacaaccugggcgcuaugugaaucaauuacacuggcaacgggaccgcugaccacuuugugggagggaaguccggguaaauuuuggaauacgacgauugcugucagcauggcgaauauauuuagaggcaguuacuuagccggagcaggguuagcauuuagccuaaugaaaucgcugggagguggaaggagaggcacgggggcucagggcgaaacguuaggagaaaaauggaaaaggcaacuaaaccaacugucaaaauccgaauuuaacacauacaaacgcagcgggauaauggaaguugacagaucagaagcaaaagaaggacuaaaacgcggagaaacuaccaaacacgcaguuucaagggguaccgcaaaacuuaggugguuuguugagcgcaacuugguaaaaccagagggaaaaguuauugauuuggggugugggcgugguggauggucuuacuauugcgcgggauugaagaagguaaccgaaguuaaagguuauacaaaaggagggccggggcaugaagaaccaauuccuauggccacauauggguggaacuuaguaaaguuacauucugggaaggauguauuuuucaugccgccugaaaaaugugauaccuuguuaugcgauauaggugagagcucacccaauccaacuauagaagagggucgcacgcucagaguucuuaaaaugguagaacccugguuaagagggaaccaguucugcauaaagauacugaacccauauaugccuuccguaguagaaacacuagaacagaugcaaaggaaacacgguggaauguuagugaggaauccguuaagucgaaacucuacucacgagauguacuggguuucguguggaaccggaaacauuguaagcgcagugaauaugaccagucguaugcuauugaauagauucacaauggcgcacagaaaaccgacuuaugagcgcgacguagaucugggagcgggaacaagacauguagccgucgagccagaaguggcgaaucuagacaucaucggacagcguauagaaaacaucaaaaaugaacauaagaguacauggcacuacgacgaagauaauccauauaagacuugggcguaucaugggucauaugaaguaaaaccgaguggaagugccagcuccauggucaauggagucguacgguuacuuacgaaaccaugggacgucaucccaaugguaacacaaauugcaaugacugacacgacuccuuucggucagcaaagaguguuuaaagaaaaaguagauacgagaaccccuagggcaaaaagggggacuacgcaaaucauggaaguaacagcuaaguggcuguggggauuuuugucacgcaauaagaaacccagaauauguacccgugaggaguucacaagaaaaguaaggucaaaugcugcaauaggagccguuuucguugaugaaaaucaauggaacuccgccaaagaagcuguggaggaugaaagauuuugggaucuaguacacagggagagagaacuucauaaacaagguaaaugcgccacuuguguuuauaacaugaugggaaaaagagagaaaaaguugggggaguucggcaaagcuaagggaagccgagcuauaugguacauguggcuuggagcacguuuucuugaauuugaagcguuagguuucaugaacgaagaucauugguuuaguagagagaauagucuaucgggaguagaaggugaaggcuuacacaaacuagguuauauucuaagagauauaucaaaaauaccagggggcaauauguacgcagaugauacugcugguugggauacccggauaacagaagaugaucuccagaacgaggcaaaaauaacagauauaauggaaccagaacaugcacuucuggccacgucaauuuucaaauuaacguaccaaaauaaagugguacggguucaacgaccugcgaaaaauggaaccguaauggaugucauaagucgacgugaucaaaggggaaguggucaaguagguacauaugggcuaaauacauuuaccaauauggagguccaauuaaucagacagauggaaucugaggguauauuuuuaccauccgaacuugaaacaccaaaucuugccgaaagggugcuagacuggcuggagaaacacggagcggaaagacuaaaaagaauggcaauaucaggugaugauuguguagugaaacccauagaugauagguucgcgacggcccuaaccgcccugaaugauaugggaaaagugcgaaaggacauaccgcaaugggaaccaaguaaaggauggaacgacuggcagcaaguuccauuuuguucgcaucacuuucaccaacuaauaaugaaagacgguagagaaauaguaguuccgugcagaaaucaagacgagcuagucgguagggcucgugugagucagggcgcgggauggagcuugagagaaacugcaugucugggaaaguccuaugcucaaauguggcaacuaauguacuuccaccgaagggaucuccgcuuagcagcgaaugcgauauguucugcaguaccaguagaguggguaccuaccagucggacgacguggucaauacacgcgcaucaucaauggaugaccacagaagauaugcuauccguuuggaauagaguauggauagaagaaaacccguggauggaagacaaaacucacguaucuucaugggaagaagucccauacuugggcaaacgcgaggaccaauggugugguaguuuaauaggcuuaacagcuagggcaacaugggcaacaaacauacaaguggcaauaaaccaagucagacggcucauaggaaaugagaacuauuuagauuauaugacaucuaugaagagauuuaaaaacgagagcgauccagaaggagccuuaugguaa

SEQ ID NO: 21150 - RNA, 9879 nt, Artificial Sequence
  derived and/or modified CDS sequence (opt6) from DENV-1__GQ868570__SS-prME
ucugugacaauguuauuaaugcuucugccaacagcauuagcauuucaccuaacaaccagagguggagaaccacauaugauagugucaaaacaagaaagaggaaaaucauuauuauuuaaaacguccgcgggagucaauaugugcacuuuaauagcaauggauuuaggagaacuuugugaagauaccaugacauauaaauguccacgaauaaccgaagcggaaccggacgauguggacuguugguguaacgccaccgauacaugggucacuuacggaaccuguagucagacaggggaacauagacgagacaaaagaucggucgcuuuagccccacaugucgguuuaggauuggaaacacgaacagaaacauggaugaguagugaaggggcauggaaacaaauacaaagggucgaaacaugggccuugcggcacccggguuuuacaguaaucgcacucuuucucgcucaugcgauuggaacuagcauuacacaaaaagguauaauuuuuauuuuauugauguuaguaacgccaagcauggcuaugagauguguagggauagguaaucgagauuuuguagaaggacuuucaggggcaacguggguagauguaguucuagaacauggaaguugcguaacgacuauggccaaaaauaaaccaacgcuagauauagaauuacuuaaaacagaaguaacaaacccugcuguacuucguaaacuauguaucgaagccaaaauaaguaauacuacaacugauuccagauguccgacacaaggugaagcaacacugguagaagaacaagacgccaauuucguaugcagacgaacuuuuguagaucgaggcugggguaacggaugcggcuuauucggaaaagguaguuuacuaacuugugcuaaauucaaauguguaacaaaacuagaaggaaagauaguccaauacgaaaaccuaaaguacucgguuauagugacuguucauaccggagaucaacaucaaguggguaaugagacuaccgagcauggcacaauagcaacaaucacaccacaagcaccuacaagugagauacaacuaaccgacuauggugcucuaacguuagacugcaguccuagaacaggacuugacuuuaaugaaaugguacuacuuaccaugaaggaaaaaucuuggcuuguacauaagcagugguuuuuagaccugccucuaccuuggacaucaggggcaucaacuucucaggaaacauggaacagacaggaccuccuuguaacguuuaaaacugcgcacgcuaagaaacaagaaguuguuguacuagggagccaggagggcgcuaugcauacugcauugacuggugcuaccgaaauacagacaucuggcacgacgacuaucuuugcuggccaccuuaaauguagauuaaaaauggauaaauugacccuaaaagguauguccuacgucaugugcaccgguucguuuaaauuagaaaaagaagucgcagagacgcaacauggcacgguauuaguacaaguaaaauacgaagguacugaugcgccguguaaaauaccguuuucuacacaagaugagaaaggugucacgcaaaauggaagauugaucacagcaaacccaauaguaacagacaaagagaaaccuguaaauauugaaacagagccgccauucggggagaguuauauugucgucggcgccggugagaaggcccuuaaacuaucaugguuuaagaaagguucaaguaucggaaaaauguucgaggcuacagcacguggggcccgccgaauggcuauucugggagauacugcaugggauuucggaucuauuggagggguauuuacaucaguaggaaaacuuguucaucaaguuuucgguacugcauaugguguauuauuuucugggguaagcuggacuaugaaagugggaaucgggauucugcuuacuuggcuuggauuaaauucacgaaguaccucgcuaagcaugacauguauagcaguagggaugguaacuuuguaucuugggguaaugguacaagcggaccuuggaugcgucauuaauuggaaaggaagggagcucaaaugcgguagugguauauuuguuaccaacgaggugcauacguggacugagcaauacaaauuccaagcugacaguccgaaacggcuaucugcagcgaucgguaaagcaugggaagaagggguaugcggcauaagaucaguaacaagguuagagaacauaauguggaaacagauaaguaaugaauugaaccauaucuuacucgaaaacgacaugaaguucacugugguagugggagaugcgaacgguauucuagcacaagggaagaaaaugauaaggccccaaccuauggaacacaaauacucauggaaaucauggggaaaagccaaaauaaucggcgcugauacccaaaacacaacuuuuauaauugacggaccagacaccccggaaugccccgacggacaaagagcuuggaauauaugggaaguagaagacuacgguuucggcauauuuacaacaaacauaugguuaaaauuacgagauucauauacucagaugugcgaccacagguuaaugucggcggcuauuaaagauucuaaagcaguacacgcugauauggguuauuggauugaaucugagaaaaaugaaacauggaaacuggcaagagcuagcuucauagaggucaaaacauguacuuggccaaaaucucauacgcuauggucgaauggaguauuagaaucagaaaugaucaucccaaagaucuauggugggccgauaagccaacacaacuacagaccaggguacuuuacacaaacggcaggacccuggcaucuggggaaacuggaauuagacuucgaucuaugugaaggcacuacugugguaguugaugagcauuguggaaauaggggaccaucguuaaggacuacgacgguaacaggaaagaucauacaugagugguguugccgauccugcacuuugccacccuugagguuccguggagaagauggcuguugguaugguauggaaauucguccaguaaaagaaaaagaagaaaaccuuguaagaucuaugguaagcgccgguucaggugaaguagacucguuuucacuggguauauuauguguaucaauaaugauugaagagguaaugagaucacgauggucccggaagaugcucaugacagguacguuagcgguuuuucuauuacuaauaaugggucaauuaacuuggaacgacuuaauacgacugugcauaaugguuggagccaacgcauccgauagaaugggcaugggcacaacauaucucgcucugauggcaaccuucaaaaugagaccuauguuugcaguuggguugcuauuuagaagauugacaucacgagaaguauuacuuuuaaccauaggacucucauugguagcaucaguugaacuuccaaauucauuagaggaacuuggcgacgggcuagcuaugggcaucaugaugcuuaaauuauugacugaauuucaaccccaccaauuauggacaaccuuacuaagucucacuuuugugaaaacuacgcuaagucuagauuacgcguggaagaccacugcaaugguacuaucgauugucagcuuauucccauuguguuuaaguaccacaagucaaaagacaaccuggcucccaguacuauuaggcagcuuugggugcaaaccgcuuacaauguuuuuaauaacugagaacaaaauaugggggcguaagucauggccucuaaacgagggaauuauggcgauaggcauagugaguauucuacucaguucguuauugaaaaacgacgugccacuagcuggcccccuuauagcaggaggaaugcuuaucgccuguuacguaauuaguggcaguucugcagaccuaucacucgaaaaagcugcagaaguuucuugggaacaagaggcagagcauucgggagccucacauaauaucuugguugaaguacaagaugacgguacgaugaaaaucaaagacgaagaacgagaugauacccucaccauuuuauugaaagcuacccuucuagcaguuuccggcguauauccaaugucaauaccggccacgcuguuuguuugguacuuuuggcagaagaagaaacaaagaagugggguauugugggauaccccaucuccaccagagguggaacgagcuguucucgaugauggaauauaccgaaucuuacaacguggucuacuugggagaagucagguaggagucggaguguuccaagauggggucuuucauacuauguggcaugucacgagaggagcugugcuuauguaccaggguaaacgucuugaaccuagcugggccaguguaaagaaggaccugauuucuuacgguggaggcuggagauuucaagggucuuggaacacuggagaagaagugcaaguaauugcuguggagccaggcaaaaaucccaaaaacguccagacuacaccugguaccuucaaaaccccagagggagaaguuggagcaaucgcacuagauuuuaagccagguacuuccggcucacccauaguaaaucgagaaggaaagauagucggauuauauggaaacggcgugguuacuacgucuggaacauaugugagugcuaucgcacaagcuaaggcuucacaagaaggaccauugccagagauagaagaugaaguauucaagaaacguaaccucacaaucauggaccuacauccagggaguggcaagacuagaagauauuuaccagcuauaguuagagaagccauuaaacgaaaauuacgaacacuaauucuagcuccaacaagaguaguugccucugaaauggcagaggcucuaaaagguaugccaauacgcuaucaaacaacugccgucaaaucagaacauacugggcgagaaauuguagaccuuaugugucacgcaacuuuuacgaugagacuucuaagucccguuagaguacccaacuauaauaugauaaucauggaugaagcucauuuuaccgacccugccucuaucgcagcacgcggauauaucucaacacgcguggguaugggugaagcggcugcaauauucaugacagcaacuccuccaggcucaguagaggcuuuuccucaaaguaaugccguuauacaggaugaggagagagauauaccugaacguuccuggaacucagguuacgacuggaucaccgacuuuccggguaaaacaguaugguuuguucccaguauaaaaucugguaacgauauugcgaauuguuuaaggaaaaauggaaagagagucauccaguuaucuagaaaaacuuucgauacggaauaccaaaagacuaaaaacaaugauugggauuaugucgugacaacugauauuagugaaaugggcgcuaacuuccgagccgacagagugauagauccucguagaugccuaaaaccggucauauugaaagauggcccugaacgcguuauauuggcuggaccaaugccaguuacaguagcaagcgcggcucagagaagaggaaggauagggcguaaucaaaauaaggaaggggaucaauauguauauauggggcaaccucuuaauaaugacgaagaucaugcucacuggacugaggcuaaaaugcuacuagacaacauaaauacgccagaagggauaauaccagcauuauuugaaccggaaagagagaaaucugcugcgaucgacggagaauaucgccuuagaggggaggcacgcaaaacuuuuguagaacuuaugagacgaggagaccuacccguauggcuuaguuauaaagucgccucugaggguuuucaguauagugaucgaagaugguguuuugacggcgagagaaauaaucaaguacuugaagaaaacauggauguggaaauuuggacuaaagaaggugaacggaaaaagcucagaccuagauggcuugacgcacguaccuauuccgacccccucgcuuuaagggaauuuaaagaauuugcagcuggccggcggucagugucuggagaccuaauauuggaaauugggaagcuaccgcagcaucuaacauugagagcucagaaugcuuuagacaaucuaguaaugcuucacaauagcgaacaagggggaaaagccuauagacacgcuauggaggagcucccagauacuauugagacucugaugcuguuagcucuaauagcgguccuuaccggaggggucacuuuauucuuuuuaucagggaaaggcuuaggcaaaaccucaauaggacugcuauguguaacagcgagcuccgcacuacucuggauggcaucuguggagccacauuggauagcagcaagcauuauauuggaauuuuucuuaaugguuuuacuaaucccugaaccagauaaacagagaacuccccaggauaaucaacuagcuuacguaguaauuggacuucuauuuaugauuuuagcgguugcggcgaacgaaaugggucuacuagaaaccaccaagaaagaucuuggcauugguuacguggcaacagaaaaucaucaacacgcaacaaugcuugauguagacuugcgaccagcaagugcguggacacuuuaugcgguugcaacaacaguaauuaccccaaugaugcgucacaccauagaaaauacuacugcgaacauaucccuaaccgcuauagcgaaucaagcugcaaucuuaaugggucuagauaaaggauggccgaucaguaaaauggacaucgguguaccuuuguuagcucuaggaugcuacucacagguuaacccucuuacacuuacagcagcaguacuaaugcuaguggcucacuacgccauaauugguccaggauuacaagcaaaagcuacacgagaagcucaaaagagaacggccgcaggcauuaugaaaaauccaaccguagacggaaucgucgcgauagaccuugauccaguaguauaugacgcuaaguuugaaaagcaauuaggacaaaucaugcugcuaauuuuaugcacgagucagauauuauuaaugagaacaacuugggcacucugcgaaaguauaacguuagcuacaggaccauugacgacccuuugggaagguucuccgggcaaauuuuggaauacaacaauugcaguauccauggcaaacauuuucagagguuccuauuuagccggugcaggucuagcguucucgcuaaugaaaucguuggguggaggacggagagggacuggugcucagggagaaacauugggugagaaguggaaacgccagcuaaaucagcuaucaaaaucugaauuuaauauauauaaacguucaggaauuauggaaguugaccgauccgaagcgaaggaagguuuaaaaaggggagaaacgacaaagcaugcagugaguagggguacagcgaaacuacguugguuuguagagaggaaucuaguaaaaccggaagguaaaguaauugaucuaggauguggacgcggaggguggagcuacuauugcgcaggacuaaagaaaguaaccgaaguaaaagguuauacaaaagguggcccuggccacgaagaaccaaucccaauggcaacauauggcuggaacuuaguuaaacugcauagugguaaagauguguuuuucaugccuccugagaaaugugauacuuugcugugugauaucggggaaaguaguccgaaucccaccauugaggagggaaggacacucagaguguuaaaaaugguagaaccguggcugcgaggaaaccaauucugcauaaagauucugaauccuuacaugccuuccgucguagaaacuuuggagcaaaugcagcguaagcauggaggaauguuaguaagaaauccauuaucgcggaauaguacucacgagauguacugggucaguuguggcaccggcaacauuguauccgcgguuaacaugacgagccgaauguuacuaaacagauuuacuauggcacauaggaagcccaccuacgaacgcgauguggacuuaggcgcuggaacgcgacaugucgcggucgaacccgagguugcuaaucuagacauuauuggucagagaauugaaaauaucaaaaaugaacauaaauccacuuggcauuacgaugaagacaaccccuacaagaccugggcauaccaugguucauaugagguuaaaccuuccggaucagcaaguuccaugguuaacggagugguccguuugcuuaccaagccaugggauguaauaccuaugguuacucaaaucgcaaugacugacaccacaccuuucggacagcaacgcgucuuuaaggagaaaguugacaccagaacgccuagagcaaaacgagggacaacacaaauaauggaaguuacggcuaaauggcucuggggauuuuuaagcaggaauaaaaagccaagaaucugcacuagagaagaauuuacuagaaaaguaaggucgaaugcagcgauaggagcaguuuuugucgaugaaaaccaauggaacagugcaaaagaagcuguagaagaugaacgguuuugggauuugguacauagagaaagagaauuacacaaacagggaaaaugcgcaacuuguguuuauaauaugaugggcaagcgcgagaagaaauugggugaauuugggaaagcaaaaggcucgcgggcaaucugguauauguggcugggggcgcgauuucuugaauuugaggcuuuaggauucaugaacgaggaccauugguucucuagggaaaauucacucucgggggucgaaggagaaggacuucauaaacucgguuauauucugcgggacauaucaaaaauaccaggcgguaauauguaugcugacgauacagccggaugggauacaagaauaacugaagaugauuuacaaaacgaagccaagauaaccgauauaauggaaccugaacacgcacuauuagcuacgucuaucuucaaacucacauaucaaaauaaaguuguacgaguacagcgucccgccaaaaauggcacagucauggacguuauuucccgacgugaccaacgagggagugggcagguagguacauauggucucaauacuuucaccaacauggagguacaacugauaagacaaauggaaucagaaggaauuuuccuaccuagcgaacuagaaacaccgaauuuggcagaaagaguccuggauugguuggaaaaacauggugcugagagauugaaaaggauggcaauaucuggagacgauugugucguuaaaccaaucgaugaccgauuugcggcagcgcugaccgcccugaaugauaugggcaaaguaagaaaagacaucccacaaugggaacccucuaaaggauggaacgauuggcaacaggucccauuuuguucccaucauuuucaucaacuuauaaugaaagaugguagagaaauuguagugccgugccggaaccaggacgagcuaguagggcgugcaagaguaucacaaggcgccggcuggucauuaagagaaacggcauguuuagggaaaucauaugcacagauguggcagcuaauguauuuucaucgucgagaccuacgauuagccgcaaaugcaauaugcagugcuguuccaguugauuggguuccaacuucaagaaccacauggucuauacaugcucaccaucaauggaugacuacugaagauaugcuuagcguauggaaucgaguguggauugaggaaaauccguggauggaagauaaaacgcaugucaguucaugggaagaaguaccauacuuggguaaacgagaagaucaaugguguggcucuuuaaucgguuuaacugcaagagccacaugggccacuaauauacaaguugcgauaaaccaagugaggagauugaucgguaaugaaaacuaccuagacuauaugacaucaaugaaacgauucaaaaacgaauccgauccugagggggcauuaugguag

SEQ ID NO: 21151 - RNA, 9879 nt, Artificial Sequence
  derived and/or modified CDS sequence (opt6) from DENV-1__KJ189302__SS-prME
ucgguuacgauguuauuaaugcugcuuccaacugcacucgcuuuucaccuaacuacuagagggggcgaaccgcacaugauagugucaaaacaagaacguggcaaaucauugcuuuuuaaaacaagugcuggcguaaacauguguacccuaauugcuauggaccuuggggaauuaugugaagauacaaugacuuauaaauguccacggauuacugaagccgaaccagaugacguagauugcugguguaaugcgacggacacaugggucacuuauggaacauguucucaaacaggagagcacaggcgagauaaaaggucaguagcguuagcgccgcacgucggacucggcuuagaaacgcggacagaaacuuggaugaguucagaaggagccuggaaacaaauacaaagggucgagacaugggccuugagacauccagguuuuacagugauagcauucuuucuugcccaugcaauaggaacaagcauuacccaaaaaggaauaauauucauucuucuaaugcuaguuacuccuaguauggcaaugcgguguguggguauaggaaauagggacuuuguggaaggacuauccggagcaacauggguugauguaguccuugaacaugguucuuguguaacuacaauggcuaaaaacaaaccuacauuggauauugaacuccugaaaacagaagucacaaauccugcgguucugaggaaacuauguauugaggcaaaaauaucaaacacaacgacagauucuagaugcccgacccaaggugaagcaacgcucguagaggaacaagacgcaaauuuugucugccggcgaacauucguagauagaggcuggggaaacgguugcggauuguucgggaaaggaucacuacugacaugugcaaaauuuaaaugcguaacaaaacuugagggcaaaauaguacaauaugaaaaucuuaaauacucgguaauaguaacaguacauacgggugaucagcaucaggucggaaacgagacaacagaacauggaacaaucgcaacaaucaccccacaagcgccuacaagugagauucaacucacagauuauggagccuugacuuuagauuguagcccaagaacagguuuagauuucaacgaaaugguuuuacuaacaaugaaagaaaagaguugguuaguacauaagcaaugguuucuugauuugccucuaccauggaccaguggagcuaguacaagccaagaaacauggaaccggcaagaucugcuuguuacauucaagaccgcucacgcgaagaaacaagaagucgugguacuuggaucccaagagggggccaugcauaccgcucuaacgggcgcaacagagauccagacuucggggaccacaacuauauuugcgggacaucucaaaugucgucuaaaaauggauaaauugacauuaaaaggaaugucauacguaauguguacggguuccuuuaaacuagaaaaggaaguagcugaaacucaacaugggacuguucuaguacagguaaaguaugaggggacggaugcaccgugcaagauaccauucucaacacaagacgaaaaaggaguaacacaaaaugguaggcuaauaacagcaaauccaauagugaccgacaaagaaaaacccguaaauaucgaaacagaaccgcccuuuggugaaagcuauaucguaguaggagcuggugaaaaggcucucaaacuaucuugguucaagaagggaaguaguauaggaaaaauguuugaagcgaccgcccgaggagcacgacgcauggcuauacuuggugacacagccugggauuuuggcaguaucggaggcguguuuacaucagugggcaaacuuguacaucaaguauucgguacugcauauggaguucucuucaguggagucucuuggacaaugaagauagggaucgguauacuacuaacuugguuaggccucaacucuaggucgacuagcuuaaguaugaccugcauugcuguuggaaugguaacacuauaucucgguguuaugguacaagcugauucgggaugugucauuaacuggaaaggucgagagcuuaaauguggaucagggauauuuguaacuaaugaaguacauaccuggacagagcaguacaaauuccaggcugauaguccuaaacgacugucugcagcuauugguaaagccugggaagaaggaguaugugguauacgaagugcuacacggcuggaaaauaucauguggaaacaaauuuccaaugagcuaaaccacauauuauuagagaacgauaugaaauuuacaguaguuguaggugacgccaacgguauccuugcacagggcaagaaaaugauuagaccacagccaauggaacacaaauacuccuggaaaucaugggggaaagcgaaaauuauaggagcugauauccaaaauaccaccuuuauuauugauggacccgauaccccagaaugcccagacggacaacgggcauggaacauaugggaggucgaagacuauggcuuuggaaucuuuacaaccaauauuuggcugaaauuaagagauucauacacucaaaugugcgaccacaggcuuaugucggccgccauaaaggauagcaaggccgugcacgccgacauggguuauuggauugaaucagagaaaaacgagacuuggaagcuggcacgcgcgucuuucauagaggucaaaacaugcacuuggccuaaaagucacacccuauggaguaacggcgugcuggaaagcgaaaugauaauaccaaaaauauauggugguccuauuagccaacauaacuauagacccggcuacuucacacaaacagccgggccauggcaucuuggaaaguuggaacuggacuuugaucuuugcgaaggaacaacggucgugguggacgaacauugugguaacagagggccgucccuuaggacuacuacuguuacuggaaaaauaauucaugaaugguguugccguucuuguacgcuuccaccauuacgauuuagaggggaagacggauguugguacggaauggagauaagaccuguuaaagagaaagaagagaaucucguacggucuauggugucugccggauccggagaaguugauaguuucucacuuggcauauuaugugucaguauaaugauagaagaagucaugagaucaagauggucaagaaaaaugcuaaugacaggcacucuugcaguauuuuuguugcuaauaaugggacaguuaacguggaaugauuuaauaagguuguguauaaugguaggggcuaacgcguccgaccguauggggaugggaacaacuuaucucgcucucauggcaacuuuuaagaugagaccaauguuugcugugggacuauuguuucgcaggcuaacaagucgggaagucuugcuucuaacaaucggacuaucauuagucgcaaguguagaacugcccaauagcuuggaagaauuaggagauggacuagcgauggggauaaugaugcuuaagcuacugacugaauuucaaccccaccaacuauggacaacuuuguuaucacuaacauuuguaaaaacuacgcuaagccuagauuacgcauggaaaacaacagcaaugguucucucuauaguuucgcuauucccauuauguuuaucaacgacaagucagaaaacgacuugguuaccuguucuccuuggcucauucggaugcaaaccguugaccauguuucucaucacugaaaauaaaauauggggacguaaaucauggccccuaaacgaaggaauaauggcuauaggaauaguaaguauauuauuguccagccuuuuaaagaaugacguaccucucgcagguccacuuaucgcuggcgguaugcuaauagcguguuacgucaucaguggaucuucugcugaucuuagucuugagaaagccgcugagguaucaugggaacaggaagcagaacauaguggugcgucccacaauauucuaguagaaguacaagaugacggaacuaugaaaauaaaagaugaggaaagagaugauacuuuaacaauauuauuaaaggccacauugcuugcuguuucggguguauauccaaugucuauaccagcgacauuauuugugugguacuuuuggcaaaagaagaaacagagaucaggaguacuaugggacacaccaaguccgccggagguugaaagggcaguguuagacgacggaauuuauaggaucuuacaaagaggauuacuaggacguucucaaguaggcguaggaguuuuucaagauggcguguuucauacaauguggcacguuacaaggggagcaguguugauguaccaggguaaacgacucgaaccuagcugggccuccguaaagaaagauuugauuagcuacgguggcggauggagguuccaaggcucuuggaauacuggagaggaaguacagguaauugccguugaaccugguaaaaaccccaaaaacguacaaacaacaccaggaacuuucaagacuccagaaggggaaguaggcgcaauagcauuagauuuuaaaccagggacuucuggcaguccuaucgucaauagagaaggcaaaauagucggccuuuaugggaacggggugguuacuacgagugguacuuauguuuccgcgaucgcucaagcaaaggcuucacaagaaggcccacuaccggaaauugaggacgaaguuuucaagaaaaggaaucuaacaauuauggaccugcauccaggcaguggcaaaacucgcagguaccuaccagccauugugcgcgaagcaauaaaacggaaauuaagaacauuaauacuagcuccuacaagggugguagcaucugagauggcagaagcacucaaaggaaugccgauacgguaucaaacaacagccguuaagucugaacauacggguagagagauaguagaucucaugugccaugcuacuuuuacuaugagauuguuaucacccguccgggucccuaauuacaauaugauaauaauggaugaagcucauuuuacagacccggcaaguauagcagcgcggggauauauauccacaaggguuggaaugggugaagcagcggcuauauuuaugacugcuacuccacccggcucaguugaggcauuuccccagaguaacgcugugauccaagacgaggaaagagauauuccugaaagaucguggaacaguggguacgauuggauuacagauuuccccgguaaaacgguuugguucgugccuucuaucaaauccggaaaugauauagcuaacugucuuaggaaaaacgggaagcgaguuauacaacucagucgcaaaacuuuugauacugaguaucagaaaaccaaaaauaaugauugggacuaugucguaacgacugauauuagugaaaugggcgcaaauuuccgggcggauaggguuauagaccccagacgaugcuuaaaaccaguaauacugaaagauggacccgaaagggugauuuuggcuggucccaugccaguuacaguugcaagugcagcgcagcgcagaggacgaaucggacgaaaccagaacaaggaaggagaccaauaugucuauaugggccaaccccuaaauaaugaugaagaucacgcacacuggacagaagccaagaugcuauuggauaacaucaauaccccagaaggaauaauaccggcauuguucgaaccugaaagagagaaaagugcagcuauugacggggaauauagauuacgaggugaagcacgaaaaacauuuguggaacuaaugagacguggagacuugccaguaugguuauccuacaaagucgcgucggaaggauuccaauacagugaccgacgaugguguuuugacggagaaagaaacaaucaaguuuuagaagaaaauauggauguagaaauauggacuaaagaaggagaacguaaaaaguuacggccaagaugguuggacgccaggacguauagcgacccuuuggccuugagagaauuuaaagaauuugcugcgggcagacgcucuguaucaggagacuuaauccuugagauaggaaaauugccgcaacauuuaacucuacgagcucaaaaugcauuagacaaucugguuaugcuccacaauagcgagcaagguggaaaagcauauagacaugcuauggaggagcuaccagauacuaucgagacauuaauguuacuagcauuaauagcugucuuaacaggcggaguaaccuuguuuuuccuaucaggaaaaggccucggcaaaacguccauuggucuucuaugugucacggcaagcuccgcucuauuauggauggcaucggucgaaccacauuggauagcagcaucaauaauacuagaguucuuuuugaugguacuauuaauaccggaaccagaccgucagcgaacgccacaagauaaucaacuagcauacguuguaauaggauuauuauucaugauauuaacaguagcugccaaugaaaugggauuguuggaaacaaccaaaaaggauuuggguaucggauacgucgcagcagaaaaccaucagcaugcuacaauguuagauguagaucuucguccugcaagcgcuuggaccuuauaugcugucgccacaacuguaauaacuccgaugaugcgucacaccauagaaaauacaaccgcaaauaucucuuugacagcaaucgcaaaucaagcugcaauauugaugggauuagauaaagguuggccaauuagcaaaauggauauagguguuccccuuuuggcucuaggcuguuauucucaaguaaauccccuaacccuaacagcggcuguacucauguuaguagcacacuacgcuauaauaggaccugguuuacaggccaaagcuaccagagaagcucaaaaacggacugcagcagguauaaugaaaaaccccaccguagacggaauaguagcaauagauuuggacccgguaguguaugaugcaaaauuugaaaaacaauuaggucaaauuauguuauugauuuuauguacgucccaaauacuuuuaaugagaacaacaugggcucuaugcgagucuauuacacuugcuacaggcccauuaacuacacuaugggaaggaaguccuggcaaguucuggaauacuacuauugccguaucgauggccaacauuuuuagggggaguuaccuugcaggagcgggauuggcauuuucucuaaugaaaucauuaggcggaggaagacgaggaacaggagcacaaggagagacauuaggcgaaaaguggaagaggcagcucaaccagcuaucuaagagcgaguuuaacacauacaaaagaaguggaaucauggaaguugauagaucagaagcuaaagagggacuaaagcgaggggaaacuacuaaacaugcagugagccgaggaacggcaaaauuaagaugguucguagagagaaaucuaguuaaaccagagggaaaggucauagaccucgguuguggucgagguggauggucguacuauugugccggguuaaagaagguuaccgaagugaaaggauauaccaaagguggccccggacaugaagaaccuauacccauggccacauacgguuggaaccugguuaaacuacacuccgguaaagacguauucuuuaugccgccagaaaaaugugauacacuauuaugugacauaggagaauccagcccaaguccaacgauagaagaagguagaacauugagaguucuaaagaugguagaaccuuggcuaaggggaaaccaauucuguauaaaaaucuugaacccguauaugccaagcguaguggagacucuggaacagaugcagcgaaaacauggagguaugcuagugcguaacccacuaucacgaaauaguacgcaugaaauguacuggguuucauguggaaccggaaacauuguauccgccgugaacaugacaagucgaaugcugcugaauagguuuacuauggcacauagaaagccaacuuacgaacgagauguugauuuaggugcugguacaagacauguggcaguugaacccgaaguugcaaaccuugacauaaucggacagcgcauugagaacauuaaaaacgaacauaaaucaaccuggcacuacgaugaagacaauccuuauaaaacuugggcauaccacggaucauacgaaguaaaaccuucggguucggcaucuuccaugguaaauggaguuguuagauuauugacaaaaccuugggacgucauuccuaugguuacacaaauagcgaugacagauacuacacccuucggucaacagcggguuuuuaaagaaaaaguugauacaagaacuccgcgcgccaaaagaggaaccacacaaaucauggaagucacugcgaaaugguuguggggcuuucugucuagaaauaagaagccacggaucuguacucgugaagaguuuacccggaagguucgcucuaacgcagccaucggagcuguguuuguggacgaaaaucaauggaacagugcaaaagaagccguagaagaugagagguuuugggauuuaguacacagggagagagaacuccacaaacaagguaaaugugcgacguguguuuacaacaugaugggaaagcgggagaagaaacuuggugaguucggaaaagcaaaaggcucucgcgcgauaugguacauguggcuuggagcacguuucuuagaguucgaggcucucggauucaugaacgaagaccauugguuuucaagggaaaauagucuaucggguguugaaggagagggacuacacaaacuaggauacaucuuacgagacauaucgaaaauaccaggcggaaauauguacgcagacgauacugcggguugggacacgcggauuacagaggacgauuuacaaaacgaggcaaaaaucacugauaucauggaaccagaacaugcacuguuggccacaucgaucuuuaaacuuacuuaucaaaacaaaguuguacgagugcaaaggccagccaaaaacgguacagucauggauguaaucucuagaagggaccaaagagggucuggccaaguaggaaccuauggguuaaacacuuucacuaauauggagguacaguugauucgucagauggaaagugaaggaauauuccuuccaucagagcuagaaacccccaacuuagcagaaagagugcuggauuggcuagaaaaacacggagcagaaagguuaaaaagaauggcaauaucuggcgaugauugcguuguaaaaccaauugacgaccguuucgcuacagcauugacagcucucaaugacaugggaaaaguccguaaagauauuccacaaugggaaccaucaaaaggcuggaacgacuggcagcaaguuccuuuuuguucacaucauuuucaccaacuaaucaugaaagacgggagagagauugucgugcccugucguaaucaggacgaauuaguaggucgagcccggguaucacaaggcgcggguugguccuugagagagacagcgugcuuaggaaaaucauacgcgcagauguggcaauuaauguacuuccaucgcagagauuugcgguuagccgcuaacgcgauuuguucagcgguacccguagauuggguuccuacaaguagaaccaccugguccauacaugcucaucaccaauggaugaccacugaagauaugcuaagcguauggaacagggucuggauugaagaaaacccuuggauggaagacaaaacacacgucucaucuugggaagaagugccauauuuagguaagagagaggaucaauggugcgguucacuaauaggccuaacagcucgagcuacuugggccacaaacauucaaguugcaauaaaccaagucagacgauugauuggaaaugaaaacuauuuagauuacaugacuucaaugaaaagguucaagaaugaaucagacccagagggugcauugugguaa

SEQ ID NO: 21152 - RNA, 9879 nt, Artificial Sequence
  derived and/or modified CDS sequence (opt6) from DENV-1__KJ189303__SS-prME
ucaguuacuaugcugcugauguuacuucccacggcuuuggcauuccacuuaacuaccagaggaggagaaccucacaugauagugucuaaacaagaaagaggaaaaucuuugcuauucaaaacuucagccggagucaauauguguacacuaauagcuauggauuuaggagaacuaugcgaagauacgaugacauacaaaugcccccgaauaacagaggcugaaccagaugauguggauuguugguguaaugcaacagauacuuggguaacuuauggaacauguagucaaacaggagaacauagacgagauaaacguucaguagcccuagccccucauguaggacuaggauuagaaacuagaacugagacuuggauguccucagaaggagccuggaaacagauucaaagaguggagacuugggcacuucgucauccaggcuuuacagugauagcauuauuuuuagcgcauguaaucggaacaaguauaacucaaaaaggcauaaucuuuauauugcuaaugcuuguaacgccuucuauggcaaugagaugcguaggaaucggcaauagggacuuuguagaagguuuaucaggagcaacaugggucgauguuguucuagaacacggcucauguguaacaaccauggccaaaaauaaaccuacucuagauauagaacuucucaaaacagaagucacgaauccagcuguccuaagaaaacuauguaucgaggcgaaaauuucuaauacaacuaccgauagccgauguccaacgcaaggggaggcgacucuagucgaagaacaagacgcaaacuucgucugccggaggacauucguggauagaggcuggggaaacggauguggacucuucggaaagggaucacuacucacgugcgcaaaauucaaaugcgucaccaaacuggaggggaaaauaguacaauaugaaaaucuaaaauauucaguuauuguaacuguccauacgggagaccaacaucaaguugguaaugagacaacagagcacgguacaauugcuacuaucacaccacaagccccgacaagcgaaauucaacugacugacuauggagcacuaacuuuagacuguucgccgagaacugguuuggacuucaaugaaaugguauuauugacaaugaaagaaaagucaugguuaguccauaaacaaugguuuuuagacuuaccuuugccauggacaaguggugcuucuacuucgcaagaaacuuggaaccgucaagauuuacuuguuaccuucaaaacagcgcaugcgaagaaacaagaaguagucguacuuggaagucaagagggugcaaugcauacugcccugacgggugcuacugagauacaaacaaguggcacgacuacuauauucgcuggacauuugaaauguagauuaaaaauggacaaacuuacgcucaaaggcaugucguacgucauguguaccgggucuuuuaaauuggaaaaggagguggcagaaacacaacaugguacaguauugguccaagugaaauaugaagggaccgaugcaccuugcaaaauuccauucucuacacaagaugaaaaagguguaacccaaaauggacguuuaaucacggcuaauccuauaguuacugacaaagaaaagccagucaacauugagacggaaccuccuuuuggcgaaaguuauauaguuguaggugccggagaaaaagcccuuaaacugucaugguuuaaaaagggguccuccauuggaaagauguucgaagcaacggcgaggggugcacgacgaauggcaauacuuggugauacagcuugggauuucggaucuaucgggggcguuuuuacaagcgucgggaaauugguacaccaaguauucgggacggcauaugguguuuuauuuaguggaguaucauggacgaugaaaauaggaaucggaauccuccuuacaugguugggucuaaauucgcgcagcacuucucuauccaugacaugcaucgcgguagggauggugacacuauauuuaggagucaugguucaagcagacuccggcugugucauaaauuggaagggacgagagcuaaagugugguuccggaauauuuguaaccaacgaaguccauacauggacggaacaauauaaauuucaagcagacuccccaaaaagacucuccgcagcuaucggaaaagccugggaagaaggagucuguggaaucaggucggcgacccgguuagaaaauauaauguggaaacaaauaucaaaugaguuaaaucacaucuuauuagaaaaugauaugaaauuuacggucguaguuggagaugcuaacggaauauuggcucaaggcaagaaaaugauccgcccgcagcccauggaacauaaauauucguggaaaucauggggcaaagcgaaaauuauuggagcugacacacaaaacacgacauuuaucauagaugguccagacacaccagaauguccugauggacaaagagcauggaauauaugggagguagaggacuauggguucgguauuuuuacgaccaauauuuggcuuaaauuacgagacaguuauacucagaugugugaucaucguuuaaugucagcugcuaucaaagacucaaaggcaguccaugcagacaugggauauuggauugaaucggagaaaaaugaaacuuggaagcucgcaagagcgaguuuuauagaggucaaaacuuguacguggcccaaaagucauacucuauggucaaacggaguucuugaaucagagaugauaauuccuaagauauauggcggaccaauuucgcaacauaauuaccggccaggauauuuuacacaaacugcuggucccuggcaucuaggcaagcuggaacuagacuucgaccuaugugaggggaccaccguaguaguagacgaacacugcggcaaccgagguccaucgcuacgcacuacaacgguaacaggaaagauuauacacgaaugguguuguaggaguuguacucuaccuccauugagauuccgcggagaagaugggugcugguaugggauggaaauccgucccguaaaagaaaaagaggaaaaccuaguaagaucaaugguaucagcuggcucuggcgaaguugacaguuucagucuaggcauacuuuguguuucaauuaugaucgaagaagugaugagaagccguuggucaaggaaaauguuaaugacagguacauuagcaguguuucuguuauuaaucaugggacaacucaccuggaaugauuugacucgauuauguauuaugguuggagcgaacgccucagaucguauggggaugggaacaacauauuuagcccuaauggcuacauuuaaaaugcgacccauguuugcgguaggucugcuauuucgucguuuaacaucacgugaaguccuacuacuuacgauaggacuaagccuaguagcuucuguagaauuaccaaacagccuagaagaacugggugauggacucgcaauggggauuaugauguuaaaauuguuaacugaauuucaaccgcaucaacuuuggaccaccuugcuaucacuuacguuugugaaaacaacauuaucgcuagacuaugcuuggaagaccacugccaugguacuauccauugugagucuauuuccacucugccuaucaaccaccucucagaaaacaacauggcuuccaguauuacuagguaguuuuggauguaaaccgcuaacuauguuucuaauuacugaaaauaaaauauggggaagaaaaucguggccgcucaaugagggaauaauggccaucggaauagugagcauuuuauuaucuucacuuuugaaaaaugacgugccauuagcaggaccucucauugcaggcggaaugcuaauugcgugcuacguuauaucugguaguagcgccgacuuaagucuagagaaagcagcugagguuaguugggaacaagaggcagaacacucuggcgcaagucauaacauacucguugaaguccaggacgauggaacaaugaaaauaaaagaugaggagagagacgacacgcugaccauacugcugaaggcuacacucuuggcuguguccggaguauacccaaugucuauaccagcuacuuuauucgugugguauuuuuggcagaagaagaaacagagaucaggcguacuaugggacacacccaguccaccugaaguugagcgcgccgucuuagacgacgggauuuaucgaauacuucaaaggggccugcuggguagaagucaagucggaguuggaguauuccaggauggaguauuucauacuauguggcauguuacaaggggagcgguguuaauguaucaggguaaacgccuagaaccuucaugggcaagcgugaagaaagauuugauaaguuacggaggaggauggcgauuucagggaucuuggaauacgggugaagaaguacagguaauugcuguugagccaggaaagaauccuaaaaacguacaaaccaccccgggaacauucaaaacuccugagggggaaguaggcgccauagcuuuagauuuuaaaccgggaacuucugguagcccaaucgucaaccgugaagggaaaaucguaggauuguauggaaauggcguagugacaacgucaggaacuuacguuuccgcaauagcacaagccaaggcgagccaagaagggccguugccagagauagaagaugaaguuuuuaagaaaaggaaucuuacaauaauggaucuccauccuggaagcgggaaaaccagacgauacuugccugcuauaguaagggaagcaauuaaaagaaagcuaaggaccuuaauccuugcaccuacccgcgucguggcuuccgaaauggcagaagcauuaaaaggaaugccaauacgcuaucaaacaacagcaguaaaaagcgaacauacuggaagggaaauaguugaucuuaugugucacgccacauucacaaugaggcuacuaucucccguuagagugcccaacuauaacaugauuaucauggaugaggcacacuuuacugauccggcaaguaucgcagcaagggguuacaucucuacgagaguaggaaugggagaggcggcagcgaucuucaugacagcuacaccaccugguagcguggaagcguuuccccagaguaacgcggucauacaagaugaagaacgagauauaccagaacgaagcuggaacucuggauaugauuggauaacagauuuuccgggaaaaacggucugguuuguaccaaguauaaaaagugggaaugauauagccaauugucugaggaaaaauggcaaaaggguaauucagcucucgagaaagacauucgauacggaauaccagaaaacgaaaaacaaugauugggacuacguuguuacaacagacauaucagaaaugggagcuaauuuuagagcagacagagucaucgauccgcgaagaugucuuaagccaguuauacuaaaagaugguccggaaagaguaauccuagcagguccuaugcccgugacuguggcuagugcagcacaacggagggguagaauuggucgcaaccaaaauaaggaaggagaucaauacguauacaugggucagccgcuaaauaacgaugaagaucaugcacauuggacagaagcaaaaaugcugcuagauaacauuaacacuccagagggaaucauucccgcauuauuugaaccagagcgugaaaaaucagcagcagucgacggugaauauaggcuccgcggggaggcaagaaaaacguuuguugaauugaugcgaagaggugaccucccgguuugguuauccuauaagguugcauccgagggauuucaguacucggaucggaggugguguuucgauggugaaagaaauaaucaaguuuuagaggagaauauggacguagagaucuggacuaaagaaggagaaaggaagaaauugcgcccuaggugguuagacgcucggacauacucagacccacucgcccuaagagaauuuaaggaauuugcagccggacgacguucagugaguggcgauuuaauccuagaaauaggaaaauugccacagcauuugacauuacgcgcacaaaaugcccucgacaaccuaguaauguuacacaauucagagcaaggaggaaaagcauaccgacaugcgauggaagaauugccugacacaauugagacuuugaugcuauuggcauuaauagcaguacuuacuggcgguguuacacuauucuuucuaagugggaagggauuagguaaaaccagcauaggucuauuauguguaacagcaagcucagcauuacuauggauggcauccguagaaccgcauuggauugcagcuagcauaauauuagaguucuuccuuaugguacuacuuauaccggagccugaucgacaaagaaccccacaagauaaccaauuagcuuacguggugauaggauuguuauucaugauuuuaacgguagcagcuaacgaaauggguuugcuugaaacuacgaagaaggauuuaggcauaggguacgucgcagcagaaaaccaccaacaugcgacaauguuggauguagauuuacgucccgcuucagccuggacacuauaugcuguggcuaccaccgucauaacuccaaugaugagacacacuauagaaaauacaacagcaaauauaucacuuacugccauagccaaccaagcagcaaucuuaaugggauuagacaagggauggcccauaucgaaaauggacauaggaguaccauuacuggcacuaggcuguuauucgcaaguaaacccccuaacucuuaccgccgcaguucuaauguugguugcacauuaugcgauaauugguccagguuuacaagcaaaagcaacucgagaggcgcaaaagagaacagcugcuggaauaaugaagaauccgacuguagauggaaucguugcaauagauuuggacccggugguauaugacgcgaaguuugagaaacaauuaggccaaauaauguuauuaauacuauguacaagucaaauccuucuaaugagaacuacuugggcuuuaugcgaaucuauaacuuuagcuacaggcccccuuacaacgcuaugggaaggaaguccggguaaauuuuggaauacaacaaucgcagucucgauggccaauauauuccgaggaucauacuuagcuggugcagggcuagcauucaguuuaaugaaaagccuaggcgguggacgacgggggaccggugcacaaggagaaacacucggcgaaaaauggaagagacaauuaaaccaacucuccaaaagcgaauuuaauaccuacaagcggucagggauuauggaagucgauagaagugaagcgaaggaaggccucaaaaggggagaaacaaccaaacaugcuguaucccgagggacugcaaaacuucggugguuuguagagagaaaucuaguaaaaccggaggggaaaguuaucgaucugggauguggacgugguggaugguccuauuauugugcaggacuaaagaaaguaacggagguaaaaggauauacaaaaggaggacccggccaugaagaaccaauuccaauggcuacuuauggauggaacuuaguaaaacuccauaguggaaaagacguuuucuuuaugcccccugaaaaaugcgauacgcuccugugugacauaggagaaucgucaccuaauccaacaauagaagaaggccgaacuuuaagaguucugaaaaugguagaaccuuggcuucguggaaaucaauuuugcauuaaaaucuuaaacccauauaugccgaguguuguagaaacuuuggagcaaaugcaacgcaaacauggaggaaugcuaguucguaacccuuugagcagaaacaguacucaugaaauguacuggguuaguugugguacagggaacauuguuucugccguuaacaugacaucgcgaaugcuacucaacagauuuacaauggcgcaccguaagccaacauaugagcgggacguugacuuaggagcuggaacucgucaugucgccguugaaccagagguugcuaauuuagauauaaucggucaacgcauagagaacauaaagaacgaacauaaauccacauggcacuacgaugaagauaacccauacaaaacgugggcguaucauggauccuacgaaguuaaacccucaggaucggcaaguucaaugguaaacggaguagugagacuccuaacuaaaccaugggacguuaucccaauggugacucaaaucgcaaugacagauacaacgccauucgggcaacaaagaguuuuuaaggaaaaagucgauacgcgcacaccacgagcaaaacgcggaacgacgcaaauaauggaagugacggcaaaaugguuguggggguuccuaucgaggaauaagaaaccgagaaucuguacacgggaagaguuuacuagaaaaguacguaguaacgcugccauaggugcuguauuuguagaugaaaaucaauggaacucagcaaaggaggccguagaagacgaaagauucugggauuuaguacauagagaaagagaacuucacaaacaaggaaagugugcaacguguguguauaacaugauggguaagcgagaaaagaaacugggggaguuuggcaaggcuaaagggucaagagcgauaugguauauguggcugggugcgcgauuuuuagaauuugaagcucuaggauucaugaacgaggaucauugguuuucacgcgaaaauaguuugagcggugucgaaggggaaggacuucacaaacuaggcuauauacucagagauaucucuaaaauaccaggaggaaauauguaugcagaugauaccgcuggaugggauacgagaaucacagaagaugaccuacaaaacgaagcuaaaaucaccgauauaauggaaccagagcaugcgcuauuagcgacaaguauuuucaaauuaacuuaccagaacaaaguagugagaguacaaagaccagcgaagaacggaacagugauggacguaauuucacgacgugaucaaagggguagcggucagguaggaacuuauggcuuaaauacuuucacuaacauggaaguacaacuuauaagacaaauggagucugaagguauauuucugccaucugaauuagagacuccaaaccuggcggagcguguuuuggacuggcuagagaaacacggagcagaacgccugaagcgaauggcuauaucaggugaugacugcguugucaaaccaauugacgacagauucgcaacugcacuaaccgccuuaaacgauauggguaaaguacggaaggauaucccucagugggaacccucuaaaggauggaaugacuggcaacaaguaccauuuugcagccaucacuuucaucaauuaauuaugaaagaugggagagaaauugugguacccugucgcaaucaagacgaguuaguaggcagagcgcgaguuagucagggggcaggcuggucauugagagaaacagccuguuuagguaaaucuuaugcucaaauguggcaacuuauguauuuccacagaagagauuugagacuagcagcuaacgcgauauguucagcgguuccgguugaauggguaccaacuucucgaacaaccuggucuauacaugcgcaucaucaguggaugacuacagaagauaugcucucuguguggaacagaguguggauugaagaaaacccuuggauggaagacaagacucauguaaguucaugggaggaggugccauacuuggggaaaagagaagaucaaugguguggaagucuaauaggacuaaccgcucgcgcaacgugggcgacaaacauucaaguagcaauaaaucaaguuagacguuuaauaggaaaugaaaauuaucuggauuauaugacaucuaugaagcgguucaagaaugaaucugauccugagggugcuuugugguag

SEQ ID NO: 21153 - RNA, 9879 nt, Artificial Sequence
  derived and/or modified CDS sequence (opt6) from DENV-1__KR028435__SS-prME
agcguuaccauguuauuaaugcuuaugccaacugcuuuagcauuucacuugacuacuagagguggugaaccccauaugauuguuucuaaacaagagagaggaaaaucacucuuauuuaaaacgucagcggguguaaauaugugcacuuuaauugcuauggaucucggugaacugugcgaggacacuaugacauacaaaugcccgagaaucacagaggcugaacccgacgacgucgacugcuggugcaacgcuaccgacacuugggugacguaugguacaugcagucaaacgggggaacaccgacgagauaaacguucaguugcguuagcaccccauguagggcuaggucuagaaacacguacagaaacauggaugagcagcgagggugcauggaaacaaauacaaaggguagaaacaugggcacugaggcauccgggauuuacaguaauagcguuauuccuagcccacgcuauaggaacaucaauaacucaaaaaggaauaauuuucauucuacugaugcucguaacaccgucaauggccaugcguuguguuggcauagguuccagagauuucguggaagggcugaguggagcgacguggguugauguaguccuugaacaugguucuugugugacaacaauggccaaagauaaaccuacacuugauaucgagcuucuaaaaaccgaaguuacaaauccugccguguuaagaaaauuauguauagaggcaaaaauaucuaauacaaccaccgauucaagaugccccacccaaggagaagcaacgcugguggaagaacaagaugcgaacuucgucugucgacggacuuuuguagaucgcggcugggguaaugguuguggacuguuugguaagggaagccuuauaacaugugcaaaauucaaauguguuacuaaauuagagggcaaaaucgugcaauaugagaaucuuaaauacagcguaauaguaacuguucauacgggagaucagcaccaaguuggaaaugagucuacugagcacgguaccaccgcgacuauuaccccgcaagcuccgacuacagaaauacaacuuacugauuauggcgcccuuacucuagauuguucaccccggacgggauuggacuucaaugaaaugguacuccugaccaugaaggaaaaaucauggcuagugcauaaacagugguucuuggaucuuccguuaccuuggaccagcggggcgagcacaucacaggaaacguggaaucgccaggaucuacucgugacguuuaaaacugcacaugccaagaaacaagaaguaguaguucuaggaucacaagagggugcaaugcauacagcgcucacuggugccacagaaauacaaacaagugggacgacgacuauuuucgcaggacauuuaaagugcagauuaaagauggauaaguugaccuuaaaaggaaugucauaugugauaugcacugguaguuuuaaacucgagaaagagguagcugaaacacagcauggaaccguccugguacaaauuaaauaugagggaacagacgcuccuugcaagauaccuuuuucuacccaggacgaaaaagggguaacucaaaacggacgacuaauuacagcuaacccuauaguaacagacaaagaaaaaccaguuaauauugaagcugaaccuccauuuggcgaaucauauauagugauuggggcuggggaaaaagcccuaaaacuaaguugguuuaagaaaggaucuuccaucgggaaaauguuugaagcuacagcucgaggcgcgcgucguauggcuauauuaggugauacagccugggacuucggaagcauuggaggaguauuuacaucugucggaaaacuggugcaccaaauauuuggaacagcguacggaguacuuuuuaguggaguaucguggacaaugaaaauagguauaggaguacuucuuacgugguuaggauuaaauucccgaaguacaagccuaucaaugacguguauagcgguaggacuugugacgcuuuacuuaggagugaugguucaggccgauaguggaugcgucauaaacuggaaaggucgagagcuuaagugcgguaguggaauauuuguaacuaaugagguacauacuuggacggaacaauauaaauuucaagcggauucacccaagcgacugagugcagcaauugggaaagcaugggaggaaggaguuugcggcaucagaucagccacucgauuagagaacauaauguggaagcaaauaucgaaugaauuaaaccacauacugcuagagaaugauaugaaauuuacugugguugugggcgacguagcuggaauacuugcacaaggcaaaaagaugauacgaccccaaccaauggaacacaaauauucauggaaaucauggggaaaagcgaagauaauaggggccgauguacaaaauacgacauucauuauagauggaccuaacacaccugagugcccugaugaucaacgagccuggaauauuugggaaguagaagauuacggauucggaauauuuacuacaaacauuugguuaaagcuaagagauucauacacacaggucugcgaucaucgacuuaugucggcggcuauuaaagauagcaaggcuguacaugcugacaugggguauuggauugaguccgagaaaaaugaaacauggaaguuagcucgagcaaguuuuauagaagucaaaacaugcaucuggccaaaaucgcauacuuuguggaguaauggcgugcuagaaucggagaugauaauaccuaaaauauauggaggaccaauaucgcaacauaacuaucgccccggauauuuuacacagacugccgguccauggcaucuagguaaauuagaacucgacuuugaucugugugagggaacuacaguaguagucgacgagcauuguggcaaucgcggacccagcuuacguacaacuacuguaacugguaaaauaauacaugagugguguugccggucauguacacuaccaccguugagguuuaggggagaggacggaugcugguauggaauggaaauaaggccaguaaaggaaaaggaagagaacuuagugaaaucuaugguguccgcaggaaguggagaaguugauagcuuuagccuaggcuuacuuuguaucuccauaaugauagaagaggucaugcgaaguagauggucacgaaaaauguuaaugacuggaacauuagccguauuuuucuugcuaaucaugggucaacuaacauggaacgaucucauuagacuuuguauaauggucggugcuaaugcaucagauagaaugggaauggguacaacauaccuugcacugauggcaacuuucaaaaugagaccuauguucgcagugggguuacucuuuagaagauuaacaaguagggaaguucuacugcugacaauaggauuaucguugguugcuaguguagaacuaccgaacaguuuagaagaacugggagauggcuuggcuaugggaaucaugauacuaaaauugcucacugacuuccaaucccaccaguuaugggcuacgcuauuauccuuaaccuucaucaaaacaaccuuuagcuuacauuacgcguggaagacaauggcuaugguucucucuauuguaagucuauucccccugugcuuaaguacaacuucgcaaaagacaacuugguugcccguacuguuaggaucuuugggcuguaagccguugacaauguuucuaauugcugaaaacaaaauuuggggucggaagaguuggccuuuaaaugaagguauuauggcaguagguaucguuucuauauuauugucuucucuucucaaaaacgaugucccucuagcaggaccacuuauagcgggaggaaugcucauugccuguuacguaauuaguggaaguucagcugaccucagcuuagaaaaggcagccgaaguaucgugggaagaagaagcagaacauagcggggcuucacacaauauauuaguagagguucaagaugauggcacaaugaaaaucaaagaugaagaaagagaugacacucuaacgauuuuacuuaaagccacauuauuagcuaucaguggaguauacccauuaaguauaccagcaacacuuuuugucugguauuuuuggcagaaaaagaaacaaagaucuggaguucuaugggacacaccaaguccuccagagguugaacgagcaguucuagacgauggaauuuaccgaauuaugcaaagaggacuacugggacguucccagguagguguuggaguauuccaagaaaaugucuuccacacaauguggcauguaacacgaggcgcuguguuaauguaucagggaaaaagauuagaaccgucuugggcuuccguuaagaaagaucuaaucaguuacgggggaggauggcgccugcaaggcucuuggaauacaggagaagaaguacagguaauagcuguagaacccggcaaaaaucccaaaaacguacaaaccgcgccagguacauuuaaaacuccugagggggaaguaggagcaauugcacucgacuuuaaaccuggaacuucuggaaguccuauaguaaaucgagaaggaaaaaucguuggauuauacggcaacggcgucguuacuacaaguggaacauacguaucugcaauagcgcaagcuaaagcgucccaggaagggccucugccagagauagaggacgaaguauuccggaaacggaaccuaaccauaauggacuugcauccaggaucagggaaaacaagacgguacuuaccggcuauuguuagagaagcaauuaaaagaaaacuacgaacccucauauuggcgcccacucgagugguggccuccgaaauggccgaagcauuaaaagggaugccaauaagauaccagacgacagccguaaaaagugaacacacugggaaggaaauaguagauuuaaugugccaugcaacauuuacaaugagauuguuaaguccgguuagaguaccaaacuauaauaugauaaucauggaugaagcccauuuuaccgauccaucuucaauugcagcccgcggauacauuuccacacguguugguaugggggaagcggccgcaauauuuaugacggccacaccucccggcucaguugaagcguuuccacaaucuaacgcaguaauucaagaugaggaagggggcauaagugagcgaagcuggaauagcggauacgaauggauuacugacuuuccagguaaaacaguuugguucguacccagcauuaaaucugguaacgauauagccaauugccugaggaagaacgguaaaagaguaauucaauuaagucggaagacauuugacacagaauaccagaaaacgaaaaauaacgacugggacuaugugguuacaacagauauuagcgagaugggggcaaacuucagagcggaucgagucauagauccuaggagaugcuuaaaacccguuauacugaaagaugguccugagcgaguuauacucgcaggaccaaugccuguaaccguagcaagcgcggcacagcgaagaggacguaucggcagaaaccauaauaaggaaggugaucaauauauuuauaugggucaacccuuaaauaaugacgaggaccaugcacauuggacagaagcuaaaaugcuacuagacaauauaaauacucccgagggaauaauuccggcccuauucgaaccagaacgugaaaaaucggcugcuauagauggugaauauagauuaagaggggaagcuagaaaaaccuucguagagcuaaugcgucggggagaucuaccaguguggcugagcuacaaaguagccagugagggauuccaguauagcgaccggcguugguguuucgauggagaaagaaauaaccaaguacuugaagaaaacauggacguagagauauggacaaaagaaggagagaggaagaaauuaagaccacgauggcuagaugcuagaacguauuccgacccuuuagccuuaagagaauuuaaagaguucgccgcgggaagaaggucagugucaggagauuuaauacucgaaauaggcaaacuuccucagcauuuaacccagcgugcgcaaaacgcauuagacaaucucguaauguuacauaacagcgagcaagguggccgugcuuaucgacacgcuauggaagaauuaccugacacaauagagacguuaauguugcuagccuuaauagccguccuaacaggcggaguuacacucuucuuucucuccgggcgaggguuagguaaaacaagcauuggccuauuauguguaauggcaaguucaguguuacuguggauggccucaguagaaccccauuggauagccgcgaguaucauauuagaauuuuucuugaugguccuguuaaucccugaaccagauaggcaacgaacaccgcaagauaaccagcuagcauacgucgucauagguuuauuauuuaugauacuaaccguggcagccaacgaaaugggcuuacucgagacaacuaagaaagaucuuggaauuggucauguagcaguggaaaaccaccaccaugcuacaaugcuggacguagauuugcacccagcaagcgcuuggacgcuauacgcagucgcgaccacgauaauaacacccaugaugcgucauacaauagaaaauacaacggccaacauuucucuaacagcaauugcaaaucaagcagcaaucuugauggguuuggauaagggcuggccaauaucaaaaauggauauaggaguaccacuacuagcguuagguugcuauagccagguaaauccauuaacauugacagcugcuguacuuaugcuaguagcacauuaugccauuauaggaccaggacuucaagcaaaagcaacacgcgaagcgcagaaacguacagcagcagguaucaugaaaaacccgacaguggauggaauaguagcuauagaccuagacccaguaguguacgaugcaaaauucgaaaaacaacuuggacagauaauguuacugauuuuauguacuucucaaauauuguuaaugagaaccaccugggcccuaugugaaucgauuaccuuagcuacgggcccacuuacgaccuugugggagggcucaccaggaaaguuuuggaacacuacaauagcaguaucuauggccaauauauucagagggucuuaucuugcuggagccggauuggcauucagcuuaaugaaaucgcuagguggcggucgaagaggcacaggagcgcaaggugaaacacuaggcgaaaaguggaagcgccagcuuaaccagcuaagcaaaagugaauuuaacacguauaaacgauccggaauaauggaggucgaucgguccgaagcgaaagaaggguuaaaacgaggcgaaacuacuaaacaugcugucucuagggguacugcaaagcuacggugguuugucgaaagaaaucuagugaaaccagaagggaaaguuauagaccugggaugcggacgaggagguuggucauacuauugugccgggcuuaagaaaguaacagaaguaaaaggauauacaaaaggagggcccggucacgaagaaccgauaccaauggcaacauacggauggaaucugguuaaacuuuauuccgguaaagacguauucuucauaccuccagaaaaaugcgauacccuucuaugcgauauuggugaaucuaguccaaauccaacaaucgaggaaggacggacacuaagaguacuaaaaaugguagagccuuggcuaagggguaaccaguucugcauaaaaauuuuaaacccauauaugccaagugugguagaaacgcuggaacagaugcaaagaaagcauggggguaugcuaguaaggaauccuuuaagcaggaacucaacccaugaaauguauuggguaucaugcgguacaggaaauauaguuucagcaguaaauaugaccucucguaugcuguuaaauagguuuacgauggcucacagaaaaccaacuuaugagcgagauguagauuuaggagcaggaacaagacauguagcaguugaaccugagguggccaaucuagacauaaucggacaacgaaucgagaauauuaaacaugaacauaaaucgacauggcauuaugaugaagauaacccguacaaaaccugggccuaccaugguucauacgaaguaaaaccaaguggaucugcaaguagcaugguuaauggcgugguuaaauuacugacaaaaccuugggacgugauuccaaugguaacacaaauagcgaugacagauacaacaccuuuuggucaacaaaggguuuuuaaagaaaaaguugauacaaggacaccuaaagccaaaagggguaccgcacagauuauggagguuacagcuagaugguuguggggguucuugucuagaaauaagaaaccacguaucuguacacgagaagaauuuacuagaaaaguucguucgaaugcugcaauaggcgcuguguuuauagacgaaaaucaauggaauagcgcgaaggaagccgucgaagacgaaagguucugggaccucguacauagggaaagggaguuacauaagcaagguaaaugugcgacauguguuuacaauaugaugggaaaaagggagaagaaacugggagaguucgguaaagcgaaggggucaagagcuaucugguacauguggcuaggugcuagauuuuuagaauuugaagcauuaggauucaugaaugaagaucauugguuuucaagagaaaauagccuaagcggaguagaaggcgagggcuugcacaaguuggguuauaucuugagagacauaucaaagauuccuggcgggaacauguaugcagacgacacagcagguugggacacaagaauuacugaagacgaucuacaaaaugaagcaaaaauuacagauauuauggaaccugaacaugcgcugcuagcgaaagcuauauucaaacuaacauaucagaauaaaguaguuaggguccaaagaccagcaaagaacggaacagugauggacgugauauccaggagagaucaacgcgguucgggacaaguggguacauauggacuuaauacauucacaaauauggaagcccaacuuaucagacagauggaaucggaagggauauucucaccuagcgaacuagagacaccaaauuuagccgaaagaguuuuagacugguuggaaaaguaugggguggaaaggcuaaaacguauggcuauaucaggcgacgauuguguaguuaaaccaauagaugaucgguuugccacugcacuaacggcgcuuaaugacaugggaaaagugcgaaaggauauaccacaaugggaaccaucgaaaggauggaacgauuggcaacaagucccauuuugcagucaccauuuucaucaacuuauaaugaaagacggucgcgaaauaguagucccgugcaggaaucaagaugagcuuguugggcgggcaagagucagucaaggggcaggauggucucuccgcgaaaccgcguguuuggguaaaucauacgcgcaaauguggcaauugauguauuuucauaggcgagauuuaagauuagcugcaaaugcgauaugcucugcaguaccaguagauugggugccaacuucuagaacuacuuggucuauacacgcacaucaucaauggaugacuacggaggauaugcuuucaguauggaauagagucuggauugaagagaacccauggauggaagauaagacgcauauaucgucaugggaagauguucccuaccuagguaagcgagaagaucaguggugugguagucuuauuggauuaacggcaagagcaacaugggcgacaaauauacaaguggcaauuaaucaagugcggagauuaauaggcaacgaaaauuaucuagauuacaugacgucgaugaagagguuuaaaaaugaaagugaccccgagggagcacuaugguaa

SEQ ID NO: 21154 - RNA, 9879 nt, Artificial Sequence
  derived and/or modified CDS sequence (opt6) from DENV-1__JQ922548__SS-prME
uccguaacuauguuauuaaugcuauuaccuacugcacuugcauuccaucugacuacuagagguggagaaccgcacaugauuguaagcaaacaagaaagaggaaaaucauugcuauuuaaaacgucggcuggagugaauauguguacauuaauagcuauggacuugggggaacuaugugaagacacaaugaccuacaaaugcccccgaauuacagaagcugaaccugaugacgucgauuguuggugcaaugcaacugacaccugggucacauacggaacgugcucacaaacaggagaacauagacgcgauaaaaggaguguggcccuagccccacauguagggcuugggcucgaaacacggaccgagacauggaugucuagugaaggagcguggcgccaaauacaaaaaguagagacaugggcgcuuagacaccccggauucacgguuauagcauuauucuuagcacauacuauagggacuucuaucacucaaaaaggcaucaucuuuauccuauuaauguuggugacgcccucaauggcaaugcguugcguagguauugguaauagagauuuuguagaaggauuaagcggggcaacaugggucgauguuguacuggaacauggaagcugcgucacuacgauggcaaggaacaaacccacauuagacaucgaacuauugaaaaccgaaguaacaaauccugcuguauuaagaaaacuaugcauagaagcaaaaauuuccaauaccacaacggauucccggugccccacucaaggagaagcaacguuaguagaggaacaagaugcaaacuuuguguguagacgcacauucguagauaggggcuggggaaauggauguggacuguucgguaaaggaucgcuuuuaacuugugcaaaauuuaaaugcgugacuaaacuagaaggaaaaauaguccaauacgaaaaucugaaauacagugugauaguaacagugcacacaggugaucaacaucaagucgggaacgagacaacggagcauggaacgauugcgacaauuacuccacaagcucccauguccgaaauacaacuaacagauuauggugcauuaacauuggauuguagcccacgaacugggcuugauuuuaaugaaauggucuuguuaacuaugaaagaaaagaguugguuaguccacaaacaaugguuccucgaccuaccacuuccauggacuucaggugcaucaacaucucaagaaacguggaaucgacaagaucuccuaguuacguucaaaacagcacaagcuaagaaacaagaggucguggucuuagguagucaagaaggagcaaugcauacagcucucacaggugcgacagaaauacaaacuagcggaacgaccaccauguuugcaggacauuugaaaugucgcuuaaaaauggauaaauuaacauuaaagggagcuucguacguuauguguaccggaccguuuaaacuugaaaaagaaguugcagaaacacagcaugguaccguauuaguucaagugaaauacgaaggaacagacgccccuugcaaaauuccauucuccacccaagaugaaaaaggcgugacucaaaauggaagacuaaucacugcuaacccaauugucacagauaaagagaagccaguuaacauagaaaccgaaccuccuuucggcgaaagcuacaucguaauaggcgccggcgaaaaagcguuaaaacuaucuugguuuaagaaaggauccucaauaggcaaaauguuugaagcuacggcccgaggagcacgccguauggcaauauuaggcgauacagcgugggacuuuggaaguauuggaggugcauucacguccguugguaaguuaguccaucaaguauuugggaccgccuauggcguucuuuuuagcggaguaaguuggacgaugaaaauugguauaggaauacuauuaacauggcugggacuaaacucaagguccacgucauuaaguaugacuugcaucgcuguuggaaugguaacucuauaucuaggaguaauggugcaagcagacaguggguguguaauaaauuggaaagguagagaacuaaaauguggcaguggaauuuuuguaaccaaugaaguacacacauggacggaacaauacaaguuucaagcagauucaccaaaaaggcuaagugcagcaauugguaaggccugggaggagggaguaugcggcauaagguccgcgacacgauuggagaacauaauguggaaacaaauaagcaaugaacuuaaucauauucucuuagagaaugacaugaaguuuacuguagugguaggagaugcgaauggaauauugacucagggcaagaaaaugauaagaccccaaccuauggagcauaaguacaguuggaaaucuugggggaaggccaagaucaucggugcugacgcgcaaaauacuaccuuuauaauugacggaccugauacgccagaauguccggaugaccaacgggcguggaauauuugggaagucgaagacuauggguucggcaucuucacgacaaauaucuggcuuaaacugagggauucauacacgcaaaugugcgaucauagguuaaugagcgccgcaauaaaagacucuaaagcgguacaugcugacaugggauauuggauagaaucugagaaaaaugaaacauggaaacuuacucgugcgucauuuauugaaguaaaaacuuguacauggccaagaucucauacacuuuggaguaauggaguauuagagagcgaaaugauuauuccuaaaaucuauggagggccuauuucucaacauaauuaucgcccuggcuauuuuacccaaacugcugguccauggcauuuagggaaauuagagcuugacuuuaaucucugugaagguacaacuguagugguugacgagcacugugguaacggcggagcaucauugggaacuacgacagugacaggaaaaauaauacaugaauggugcuguaggagcuguacgcucccacccuugcgauuccuuggcgaagacggauguugguauggaauggagauaagacccguuaaggagaaagaagagaauuuauuccguaguaugguuagugcuggaucgggugaaguagauaguuuuagcuugggcuuacuaugcguauccauaaugaucgaggaagugaugcguaguagauggucucggaaaauguuaaugacuggaacauuagcuguguucuuuuuguuaauuauggggcagcuuacguggaacgauuuaauucguuuauguauuauggucggugcaaaugccuccgacagaaucggcaugggaacuacguaccucgcacuaauggcuacuuucaaaaugagacccauguuugcagugggacucuuguuuagacgccucacaucaagggaaguuuuauuacuaacgauaggacuaucacuuguagcaucagucgaauuaccaaauucacuugaggaauuaggagacgguuuagcaauggguauuaugauguugaaauuauuaacagauuuucaaagucaccaacuuuggacuacacuacuauccuuaacuuuuauuaaaacaacuuuaucucuugauuaugcauggaagaccauagcgaugguauuaucuaucguaucacucuuuccauuaugccuaaguacaacaagucagaaaacgacgugguugccaguguugcucggaucauuugggucuaaaccucuaacgauguucuuaauaacugaaaacaaaaucuggggaaggaaaagcuggccccucaacgaaggaauaauggcaguagguauagugucaaucuuguuaucuagccuaccgaagaacgacguaccucucgcagggccacugauagccggcggaaugcuuauagcauguuauguaauuucggguucuagugcagaucugaguuuggaacgcgcagcagaaguauccugggaagaagaagcagaacacucuggcgcuagccauaauauccuggucgaaguacaagacgaugguaacaugaaaaucaaggaugaggaaagagacgauucguuaacaauacuucuuaaggcuacgcuguuagcaguaucuggcguuuauccaaugucuaucccugccacauuauuuguaugguacuuuuggcagaagaagaaacaacgcagcggaguauugugggauaccccuaguccgccagaagucgucagagcaguacucgacgauggaauuuacaggauucuacaaagaggccuauuagggagaucucaaguaggcguggguguguuucaggacggcguuuuucacacaauguggcacguaacacgaggagcuguuuuaauguaccagggcaaacguuuagaacccucuugggcaaguguuaagaaagaucugauuuccuacggagguggguggagauuucaagggucauggaauaccggcgaggaaguucaaguuaucgcgguggagccagguaaaaauccaaagaauguucagaccacaccuggaacguucaaaaccccagaaggcgagguuggagcaauagcucuugauuuuaaaccaggaacaucuggaaguccuauaguaaaucgugagggaaagauugugggacuuuacggaaauggcguuguaacuacauccgguacauacguaucugcuauagcacaagcaaaggccucgcaggaaggaccgcugccagagauugaggaugaaguauuuaagaaaagaaaucuuacuauaauggacuuacauccugguaguggaaaaacgcgucguuauuuaccagcaauugucagagaggcaauaaagcggaaacuaagaaccuugauuuuagcaccgacucggguuguagcguccgagauggcagaagcgcucaaaggaaugcccauacgcuaucaaacgacagcagugaaaucggaacauacagggagagagaucguagacuuaaugugucacgccaacuuuaccaugagacucuugagcccuguacgaguaccgaauuauaacaugauaauaauggaugaagcacauuucacugacccggccucaauugcugcuagagguuauaucuccacaaggguaggaaugggcgaagcagcugccaucuuuaugacggccacuccaccaggaucgguagaagcauuuccacaaucgaaugccguaauccaagacgaggaaagagacauaccagaaagaaguuggaacaguggguaugauuggauaacagacuuuccaggaaaaacaguuugguuuguuccguccauaaaaucagguaaugacaucgcuaauugccuaagaaagaacggcaagagggucauacaauuaucgaggaaaacauuugacacagaauaccagaaaacgaaaaauaacgacugggauuauguagucacuaccgauauaucagaaaugggugcaaacucacgaacagaucgagugauagauccacgacggugucuuaaacccgugauacucaaggacggaccugagcggguaauacuugcaggaccgaugcccguuacggcagcuagugcagcacaacgaaggggaagaauaggacgaaaccaaaauaaagaaggcgaucaguacauauauaugggccagccauugaauaaugaugaggaccaugcucauuggacagaagcuaaaauguugcuagauaacauaaacacaccagagggaaucaucccugcgcuauucgaaccggaacgugagaagucggcugcaauagauggagaauacagacugaggggagaggcgcgcaaaaccuucguugaacuaaugagaagaggugauuuaccaguuuggcuaagcuauaaaguagcuucugaaggauuccaauacucagauagacguugguguuuugauggagaacgcaacaaccagguacuugaagaaaacauggacguugaaauuuggacaaaggaaggagagagaaagaaauugagaccacguugguuagacgcaaggacguauagugauccccuagcuuuaagggaauuuaaagaguuugcugcaggaagacgcagcguuucuggcgaucuaauauuggaaauuggaaaacuaccacagcacuuaacacuuagagcucaaaaugcacuagacaaccuagucaugcuucacaauucagaacaaggaggcaaagcauauaggcaugccauggaagaauuacccgacacaaucgaaacucuaaugcuuuuggcucugauagcggucuuaacagggggcguaaccuuauucuuuuuaucaggaaaaggucucggaaaaacaagcauaggccuauuaugcguaauggcgagcagcguacuauuauggauggccucaguagaaccgcacuggauagccgcuagcauaauauuagaguucuuucuuaaagagcuccuaaucccagaugcggauggacaacgaacaccgcaggacaaucaauuagcuuauguaguuauuggauuauuguuuaugauuuuaacaguagcagcgaaugagauggguuuacuagaaacaaccaaaaagaauuuagggauaggacacgucgucgcugaaaaucaccaccaugcuaccaugcuggauauugacuugcauccugcuucugcauggacccucuacgccgucgcuaccacgauaauuacaccgaugaugcgacacacgauagaaaacacaacagcgaacauuucauuaaccgcuauagcgaaucaggccgcgaucuuaaugggucucgacaaaggucgcccuauuucgaaaauggacauaggcgugccguuguuagcacugggcuguuauagucaaguaaauccccugacacuaacagccgcaguauugauguuaguagcacauuaugcuauaauagggccaggucuucaggccaaagccacgagagaagcacagaaaagaacggcagccggacucaugaaaaauccaacgguagacggaauagccgccauagaucuagacccuguugucuacgacgcaaaguuugaaaagcaauuaggccaaauaauguugcugauauuauguacuucgcagauucuccucaugcgaacgacaugggcgcuuugugaauccauaacgcuugccacuggaccacuaacaacccugugggaaggaucaccaggaaaauucuggaauacuacuauagcagugucuauggcgaacauauucagagguagcuaucuugcaggagcaggacuugcuuuuagucuuaugaagucccucggggguggccgacgaggaacaggagcacaaggcgaaacacuuggcgaaaaauggaaaagacaacuaaaucaauuaagcaaaucagaauuuaacacuuacaagcguagcgggauuauggaaguggaccguagugaagccaaagaaggauuaaaaagaggcgagaccacuaaacaugcaguaagcagggggacugcaaaguuacguugguuuguagaacggaaucuugugaaaccagaggguaaagucauagaccuuggcuguggaagaggaggguggaguuauuauugugccggccucaagaaaguaacggaaguaaaaggguacacuaaaggcggucccggacaugaggaaccaauuccaauggcgacuuacgguuggaauuuaguuaaacuucauagugguaaagauguauuuuucacaccacccgaaaaaugcgacacauugcuaugugacauuggcgaaucuucuccaaacccaacgaucgaagaaggaagaacccugaggguacucaaaauggucgaaccauggcugaggggaaaccaauuuuguaucaagauuuuaaaccccuacaugccgagcguugucgagaccuuggagcaaaugcaaagaaaacauggcggcaugcuggugcguaauccucuuagcagaaauagcacgcacgaaauguacugggugagcugugcaacaggcaauauuguaagugcggugaauaugacaagucguauguuacugaaccgauuuacgauggcccauagaaagccgacuuaugaaagggacguagauuuaggagcaggcacuaggcacgucgcagucgagccagaaauagcaaacuuagacauaaucggucaaagaauugaaaauaucaaaaaugagcauaaaucaacauggcacuacgaugaagauaauccuuauaaaacuugggcauaccacgguacguaugaaguuaaaccaaguggaagugccucaaguauggugaauggaguaguaagacuucucacaaaaccuugggaugucauaccuaugguaacucaaauagcaaugaccgauacaacgccauucgggcaacaaagaguauucaaagaaaaaguggauacacguacuccaaggccuaaacgaggaacagcacaaaucauggaaguuacagcaagauggcuauggggauuucuaucuagaaauaagaaaccgcgaauaugcacacgggaagaguucaccagaaaagugcguucaaaugcagcaauaggggcuguauuuguugacgagaaucaauggaacucugcuaaagaagcuguugaagaugaacgauuuugggauuuagugcacagagaacgugaacugcauaagcaggggaaaugcgcuacguguguuuacaauaugauggguaaacgagagaagaaacugggagaguuuggcaaggcuaaagguagccgggcaauaugguauauguggcuaggagcccgauuccuagaauuugaagcguuaggcuucaugaacgaggaucauugguuuuccagagaaaacucucuuucaggggucgaaggugaagguuuacauaagcucggauauauauuaagggauaucaguaaaauucccgguggaaauauguaugcagaugacaccgcagggugggacacaaggauaacagaagacgaucugcagaaugaagccaaaauuaccgacauuauggaacccgaacaugcauugcuggcgacuuccaucuuuaaauugacuuaccagaacaaagugguacgcguacaacgaccugcaaaaucugggacaguuauggacguuauuagcagacgggaucaaagagguaguggacaagucgggacauauggacuaaauacauuuaccaauauggaagugcaauuaauacgucagauggagagugaggguauauuuucacccagugagcuggaaaauaguaaucucgcagaacgagcgcucgauuggcuagaaaaacacggcguagaacgacugaaaaggauggccauaaguggggaugacugcguuguuaaaccuacagacgaucgcuuugcgacugcguuaacggcuuuaaaugacauggguaaaguuagaaaggacauaccccaaugcgagccaaguaagggguggaaugauuggcaacaaguuccguuuuguucacaucacuuccaccaguuaauuaugaaggauggaagagaaauuguagugccgugcaggaaucaagacgaguuaguagguagagcaaggguuucucaaggagcaggauggucuuuacgugaaacggcaugccucgggaagaguuacgcucaaauguggcaacuaauguauuuccauagaagggaucuucgauuagcagccaacgcaaucuguagugcagucccuguuaauuggguaccaacaaguagaacuacauggucuauacacgcucaccaucaauggaugacgaccgaagauaugcuuagugucuggaacaggguauggaucgaagaaaauccauggauggaagacaaaacccaugucucaucuugggccgauguaccguacuuaggcaagagagaagaccaguggugcggaucccuaauuggguuagccgcaagggcaacuugggcuacuaauauccaaguugcacugaaccaggucagacgacuuauagggaacgaaaauuaucuugauuauaugacaaguaugaagcguuuuaagaaugagucugauccugaaggagcucucugguaa

SEQ ID NO: 21155 - RNA, 9879 nt, Artificial Sequence
  derived and/or modified CDS sequence (opt6) from DENV-1__JQ922544__SS-prME
agcguuaccaugcuauuaauguuacuaccuacugcauuagcauuucauuuaaccacccgagguggugaaccacacaugauagugucuaaacaggaacgagguaaaagucuuuuauucaaaaccucugcuggaguaaauaugugcacuuugauagcaauggauuuaggcgaauugugcgaagacacaaugacauacaaaugucccagaaucacugaagcagaaccagaugauguggauugcugguguaaugccacugauacauggguaaccuacggaacaugcucucaaacaggggaacauaggagagacaaaaggaguguugcacuagcgccacacguuggacuaggauuagaaacgcguacugaaacuuggaugucaugcgaaggagccuggaaacaaauacaaaaagucgaaauaugggcauugagacaccccgguuuuaccguuauagcacucuucuuagcgcacgcaauugguacaucaauaacacagaaaggaaucauuuuuauccuauuaauguuaguuacgccaucaauggcuaugcgcuguguaggaauagguaaucgugaauuuguagagggacuuagcggugcaacauggguugauguuguuuuggaacauggaucaugccuucacacuauggcacaaaauaaaccuacacuugauauagaacuguuaaaaacugaaguuacgaacccagcgguacucaggaaacuauguauugaagcaaaaaucucaaacacgacaacugauucucgguguccuacacaaggagaagcaacacucguggaagaacaagaugcgaauuuugucugcagaagaacguuugucgacagaggguggggaaauggauguggacuauucggaaaagguucacuccuaaccugcgcgaaguuuaaaugcgugacaaaauuagaagguaaaaucguacaguaugaaaaucuaaaauauucaguuaucgugacgguucauacuggugaccagcaucaaguugggaaugaaacaacaacacauggaaccaucgcaacaauaacgccacaagcaccaaccagugaaauacaauugacugacuacggagcuuuaacauuagacuguaguccgagaaccggucuagauuucaaugaaaugguacugcugacuaugaaggaaaaauccuggcuaguucauaaacaaugguuuuuagaccuaccauugccguggacauccggagccagcaccagccaagaaaccuggaauaggcaagauuuauuaguaacuuucaaaacugcacaugccaagaaacaagagguagucguuuugggcagucaagaaggcgcaaugcauacugcacuuacaggugcgacagagauucaaacaucggguacaacaacaauuuuugcuggucaucuaaagugcaggcuuaaaauggauaaacuaacacuuaaggguaugaguuacguuaugugcacugguucuuucaagcucgagaaagaaguugcggagacccagcauggcacaguuuuaguccaagugaaauaugaaggaacagaugcaccaugcaaaauuccuuuuaguacccaagaugaaaaaggaguaacucaaaauggacgccuuaucacugcgaacccaauaguaacugauaaggaaaaaccaguaaacauagaagcugaaccaccuuuuggggaaaguuauauaguaguaggggcuggagaaaaagcacucaaacuaaguugguucaagaaaggaucuuccauagguaagauguuugaagcaacggcaagaggcgccagaagaauggcaauccuaggcgauacugcgugggacuuuggcucuauaggugguguuuuuacaucaguugguaaguuaguacaccaaguauuuggaacagcguacgguguacuuuucagcgggguuaguuggauaaugaagauaggcauugggauuuuacuaacauggcucggacuuaauucuagaucuaccucuuuaucaaugacguguauugcggugggaaugguuacucuauauuuaggagucaugguucaagcagacucagguugcguuauuaauuggaagggaagagaauuaaaaugcggaucaggaauauucguuaccaacgaaguccauacuuggacugaacaauacaaauuucaagcagacaguccuaagagacuauccgcagcaauagggaaagccugggaagaaggugugugcggaauaaggucagcaacucggcuggaaaauauuauguggaaacaaauaucuaaugagcuaaaccacauacuccuagaaaacgacaugaaauuuaccgucguaguuggugacgcuaacggcauucuagcucaaggcaagaaaaugaucagaccccaaccaauggaacacaaauauaguuggaaaucguggggcaaggcgaaaauaauaggugcggauauucagaauaccaccuuuauuauagauggaccggacacccccgaguguccagaugaucaacgagcauggaauaucugggaagucgaagauuaugguuuuggaaucuuuaccacaaauauauggcuaaaauuacgagauaguuacacacaaaugugugaccaccgacugauguccgcggcgauuaaagauuccaaagcaguccacgcagauaugggcuacuggauagaaucagagaaaaaugaaacuuggaaacuugcccgagcauccuuuauagaagugaaaaccugcaucuggccaaaaagccauacuuuguggaguaacggaguacuggaaucggaaaugauuauaccaaaaaucuauggagguccaauaucgcaacauaauuauaggccgggcuauuuuacccaaacugcaggaccauggcaucuuggcaaacuggaauuggacuucgacuuaugcgaagguacaaccguagucguugaagaacauuguggaaauagaggaccuucucuaagaacgacaacaguaacagguaaaauuauucacgaaugguguugcaggucguguacgcuuccacccuuacgguuuaaaggagaagacggguguugguauggaauggaaauaagaccaguaaaggaaaaggaagagaaccuagugagaucaauggucagcgcaggaucaggagaaguagauucauuuucguuaggacuuuuauguguuucaauaaugauagaagaagucaugagaucacgcuggagucgaaaaauguuaaugacaggaacucuugcaguguuccuauuauuaauaaugggacaacugacuuggaaugauuugauacgacuauguauaauggucggagcuaacgcaagugaccgaaugggaauggguacuacauaccucgcguuaauggcaaccuuuaaaaugcgacccauguucgcagugggauuacuuuuuaggagauugacuagcagggaaguucuauuacuuacgaucggauuaucgcuaguagcuucaguagagcugccaaacucucuagaagaacuuggugacggguuggcaauggggauaaugaugcuaaaacuacuuaccgauuuccaaucucaucaacucuggacuaccuuauugucgcuaaccuuuauuaaaacaacacuaagccuggauuaugcguggaaaacaauggcaaugguacuaucaauagucagccuguuccccuuaugucuaucaaccacaagucagaagacuacuugguuaccagucuugcuagguaguuuugguuguaaaccacuuacaauguuccucauaacagaaaacaaaauauggggccgaaaaagcuggccuuugaacgaagggauaauggcaguuggcauaguuaguauacuauugucuagccuuuugaaaaacgauguuccucuagcaggaccacuaauagcgggcggaaugcuuaucagcuuuuucguuauaucuggguccucugcugacuuaucguuagaaaaggcagcggaaguaucaugggaagaagaagcagaacauuccgguacaagccacaacauauugguagagguacaagacgauggaacuaugaaaauuaaggacgaagaacgugaugacacgcuuaccauucuauugaaggcaacuuuacuugcaguuagugggguuuacccaaugucaauaccggcgacauuguuugucugguauuucuggcagaaaaagaaacaacgaaguggaguauuaugggauacgccaagucccccagagguugagagagcgguccuugaugacgggauauacagaauacuacaaaggggacuucuugggaggucgcaagugggaguaggaguauuccaagauggagucuuccauaccauguggcauguaacgaggggagcaguauugauguaucaaggaaaaagguuggagcccucuugggcaaguguaaagaaagauuugauuucguauggugguggcuggagguuucagggauccuggaauaccggugaagaagugcaaguuauagcgguagaaccugguaaaaaccccaaaaacguucaaacuacuccugguacauuuaaaaccccagaaggugaagugggcgcaauugcucuugauuucaagccagggacgagcggaaguccgauuguuaaucgcgaggguaaaauuguaggauuauacggaaauggcgucguuacgacauccggaacuuauguuagugcgauugcucaagcuaaagcaagccaggaaggcccucugccugagauugaagaugaaguauuccgaaaaagaaaucuuacgauaauggaccuucacccagggucgggaaaaacacguagguacuugccagccaucgugcgagaagcgaucaaaagaaaauuacgcacuuuaauauuagcacccacuaggguaguagcaagugaaauggcugaagcacucaagggcaugccaauuagguaucaaacgacagcaguaaaauccgagcauacaggucgagaaauuguggauuuaaugugccaugcgaccuuuaccaugagacuuuuaaguccuguaagggucccaaauuauaauaugauaauaauggacgaagcacacuuuacagauccagccucaauagccgcuaggggauacauaucaacaagaguaggaaugggugaagcagcagcgauauuuaugacugcgaccccaccagguucuguggaggcauuuccacaguccaaugcaguaauacaagacgaagaaagagauauaccagaacguucauggaauagcggauaugacuggauaacggacuuuccugguaaaacaguaugguuuguuccaucuauaaaguccggaaacgauauagcaaauugccuuagaaagaauggaaaaagaguaauucaauugucgcgaaaaacauuugauacugaguaucaaaagacaaagaauaacgauugggauuauguaguaacgacugacauauccgaaaugggagcaaauuuccgagcagacaggguuauugacccuagaagaugccuaaaacccguaauuuuaaaagauggaccagaaagaguuauuuuggcggggcccaugccugugacuguugcgagcgcagcacaaagaagaggcaggauaggaaggaaccaaaacaaggagggagaucaauauguaaauauggggcaaccacucaacaacgaugaagaucacgcacauuggaccgaggcaaaaaugcuacucgacaauauuaacacaccagagggaauuauucccgcgcuauucgaaccugaaagaaagaaaucugccgcagucgacggcgaauaccggcucagaggugaggcacguaagacuuuuguugaauuaaugaggcgaggcgacuugcccguauggcuauccuacaagguugccucagaagguuuucaguacucggaccggagguggugcuucgauggagagcgaaauaaucaaguacuagaagagaauauggacguggagauuuggacaaaggaaagagagcgaaagaaacuucgaccuagauggcuagacgcacgaacuuauucggaccccuuagcccucagagaguucaaagaauuugcggcaggaaggcgauccguaagcggagauuugaucuuagaaauugguaaauuaccacaacacuuaacuuugagagcacaaaaugcucucgauaauuuaguuauguugcauaacucagaacaaggcggcaaagccuaccgacacgccauggaagaacuuccagauacuaucgaaacacuaaugcuuuuggcacugauugcgguccucacaggcggugucacauuauuuuuccucucagguaaaggauuaggcaagacuagcauaggacuacuaugugucauggcaaguagcgcuuuacucuggauggcaucgguagagccacauuggauugcggcuagcauuauuuuagaguucuuucucaugguacucuugauucccgaaccugaccgacaacguaccccacaagauaaucaacuagcguauguuguuauaggacugcucuuuaugauuuuaacugucgcagcaaacgagaugggucuauuagagacaacaaagaaagaucuuggaaucggacacguugccgcagaaaaucaucaccaugcaacgauguuagauguggauuugagaccugcauccgcuuggacccuauacgcggucgccacuacgauuauuaccccaaugaugagacacacaauagagaauacgacagcgaauauaucacugaccgcaaucgcaaaucaagcagcaauacuaaugggguuggacaaaggauggccaauaagucuuauggauauagguguuccguuacuagcauuaggauguuacagccaaguaaauccuuuaacacucacggcugcagugcuaaugcugguagcgcauuaugccauaauagguccaggucuucaggccaaagccacacgagaagcacaaaaacgcacagccgcuggaauaaugaaaaauccuacaguagacggaauagucgcaauugauuuggacccaguaguauacgaugcaaaauuugaaaaacaacuagggcagaucaugcuacuaauucuaugcacuucccaaauucuuuugaugagaaccacgugggcacucugcgaaucaauaacgcuagcgaccgggccacuuacaacguuaugggagggcuccccaggaaaguuuuggaauacaacaauugcgguuagcauggcuaacaucuucagaggcaguuauuuagccggggcugguuuagcauucucuuuaaugaaaucauuaggagguggaaggagaggaacgggcgcgcaaggcgagacguuaggagaaaaauggaagagacaauuaaaucaauuaucaaaaucggaguucaauauauauaaaagaagcggaauaauggaaguggaccgauccgaagcgaaagaggguuugaaacguggcgagacgacgaaacaugcuguaucuagaggaacggcgaaacuaaggugguucguugagagaaauuuaguaaaaccugaaggcaaaguuauagaccucgguuguggucgcggaggauggagcuauuacugcgccggacucaagaaaguaacagaaguaaagggcuacacgaaaggaggaccggggcacgaggaaccaauuccaauggcaacguauggcuggaacuugguuaaacuccacaguggaaaagauguauucuuuacuccuccugaaaaaugugacacacuccucugugauauaggcgaaagcuccccgaaccccacuauagaagaaggacgcacacuuagaguucucaaaaugguggagccaugguuacggggcaaccaauucugcauuaaaaucuuaaacccguauaugcccaguguggucgaaacucuugagcaaaugcagcguaagcauggagguauguugguaagaaacccacuaucucgaaauucuacccaugaaauguauugggucagcuguggaacugguaacaucgucucagcugucaauaugaccagccgaauguuguuaaauagauuuacaauggcucaccguaaaccuacguaugaaagagacguagaucuaggagcugguacucgccaugucgcaguagaaccugaaguggcaaacuuggauaucauugggcaacgaaucgagaacaucaaaaacgaacacaaaucuacauggcauuaugacgaggacaacccauauaaaacgugggcauaucacggaucuuaugaaguaaagcccucagguucagcuaguaguaugguaaacggaguuguucggcuacuaaccaaaccuugggacgugauaccaauggugacccaaaucgcaaugaccgauacgacuccuuuuggacaacaacguguauuuaaggagaagguggacacaagaaccccacgcgcuaaaaggggaacagcacaaaucauggaaguaacugcgaaaugguugugggguuuccuuagccgaaauaagaaaccucgaauaugcacacgcgaagaguuuacucggaagguuagauccaacgcggcaaugggagcuguauuuguugaugaaaaucaauggaacuccgcgaaagaagcaguggaagacgaaagauuuugggacuuaguucacagagaacgcgaguuacacaaacaaggaaaaugcgcaacauguguauauaauaugauggguaaaagagaaaagaaacucggagaauuuggcaaggccaaaggcucacgggcuauaugguauauguggcuaggcgcucguuuccuggaauuugaagccuuaggguucaugaaugaagaccacugguuuucuagggaaaacucccuuaguggcguggagggagaaggauugcauaaauuaggcuauauccuccgagacauaaguaaaauaccugguggaaacauguaugcggacgauacggcgggaugggacacucgaaucaccgaagacgauuuacaaaaugaggcaaagauaacggauauuauggaaccugagcaugcguugcuugcaaccaguauauucaaauuaacauaucaaaauaaagucguuagaguacaacgaccugcaaaaucaggaacagucauggauguaauaucacgaagggaucaaagaggaucaggccaggucggcacauacggauuaaacacuuuuacuaauauggaaguacaacuaauaagacaaauggaaucagaagggauauucuugccaagugaacuagaaacuccuaaucuagcugagagaguucuggacuggcuagaaaaacacggggcagaaagauuaaaaagaauggccauaucaggcgaugauugcguggucaaacccaucgaugacagguucgcuacagcuuugaccgcacuaaacgacauggguaaagugcgaaaagauauuccucagugggaaccgaguaagggauggaaugacuggcaacaaguucccuucuguucacaccacuuccaccaguugauaaugaaagauggaagggagauugugguaccuuguagaaaccaagauaaacucguuggcagggcacgaguaucucaaggagcgggauggucauuaagagagacagccugucuggggaagucauaugcccaaauguggcaauuaauguauuuccauaggcgugaucucagacuagcagcuaacgccauuuguucagcugucccaguugacuggguuccaacuagcagaacuaccuggaguauacaugcccaccaucaauggaugacaaccgaagauauguuaucaguguggaacaaaguauggaucgaagagaaucccuggauggaagauaaaacacauguuucaucaugggaagauguaccguaucuaggaaaacgagaagaccaaugguguggcaguuuaauugggcugacugcaagagcgaccugggcaacaaacauacaaguugcaauaaaccaaguccggagauuaauagguaaugagaauuaccuagacuacaugacgucaaugaagcgauucaaaaacgaaucugaucccgaaggagccuugugguaa

SEQ ID NO: 21156 - RNA, 9879 nt, Artificial Sequence
  derived and/or modified CDS sequence (opt6) from DENV-1__JQ922546__SS-prME
aguguugcaauguuauugaugcuucuaccgacagcuuuggcguuccaccuaacgacgcgcggcggcgaaccgcacaugauaguuaguaaacaggaacgggggaaaucccuacuauuuaaaacaagugcuggggugaauaugugcacguuaauagcuauggaccuaggcgaauuaugcgaagacacaaugacauacaaauggccccgaauuacagaagcugaaccugaugacguggauugcugguguaaugccacggauacguggguuacguauggcacauguucacagacuggggaacauagacgagauaaacgaaguguggcauuggcuccacaugucgguuugggguuagaaacaagaacagaaacguggaugaguucagaaggcgccuggaaacaaauacaaaaaguagaaacgugggccuuaagacacccuggguuuacagugauugcuuuauuuuuagcgcacgcuauugggacaucaauaacucaaaaaggcauaauauucauucuauugaugcuaguaacucccaguauggcaaugcguugugugggaaucggcaaccgugauuuugucgaaggacucuccggagcuacguggguagauguagucuuagaacaugguucgugcguuacuaccauggccaaaaauaaaccuacucucgauauugaacuucuaaaaacggaaguaaccaauccugcuguacuucgaaaacugugcauagaagcaaaaauuucaaacacuacgacugacaguagguguccaacccaaggcgaggcaaccuuaguugaggaacaagaugccaauuucguaugucgaaggaccuuuguagauaggggaugggggaacgguuguggccucuucggaaaagggagccuacuaacaugcgcaaaauucaaauguguaacaaaacuagaaggaaaaauuguacaauaugaaaauuugaaauacucagucauugucacgguucauacaggagaccaacaccaaguagguaaugagaccacagaacauggaacuauagccauuauaacaccgcaggccccaaccucagagauacaacuuacggacuauggugcauuaacacuugacuguucacccaggaccggucuagauuucaacgagaugguacuauuaacgaugaaagagaaaaguugguugguccauaaacaaugguuucuugaccucccauugccguggacaagcggcgcaagcacgagccaagagacauggaauaggcaagaccucuuaguuacauucaaaacagcucaugcuaagaaacaagaaguaguuguauugggcucgcaggaaggugcaaugcauacugcucucacaggagcaacagaaauacaaacaucagggacuacgacaaucuuugccggacaucuaaaaugucgacuaaaaauggacaaacugacgcuuaaagguaugaguuacguaaugugcaccggaucauuuaaauuagagaaagaaguggcugaaacccagcauggaacuguguuaguacaaguuaaauaugaagggacggaugcaccauguaaaauaccuuucucuauacaggacgagaaaggcguaacacaaaacggccgguuaauaacugcaaauccaauaguaacagacaaagaaaaaccugugaauauagagacagaaccuccauuuggagaaucuuauauuguuguuggugccggagaaaaagcgcuaaaacugagcugguuuaagaaagguucaucuauaggaaaaauguuugaggcaacagcccgaggugcccgcagaauggcaauauuaggugauacagcaugggauuucggaaguauugggggaguguucacuucgguaggaaagcuaguacaucaagucuucgggacugcauacggcgugcucuuuucagguguaucauggacgaugaaaaucggaaucggaauccuuuugacaugguuagggcuuaacucgagauccacaagccuuaguaugacuuguauagcagucggcaugguaacuuuauaucuaggugugaugguacaagcggauagcggauguguaaucaauuggaaaggcagagagcuaaagugugguaguggcauuuucgugacaaaugagguccauacauggacagagcaauacaaauuucaagcagauucaccaaaacggcugagugccgcgauuggaaaggcuugggaagagggcgugugugguaucagaucugcaacgagguuagaaaauguaauguggaaacaaauuucuaacgaacucaaucacauacuauuagaaaacgauaugaaauuuaccguaguaguuggugauguuaacggcauucuggcacaagguaaaaagaugauuagaccgcaaccuauggaacauaaauauagcuggaaaaguuggggaaaggccaagauaauaggagccgauauccaaaacaccacguucauuauugaugguccggauacaccagaaugucccgaugaucaaagagcauggaauauaugggaaguggaagacuacggguucggaauuuucaccacaaacauuugguuaaaguugagggacucguauacgcaaguaugcgaccauagauuaaugagugcugcaauuaaggacucgaaagcaguacaugccgauaugggauacuggauagagucggagaaaaaugaaacauggaaguuggcgagagcguccuuuaucgaaguaaaaacgugcacauggccaaagucacauacucucuggucuaauggaguauuggagagcgaaaugauuauaccgaaaaucuacggugggcccaucucacaacauaacuacaggccuggauauuuuacccaaacagccggaccauggcauuuaggaaaacuggaauuggauuucgaucugugcgaggguacaacaguaguaguagacgagcauugcggaaaucgagggccaagucugagaacaacaacggucacugggaagauaauacacgaguggugcuguaggucauguacacuaccaccuuuaagguuuaaaggagaagacggcugcugguacggaauggagauucgcccggugaaagaaaaggaggaaaaccuagucaggaguaugguaucugcagguucgggugaagucgauagcuucucccuugggcuguuguguguaucaaucaugauugaagaaguaaugcgaucuagguggagucgaaaaaugcuaaugacagggacccuagcaguauucuuuuugcuaauuaugggacaacuaacauggaaugauuuauuuaggcucuguauaaugguuggagcaaaugcaagugaucgaaugggcauggggaccacauaccuagcacuuauggcaacuuuuaaaaugaggccuauguuugccguaggguuauuauuccggcgccuaacauccagagaagugcuacuauuaacaauuggacuaagucugguugccucaguagagcuaccaaauucacuagaagaguugggagauggguuagcaaugggcauaaugaugcuuaagcuacuaacugauuuucagucccaucagcuguggacaacgcuacuguccuuaacuuucaucaaaacgacauuaucccucgacuacgcauggaaaaccauggccaugguguuaucgauaguuucuuuaaguccccucugcuugucaacaacuagccagaaaacuacgugguuaccaguacuucuagguuccuucgguugcaaaccacucacgauguuucuuauaacagaaaauaaaauuugggguagaaaaagcuggccgcuuaaugagggcaucauggccgucggcaucguguccauauugcuaucaagccuauugaaaaacgauguaccacuugcuggaccacugauugcaggagggaugcuuauugccuguuacguaauaucggggucauccgcagaccuaucacucgaaaaagcagcagaggucucaugggaggaagaagccgaacauucuggugcaucgcauaauauccuaguggaaguacaagacgauggcacaaugaaaauuaaagaugaagaaagggaugacacacuuaccauucuauugaaagcaucacuacucgcugugagcggcguguaucccaugagcauaccugcuacucuuuucgugugguacuuuuggcaaaagaagaaacaacggagugggguacuaugggacaccccuaguccacccgaaguagaaagggcagucuuagaugacgggauauauagaauacugcaaagaggacucuuaggaagaagccagguagggguaggcauauuccaagacgguguauuucauacaauguggcaugugacacguggagcaguacuuauguaucaaggaaaaagacucgaaccgagcugggcuucaguuaagaaagaccugauaucauaugggggaggauggagauuccaaggcaguuggaauacgggugaggaaguacagguaaucgcagucgaaccgggcaaaaacccuaagaauguucaaacuaccccaggaauuuuuaaaacaccugaaggagaaguuggagccauaacauuagacuuuaaaccaggcacaucagguuccccaauaguuaaccgugaggggaaaauaguaggauuguacgggaauggugugguaacuacaucggguacauaugucucagcaaucgcccaggcgaaggcgagucaagaaggaccacuaccugaaauagaagaugagguauuuagaaagagaaaucuuacaauuauggaccuucauccuggaucggggaaaacuagaagauaccucccugcaauaguaagagaggcaaugaaaagaaaacugagaacacuaauauuagccccaacccgugugguagcaucagaaauggcagaagcacuaaaggguaugccaaucagguaccaaacuacagcugugaaaagcgagcacacagguagagaaauaguagacuuaaugugucacgcaacauuuacuaugagauuauuguccccaguacgcguuccgaacuauaacaugauaaucauggacgaagcgcacuucacagacccugccagcauagcugcuagaggauauauaucaacccggguagguaugggcgaagcugcagcuauuuuuaugaccgcaacacccccagguucaguagaagcauuuccacaaucgaaugcuguaauucaagacgaagaacgugauaucccagagagaaguuggaacucaggcuaugauuggauuacagauuucccaggcaaaacaguaugguucgucccaucaauuaaaucagggaaugauauagccaacugucuccguaaaaacggaaaaagagugauccagcuaaguagaaaaacauucgauacugaguaucagaaaaccaaaaauaaugacugggauuauguagucaccacagacauauccgaaaugggugccaacuuuagagcagauagaguuaucgaucccagaagaugucuaaaaccugugauauuaaaagagggaccggaaaggguaauucuggcaggcccaaugcccgugacggucgcuagcgccgcacagaggaggggaagaauaggacgaaaccaaaacaaagaaggggaucaguacguuuacaugggucaaccucuaaacaaugaugaggaucaugcacauuggacggaggcuaaaauguuguuggaucauaucaacacaccagaagggauuauuccugcacucuucgaaccagaaagagagaaaagugcugcuauagauggugaauauagauugcguggcgaggcaaggaagacauuuguggagcuuaugagaaggggcgaucuaccaguaugguugucauacaaaguggcaucggaaggauuucaguauacagaucgucgaugguguuucgauggagaaagaaacaaucagguauuagaagaaaauauggacgucgaaauuuggauggaagaaggagaaaagaagaaaauacgccccaggugguuggagauagaaaaauauagcgauccguuagcacuucgggaauuuaaggaguucuccgcgaagaggaaaagcguacuuggugauuuaaaauuggagaucgguaagcugccucagcaccucaccauaaaagcgaggaacgcacucgacaaccugguaaugcuucauaauucugaacaaggagggaaagccuacaggcaugccauggaagaauugcccgauaccauugaaacuuuaaugcgguuaggucuaauagccguuaugacuggagguguaacacuauucuuucucucugguaaagggcugggcaaaacgucaaacggacuccucuguguuauggcaucgaguguccuucucuggauggcuagcguugaaccccauuggaucgcugcaagcauaauccuagaguucuuccugaugguacuucucauaccagagccugacaggcaacgaacaccucaagauaaucaguuagcuuauguaguaauaggacuucuuuuuaugauucucaccguugcggcgaaugaaaugggauuauuggaaacgaccaagaaagaucuugguauaggacauguaguggcagaaaaucaucaccacgcgaccauguuagauguagauuuacauccagcaucagcauggacuuuauaugcuguugccacuacuauaauuacgccgaugaugcgacauaccauagaaaacacaaccgccaauauaagucuuacugcaauagcuaaucaggcagcuauauuaaugggauuggacaaaggguggccuauuucgaaaauggauauagguguuccccuacucgccuuaggauguuauagucaagucaaucccuuaacauugacggcagcuguguugauguuaguagcacacuacgcuauaaucggucccggguugcaagcaaaagcuaccagagaagcccaaaagagaacagcaccucaaauaaugaaaaaccaaauaguggauggcauuguagcgguugaccuugacccagugguguaugacgcaaaauucgaaaaacaauuaggacagauaaugcuauuaauacuauguacaagucaaauucuacuaaugaggacaacuugggcguuaugugaaucuauaacgcuggccacagguccacuuacuaccuuaugggaaggcagccccggaaaauucuggaacacuacuauagcugucucuauggcaaauaucuuuaggggaaguuaccuagcaggcgcaggauuagcauuuucucuaaugaaaucacuaggugguggaagaaggggaacgggugcccaaggcgaaacgcugggagaaaaguggaaaaggcagcugaaucaauuaucaaaaucagaauuuaauaccuacaaaagaucuggaauuauggagguugauagaagugaggccaaagagggcuugaaacgaggcgaaacuacaaaacaugcuguuagucgggguacagcaaaacuacgaugguucguugagagaaaccuaguuaaaccagaagggaagguuaucgaucuagguugcggcagggguggauggaguuacuauugcgcgggacugaaaaaggucaccgaagugaaagguuauacuaaaggcggaccaggacacgaggagccgauaccaauggcuacuuaugguuggaacuuaguaaaauugcauaguggaaaagaugucuucuuuacaccaccagaaaaaugcgauacguuacuaugugauauaggugaaucgucaccuaauccaacuauagaagaggguagaacuuuacguguuuuaaaaaugguggaaccauggcuacguggcaaucaguuuuguauaaaaauauugaacccguacaugccaucugucguagagacucucgaacaaaugcaaagaaaacaugggggaaugcugguaagaaacccauugagccgcaauuccacccaugaaauguauuggguaaguuguggaacuggaaauauaguuucagccgucaauaugacaucccggaugcuacucaaccgauuuaccauggcucauagaaaaccgacauacgagagagacguagaccuaggugcugguacuagacauguagcuguugagccagaaguggcaaaucuggacaucauaggccaacguauugagaauaucaaaaaugaacacaaaagcacauggcacuaugaugaggauaacccauacaaaacgugggcauaccauggauccuaugaaguuaagccuucugguagcgcuucaaguaugguaaauggaguagucagacugcuuacuaagcccugggacgucauaccaaccguaacacaaauagcaaugaccgacacuacaccuuuuggucagcaaaggguauuuaaggaaaagguagacaccaggacaccuaaggcaaagagagguacagcccaaaucauggagguaacugcaaacuggcuauggggcuuccugucaagaaauaaaaagccacgcauaugcacgagagaagaauuuacaagaaaaguaaggucaaacgcagcuauaggugcaguauuuguggaugaaaaucaauggaacucggcgaaggaagccguugaagaugaaagauuuugggaccuaguucacagggaaagggaacuccacaaacaagggaagugugccacguguguauauaauaugauggggaagagagagaagaaauuaggcgaauuuggcaaagcaaaggguucacgagcuaucugguauauguggcuuggagcgcgcuuucuagaauuugaagcgcuuggguuuaugaacgaagaucacugguuuagucgagaaaauagccuaaguggagucgagggagagggauuacacaaguuaggauacaucuuaagagauauauccaaaauaccuggagggaacauguaugccgaugauacugcaggcugggacacacguauaaccgaagaugaccuccagaaugaggcaaaaauaacagacauuauggaaccagaacaugccuuauuagcuacaaguaucuucaaauuaacauaccaaaauaaagugguaagaguucaacgaccugccaaaucugguacagucauggauguaaucaguagacgcgaccagagaggaaguggacaaguagggacuuacggacucaauaccuuuacuaauauggaaguccaauuaauacgacaaauggagucugaagguaucuucuuaccaucagaauuggaaacaccuaacuuagccgagagaguauuaaauuggcuagaaaaacauggaguggaacgauuaaagaggauggccauuaguggagaugauugcgugguaaaaccuacggaugaccgauuugccaccgcacuuacugcucuaaaugacaugggaaagguuagaaaagacacuccacagugggagccuagcaaaggauggaacgacuggcaacaaguaccguucugcucacaucauuuccaucaauuaauuaugaaggacggucgcgaaauagucguaccauguagaaaucaagacgaauugguuggcagagcuagaguaucgcauggggcaggcuggucacuccgagaaacagccuguuuggggaagucauaugcacaaauguggcaacuuauguacuuccauagaagggauuuacgacuugcagccaacgcaauauguagugcagucccuguugauugggucccgacuuccagaaccacgugguccauucacgcucaccaucaauggaugacuacugaagacaugcuaaguguauggaaccgaguauggauagaagaaaauccauggauggaggacaaaacucacguaaguuccugggaagacguaccuuaccuaggaaagagagaagaccaguggugugggucaauaauaggguugacugcuagagccacaugggcuacaaauauucagguugccauaaaucagguaagacgacugauugguaaugaaaauuaucuagacuauaugacuucuaugaagagauuuaagaaugaaagugauccagaaggagcgcuaugguaa

SEQ ID NO: 21157 - RNA, 9879 nt, Artificial Sequence
  derived and/or modified CDS sequence (opt6) from DENV-1__JQ922545__SS-prME
uccguaacuaugcugcuaauguuacuucccacugcuuuagccuuucaucuaaccacgcguggcggcgaaccacauaugauaguuaguaaacaagaacgggggaaauccuuacuauucaaaacuucggccggggucaauauguguacccucauugcaauggaucuuggugaguuaugugaagacacuaugaccuauaaaugcccacgaauaacagaagcagaaccggaugauguugauuguuggugcaaugcaacugauacuugggucacuuaugguacaugcagccaaacuggcgaacauagaagagauaaaagauccguugcucuagcaccacaugucgguuuggggcuagaaacuagaaccgagaccuggaugucuucugaaggagcauggcgccagauacaaaaaguggagacaugggcucuaagacauccaggauuuacuguaauagcuuuguuuuuagcucacaccauugguacaucuauaacacaaaaagguauaauuuuuauccuauuaaugacuggagcucccauaauggcuaugcgcuguguaggaauaggaaaucgagacuuuguagaaggucugucuggcgcacccuggguugaugucguccucgaacauggcaguugucucaguaauauggcgaaaaauaaaccaacuuuagauauagacuucuuuaaaacggagguaacgaauccagccguuuugcgaaaacuuuguauagaagccaaaauauccaauacgacuacugacaguagguguccaacccaaggugaggcaacacugguugaagaacaagaugcuaauuuuguaugcagacggacauuuguagauaggggaugggggaauggaugcggauuguucggcaaaggcucucuguuaacgugugcaaaauuuaaaugugugacaaaacuagaggguaaaauaguacaauaugagaaucucaaauacucuguuauagugacgguacauacgggcgaccaacaccaagugggaaaugaaacaacagaacacggcaccauugcgaccauuaccccgcaagcaccgacuagcgaaauucaauugaccgacuacggugcuuuaacguuagacuguucaccucgaaccggcuuagacuuuaaugaaaugguacuucuaacaaugaaagaaaaaucuuggcuaguacacaaacagugguuuuuagaucuaccauuaccuuggaccaguggagcaucuacaagccaagaaacguggaacagacaagaucugcuaguuacuuucaaaacugcacaugcgaagaaacaagaggucguuguucuuggcucccaagaaggagcaaugcacaccgcucuaacuggggcuaccgagauucaaaugagugguacuaccacaauauucgcaggccaucuaaaaugccguuuaaaaauggauaaacuaacacuaaaaggggugagcuaugugaugugcacaggcuccuuuaaacuagagaaagaaguugccgaaacucaacacggaacaguauuagugcagguaaaguacgaagguacagacgcuccuuguaaaauaccuuucucaacacaggaugaaaaaggaguuacgcagaaugguaggcuaauuacagcuaauccuauaguuacagauaaagaaaaacccguaaauauugaaacagagccaccauuuggagaaagcuauauaguaauuggagccggcgaaaaagcauuaaagcuaaguugguuuaagaaggggagcucgauagggaaaauguuugaagcgacugcaagaggagcacgaagaauggcaauuuuaggcgacacagcaugggacuuuggaagcaucggaggcguauucacaagugucggaaaguuaguccaucagguguuuggaacagcauaugguguguuauuuucaggggugagcuggacgaugaaaauaggaauuggaauauuauuaacgugguuaggucuaaacuccaggucaacuucauugaguaugacauguauugcaguuggaauggucacucuauaucuggguguaaugguacaagcugauucggguuguguaauuaauuggaaggggcgggaacuaaaaugcggaagcgguauuuuugugaccaacgaaguucauacguggacugaacaauacaaguuucaagccgacucccccaaacgcuuauccgcggcaauuggaaaagcaugggaagagggcguaugcggaauuagaagcgcgaccugccuagaaaauauaauguggaaacaaauauccaaugaacuaaaccauauccuacuugagaacgacaugaaguucacuguuguaguuggggaugcaaacgguauacugacacaagguaaaaagaugauaagaccucaaccuauggaacauaaauauucuuggaagaguuggggcaaagccaaaauaauaggagcagauauucagaacacaacuuuuauaaucgacgggcccgacaccccagaguguccagaugaccagagggcguggaacaucugggaaguagaagacuauggauucgguauuuucacaaccaauauauggcuuaaacuacgagauucauauacacaaaugugugaucaucgccuaaugucugccgcaauaaaagacagcaaagcuguacacgcagauaugggcuacuggaucgaaucggagaaaaacgaaacguggaaacucgcgagggccucauucauugaaguuaagacuugcauauggccgagaucacauacucuuuggagcaauggaguauuagagucggagaugauaauuccuaaaaucuaugguggucccauaagucaacacaauuaccgaccagguuacuucacacaaacugcaggaccauggcaucuugguaaguuagaacuagauuucgaucucugugaaggaacaacaguuguaguugaugaacauuguggaaaucgaggaccaagccugagaacuaccacgguaacgggcaagauaauacacgaauggugcuguaggucuuguacguuaccaccauuaagauuuaagggagaagacggauguugguauggaauggaaauuagaccaguuaaagaaaaggaggaaaacuuggucagaaguaugguaucagcuggauccggagaaguagacuccuucucuuugggcuuauuaugcguuucaauaaugauugaggaaguuaugaggucaagguggucgcgcaaaauguugaugacagguacauuagcgguguucuuuuuauuaaucauggggcaauuaacuuggaacgaccuuaucagacucuguauaaugguuggagcaaauguuuccgaucgcaugggaaugggaacaacauaccuugcguugauggcuaccuuuaaaaugcguccaauguucgcuguuggguuauuguuccguagauugacuagccgggaaguauuauuacucacaauaggccuaagucuuguugccucaguggaacuuccuaauucuuuagaagaacugggagacggguuagccauggggauaaugaugcuaaaacuuuuaacugauuuucaaagucaucagcucuggacgacauuauuaucauuaacauuuaucaagacgacacugucacuggauuaugcauggaagacaaucgcgaugguuuuaucaauaguuagccuuuuuccccuauguuuaaguacgaccagccagaaaaccacuuggcuacccguguuacucggcuccuuuggguguaaaccauuaacuauguuuuuaauuacugaaaauaagauauggggacgaaaaaguuggccacuaaacgagggaauaauggcaguagggaucguuuccauauuacuaaguucauuacucaaaaacgaugugccauuagcuggaccgcugauagcugggggaauguugauugcuugcuacguaaucucaggaucaucggcagaccuaucacuugaaaaggcugccgaagucucgugggaagaagaggcccaacauucaggagccagccauaacauuuuggucgaggugcaagacgauggcaccaugaaaaucaaagaugaagaacgggacgacacauuaacaauacuacuaaaagccacacuacuagcuguaaguggaguauacccaaugucaauacccgcgacacucuuuguaugguacuuuuggcaaaagaagaaacaaagaaguggaguccuuugggacacuccgucgccaccugaaguggaacgagccguucuugaugaugggauuuaccggauucugcaaaggggcuuacuagggagaucacaggugggaguaggaguauuucaagauggugucuuccauacuauguggcaugugacaagaggagcaguauuaauguaccaaggaaaacgucuagagccuucuugggccagugugaagaaagaccuaaucucauacggugguggguggagguuucaagguucauggaacacaggagaagaaguucaggucauagcagucgaaccggggaaaaacccuaaaaacguucaaacgacgccuggaacuuuuaagacaccagaaggggaaguuggagccauugcauuagauuucaaaccagguaccucggguucuccaauagucaaucgggagggaaaaauugugggccuauaugguaauggaguugucaccacgagugggaccuaugugucagcuaucgcacaagcgaaggcaagucaggagggcccauugccugagaucgaggacgagguuuuuaagaaacgaaauuugacuauaauggaucugcauccuggaagugggaaaacccgaagauacuuacccgcaauuguuagagaagcaaucaaaaggaaauuacggacguuaauuuuggcacccacgaggguaguagcgagugagauggcugaggcucuaaaagggaugccaauucguuaccaaacgacggcgguaaaguccgagcacacagggagagaaauagucgacuugaugugucacgccacauuuacgaugagguugcucagcccggugagaguaccgaauuacaauaugauaauuauggaugaagcacacuuuacugauccugcuucaauagcugcaaggggauacauaaguacgagggucggaaugggagaggcugcagcgauuuucaugacugcgacaccucccgguuccguagaagcguuuccacagaguaacgcaguuauacaagacgaggaacgugauauaccagaaagaucguggaacucugguuacgauuggauuacagauuuuccuggaaaaacuguaugguuuguaccaagcauuaaaucuggaagugacauagcaacaguucucgaacgaucacgagaacccguaauacaacuaucgcgaaagacauuugauacagaguaucaaaagacaaagaauaacgacugggauuauguaguuacaacugauauuucagaaaugggagcaaauuucagggcugauagagucaucgauccuagacggugcuugaaaccaguuauacccaaagaugguccagaacguguuauauuggcuggccccaugcccguaacuguugcaucggccgcacaaaggagaggaagaauaggaaggaaccagaauaaagaaggcgaucaauacauuuacauggggcagccguugaacaacgacgaagaccacgcucauuggacugaagcuaagauguugcuggauaauauaaauaccccagaaggaauaauaccugcguuauucgagccggaaagagagaaaagugcagcuauugacggagaauacagguugcgaggagaggcccggaagaccuuuguagaguuaaugagaagaggggaccucccagucuggcuuagcuauaagguagcaucugaaggauuucaguauucagauagaagguggugcuuugauggugagcgaaauaaccaaguguuggaagagaauauggaugucgaaaucuggacaaaagaaggcgaaaggaagaaacuuagaccaagaugguuagacgcucguacguacagugacccguuagcacuacgugaauuuaaagaguuugcagcaggaaggaggucgguaagcggagaucugaucuuagagauugaaaaacuaccucaacacuuaacacugagggcccaaaaugcauuagacaauuuaguaaugcugcauaacucagaacaagguggaaaggcauauagacacgcaauggaagaguugcccgauacuaucgaaacgcuaauguugcuugcauuaauugcaguauuaaccggcggaguuacgcuauucuuucugaguggaaaagguuuggguaaaacaucaauaggccuuuuaugcgugauggcaagcucuguacuucuguggauggcauccguggaaccccacuggauagcagcaucaaucaucuuggaauuuauauuaaugguauuacucauuccagagccugauagacagcguacaccacaagauaaccaacucgcuuauguuguaauugguuuauuauucaugauacuaacgguagcagcaaacgaaaugggauuguuagagacaacaaagaaagaucuuggcauaggucauguuguagcagagaaccaucaucaugcaacgauguuggauauagaccuucauccugcuucagcuuggacccuauacgcaguagcaacuacuauaauuacuccuaugaugagacacaccauugaaaauacgacugcaaauaucagccugaccgcaauugcaaaucaggcagccauucucauggggcuugauaaaggauggcccaucucaaaaauggauauaggcguaccacuacuagcccuuggauguuacucucaaguaaacccccuaacacuaacggccgccguacuuauguugguagcacauuaugcaaucaucgguccuggcuuacaggcuaaagccacucgagaagcgcaaaagcgcaccgccgcuggaauuaugaagaauccaacggucgauggaaucguagcaauugacuuagauccaguaguuuaugacgcaaaauucgaaaaacaauuaggucaaaucaugcuucuaauucuaugcacaagucaaauccuguugaugaggacuacuugggcacuaugcgaaagcauuacucuugcuacggguccuuugacgacacuaugggaaggaagcccgggaaaauuuuggaauacgacaauagcaguaucaauggcuaacauauuuagagguaguuaucuagcgggugcaggccuagccuucaguuugaugaaauccuuaggugguggucgacguggaacaggagcacagggugaaacacuaggcgaaaaauggaaaagacaauuaaaucaauuaucuaagucagaauuuaauacguauaaaagguccgggauuauggaaguugacaggucugaggccaaggaaggacugaagcggggagaaacaacuaagcacgcugucucuaggggaacugcuaaacuacgaugguucgucgaaagaaaucuaguuaaaccugaagggaaaguaaucgacuuaggcuguggaagagguggcuggucauauuauugcgcuggauuaaagaaagucaccgaagucaaaggguauacaaagggagguccgggucacgaagaaccuaucccaauggccacuuauggguggaauuuaguaaaacuacauuccggaaaagauguauucuuuacgccacccgagaaaugugauacucuucugugcgauauaggugaaaguucaccaaauccaacaauugaagaagggcgaacucugagaguauuaaaaaugguagaacccugguuaaggggaaaucaauuuuguaucaagauuuuaaauccauauaugccuaguguuguagagacuuuagaacaaaugcaacggaaacacggagguaugcuaguuagaaacccguuaagucgaaauaguacccacgagauguauugggugaguuguggaacuggaaacauaguaagugcaguaaacaugacaagucgaauguuacuuaauagauuuacaauggcacauaggaagccaacauacgagagagacguggacuuaggagcaggaacaagacacguagccguagaaccagaaauagccaaccuagacauaauuggacaacggauugaaaauauaaagaucggucacaaaagcacauggcauuacgacgaagauaaucccuacaagacaugggcuuaccacgguucuuaugaagucaaaccaucggguucagcuaguagcauggucaaugguguaguuagguugcuaacuaaaccaugggacguuauucccauggucacacaaauagcuaugacagauacaacgccuuuugggcagcagagagucuucaaagagaaaguagacacaagaacgccuagaccaaaaaggggaacagcacaaauaauggaaguaacagccaaauggauguggggguuucuauucaggaacagacccccucgaauauguacucgcgaugaauuugcgcggaaagucagaucaucaacagcaaauggugcagucuuuguagaugaaaaucaauggaacucagcuaaagaggcaguugaggaugaaagauuuugggaucuaguacaccgugaaagagaauuacauaagcaaggcaagugcgcuacuuguguauauaacaugauggguaaaagggagaagaaauuaggagaauuuggcaaggccaagggaucacgugccauaugguacauguggcucggagcaagauuucuagaauuugaagcguuagguuucaugaaugaagaccacugguucagccgcgagaacucgcugagcgggguugaaggugaagguuugcauaaacuaggauauauacuacgagauauaucaaaaaucccuggagguaacauguaugcggaugacacagcagguugggacacaagaauuacagaagaugauaguucuaaugaagcaaaaaucauagagcucaugagaccggaacaugcauuauuagcuacuucaauauuuaaauuaacauuccaaauuucagucguuagaguccaaaggccagcaaaaagcggaacaguuauggagugcauaucccgccgugaucaaaagaggagcggccagguaggcacauacggauugaauacuuuuacaaacauggaaguccaauuaauccgacagauggaaucugaaggaauuuucuccccguccgaaauggagaacucaaaucuugccgaacggguacuagacugguuggaaaagcaugggguagaaagacugaaaagaauggcaauaucaggagaugacugcguaguuaagccaacugaugaucgauucgcuacagcauugaccgcacuuaaugacauggguaaagucaggaaagacauuccacaaugggaaccaucuaagggcuggaacgauuggcaacaaguaccauuuugcagucaccacuuucaucaauuaauaaugaaggauggacgcgaaauaguaguuccguguaggaaccaagaugagcuaguuggccgggcacgggugucucagggggcugguuggucacuuagagagacagcaugcuuggggaaaaguuacgcacagauguggcaauugauguauuuucaucgaagagaucuucgauuagcagcuaaugccauauguucugcgguuccuguagauuggguaccuacaucacgaacgacauggaguauacaugcgcaccaucaauggaugaccacagaagauaugcuaucuguuuggaaucgaguuuggauagaagaaaaucccuggauggaggacaaaacucacguuucaaguugggaagauguaccguauuuaggaaaacgugaggaucaauggugcgggucccucauuggcuuaaccgcaagagccacaugggcgacaaacauucaagucgcgaucaaucaaguacgacguuuaaucggaaacgaaaacuauuuagauuauaugacaucaaugaaacgcuuuaaaaaugaaagcgaccccgagggugcucuaugguag

SEQ ID NO: 21158 - RNA, 9879 nt, Artificial Sequence
  derived and/or modified CDS sequence (opt6) from DENV-1__GU131887__SS-prME
ucuguuaccaugcuucugaugcuaaugccuacugcguuggcguuccaccucacuacacgaggaggggaaccccacaugauuguuucgaaacaagaacgagguaaaagucuauuguucaaaacuuccgccggcguaaacaugugcacccuuauugcuauggaccucggagaacuaugugaagacaccaugacauacaaauguccuagaauaacagaggcugaaccugacgacguagacuguugguguaacgccaccgauacauggguaacauacgggacaugcagccaaacuggagaacaucguagggauaaaagaucgguagcacuggcaccucaugucggauugggccuagaaacaagaacggagaccuggaugucaagugagggagcauggaaacaaauacaaagaguagaaacuugggcacuacgucaccccgguuucacaguuauagcacuguuucuggcacaugccauaggaacaaguauaacccaaaaaggaauaauauuuauauuguugaugcuuguuacacccucgauggcuaugaggugcguaggcaucggaagucgggauuucguggaaggauuaucuggugcuaccuggguagacgucguucuugaacacggaucauguguuacuaccauggcaaaagauaaaccuacccuagauauagaguuacuaaaaacggagguaacuaauccggccauacuaagaaaauuaugcauagaagcgaaaauauccaacacaacuacagacucacguugcccgacccaaggagaggcaacucuaguagaagaacaagaugccaacuuuguaugcaggaggacauuuguagauagagggugggguaacgguuguggacucuucgguaaaggaucauuaaucacuugugcuaaauuuaaaugcguaacgaaauuggaaggaaaaauuguacaauaugagaaccuaaaauacucuguaauaguaaccguacacacgggggaucaacaccaagugggaaaugaauccacagaacacggaaccacagcaacaaucacuccacaagccccaacuacggaaauucaauuaacagauuacggagcauugaccuuagauuguucaccaagaacaggacuagauuuuaaugagaugguccuacuuacuaugaaagagaaaucauggcugguacacaaacaaugguuucuugauuugccucuuccauggacaucuggagcuucaaccagucaagaaacauggaauagacaagaucuauuagucacguuuaaaaccgcacaugcgaagaaacaagagguugugguccuaggaucacaggagggagcgaugcauacugcacuaacgggggccacugagauccagacgucaggcaccacuacaaucuuugcgggacaucuuaaaugucgcuugaaaauggacaaacugacacuuaagggaaugucguaugucauguguacggguucauucaaacuggaaaaagaaguagcugaaacgcagcauggcacggucuuagugcaaauucgauaugaaggaacggacgcuccguguaaaauuccguuuucuacccaagaugaaagaggaguuacacaaaauggucgauugauaacagccaacccaauuguuaccgauaaagagaaacccguaaauauugaggcagaaccuccguuuggggaaaguuauauaguaaucggcgccggagaaaaagcguuaaaacuuuccugguucaaaaagggcuccucaaucggaaagauguucgaagccacugcacgaggagccaggcggauggcaauauuaggcgacacggcaugggacuuuggcaguauuggggguguuuuuacaaguguaggcaaacuugugcaucaaauuuucgguacagcauacggaguacuauuuucuggugugagcuggacuaugaaaaucggcauagguguacuauuaacguggcuuggccuuaacaguagaucaacuagcuuuaguaugacuugcauagcggucggcuuaguuacucuauauuuaggagucaugguucaggcagauucgggaugcguaauaaauuggaagggaagagaauugaaaugugggucagguauauuuguuacuaacgaaguacacacauggacugagcaguauaaauuccaagccgauagucccaaaagacuauccgcagcaauagggaaagccugggaggaaggagugugcgguaucagaagugcgacaagauuagagaacauaauguggaagcaaauaagcaaugagcugaaucauauacuauuagaaaaugauaugaaauucacgguuguuguaggugacgucgcagguauuuuagcgcaaggaaagaagaugauucgaccacaaccuauggaauacaaauauaguuggagaucaugggguaaagcuaaaaucauaggagccgacguacaaaauacgacauuuauaauagaugggccuaauacgcccgaauguccugacgaucaacgagcauggaacauuugggaaguugaagauuaugguuucggcauuuuuacaacgaacauuugguuaaaacucagagacagcuauacgcaaguaugugaucacagguuaaugucagcggcaauaaaagacagcaaagcuguucaugcugacauggguuauuggauagaauccgagaaaaaugaaaccuggaaauuagcgcgugcuagcuuuauagaagucaaaaccugcaucuggccgaaaucacacacguuguggaguaacgggguauuagaaagugaaaugauaaucccuaagauuuauggaggcccuaucagccagcauaacuacaggccaggauacuucacucaaacggccggacccuggcacuuaggcaaacuagaguuagauuucgaucugugugaaggaacuacagugguaguugaugaacauugcggaaacagaggacccaguuuacgaaccacaacaguaacagguaaaaucauucaugaaugguguugucguucauguacgcucccuccgcugagguuuagaggugaggacggauguugguaugggauggagauaagaccagucaaagaaaaggaagaaaaucuaguaaaaucgaugguauccgcaggcagcggggaaguagacaguuuuucacuagggcugcuuuguauuuccauaaugauugaggaaguuaugcguucaagguggucacgaaagaugcuuaugacugguacacuggcggucuuuuuguuauuaauaaugggacaauuaacuuggaacgauuuaauucggcucugcauaaugguaggcgcuaacgccucagacagaaugggcaugggaacaacauaccuagcccuuauggccacauucaaaaugcguccuauguuugcagugggucuauuauuccgcaggcuaacaagccgugaaguacuucuauugacaaucggcuugaguuuaguugcuucaguagaauugccaaauucguuggaggaguugggcgacgguuuggcaauggguauaaugauacugaaacuauuaacagacuuucagagucaccagcuuugggcgacucuccuaucgcuaacauuuaucaagacuacauuuucucuucacuacgccuggaaaacaauggccauggucuuaaguauuguuucacuauucccccuaugcuuaaguacgacaucccaaaagacgacuugguuaccuguuuuguuggguucccucggaugcaaaccacuuacgauguuucuuauugcagaaaauaagauauggggaagaagaagcuggccccuaaacgagggaauaauggcaguaggaaucguaucgauauuacuaucaagucuuuugaaaaaugaugucccacuagccggaccgcuuauugcgggugguauguugauugcaugcuacguuauaagcgggucaucagcggaccuaucauuggaaaaggcggcagagguuucaugggaggaagaagcagagcacagcggugcgucacacaauauauugguagaaguacaagacgaugguacaaugaagauuaaggaugaagaaagagaugauacccugacaauuuuauuaaaggcaacccuacuagcuguaucagguguauauccacuaucaauaccggccacauuguucgugugguacuuuuggcagaagaagaaacaaagguccggaguuuuaugggacacaccuaguccucccgaagucgaaagggcaguucucgaugacggaauauauagaaucaugcagcgggggcuauuagguaggucucaagugggcguaggaguguuucaggaaaacguguuucacacuauguggcauguaacacgaggugcaguccuaauguaccaagguaaacgauuagagccuucuugggcgucggucaagaaagaucucaucuccuacggagggggauggagauugcaagggucauggaauacaggggaggaaguccaggugaucgccguugaaccuggcaaaaacccgaaaaaugugcagacagcacccggaaccuuuaaaacgcccgaaggugagguuggugcgauagcucuagacuuuaaaccaggaacaucuggguccccuauuguaaaccgcgaagguaaaauagucgggcuauacggaaauggcguaguuaccacaucugguacauacguaucagcgauagcucaagccaaagcaagccaagagggaccccugccagaaauagaagaugaaguauuuaggaaacgaaauuuaacaauaauggaucuacauccaggcucgggaaaaacccgccguuacuuacccgcaauuguuagagaagccauaaaaagaaaacuucggacccucauacuggcuccaacccgagucguagcaagugaaauggcagaagcccucaaagggaugccuauacgcuaucaaacgacugcuguaaaaucagaacauacgggcaaggaaaucguugauuuaaugugccaugcuaccuuuacaaugcgcuuauugaguccaguaagagucccgaauuauaauaugauaauaauggaugaggcgcacuuuacggauccauccaguaucgcagcgagaggguauauaucuacaagagugggcaugggagaggccgcagcaauauucaugacggcaacaccuccuggaucugucgaagcauuuccacagaguaaugccguaauccaggaugaagaaagggauauaccagaacguucuuggaauagcggauaugaauggauaacggauuuucccggaaagaccguaugguucguacccuccauaaaaucuggaaaugauauugcaaacugcuugcguaaaaaugguaaaagaguuauacaacucucaaggaagacauuugacacugaauaucagaagacgaaaaauaaugauugggauuaugugguaacuacagauauaucagaaaugggcgcaaacuucagagcggacagaguaauagacccaaggcguugucugaaacccgugauacuaaaggaugguccagaaagaguaauauuagcagguccaaugcccguaacaguagcaucagcagcacaacgucgaggaagaauaggucggaaucacaacaaagaaggagaucaauauauuuauaugggccaaccauuaaauaaugacgaggaccaugcacacuggacggaagcaaagauguuacuagacaacaucaacacaccggaaggcauaaucccggcauuguuugagccggaacgugaaaaaucugcugcaauugauggugaguaucgacuaagaggagaagcacggaagacguuuguagaacuuaugaggagaggagaucuaccaguuuggcuuucauacaaaguagcaagcgaaggguuucaauauagugaccgucguuggugcuuugauggugaaagaaauaaucagguauuggaagaaaauauggauguagaaauuuggacaaaagagggugaaagaaagaaacugcgaccucgauggcuagacgcucgaacauacucagacccucuagcauuacgagaguuuaaggaguuugccgccggcagaagaucgguaucaggagauuuaauacucgaaauuggaaaacuaccucaacauuuaacacaaagggcccaaaacgcacuagauaaccucguuaugcuacauaauucagaacaagguggacgagcauaucgucacgcaauggaagaacuuccagacacaauagagacguuaaugcuacuugcacuaauagcugccuuaacaggugguguaacacuauuuuuccuaucugguagggguuuagggaaaacgaguauagggcuucuuuguguaauggcaucgagugugcugcuauggauggcaagcguugaaccacacuggauagcagcuagcauaauuuuagaguucuuuuuaaugguacucuuaauuccagaaccagacaggcaaaggacuccucaagauaaccaauuagcguaugucguuaucgguuuauuguuuaugauauuaacgguagccgcaaaugaaaugggguuacuugaaacaacgaagaaagacuuaggaauuggacauguagcgguaggcaaucaucaccaugcugcaauguuagacguugauuuacacccugcgucagcauggacuuuauaugcugucgccacgacaauaauaacaccaaugaugcgucacacgaucgaaaacacgacggcgaacauuagucugacggcaauugcuaaucaggcggcaauacuuaugggucucgauaaaggauggccuauaucaaagauggauaucggagugccacugcuagccuuagguugcuacucacaagucaacccauuaacacugacggcagcugugcucaugcuuguggcucauuaugcuaucauagggccgggucuacaagcaaaagcaacucgagaggcucagaaaaggacugcagcuggaauaaugaaaaauccaacaguugacggcauaguagcaauugaccuagauccagugguauaugaugcuaaguucgaaaaacagcuaggucaaauaauguuguugauucuauguacgucucaaauucuguuaaugcguacaacuugggcguuaugcgaaucaauaacuuuagcuacaggaccuuugacaacgcucugggaaggaaguccgggcaaauuuuggaauacuaccauugccgucagcauggcaaacauuuuccgaggaucguaccuggcaggagcgggauuagcuuucucguuaaugaaaucccuaggcgguggacggcgagguacaggagcgcaaggugaaacucuaggugaaaaguggaaaaggcaacuaaaccaacuauccaaaucagaguuuaacaccuacaaacgaucgggcauaauggaaguagacagaucagaggccaaagaaggacugaaaaggggagaaauaacaaaacacgcaguaucucgagguacugcgaaacuacgcugguuugucgaacgaaaucuuguuaagccagaagguaaaguaauagauuuaggcuguggcagaggcggguggaguuacuacugugccgguuuaaagaaaguaaccgaagucaaagguuacacuaaagguggaccgggacaugaagaaccuaucccaauggccacuuacggcuggaaucuaguaaaauuacauucagguaaagaugucuucuuuguuccacccgaaaaaugcgauacccuuuuaugcgauauaggggaaaguucuccaaacccuaccaucgaagaaggacgcacauugagaguguugaaaaugguagagccgugguuaaggggcaaccaguucuguauuaaaauucuuaaucccuauaugccaaguguugucgaaacacuggaacaaaugcagagaaaacauggugguauguuaguaagaaacccucuaaguagaaauagcacucaugaaauguacuggguuucguguggcacagggaacaucguaucagccguuaacaugacaaguagaauguuauuaaauagguucacaauggcccaucguaaaccuacuuaugaaagagauguagauuugggagcagguacacgucauguagcaguugaaccugagguagcaaaucuggacauaaucgggcagagaaucgaaaauauaaaacaugaacauaaaucaacuuggcauuaugacgaagauaaccccuauaagacaugggccuaccaugggucauacgaagucaaaccuuccggaagcgcgaguaguaugguaaauggcguaguaaaacuacuaacaaagccaugggauguaauuccaaugguaacccagauugccaugacagauacuacuccguucggacagcaaagaguuuuuaaagagaaaguagacacaagaacaccaaaagcuaaaagaggcacagcucagauaauggaaguuacagccaaaugguuauggggauuucuauccaggaacaagaaaccaagaauuugcaccagagaggaauuuacuagaaaggugcgcuccaacgcagcaauaggagcuguauuugucgaugagaaucaauggaacucugcaaaggaggcaguugaagacgaaagauucugggacuuaguccaucgcgagagagaacuccauaaacaagguaaaugcgcuaccuguguauacaacaugauggguaaaagagagaagaaauugggcgaguuuggcaaagcuaagggaagcagagcuauuugguacauguggcucggagcaagauuucuagaauuugaagcacuaggauuuaugaacgaagaucauugguucagcagagaaaacucauuaagcggaguugagggcgagggcuuacauaaauuagguuauauuuuaagagauauuaguaaaauaccaggggguaacauguacgcugaugauacugcaggaugggacacucgaauaaccgaagaugauuuacaaaaugaggcccgaauaacagauauaauggaacccgagcacgccuuauuggccaagagcauuuucaaauuaacauaucaaaauaagguugugagaguacaacguccagcgaagaaugggacaguaauggauguuauaagucgucgagaccagagaggaagcgggcaaguagguacauacggacugaauacauuuacuaauauggaagcgcaacuaauacggcaaauggaauccgaagguauauuuucgccgucagaauuagagacaccuaaucuagcagaacgaguuuuagauuggcuagaaaaauacggcguagaaagacuaaaacguauggcuauaaguggugaugauugcguaguaaaaccgaucgacgauagauucgcaaccgccuugacggcgcuaaacgacaugggaaaaguuaggaaagacaucccccagugggagccuucgaagggguggaacgacuggcagcaaguaccuuucuguagucaucacuuccaucagcuaauaaugaaggacgguagagaaauaguagugccgugcagaaaucaagacgagcuuguagguagggccagaguaucacagggagcaggauggagucuccgagagacagcauguuuaggaaaaagcuaugcucaaauguggcaguuaauguacuuucaucgcagagaucuuagacuagcugccaaugcgauauguagcgcaguuccuguagacuggauccccacaagucggacuacauggucgauccaugcgcaucaccaguggaugacuacagaagauaugcuauccguuuggaaccgagucuggaucgaagaaaauccuuggauggaagauaaaacucacaucucuagcuggggagacguaccauacuuaggcaaacgcgaggaucaauggugcggaucacugauugguuugacagcgagagcaacuugggcaacaaauauacagguagcaaucaaccaaguuagaagacuaaucggaaaugagaauuaccuagauuacaugacgucuaugaaaagauuuaaaaaugaaucagacccagagggugcacuaugguaa

SEQ ID NO: 21159 - RNA, 9879 nt, Artificial Sequence
  derived and/or modified CDS sequence (opt6) from DENV-1__GU131888__SS-prME
ucgguaacaaugcucuuaaugcuaaugccaacugcgcuugcauuccauuugacuacgaggggaggagaaccacacaugauuguuaguaaacaagaaagaggaaaaagccuguuauucaaaacaagcgcagggguaaacaugugcacauuaauagcaauggaccucggugaauuaugcgaagacacuaugacauacaaauguccacgaauaacggaagcggaaccagaugauguugauugcuggugcaaugcaacagauacauggguaacauacggaacguguagucaaacaggagaacacaggcgagauaaacgcaguguggcauuagcgccgcaugucgggcuuggacuugaaacccgaaccgaaacauggaugucuucagaaucggcauggaaacaaauucaaagaguagaaaccugggcuuuacgacauccuggauucacgguuauugcacuguuccuggcacacgcuauugggaccagcauaacccaaaaaggaauuauuuuuauauuauugauguuggugacaccaaguauggccaugcguuguguaggaauagguucaagagauuuuguagaaggauuaucgggggcuacuuggguugaugucgugcucgaacauggauccugcgugacgacaauggcgaaagauaaaccaacacuagauauagaauuauugaaaacggaaguaacaaauccagcuauacuaagaaaacugugcauagaagcaaaaauaaguaacacaacaaccgauucaagaugcccuacucagggcgaagcaacucuaguggaagaacaagacgcaaacuucguguguagaaggacuuuuguagauagaggauggggaaacgguugcggacuuuuugguaaagggucacuaaucacgugugcgaaauucaagugugugacuaaacuugaaggaaaaauaguucaauacgaaaauuuaaaauauuccguuauagucacuguccauacaggugaccaacaccaaguagguaacgaaagcacagaacacggaacaacggccacgauaacaccucaagccccuacaacagaaauacaacuaacagacuacggggcauuaacauuagauuguucaccaagaaccggguuagauuucaacgaaaugguauuauuaaccaugaaagagaaaagcuggcucguucacaagcaaugguuucuggaucuaccacuaccauggaccucaggagcgucaacaagucaagaaacuuggaauaggcaagauuuacucgucacuuuuaaaaccgcacaugccaagaaacaagaaguuguaguauugggaucacaagaaggugcaaugcacacagcauuaacuggcgcaacagaaauacaaacaucgggcacaacuacgauauuugccggccauuuaaaaugccgauuaaaaauggauaaacuuacacuaaaagggaugucauaugugauguguacaggcagcuuuaaauuagaaaaggaaguggcagaaacccagcaugggacaguucugguucagauuaaguaugagggcacugaugcgccauguaaaauuccuuucuuaacgcaggacgaaaaaggggucacacaaaaugggcgucuaauaaccgcgaacccuauaguaacugauaaggagaagccaguuaacauugaggcagaaccuccauuuggggaaagcuauauaguuauaggggcuggcgaaaaggcuuuaaaauuaucuugguucaaaaagggaucuucuauaggcaagauguuugaggcaaccgcacgaggagcucguagaauggcuauauugggggauacggguugggacuuugggucuauaggaggaguauuuacuuccguaggaaaauuaguccaucaaaucuuugguaccgcauaugguguauuguucucggguguaucauggacuaugaaaaucggaauaggaguacuuuugacuugguuaggacuaaauucucgguccaccucgcucucuaugacauguaucgcagugggauuaguuacucuauaucuagggguuaugguacaagccgacagcggauguguaauaaacuggaaagggagggagcuuaaaugugguucugggauauuugugacaaaugaaguucauacuuggaccgagcaauacaaguuccaggcggauucaccuaaaagauugucugcugcaauugguaaagcgugggaagaaggaguaugugggaucaggucugccacuagacuugagaacauaauguggaaacagaucagcaacgagcuaaaccacauucuacuggaaaaugacaugaaauucacaguggugguaggagauguugcgggcauucuagcacaggguaagaaaaugaucagaccucagcccauggaauauaaauauagcuggaagucgugggguaaggcaaaaauaaucggagcagacguucagaacaccaccuucauaaucgaugguccgaauacgccagaaugcccggacgaccaaagagcauggaacauaugggaggucgaggacuacggauuugggauuuucacuacaaauauuugguuaaaacucagagauagcuacacacaaguaugugaucacagacuuaugagugcagccauaaaggacucaaaagcgguacacgcagacaugggcuacuggauugaaucagagaaaaacgaaacauggaaauuagcaagagcaucauuuauugaaguaaagacuuguauauggccuaaaucacacacccuguggucaaacggcguuuuggaaagcgaaaugauaauaccgaaaauuuacggagguccuauaagucaacauaauuaucgcccaggauauuucacacaaacagcggggcccuggcaucucgguaaauuagaacuagauuucgaccuaugugaagggacuacugugguaguggaugaacauugugguaaccguggucccuccuugcgaacgacuacaguaacuggaaagauaauacacgaauggugcugcagaucuugcacauuacccccgcuucgguuucguggagaggacggaugcugguauggaauggaaauccgaccgguaaaagagaaagaagaaaaucuaguuaaaucaaugguaucagcugguucuggagaaguagauaguuuuucgcugggauuacuuuguauauccauuaugaucgaagaggucaugaggaguagguggagucgaaaaaugcucaugacagguacacuagcugucuucuugcuuuuaaucauggggcaauugacauggaaugauuuaauacgucuauguauuaugguuggagcaaacgcgagugaucgaauggggauggguacuacauaucuugcauuaauggcuacauuuaaaaugaggccaauguuugcaguaggacuauuauuuagacgacugacaucccgcgagguacuauuauugacaauuggccucagccugguggcaagugucgaauuaccuaacagucuagaggaacuaggagacgggcucgcaaugggaaucaugauccucaaguuacugacggauuuucaaucacaucaauugugggcaaccuuauuaagccucacuuuuaucaaaacuacauucucauugcauuacgcauggaaaaccauggcuaugguguuaaguauaguuaguuuauucccguuaugccuguccacaacgagucagaaaacaacuugguugccgguuuuauuagguagucuuggcuguaaacccuugacuauguuccuuauagcugaaaauaagaucuggggcagaagaucuuggccacuaaaugagggaauuauggcaguaggaaucguaaguauucuauuaagcagccuguuaaagaacgauguaccuuuggcuggaccuuuaauagcaggagguauguuaaucgcaugcuacgucaucuccggaucaucugcagauuuaucccuagaaaaagcagcagaaguuaguugggaggaggaggcugaacacucaggggcuucacauaacaucuuaguggaaguccaagaugaugguccaaugaaaauaaaagaugaggaacgugaugacacacuaaccauuuuauugaaagcaacguuguuagcaguaucuggaguuuacccccucaguauaccggcgacucuuuucguaugguauuuuuggcagaagaagaaacagagaaguggggucuuaugggauacuccaucaccgccugaaguagagagggcgguuuuagaugauggcauauaucguauaaugcagcgaggacuccuaggcaggucacaaguggguguagguguguuucaagaaaaugucuuucauacuauguggcacgugacucgaggugcagucuuaauguaucaagguaaacggcuagaaccauccugggccagcguuaagaaagaucuaaucagcuacggaggugguuggaggcugcagggaaguuggaauacaggagaagaaguacaaguaauagcuguagaaccagggaaaaaucccaaaaacguacaaacugcaccuggaaccuucaaaacaccagaaggagaagugggcgccauagcacuagacuuuaaaccagguacaucaggaucaccuauuguaaaccgugaagguaaaauuguaggccuuuacggaaauggaguagucacaacgucuggaaccuaugucagcgcaauagcacaagcuaaagcgagucaagaaggaccguuaccagaaauagaagacgaggucuucagaaaaagaaaccuuacgaucauggauuuacacccaggcucggguaaaacucgccgauaucuaccugccauuguacgggaagcaauuaaaagaaaacuucgaacacugauuuuagcaccaacacgggugguugccucugaaauggcagaggcuuuaaagggaaugccaauucgcuaccagacaacggcuguuaaaagcgaacacacugguaaagaaauagucgaucucaugugucaugcaacauucacaaugagauugcuuucaccaguaagggugccuaacuacaauaugauuauuauggaugaagcacacuuuaccgacccuucuagcauagcugcucgagguuauauaucaacaagggucgguaugggagaggcagcagcaauauucaugaccgcuacucccccaggaucggucgaggcuuuuccgcaaagcaaugcgcuuauccaagaugaagaaagagacauuccagaaaggucuuggaacucuggauacgaauggauaacugacuuccccggaaaaaccguaugguucguaccuuccaucaaaucagguaacgauauugcaaacuguuuaaggaaaaaugguaagagagucauccagcuaagucggaaaacauuugacaccgaauaccaaaagaccaaaaauaacgacugggauuaugucguuacuacugauaucucggaaaugggagcgaacuucagagcugaccggguaauugauccacguagaugucuuaaacccgugauauuaaaggacggaccagaacgagucauacuggcaggucccaugccugugacgguagcaagcgcggcacaacgaagaggacggauuggaagaaaccacaacaaagagggagaccaauauauuuacaugggucagccauugaauaacgaugaagaccacgcucauuggacggaagcaaaaauguuacuugacaauauuaauaccccagaagguauaauaccagcacucuucgaaccagaaagagaaaagucagcagcaauagauggcgaauauagacugagaggagaagccagaaaaacauucguugaacucaugcgacguggggaccucccaguuugguuaaguuacaaaguagcgucugaagguuuccaauacucugaucgaagaugguguuuugacggggaacgcaauaaccaaguucuagaggaaaacauggauguagaaauauggaccaaagagggcgaacgaaagaaacuccgaccccguugguuagacgcccguacauauagugauccguuggcacugagagaguuuaaagaguucgcagcaggcagacggaguguaucgggagacuuaauucuggaaaucggaaaauuaccucaacaucuaacucaaagggcacagaaugccuuagauaaccucgucauguuacacaacucggaacaggguggacgagcuuaccgacaugccauggaagaacugccagacacuaucgaaacacucauguuauuggcguuaauagcuguccucacuggaggggucacacuauucuuucucuccggccggggauuaggaaagacgaguauuggccugcuaugcguaauggcaucuucaguguugcuauggauggcaucagucgaaccacacuggaucgcagccucuauaauccuugaauuuuuccuuaugguauuacuuauuccagaaccugacagacagcgaacaccacaagacaaccagcuugcauauguagugauagggcuccuauuuaugaucuuaacggucgcagcgaaugagaugggacuguuggagacgacuaagaaagaccuagggauaggacauguagcaguaggaaaucaccaccaugcagcaauguuagaugucgaccuucacccggcgagugcuuggacacucuaugccguugccacaacuauuauaacaccuaugaugagacacacgauugaaaacacaacugcuaauauaucccuaacagcaauagccaaucaggcagcuaucuuaaugggacuugacaaagguuggccgauaucaaaaauggauauaggaguacccuugcuagcgcuagguugcuauucacaagucaacccacuaacccugacagcagcggugcugaugcugguggcccauuacgcaaucauaggacccgggcuucaagcgaaagcuaccagggaagcucagaaaagaacggcggcugguauaaugaagaacccaacgguagaugggauaguugcaaucgacuuagacccaguaguauaugaugccaaguuugaaaaacagcuuggacaaauuaugcuucuuauacugugcacaagccagauuuuauugaugagaacaacaugggcgcucugugaaaguauaacuuuggcaacugggccauuaacgacucucugggaaggaaguccgggaaaauucuggaacacaacgauagccguuaguauggcaaauauauuucguggaucuuauuuggcuggagccggacuugcuuuuucuuuaaugaaaucccucggggguggaagaagagggacuggggcccaaggggaaacucuuggugaaaaauggaaacgccagcuuaaccaacuuuccaaguccgaauuuaauacuuauaaacgaucuggaauuauggaaguagauagauccgaggcgaaggaaggucuaaagagaggcgagacaaccaagcacgcuguaagcagggguacagcaaaauugagaugguuuguagaacggaacuuaguuaaaccggaagggaaaguaauugaucuagggugcggccggggaggguggaguuacuauugcgcgggacuaaagaaaguuacagaaguuaaaggguauacgaaaggagggcccggacaugaagaaccaauuccgauggcuacauauggauggaaucucgugaaauuacacagcgguaaagauguguucuuuaucccuccagaaaaaugcgauacauuauuaugugacauaggggagagcagcccgaauccaacgauugaggaaggaagaacucuaagaguuuugaagauggucgaaccaugguuaagagguaaucaauucugcaucaaaauacuaaacccguauaugcccucaguaguagagacauuagagcagaugcagaggaaacauggcggcauguuaguuaggaauccccuaucgcggaauagcacacaugagauguacuggguguccuguggcacuggaaacauuguauccgcgguuaauaugacgagcagaaugcuucuaaacagauucacgauggcgcaucguaaaccaacauacgaacgggauguagacuuaggagccgggacucgccaugucgcuguggaaccggaaguagcgaauuuagacauaaucggccaaaggauugaaaauauuaaacacgaacacaagagcacauggcauuacgaugaagauaacccauauaagacaugggcauaccacggaucauacgagguaaaaccuucaggauccgcaucuucaauggugaaugggguagugaaauuauuaacaaaacccugggauguuaucccaaugguaacacagauagcgaugacggacaccacaccauuuggucaacaacggguguuuaaggagaaaguggacacgagaacgccuaaagcaaagagaggaacugcgcaaauuauggaaguuacugcgaaauggcuguggggguuuuugucaagaaacaagaaacccagaauauguacgagggaagaauuuacucgcaaaguccggagcaaugcggccauuggugcagucuucguagacgaaaaucaauggaacucugcuaaggaagcaguagaagaugagcgcuucugggaucuaguacauagggagcgagaauuacauaagcaaggcaagugugcaaccuguguauacaauaugaugggcaaacgagagaagaaauuaggagaguucggcaaagcaaaaggaucaagagcaauaugguauaugugguuaggggcacgguuuuuagaguucgaagcucuuggauuuaugaacgaagaucauugguuuucacgagaaaauucacuaagcgggguggaaggcgaagggcuacauaaacuuggauauauauuaagagacaucaguaaaauuccuggugguaauauguacgcggaugauacugcaggaugggacacgcguauaacugaagacgaucuacaaaacgaagcuaggauaacugacauuauggaaccagaacaugcuuuauuagcaaaaaguauuuucaaauuaaccuaccagaacaaaguggucagaguacaaaggccagccaaaaauggaacgguuauggaugucauaucacgacgagaccagcgaggcaguggccagguagguacauauggucuuaacacguucacaaauauggaagcucaguugauaagacaaauggaaucugagggaaucuuuucaccaucagaacuugaaacuccuaaccuagcagaaagggucuuagacugguuagagaaauacggagucgaaagauugaaaagaauggcaaucucuggcgacgacugugugguuaaacccauagacgauagauuugcaacagcgcugaccgcguuaaacgauaugggaaaagucagaaaagacauaccucaaugggaaccuuccaaaggauggaacgauuggcaacaagugccguuuuguagucaucauuuucaucaauuaauaaugaaggauggaagagaaauaguaguucccuguagaaaccaagacgagcuaguagggcgcgccagaguuucacaaggagcuggcuggucauuacgagagaccgcuuguuuaggaaaaucuuacgcacaaauguggcaacucauguauuuucauagaagggauuuacgacucgcagcuaacgcaauaugcagugcuguaccuguagacuggauuccaacuucuagaacuacuuggaguauacacgcgcaucaucaguggaugacgaccgaagauauguuaucagucuggaaucgaguauggauugaggaaaaucccuggauggaggauaaaacacauauuaguucauggggagacguaccguauuuagggaaaagagaagaccagugguguggcucguuaauaggguuaaccgcuagagcaacaugggccacgaacauccaaguugcuauuaaccaagucagaagauugauugguaaugaaaacuauuuggacuacaugacaaguaugaaacgguucaagaacgagucagaucccgagggagcccuaugguaa

SEQ ID NO: 21160 - RNA, 9879 nt, Artificial Sequence
  derived and/or modified CDS sequence (opt6) from DENV-1__GU131892__SS-prME
agcguaaccauguuguuaaugcuuaugccgacugcgcuagcauuccacuuaaccacucggggaggagaaccgcacaugauagugucgaaacaagaacgggguaaaucgcuacuguucaaaacaucggcuggcgucaauaugugcaccuuaauagcaauggaucugggggaauuaugugaagauacaaugacuuauaaauguccgagaauaacugaagcagaaccugaugauguagacuguugguguaacgcuacggacacguggguaaccuaugggacauguucucaaacuggugaacauagaagggacaaaaggagcguugcucuugcgccgcauguugggcuaggauuggaaacgagaacugaaacuuggaugucuagcgaaggcgcauggaaacaaauucaaaggguggaaacuugggcucuuagacacccaggauuuacaguaauugcauuauuuuuggcacaugcaauaggaaccagcaucacucaaaaaggaauaauauuuauucuguuaaugcuagucacaccauccauggcaaugagaugugugggaauuggauccagagauuucguugaaggacuuucuggggcaacauggguagacguggugcuugaacauggcagcuguguaacgaccauggcaaaagauaaaccaacuuuggacauagaauuauugaaaaccgaaguaacuaauccagcaauacugcgaaaacugugcauugaagcaaaaauauccaauacuacgacagacucacguuguccaacccaaggagaagcaacuuuaguugaggaacaagaugcuaacuuuguauguagacgaaccuuuguugaucgaggcugggguaacgguugcggccuauucggcaaagguucgcuuauaacaugugccaaauucaaaugcguuacuaaacuggaaggcaaaauugugcaauacgagaauuugaaauacaguguaauuguaacaguucauacaggggaucaacaccaaguagggaaugaaucaacugagcaugguacaacugcgacuauuaccccucaagcaccgacaacggagauacaacuaaccgacuauggagcguuaacucuagacugcucaccgagaaccggucuugauuuuaaugaaaugguacuacucacaaugaaagaaaaaucguggcucguacacaaacaaugguuuuuggacuugccacugccauggacguccggagcaaguacgagucaagaaacuuggaacagacaagaccuucucguuacauuuaaaacugcacacgccaagaaacaagagguugucgucuuggguucccaagaaggagcuaugcauacagcguugacaggugcuacggaaauacaaacuagcggaaccacaacaauauucgcgggucaccucaaaugcagacuuaaaauggauaaacugacauuaaaaggaaugucauauguaaugugcacgggaucuuuuaaauuggaaaaagaagucgcagaaacacaacacggcaccguauuaguccaaauaaaauaugaggggacugacgcgccuuguaaaauaccauucaguacgcaggaugaaaaagguguaacacagaauggacguuuaauuacagcaaauccaauaguaacugauaaagaaaaaccuguaaacauugaggcugaaccgccauuuggcgaaaguuauaucguaauuggugcaggagaaaaagcccugaaacuaucgugguuuaagaaagguuccuccauaggaaagauguucgaagcuacugcucguggagcacgacguauggccauucuaggagacacggcgugggacuuugggaguauaggcggcguuuucacaucgguggggaaguuaguacaccagauauucggcacagcuuauggaguacucuucagcgguguuagcuggaccaugaaaaucgguauagguguucuuuuaacaugguuagggcuaaauuccagauccaccucccuaucaaugaccuguauagcaguaggcuuaguaacuuuguauuuaggagucaugguucaagccgauuccggaugcguuauuaauuggaaaggaagagagcuuaaauguggaaguggaauuuucguaacuaaugagguucacaccuggacugaacaauauaaauuucaggcagauagccccaagcgauuaucagccgcaauugguaaagccugggaggagggugucuguggaauuaggucugccaccaggcucgaaaauaucauguggaaacaaauaucuaaugaauuaaaucacauccuauuagaaaaugacaugaaguuuacaguugucgucggcgacguagcaggaauccuagugcaaggcaagaagaugauacgaccacagcccauggaauauaaauauucuuggaaaucauggggaaaagcgaaaauaauaggagcagacguacagaacacaacuuucauuauugacgguccaaacacuccugaguguccagacgaccaaagagcuuggaacauaugggaaguagaagacuacgguuucggaauauuuacaacuaacaucugguuaaaauuaagagacuccuacacucaaguaugugaucacagguugauguccgcggcgauaaaggauucaaaagcaguacaugcagacaugggcuauuggaucgaaucagagaaaaacgaaaccuggaaacucgcaagagccagcuuuauugaagucaaaaccugcaucuggccuaaaagccauacauugugguccaacggaguacuugaauccgagaugauaaucccaaaaauuuaugguggcccaauaucacaacauaacuauagaccuggauacuucacucagacagcuggaccauggcaccucggaaaacuagaacuagacuucgauuugugugaagggaccacaguaguaguagaugagcacuguggcaacagaggcccaucucucagaacaacaacuguaacuggaaaaaucauacaugaauggugcugucguucuugcacucuaccuccacugagguuucgcggagaggaugguuguugguaugguauggaaauaagacccgugaaggagaaggaagaaaaccuagucaaaucuaugguuagugcagggaguggagaaguagauucguucucucuaggccuccuauguauuuccauuaugauagaagaaguaaugaggucaagauggucucgaaaaauguuaaugaccggaacacuggccgucuucuuacuauugauaaugggacaguuaacuuggaaugacuuaauacgucuauguauaaugguaggagcaaaugcuucagaccgcaugggaaugggaacgacguaucuggcucuuauggcaacauuuaaaaugcgacccauguuugcagugggauuguuauuucgccgacugacaagcagagaaguacuacuguugacaauaggacucucacucguugcuaguguugaauuaccaaauucauuggaagaacuaggagauggacuugcaauggguauaaugauacuuaaauugcuuacagauuuucaaagucaucaacuaugggcgacacucuugagccuuacuuuuauaaagacgacauucucacuucacuaugcauggaaaacaauggccaugguauuaaguauuguaucacuauuuccacucugccucaguacaacaagucagaaaacaaccuggcuaccaguucuguuaggaucacugggcugcaagccccuaacuauguuucuaauagcagaaaacaagauauggggaagacgaucauggccacuuaaugaagguaucauggcaguuggcauagucucaauucucuugucuagccugcuaaagaacgacguaccauuagcagggccauuaaucgcugggggaaugcuuaucgcuuguuaugugauuucuggcuccagcgcugaucucaguuuagaaaaagccgcagaaguauccugggaagaggaggcagaacacagcggugcuagucauaauauuuuaguagagguccaggaugaugguacgaugaaaauaaaggaugaagaacgggaugauacauuaacuauucuauuaaaagcaacauuguuagccguuucuggaguuuaucccuuauccauaccggcgacauuauucguaugguacuuuuggcagaagaagaaacaaagaaguggaguauuaugggacacaccaucaccaccagaaguagaacgggcgguucuagaugaugggauuuauaggauaaugcagcgaggauuacuaggaagaagucaagucgggguuggagucuuucaagaaaauguauuucauacuauguggcaugugacacgaggagccguauugauguaucaggguaaacgucuagaaccgaguugggcgagcguuaagaaagauuuaauaucguauggugggggauggagauuacaagguucuuggaacacuggugaagaaguccaaguuaucgccguagaaccagggaaaaaucccaaaaauguacagacagcuccagguacauucaaaaccccagaaggagaagucggagccaucgcgcuggacuucaagccaggaaccaguggaucuccuaucguuaaucgagaaggaaaaauugucgggcucuauggaaauggaguuguuacaaccaguggaacauacgucagcgcgauagcgcaggcaaaagcaagccaggaaggaccgcuaccagaaaucgaagacgagguguuucgcaaaagaaacuuaaccauaauggaccuccacccggguagcggaaagacaagacgcuacuuaccugcaauuguccgcgaagcuauuaagcggaagcuacgcacucuaauccuagcaccaacccgcguuguagcaucugaaauggcugaagcacucaaggguaugccaauucguuaucaaacaacugcaguaaaaagugaacauacugggaaagaaauaguggauuugaugugucaugcaacauuuacaaugaggcuacugaguccaguccgaguaccaaauuacaauaugauuauaauggacgaagcgcauuuuacggauccuucgucuauagcagcgaggggauauauaucuacgcgaguaggaaugggagaagcggcagcaauauuuaugaccgcaacuccucccgguucaguagaagcauuuccccaaucuaaugcaguaauccaggacgaagaaagggauauccccgagagaaguuggaauaguggauaugaauggauaacagauuuccccggaaaaacaguaugguucgucccuucaauuaagaguggaaacgacauagcaaauugcuuaagaaagaacggcaaacgaguaauccaacuuuccagaaaaacguucgauacggaauaucagaaaaccaaaaauaacgacugggacuacgugguaacgacagauauaucugaaaugggugcaaauuuuagggcugacagaguuauagacccccgccgaugccuaaaaccagugauucugaaagacgguccagagagaguaauacuggcggguccgaugccaguuacgguagcuagugcggcgcaacgaagagggcggauuggccggaaucacaauaaggaaggugaccaauacauauauaugggccaaccuuuaaauaaugacgaggaccaugcacacuggacagaagcgaaaauguuacucgacaacauuaauacaccugaaggaauaauaccugcucuauuugagccugaaagggaaaagagcgccgcuauugauggugaauauaggcuccggggagaagcaagaaagacauucgucgaacuaaugcgaagaggugaucuuccaguuuggcugucguauaaaguagcaagugaaggguuucaauacucagaucgaaggugguguuucgauggagagcggaauaaccaaguacuugaagaaaauauggacguagaaauuuggaccaaagaaggagaaaggaagaaauuaaggccacggugguuagaugcaagaacuuacucggauccucuugcauuaagagaauuuaaagaauuugcagccggacgcagaucuguaucuggcgaucuaauccuagaaauuggcaaauuaccgcaacaucuuacgcagagagcacaaaacgcgcucgauaaucuaguaaugcuacacaauucggaacaaggaggcagagcguauagacacgcaauggaggaauuaccagacacaauagaaacgcuaauguuguuagcacuuauugccguucuaacaggaggaguaacauuauuuuuccuuaguggacgaggucuuggaaaaacaucuauuggcuuauugugcguuauggcuagcuccgucuuacuauggauggcaucaguugagccacacuggauagccgcaaguauaauccuagaguucuucuugaugguacuauugauacccgaaccugaccgccaaaggacaccacaagacaaucaacuagcauauguaguuauuggccuacuauuuaugauacuaacagucgcagcuaaugaaaugggauuacuugaaacaacuaagaaagauuuaggaaucgggcauguggcaguaggcaaccaucaucacgcugcgaugcucgauguugaccuacauccugccucagcuuggacguuauaugcaguagcaacuacuauaauuacuccaaugaugcgacauacaauugaaaauacgacagcaaauauuagucuuacagcgauagcuaaucaagcugcaauauuaaugggccuagauaaagguuggccuaucucuaagauggauauuggaguuccucuacuagcauuaggaugcuacagucaggugaauccgcuaacacuuacggccgcuguacuaauguuaguugcacauuacgcuauuauugggccaggacuucaggcgaaagcuacuagagaagcucagaaaagaacagcagcuggaauuaugaagaacccuaccguagacgguauugucgcaauagaucuggacccuguaguguaugacgcgaaauuugaaaaacaacuaggucaaaucauguuauugaucuuaugcacaucacagauacuuuugaugcgaacuacuugggcucuuugugaauccaucacauuagcgacgggaccacugacaacguuaugggaaggaucgccgggaaaauucuggaacacaacuauugcagucucuauggcuaauauauuccggggaucauaucucgcuggagcuggacucgcguucaguuuaaugaaaagucuagggggcggcaggcgugggacgggugcgcaaggcgagacuuuaggcgaaaaguggaagcgccaguuaaaucaguugaguaaaucugaauuuaauaccuacaaaagaaguggaauaauggaaguggaccguagugaggcuaaagagggccuaaaaagaggugaaacaacuaaacaugcaguaucacgagggacagcgaaacuuaggugguucguagagcguaaucuugugaaacccgaggguaaaguaauugacuuaggaugcggcagaggagguuggucuuacuauugcgcgggacugaagaaaguaacugaaguaaaagguuacacaaagggcgguccaggucaugaggagccgauuccaauggcgacauauggcuggaaucucgugaaacuucauagcgguaaagauguguucuuuaucccaccugaaaaaugcgauacucuucugugugauauuggagagucuaguccaaacccaaccauagaagaaggaagaacauugcguguuuuaaaaaugguagaaccauggcuacgagggaaucaguuuuguauaaagaucuugaauccguauaugccgagcgugguggaaacgcuggaacagaugcaacguaaacauggcgguauguuaguacggaacccucugagcaggaacucaacgcaugagauguauugggucagcugugggacuggaaacauugucagugcgguaaacaugacaucuaggaugcuguuaaaccgcuuuacgauggcgcaccgcaaaccuacguaugaaagagauguagacuuaggugcgggaacacgccacguagcaguagaaccugaaguugcuaauuuggauauuaucggucaaagaauagaaaauauuaagcaugaacauaaaucaacauggcacuacgaugaggacaacccauacaagacuugggcauaucacgggaguuaugagguaaaaccgaguggcagugccucguccauggugaaugguguugucaagcuccugacgaaaccaugggacguaaucccgaugguaacacagauagcaaugacugauacgacgccuuucggccaacaacgaguauucaaggaaaaaguagacacucgcacuccaaaggcuaaacguggcaccgcgcaaauuauggagguaacagcaaaguggcuauggggcuuuuugucuagaaacaagaaaccuagaauauguacaagggaggaauuuacgcgaaaaguacgguccaacgcugccauuggagcgguguucguagaugaaaaucaguggaacucagcaaaagaagccguugaagacgaaagguuuugggaucucguccaucgagagagggaauuacacaagcaaggaaaaugcgcaacuuguguuuacaauaugauggguaaaagagagaagaaacucggugaguuuggaaaagcaaagggaucaagagcaauuugguauauguggcuaggagcgcgauucuuagaguucgaagcacuaggauuuaugaaugaagaucauugguuuucucgugaaaacagucuuucagguguggaaggggaaggucuucauaaacuaggauauauucucagagacauuaguaaaauaccuggagguaauauguacgcugaugauacggcuggcugggauacgcguauaacugaagacgacuuacagaaugaggcacggauaacagauauaauggaaccagaacaugcacuauuagcaaaaucaauauuuaaacugacauaccaaaacaaagucguaagaguacaacggccagcgaagaacggcacagucauggauguaauaucacggcgugaccaaagaggcucaggccaaguuggaacuuacggauugaauacguucacuaacauggaggcucaguugaucagacaaauggaaagugaaggaauauucucccccucugaacuagaaacccccaaccuggcagaacggguuuuagacugguuagaaaaauauggcguugagagauuaaagcgcauggcaaucagcggcgacgauugugucgugaaaccuauagacgacagguuugccacagcucuaacugcacuaaaugauaugggaaaaguacguaaagauauaccucaaugggaaccaucgaaaggguggaaugacuggcaacaagucccguucuguucucaucauuuucaucaacuuauaaugaaagacggucgugagauaguggugccaugcagaaaucaagaugagcuaguagggagggcgaggguuucacaaggagcuggcuggaguuuaagagaaacugcuuguuuaggaaaaagcuacgcgcaaauguggcaauugauguauuuccacagaagagacuuaaggcuggcugcaaacgcaauuuguucggcaguaccagucgauuggauuccaacaucgaggacgaccuggagcauacacgcucaccaucaauggaugacaacggaagacauguuguccguauggaauagaguuuggauugaagaaaauccauggauggaagauaaaacgcacauaaguucauggggagacguuccauacuuggguaaacgcgaagaccaauggugcggaagucuuaucggauuaacugcgcgcgccacuugggccaccaauauacaggucgcuauaaaucaaguaagacggcuaaucggcaaugaaaacuauuuagacuacaugacaucuaugaagcgauuuaaaaacgaaucugacccugagggagccuuaugguaa

SEQ ID NO: 21161 - RNA, 9879 nt, Artificial Sequence
  derived and/or modified CDS sequence (opt6) from DENV-1__GU131893__SS-prME
uccgucacuaugcuacuuaugcuuaugccgaccgcuuuggcguuucaccuaacaacaagggguggagaaccacauaugauagugucuaaacaagaacguggaaaaucccuacuauuuaaaacgagugcaggcguaaauaugugcacauugauugcaauggacuuaggcgaguuaugugaagauaccaugacuuacaaauguccgaggauaaccgaagcggagccggaugauguugacugcuggugcaaugcaacugauacuuggguaacuuacggcacgugcagccaaacaggggagcaucgacgggauaaacggagcguggcauuggccccgcacguuggucuaggacuugaaacacgcacggagaccuggaugaguagugagggcgcauggaaacaaauucaacgcguagaaacaugggcacuuaggcauccaggauuuacagugauugcguuauuccuugcccaugcaauaggcacauccauuacucagaaaggcauuaucuucauacuguugaugcuagucacgccuucaauggcuaugagaugcguuggaaucggaagucgugacuuuguagaaggauuaucgggugccacguggguagacguaguccucgagcacggaaguuguguuacgacaauggcaaaagauaaaccuaccuuggauauugaacuucucaaaaccgagguaaccaacccggccaucuugagaaaacuuuguaucgaggcgaaaauauccaauacuaccacagacaguagauguccaacacaaggcgaggcaacucuaguagaggaacaagaugcaaauuucgugugccgccgcacuuuugucgacagagguuggggcaauggauguggucucuuugguaaaggaucuuuaaugacgugcgcgaaauuuaaaugugucacaaaauuagaagggaaaauaguacaauacgaaaaucucaaauauuccgucauagugacugugcauaccggcgaccagcaucaaguggggaacgaaucaacugagcauggcacaacagcaacaaucacuccacaagcuccuacuaccgaaauucaacugacagauuacggcgcacugacacuagauuguagucccagaacaggacuagacuuuaaugagaugguuuuacugacaaugaaagaaaaaucuugguuaguacauaaacaaugguuccuugaucuucccuuaccuuggacaaguggcgcaaguaccagucaagaaacuuggaaccgccaggacuuauuagugacuuuuaaaaccgcacaugcaaagaaacaagaaguagugguauugggaagucaggagggugcaaugcauacggcauugacaggugcgacagaaauacagaccucuggaacaacaacuauauucgcagggcauuuaaaaugucgacucaaaauggacaaacuaacauuaaaggguaugucauauguaauguguacuggaucauuuaaguuagagaaagaaguagcugaaacucaacacgggacgguccuuguacagauaaaauaugaagguacagaugcucccugcaaaauaccuuucucuacucaggacgaaaaaggagcaacgcaaaacggucgccuaaucacugcuaauccuaucguaaccgauaaggaaaaacccgugaauauugaagcugaaccacccuuuggagaaucuuauauuguaauaggcgcuggagaaaaagcucuaaaauugucaugguuuaagaaaggaagcagcauaggaaaaauguuugaagcuacggcaagaggagcgaggcgaauggcaauuuugggcgauacggcuugggauuucggaucaauuggaggaguauuuacaucugugggaaagcuaguucaucaaauauucgguacagcauauggaguauuauuuagcggaguaucuuggaccaugaaaauuggucuugguguccuuuuaacguggcuaggacuaaauucacgaucuacuucccuaaguaugacaugcauagcaguuggacucguaacguuauacuugggaguaaugguccaagcagacagugguuguguuauuaauuggaaagguagagaacuuaagugcgguagcgguaucuucguaacuaaugaaguacauacauggacagaacaauauaaauuucaagcugauaguccaaaacgucuuucagcagcaaucgguaaagcaugggaggagggaguaugcgguauuagaucagcaacaagauuagaaaauauuauguggaagcaaauauccaacgaauuaaaccauauucuauuagaaaacgauaugaaauuuacgguaguaguaggugacguggcagggauacuagcacagggaaagaaaaugauaagaccacaaccaauggaguauaaauacaguuggaaaaguuggggaaaagcaaaaaucaucggggcugauguucaaaauaccacauucauuaucgaugguccaaauacacccgagugcccagaugaccaacgggcauggaauauaugggaagucgaagauuaugguuuuggaauauuuaccacaaauauaugguugaaacucagagacagucacacccaggucugcgaucaccguuugaugucugcggcuauaaaagauagcaaagccguccaugcugacauggguuauuggauugaguccgagaagaacgaaacuuggaagcuagcuagggcgaguuuuaucgagguaaaaaccuguauauggcccaaaucccauacuuuguggucuaacgggguauuggaaagcgaaaugaucauaccuaaaauuuauggugguccuauuucgcaacauaauuacagaccagguuacuucacacaaacagccggaccuuggcaucuugguaaacuagaauuggacuucgaucugugugaaggaacuacgguaguaguagaugagcauuguggcaauagaggccccagcuugcggacaacaacuguuacaggaaagauuauccaugaauggugcugcagaaguugcacucuaccgccuuuacguuuccgaggagaagauggcugcugguacgggauggagauaagaccaguuaaagagaaagaggagaaucugguuaaaagcaugguaucagcaggcuccggugaaguugauaguuuuucauuaggucuguugugcauaucaauaaugauagaagagguuaugcgcucucgguggaguagaaagaugcucaugacagguacauuggccgucuuucuccuuuuaauuaugggucaacuuacauggaaugauuuaauaagacuuugcauuauggucggcgcaaacgcuucugacagaaugggcaugggcacaaccuaucuugcauuaauggcgacauuuaaaaugaggccaauguuugcuguaggauuguuauuuagacgguugaccagucgggaaguccuacuucuuacaauaggucugaguuugguggcaagugucgaauugccuaacaguuuagaggaacuaggugauggauuagcaaugggaaucaugauccuaaaacuucuaacagauuuccagagucaucagcuuugggccacgcuucuaagccucacauucauuaaaacaacauucucauuacauuaugccuggaagacuauggcaauggucuugaguauugucagccuauuuccacuaugcuuaaguacuacaagucagaaaaccaccuggcuaccggucuugcuagguucucuagggugcaagccuuugaccauguuccuuauagcggaaaauaaaauauggggcagacgaucauggccccucaaugaagggaucauggcugugggaauaguuaguauacuauuaucuagcuuacuuaaaaaugauguuccauuagcuggcccauuaaucgcuggugggauguuaauagcguguuaugugaucagcgguagcucugcugaccuuagccuugaaaaagcugcagagguaucuugggaggaagaagcagaacacucaggagccucgcauaauauucucguagagguacaagaugacggaacuaugaaaauuaaagaugaagagagagaugacacucuaacgauauuacuaaaggcaacacuccuugcuguuucaggaguuuauccucuaucuauaccagccacguuauuuguaugguauuuuuggcagaagaagaaacaacguaguggaguccuaugggauacuccaagcccuccagaaguagaaagggcaguauuagacgauggcauauaccguauuaugcagcgagguuuauuaggccgaucacaggugggaguagguguuuuccaggagaauguuuuccacacaauguggcaugucacacggggcgcuguguuaauguaucaagguaaaagguuagaaccgucaugggcgaguguuaagaaagauuugaucaguuacggaggaggcuggagauuacaagggucguggaauacaggugaagagguacaagucauagcuguagaaccugguaagaacccaaagaauguucaaacugcccccggcacauucaaaacaccagaaggagaagugggugcuauugcguuggauuuuaagccaggcacaaguggcagcccuauagucaaccgagaaggaaaaauuguaggauuauacgguaaugggguaguaacgacuucuggaaccuacguuagugcaauugcacaggcgaaagcaagccaagaaggcccguuaccagagauagaagacgagguauuuaggaagcgaaauuuaacuauaauggauuuacauccagguucugguaaaacgcguagguauuugccugccauaguaagagaagcaaucaaacgaaaauuaagaacacuaauuuuagcccccacaaggguuguagcauccgaaauggcggaggcauugaagggaaugccuaucagauaucaaacaacagccgugaaaagugagcacaccgguaaggaaaucguagacuuaaugugucaugccaccuuuacgaugagauuguuaucuccugucagagugccaaauuacaacaugauaauuauggaugaagcacauuuuacggacccgucuaguauagcagccaggggcuauauaagcacacggguaggcaugggugaagcagccgcuauauuuaugacugcgaccccuccgggaaguguagaggcuuuuccucaaaguaaugccguuauacaagacgaggaaagggauauaccugaaagaagcuggaauaguggauacgaauggauaaccgacuuccccggcaaaacuguuugguucgugccaucuauaaagaguggaaaugauauagcuaacugccuucguaaaaauggaaagcgagucauucaacucucacggaaaacauuugauacggaauaccagaaaacuaaaaacaacgauugggauuaugucgucacaacggauauaucagaaaugggugcaaauuuucgggcggauagaguuauagauccgcguagaugcuuaaagccuguaauacuaaaagacggaccggaacgaguuauacuagcagggccaaugccagucacaguagcuagcgcggcacaacggcgcggacgaauuggucgaucacacaauaaggaaggagaucaauauauuuauaugggucaaccucugaacaacgaugaagaccacgcccauuggaccgaagccaagauguuauuggauaacauuaauacgccagaagggaucauucccgcauuauuugaacccgagcgagagaaaagugcugcgauagauggagaauacagacuaagaggcgaagcgcgaaaaaccuucguggaacuaaugagaagaggagauuugccugugugguuaucguacaaaguugccucggagggauuucaauacucggauagaagguggugcuuugacggagaaagaaacaaucagguacuagaagagaauauggauguagaaauuuggacuaaagagggagaaagaaagaaauugcgaccccgauggcuagaugcuagaacuuacucagauccauuagcguugagagaauuuaaagaguuugcugccggacgacgaagcguuucuggagauuuaauauuagaaaucggcaagcuaccccaacaccuaacacagagagcucaaaacgcucuagauaaccuuguuaugcuucacaauucugaacaaggaggacgugcuuauagacaugcuauggaagaacuaccagauacuaucgaaaccuuaauguuauuagccuuaaucgcgguguugacgggaggaguuacacuuuucuuccuaucaggaagaggauuaggaaaaacaucaaucggauuguuaugcguuauggcgucuuccguauuguuauggauggcaucaguagaaccacauuggauugcagcuucgaucauacuagaguuuuuccucaugguacugcuaauuccagagccugaucgccagcgaacgccacaagauaaucaauuagcuuacguuguaauugguuuacuguuuaugauccuaacuguagcugcuaaugaaaugggauuauuagaaaccacgaagaaggacuuagguauaggucauguugcaguagggaaccaccaucacgccgcuauguuggauguggaucuucauccagccucggccuggacauuauaugccgucgcaacuacgauaauaacaccuaugaugaggcauacaauugagaauacaacugcgaacauuagccuuacagcuauugcaaaucaagccgccauucuaauggguuuagauaaagguuggcccaucuccaagauggacauuggggucccacuccucgcuuuaggguguuauucacaaguaaauccucuaacuuugacugccgcagucuugaugcuaguugcgcacuacgcuauaaucgguccuggauugcaagcaaaagcuacgcgagaagcgcaaaaacguaccgccgccgguaucaugaaaaacccaaccguugaugguaucguagcaauugacuuagacccaguaguauacgaugcaaaauuugaaaaacaauuaggacaaauuauguuacuuauucuuuguacuucccagauucuauuaaugcgcacaacuugggcguuaugcgaaagcauuacauuagcgaccggaccucuuacaacgcuuugggagggaucuccaggaaaauucuggaauacaacaauagcaguuucuauggcaaauaucuuuagagggaguuaccuggcgggagcgggauuggcauuuucgcuaaugaagucauuagguggaggacgaagagguacaggagcacaaggggaaaccuuaggagagaaauggaaaagacaacuaaaucaauuaucgaaaucugaauuuaauaccuacaaaagaucaggcauaauggaaguagaucgaucugaagcaaaggaaggccucaaaagaggcgaaacaacaaaacacgcagugagcagaggaacugccaaauugcgaugguuugucgagcgcaauuuagucaaaccagaaggaaaaguuauagaccucggguguggcagaggcggguggucuuacuauugugcaggccucaagaaaguaaccgagguaaagggcuacacaaaagggggccccggacaugaggaaccaauaccaauggcaacauauggcuggaaccuuguaaagcuccacucggguaaggauguguuuuucauuccaccugaaaaaugugauacauuacucugugauauaggggagucaagucccaauccgacgaucgaagagggaaggacauugagaguacuaaaaaugguagaaccuuggcuuagaggaaaccaauucuguauaaaaaucuuaaauccauacaugccauccgugguugaaacccuggaacaaaugcaacgaaagcacggagggaugcuaguacgcaaucccuuauccagaaauagcacccacgaaauguauuggguuucuuguggaacugguaacauagugagugcggugaauaugacaucaagaauguugcugaaucguuucacaauggcccacagaaaaccaacauaugaacgggauguugauuuaggcgcggggacgcgucauguagcgguagaaccagaagucgccaaucuugacauuauaggucaacgaauagagaauauaaaacaugaacauaaaucaacauggcacuaugaugaagacaauccguacaaaacuugggcauaccauggaucuuacgaaguuaaaccaagcgguucagccuccucgaugguaaacggaguagucaaacuccuaacaaagccaugggacguaaucccuaugguuacacaaaucgcuaugacugauacaacuccguuuggacaacaacgugucuuuaaagaaaaagucgauacaaggacuccgaaagcaaaacguggaacugcacagauaauggaagugaccgcaaaauggcuaugggguuuucugagucgaaacaagaaaccuagaauauguacgagagaggaauuuacaagaaagguacguucaaaugcugcaauaggagcugucuucguggaugaaaaccaguggaacucugccaaagaagcagucgaggaugaacgauucugggauuuaguccauagagaaagggaauuacauaagcaaggaaagugugcuacguguguguacaacaugaugggaaaaagagagaagaaacuaggagaauuuggcaaagcaaagggaagcagagcaauaugguauaugugguuaggcgcacgauuccuugaguuugaggcucuaggauucaugaacgaagaccauugguuuucaagagaaaacagccugagugggguagagggagaaggcuuacacaaauuaggcuacauauuaagagacauuuccaagauaccaggaggaaauauguacgcggaugauacagcaggcugggacaccagaauuacagaggacgaucuucagaacgaagcgaggaucacugauauaauggaaccagaacacgcacuucuagcgaaaucaauauucaaacucaccuaucaaaauaagguuguccggguucaaagacccgcgaaaaacggcacugucauggaugucauaagucgacgggaucaaagaggaucaggccaaguaggaacauacgggcuuaacacauuuacuaauauggaagcucaacuaauacgacaaauggaaagugaaggaauuuucucucccucagaacucgaaaccccuaaucucgcagaaagaguacuuguauggcuagaaaaauaugguguugaacguuuaaaaagaauggcgauaagcggugaugauugcguagucaagccaauagacgacagauuugcuacugcccuuacugcucuaaacgauaugggaaagguacgaaaagauauaccucagugggaaccaaguaaaggcuggaacgauuggcaacagguacccuuuugcucacaucacuuccaccagcugauuaugaaagauggucgagagauaguaguaccaugccgaaaccaagaugaacucguaggccgugcaagggucucacaaggagcaggauggaguuugcgugagacagcaugucuagggaaaagcuaugcccagauguggcaacuuauguauuuucauagacgagaucugagguuagcagcuaaugcuaucuguucugcaguucccguagauuggauaccaacuuccaggacuacguggaguauucacgcgcaucaccaauggaugacgacagaagauaugcuuuccguuuggaauagaguguggaucgaagagaauccguggauggaagauaaaacgcauauaaguuccuggggagacguaccguacuuaggaaaaagagaagaccaguggugcggaaguuuaaucggauuaaccgcuagagcuaccugggcgacaaauauucaaguggccaucaaccaaguccgacgauugaucggcaaugaaaauuaucucgauuauaugacaucaaugaagcgguuuaaaaaugagagugauccggaaggagcguugugguaa

SEQ ID NO: 21162 - RNA, 9879 nt, Artificial Sequence
  derived and/or modified CDS sequence (opt6) from DENV-1__GU131894__SS-prME
agcguaacuauguuguuaaugcuaaugcccacagcuuuggcuuuucauuugacuacccgcggaggagagccacacaugauagugaguaaacaggaaagagguaagucuuuacuauuuaaaacgucagcuggagucaauaugugcacacuaauagcuauggauuuaggagaacucugcgaggauacuaugacauauaagugucccagaauuacggaggcagagccggaugauguggauuguugguguaaugccaccgauacguggguuaccuaugguacauguucucaaacaggugaacauagaagagacaagagauccguugcacuagccccacauguaggacucggucuagaaacaagaacagagacauggaugucgucagagggugcguggaaacaaauucaacguguugaaacaugggcucuccgacauccugguuucaccguuauugcacuuuuccuagcacacgcgauagggacgucaaucacccaaaaagguauaauauuuauacuacuaaugcuugucacaccaucuauggcuaugagaugcgugggaauagggagccgagacuuuguagaaggcuugaguggagccacauggguugacgugguauuagaacauggaagcuguguaaccacgauggcgaaagauaaaccuacacuggauauagagcucuugaaaacugaagucaccaauccagccauucuucgaaagcuauguaucgaagcaaaaauaagcaacaccacaacagacagcagauguccaacacagggcgaagcaacccuaguagaggaacaagaugccaauuuuguaugcagacggacauuuguagaucgcggguggggaaauggaugcgguuuguuugggaaagguagucuaauuacaugugcgaaguuuaagugcguuacaaaguuagaagguaaaauaguacaauaugaaaaucugaaauauucaguuauaguaacuguacauacuggggaucaacaccaaguagguaacgaaagcacagagcauggcacaacagcaacaauaaccccucaagcaccaacaacugagauacaauugaccgacuauggagcacuuacucuugauugcagcccaagaacagguuuagauuuuaacgagauggucuuauuaaccaugaaagagaagucaugguuaguccauaaacaaugguuuuuggaucuaccacucccuuggaccucuggugcauccacgagucaggaaacuuggaauagacaagacuuauuaguaacguucaaaacagcacaugcuaaaaaacaggaaguagugguacucgguucucaagaaggagcaaugcacaccgcucuaacuggcgcuacugagauacaaacaucugguacgaccaccauauuugcuggucaccuuaaauguaggcuaaaaauggauaaacuaacgcuaaaaggcaugucuuauguaauguguacuggaucauucaaacuagaaaaagaagucgccgaaacacagcacggcacaguguuaguccaaauaaaguaugagggaacagaugcgccuugcaaaauaccuuuuucuacucaagaugaaaagggaguuacgcaaaacggacgauuaauaacagcaaacccaauaguuaccgacaaagaaaaaccaguaaauauugaagcugaacccccauucggcgaaagcuauauuguaauaggagcaggugaaaaagcauuaaaauuaucuugguuuaaaaaagggaguagcaucgguaaaauguucgaagcuaccgccaggggggcacgaaggauggcuaucuuaggggauaccgcaugggacuucggcagcauuggugguguuuuuaccucagucgggaaauuggugcaucaaauauucgggacugccuauggggucuuguuuagcgguguaaguuggacgaugaaaauaggcauugguguauuacugacgugguuaggguuaaauucucguucaacgucccugaguaugacuuguauagcaguggguuugguaacuuuauaccugggaguaaugguacaagcugauagcggcuguguaaucaacuggaaagguagggaacucaaaugugggagcgggaucuuuguaacuaacgagguucacacauggacggaacaauauaaguuccaagcggacucccccaaacgcuugagugcugcuauagggaaagcuugggaagaaggaguuugcggaaucagaucugcaacccgacuagaaaauauaauguggaaacaaauaaguaaugaauugaaccacauacugcucgaaaaugauaugaaguucacuguuguagugggagacguggcuggaauacuagcucaaggaaaaaaaaugauccguccccaaccuauggaguauaaauacucguggaaaaguuggggaaaggcaaagauaauaggugcggauguacaaaacacuaccuuuauuauugauggccccaauacaccggaguguccagaugaccaaagagcauggaauauaugggaaguggaagauuacgguuucggaauauuuaccaccaauauaugguuaaaauuaagagacucauauacccaagucugugaucacagacuaauguccgcagcaauuaaagauucaaaagccguacaugcggauaugggauauuggaucgaaagcgagaaaaaugaaacuuggaagcuagcaagagcaucuuuuauugaaguuaaaacuugcaucuggccgaaaucacacacuuuauggucaaacgguguacuugaaucagagaugauaauucccaaaauuuaugggggaccuauaagucaacauaauuaccgaccaggguacuuuacacagacagcaggcccauggcacuuagguaaacucgaauuagauuucgaucuuugcgaggguacuacagucguuguggacgaacacugugguaaccgagguccaagcuugcggacuacaacagucacuggaaaaauaauucaugaauggugcuguagaucguguacauuaccaccuuuacguuuuaggggagaagacggaugcugguacggaauggaaauuaggccuguaaaggaaaaggaagaaaaccugguaaaauccaugguuagugccggaaguggugaaguagauagcuuuucauuaggacucuugugcauaucaauaaugaucgaagaggucaugaggagucgguggucccguaagaugcuaaugacuggcacauuagcaguuuuuuuauuacucauuaugggccaauuaacauggaacgaccuuauaagauuauguauaauggucggagcuaaugccagugaccguauggggauggguacgacauaccuagcauugauggcaacuuuuaaaaugagaccuauguucgcugugggacuacuauucagaagacuaacaagccgugaaguuuuacuuuuaacgauaggacugucauugguugcaaguguugaauuacccaauucauuagaagaacucggagacgguuuggcaaugggcauuaugauccugaagcuucuuacugacuuccaaucccaccaauuaugggccacguuguugucccucacauucauaaagacaacguucucucuccacuaugccuggaaaacuauggcaauggucuuaaguauagugucgcuauucccccuaugccuuucuaccacgucacaaaaaacaacuugguuaccugugcuauuggguucauuaggaugcaaacccuuaacaauguuccucauagcggaaaacaagauauggggaagaaggagcuggccccucaacgaaggaauuauggcuguggggaucgucucaauacuucuuucuuccuuguugaagaaugauguaccccuagccggcccucugauagcuggcggaauguuaauagcuugcuacgucaucaguggcaguagugcagaccuuagccuagaaaaagcugcugaaguaucaugggaagaggaagccgaacacucgggugcaagucacaauauucuuguggaaguacaggaugauggaacuaugaagaucaaggaugaagagagagaugauacacuuacuauauuauuaaaagcuacguuacuggcaguauccgggguuuacccccuuaguauaccagcuacacucuuuguuugguacuucuggcaaaaaaaaaaacaaagaucuggcguccuuugggauacuccuaguccgccggaaguugagcgggcgguauuagacgauggaauauauagaauuaugcaaagaggucuuuugggacggucgcaaguagggguaggcguauuucaagaaaauguuuuucacacaauguggcauguaacucgaggugcgguguuaauguaucagggaaaaagacuugaaccuucuugggcuucggugaaaaaagaucuaauauccuacggcggaggauggcgauuacaagguucauggaauaccggugaggaaguucaagucaucgcuguugaacccggaaaaaacccaaaaaauguccaaacugcucccggcacuuucaaaacuccagaaggggaagucggcgcgauugcacuggacuuuaagccuggaacaucgggcucuccaauuguaaacagagaaggaaagauaguuggccuguaugguaacggugucguuacgaccuccgguacauauguaucggcgauugcacaagcgaaagccagccaagaagggccucuaccagagauagaagacgaaguuuuuagaaaaaggaaucuaaccauuauggauuuacaucccgguucggggaaaacaagaagauaucucccagcaauaguacgagaagcaauuaaacgaaaauuaaggacccuaauucuagccccaacaagaguaguggcaucugagauggccgaggcguuaaaaggcaugccuauuagauaucagacuaccgcagugaaaagugaacauacugguaaggaaauaguagauuuaaugugucacgcuacauucacaaugcgccuuuuaagcccagugcggguccccaauuauaauaugauuauuauggaugaagcgcacuuuacagacccuagcucaaucgcugcccguggauacauaucuacaagaguagguaugggcgaagcggcagcaauauucaugacagcaacgcccccaggaaguguagaggcguucccccaaaguaaugcaguuauccaggacgaggaaagagauauaccagaaagaucauggaauaguggauaugaauggauaacagauuuuccuggcaaaacgguaugguuuguuccaucgauaaaaucgggaaaugauauagcaaauuguuuaagaaagaauggaaaacgaguuauucaacuuagucguaaaacauucgauacagaauaccaaaaaacaaaaaacaaugauugggacuacgugguaacaacugauaucucugaaaugggugcaaauuuccgugcagauaggguaaucgacccucgaagaugcuuaaagccugugauacucaaggauggaccagagagagugauauuggcugguccaaugccagucacuguugcaucggcugcacagagacgcggccgcauaggcaggaaucauaauaaggaaggagaucaauacauuuauauggggcaaccacuuaauaaugacgaagaucacgcccacuggacggaggcaaaaauguuacuagacaacauuaauacgccugaaggaauuaucccagcgcuauuugaaccagagagggaaaaaagcgcagccauugauggggaauauagacugcggggugaggcuagaaaaacguucguagaauuaaugagaaggggcgauuuaccaguuuggcucuccuacaaaguagcaucagagggauuucaauauucggauagacgguggugcuuugacggggagcguaauaaucaaguauuagaggagaacauggacguagaaauauggacgaaagagggcgaacguaagaaacugcguccucgcugguuagaugcccgaaccuauagcgacccccuggcacugcgugaguucaaagaauucgccgccggaagacgaucaguuucuggagaucuuauuuuagaaauaggaaaguuaccacaacauuuaacacaacgagcacaaaacgcgcuagauaacuugguaauguuacacaacuccgaacaaggagguagagcguaccgucaugcgauggaggaacugccugauacgauugagacguuaaugcucuuagcccuuaucgcuguacuaaccggaggggucacuuuauucuuucugucugggagagguuuagggaagacuuccauugguuuacuaugcgugauggcgucgucgguacuguuauggauggcuucuguugaaccccauuggauugcagccagcaucauauuggaguucuuuuugaugguuuuacucauuccagaaccugauagacaaagaaccccacaagauaaccaauuggcuuacguaguuauuggucugcuauucaugauacuaaccguugcagcgaaugaaaugggacuguuggagacgacuaaaaaagacuuagguauaggucauguagcagucgggaaucaccaucacgcugcgaugcucgauguagaucuccauccagcaucggcauggacacuguacgcuguggcaacuacuaucauaacccccaugaugcggcauacaauugaaaacaccaccgcuaauauaucucuaaccgcaauagcuaaccaggccgcgauauuaaugggauuggauaaaggauggcccaucucuaaaauggauauuggugugccuuuauuagcauuaggcuguuauagccaagugaauccauuaacauuaacggcagccguguugaugcugguagcucacuaugcaauaauugguccagguuugcaagcaaaggcaacccgugaagcacagaaaagaacugcagcuggaaucaugaaaaacccaacagucgacgggauaguggcgauagaucuagacccagucguguaugacgcgaaauuugaaaaacaacucggucaaauuaugcuacuaauccuguguacaucacaaauauugcuuaugcgcacaacgugggcacuaugcgaaucaauaacgcucgcaacuggaccucuuacgacgcucugggaaggaaguccugggaaguuuuggaacacaacuauagccguaucgauggcgaacaucuuucgaggaucuuaccuugccggcgccggucuagcuuuuucccucaugaaaucucuugguggaggacgucgcggaacuggggcgcaaggagaaacucuuggggagaaauggaaacgacaacucaaucagcuaucgaaaucggaauuuaacaccuacaaaaggaguggcauaauggaaguggacagguccgaagcgaaagaagggcuaaaacgaggugaaacuaccaaacacgcaguaucaagagggacagccaaacuaagaugguucgucgaacguaacuuaguuaaacccgaagggaaaguaauagaccuuggcuguggaagaggaggguggagcuacuacugcgccggacugaaaaaaguuacagaaguuaaagguuacacuaagggugggccugggcaugaagaaccuauucccauggcgaccuauggauggaaccuuguuaaacugcacucugguaaagauguauuuuuuauaccacccgaaaaaugugauacccuauugugugauauaggugaaaguaguccaaauccaacuaucgaagaagguagaacccucagaguccugaagaugguagaaccauggcuucguggcaaucaguucuguauaaaaaucuuaaauccauauaugcccaguguaguugaaaccuuagaacaaaugcagaggaaacauggaggaauguuagucaggaauccauuaagccgaaauucaacacacgagauguauuggguaucguguggaacagggaauauaguuucugcagugaauaugacauccagaauguuacuuaaucgauuuacaauggcacaucguaagccaacuuaugaacgagacguggaucuaggugcaggcacaagacauguagcaguugaaccagaaguagcgaaucuugauauaaucggacaaaggauagaaaacauaaaacaugagcacaagagcacauggcacuacgaugaagauaacccuuauaaaacaugggccuaccacggcagcuaugaagugaaaccuaguggaagcgcaaguucaaugguaaauggagucgucaaguuacuuacaaaaccgugggacguaaucccuauggugacacaaaucgccaugacggacacuacaccauuuggacagcaaaggguuuuuaaagaaaaaguugauacacgaacaccgaaagccaaacgcggaacagcccaaaucauggaaguaacagcaaaaugguuauggggauuuuugucuagaaacaaaaagccaagaauuugcacaagagaagaauucacgagaaaaguccgguccaaugccgccaucggagcaguauucguggacgagaaccaauggaauucggccaaagaggcaguugaggacgaacgcuucugggaucuaguucauaaagagagagaauuacauaaacaaggaaaaugcgcuacgugcguuuauaacaugaugggcaaacgggagaaaaaacucggagaauuugggaaagccaaagguucgcgcgcuauaugguauauguggcugggcgcccgauucuuagaguucgaggcacuaggcuuuaugaaugaagaucauugguuuagucgcgaaaacucgcuaucaggaguagaaggcgaaggccuacauaaauuagguuauauccuaagagauauaucaaaaauuccuggagguaacauguaugcagaugacacggcaggcugggauacucguauuacagaggaugaccuacaaaacgaagcacguauuacagauauaauggaaccugaacaugcuuugcuugccaagaguauuuucaaacucacauaucaaaauaaaguaguucgaguacagaggcccgcaaaaaauggcacagugauggauguuauuaguaggcgugaucaaagaggaucaggucagguaggaacauauggcuuaaacaccuuuacaaauauggaagcacagcuuauaagacaaauggaaagcgagggaauauucucgccaucugaacuggaaacuccaaaucuagcagagagaguucuugauugguuagaaaaauacggugucgaaaggcuuaagaggauggcaauuaguggugacgauugcguuguaaaaccgaucgaugacagguuugccacagcauugacggcuuuaaaugauauggguaagguucggaaagacauuccucaaugggaaccuuccaaaggcuggaacgauuggcaacaaguaccauuuugcucucaucacuuucaucagcucauaaugaaggauggccgagagauaguagucccauguagaaaucaagaugaacucguuggcagggcuaggguaucgcaaggagcuggguggucacugcgcgaaacggcgugccuugggaaaucauaugcccaaauguggcaauuaauguacuuucaccgaagggaccuaaggcuggccgccaaugcaauuugcucugcaguaccugucgauuggacaccuacaaguagaacgacaugguccauacaugcgcaucaucaauggaugacaacggaagauaugcucaguguauggaacagaguguggauugaagagaacccuuggauggaggauaaaacgcacauaucaaguuggggcgacgucccuuacuugggcaagcgagaagaucaauggugugggucauuaauaggucuaacagcuagggccacaugggcgacaaacauucaaguugcaauuaaucagguaagaaggcuuauaggaaaugaaaauuauuuggauuauaugacaucaaugaaacguuucaaaaaugaaagcgauccagagggagcccuaugguaa

SEQ ID NO: 21163 - RNA, 9879 nt, Artificial Sequence
  derived and/or modified CDS sequence (opt6) from DENV-1__GU131895__SS-prME
ucaguuacaauguuguuaaugcuuaugcccaccgcguuagcauuccauuuaacuacgcgagggggagaaccgcauaugauuguaucaaaacaagaaagggguaaaucacugcuauucaaaaccucagcaggggugaacauguguacguuaauugcaauggauuuaggugaacuuugugaagauacaaugacauauaaaugcccuaggauuacagaagcagaacccgaugacguagacuguuggugcaaugcaacggacacuuggguuacguacgggacguguucccagacgggagaacaucgacgugacaaaaggaguguggcacuagcgccgcauguagggcuaggacuagaaacgagaacggaaaccuggaugucuagcgaaggggcuuggaaacaaauacaacgaguggaaacaugggcuuugagacacccagguuuuacuguuauagcacuuuucuuagcacacgcuaucggaaccucaauaacgcaaaaaggcauaauauucauacuuuuaaugcuagugaccccaucaauggcgaugagguguguugguauagguucacgggauuucgucgaagguuuaaguggagcaacguggguagauguuguuuuagaacauggcuccugugugacgacaauggcuaaagacaaaccaacccuagauauugaacuucuaaaaacagaagucacaaauccagccauacuacguaaacuaugcauagaagcgaaaaucucuaacacaacuaccgacucaagauguccuacccaaggugaagcgacgcuaguugaagaacaagacgcuaauuuuguauguagaaggacguucguugaucgugguugggguaaugggugcggucuguuuggaaaaggcucauuaaucacgugcgcaaaauuuaaauguguaacaaaacuagaaggaaaaauaguucaauaugaaaaucuaaaauauaguguuaucguuacaguacacacgggggaccaacaccaaguaggaaaugaaaguacugaacaugguacuacagcuacuauaaccccacaagcaccaacaaccgaaauccaacugacagauuacggagcacuaacgcuggacuguucacccagaacaggucuagauuucaaugaaaugguauuacuuaccaugaaagaaaaaucuugguuaguucacaaacaaugguuuuuggauuugcccuuaccguggacuagcggagccagcacuucacaggaaaccuggaacaggcaagaucuauuaguaaccuuuaaaacggcgcaugcuaagaaacaagaaguaguaguacuuggaucacaggaaggugcaaugcacacggccuuaacaggagccacggaaauccaaacaaguggaacaaccacaauuuucgcuggucaucuaaaauguagguuaaaaauggauaaacuagcacuaaaaggaaugagcuaugucaugugcacugguucuuucaaauuggaaaaagaaguagcggaaacacaacaugguacaguccuaguacaaauaaaauaugaagguacagaugcuccaugcaaaauuccauuuucaacccaagaugaaaaagggguaacacaaaacgggcgauugaucaccgcuaacccuauuguuaccgauaaagaaaaaccuguuaacauagaagcagaaccaccuuuuggugaaagcuacauagucaucggagcaggggaaaaagcauuaaaacuuaguugguucaagaaagguucaucuauugggaaaauguuugaagcaacagcccgaggugcccgaagaauggcaauacuaggagacaccgcuugggauuuuggaucuauaggagggguauucaccagugucgguaagcuaguccaucagauuuuugguacagcuuaugggguucuguucucggguguuucuuggacaaugaaaauugguauuggaguccuucugacguggcuuggcuuaaacagucguucgaccaguuugagcaugacuuguaucgcaguugggcugguaacauuauaucuagguguuaugguucaagccgacaguggaugcgugaucaacuggaagggucgcgaguuaaaguguggcucaggcauuuuuguuaccaaugaaguacauaccuggacggaacaauauaaguuucaagccgauucaccgaaacgccuaagugcagcgaucgggaaggcuugggaggaaggcgugugcgguaucaggucagcaacccgacuugaaaauauaauguggaaacaaauaaguaaugaacucaaccacauauuauuggagaaugacaugaaauucacaguugucguaggugacguagcgggaauauuagcccaaggcaagaaaaugauucgaccgcaacccauggaauacaaguauaguuggaaaucauggggaaaagcuaaaauaaucggcgcagauguucagaacacaaccuuuauaauugauggaccaaauacgccagaauguccugaugaucaacgagcauggaacauaugggaaguagaggacuauggauucgggauauucacgacgaacauauggcucaaauuaagggauucguauacacaggugugcgaccaccgauugaugagcgcagcaauuaaagauaguaaagcaguacacgcagacauggguuacuggauugaaucugagaaaaaugagacguggaaacucgcacgagcgucuuucauagaagugaaaacaugcauauggccgaaaucucacaccuuauggucaaauggcguucuagagucugaaaugaucauccccaaaauuuaugguggucccaucagucaacacaauuaccguccaggcuauuucacacaaaccgcuggcccauggcacuugggcaaacuagaacuagauuuugaucuaugcgaggggacaaccgucguugucgacgaacauugugguaauaggggacccucgcuaagaacaacuacuguaacaggaaagauaauacaugaauggugcugcagaagcugcacauuacccccguuacgguuuagaggagaagauggauguugguauggaauggaaauacgacccguuaaagagaaagaagaaaaucuaguaaagagcaugguuuccgcgggaaguggagaaguugauaguuuuucacuaggcuuacuauguauaaguauaaugauagaagaaguaaugagaucuagauggagucgaaaaaugcuaaugacuggaacgcuugcaguguucuuacucuuaauaaugggucagcucacauggaaugacuuaauaagguugugcaucaugguaggggcaaacgcaucugauagaauggggauggggacaacauaucuggcucuaauggcgacauucaaaaugaggccaauguuugcaguaggucuuuuauuuaggcgcuuaaccucuagagagguauugcuauuaacaaucggccuuucuuuaguggccuccguagaauugccaaacucccucgaagaauuaggugacggguuagcaaugggcauuaugaucuuaaaauuauuaacugauuuucagagucaucaauugugggcuacccuacuaucucuuacauuuauaaagacaaccuuuaguuuacauuaugcauggaagaccauggccaugguccuuucgauuguaucucuauuuccucuuuguuuauccacgacaucccagaagacuacuugguugccaguccuauuagggagucuggguuguaagccuuugaccauguuuuuaauagcagaaaauaaaauaugggguagacguaguuggccacugaaugaaggaaucauggcaguagguauagucagcauuuuacuguccucccuacucaaaaaugauguuccauuagcgggccccuuaaucgccggugguaugcuaaucgcauguuacguuaucaguggcucuagcgcggacuuaucacuugagaaagcagcggaaguuucgugggaagaagaagcagaacauaguggugcaagccacaauauacuuguagagguacaagaugaugguacuaugaagauaaaagacgaagaacgagaugauacauuaacaauauuacuaaaggcaacacucuuagcagucaguggugucuauccacugucaaucccagccacacuguuuguaugguauuucuggcagaagaagaaacaaagaagcggagugcucugggacacaccgucacccccagaaguagaaagagcuguuuuagaugauggaauauacagaauaaugcagagagggcuucuuggccgaucacaaguaggcgucggugucuuucaggaaaacguguuccacacuauguggcaugugacaagaggugcaguguuaauguaucaaggaaaacgguuggaaccuaguugggcuucagucaagaaagauuuaauaaguuauggaggaggauggagacugcaagguucauggaauaccggggaagaaguacaagugauugccguugaaccgggcaagaaccccaaaaauguacaaaccgcuccuggaacauucaaaacaccagaaggugaagugggagccauagcucuagauuuuaagcccggcacaucaggaagucccauuguaaaucgggagggcaaaauagucgguuuauaugguaacgguguaguaacaacaagcgggacuuauguaucggcgauugcacaggcaaaggcaucacaagaagguccacuaccagagauagaagaugaagucuuuagaaaaagaaaccucaccauaauggauuuacacccaggaagcggaaaaacuagacgguaucuaccagcaauagugcgagaggcaauaaagcgaaaacuuagaacucucauuuuggcacccacacgagucgucgcaucagaaauggcggaggcacugaaaggaaugccuauacgauaucaaacuacagcgguaaagucagaacacacaggaaaagaaauaguugaccucaugugccaugcaaccuucacuaugaggcuauugucgccaguucgcguaccaaauuauaacaugaucauaauggacgaagcucauuucaccgacccuagcucgauagccgcacggggauauauuucaacaagagugggaaugggagaagcggcagcaauauuuaugacagcgacaccgccagguucaguagaggcuuucccccagucuaaugcaguaauacaagacgaagaaagagauauaccagagcgaucauggaacucgggguaugaauggauaacggacuuuccaggaaaaacuguaugguucguaccuaguauaaaaagugguaaugacauugcaaauugcuugaggaaaaauggcaaaagagugauucaauuaucacgcaaaacuuucgauacagaauaucaaaagacuaagaauaaugauugggauuacguagucacaaccgacauuuccgaaaugggggcaaauuuuagagcggacagaguuaucgauccaagaagaugucuuaagccuguaauucuaaaggacggcccagaaagaguaauucucgcugguccuaugccgguaacaguugccucugcggcacaacgaagagguagaaucggaaggaaucacaacaaagaaggagaccaauacauauauaugggacaaccuuuaaacaaugaugaagaucacgcgcacuggacggaggcaaagauguuacuagacaauauaaacaccccagaagguaucauuccagcgcuuuucgaaccagaacgggaaaaaucggcggcaauagacggagaguauagacuuaggggcgaagcacggaaaacauuuguugaguuaaugcgaagaggagauuugccagugugguuaucauauaaagucgcgagcgaagguuuccaauacagugaccgaagguggugcuucgacggggaaaggaauaaccaaguccuugaagagaauauggauguugagauauggacuaaagaaggugaaaggaagaaacuacguccuagguggcuggaugcaagaacuuauucggauccacuugccuugagagaguucaaggaguucgcggccgguagacgaagugugucuggagacuuaauacuagaaauaggcaaacuaccacaacaucuaacacaaagagcacaaaacgccuuggacaaucuggucaugcuccacaauucagaacaaggcgggagagcguauagacacgcaauggaggaauuaccagauacaauagagacauuaauguuauuagcacugauagcaguucuaacaggaggugugacuuuguuuuuccuuucgggucgaggacucggaaagacuagcaucggacugcugugugucauggcaucgaguguacuguuguggauggcaagcguagagccacauuggaucgccgcuucaauuauucucgaguucuuucucaugguucuuuugauaccagaaccugaucggcaaagaacuccgcaagacaaccaguuagcauauguuguaauaggguuguuauuuaugauucuaaccguugcagcuaaugaaaugggauuacuagaaacaacuaagaaagaucuaggaauuggacacguugccguggguaaucaccaucaugcugcuaugcuugacguggaucuacauccagcuucagcguggacacuuuaugcaguugccacaacuauaauaaccccaaugaugagacauacuauagaaaauacgacggcaaacauaagccucacagcaaucgcuaaucaggccgcaauauugaugggacuugacaaaggguggcccauuucuaaaauggacaucggcguucccuuacuagcguuaggcugcuacucacagguuaacccacuaacgcugacagcagcuguuuuaaugcuaguagcacauuacgcgauaaucggcccagggcuacaagcaaaagcuacaagagaagcacagaaaagaacugcagccggcauuaugaaaaauccuaccguagauggaaucguugccaucgauuuggacccaguuguauaugacgcuaaauucgaaaaacaauuaggacaaauuaugcuauuaauauuauguaccucgcaaauucuucugaugagaacuaccugggcacuaugugaguccaucacacuagcaacuggaccuuuaacgacgcuaugggaagggucaccagguaaauuuuggaauacaacaaucgcuguguccauggccaauauauuucguggaucauauuuagccggagcgggucucgcguuuagucugaugaaaucacuaggcggaggaaggcgggggaccggggcacaaggugaaacauugggggaaaaauggaagagacaacuuaaccaguuaaguaaaucggaguucaauacuuacaaacgauccgguauuauggaggucgaucggucugaagccaaagaaggacuaaagagaggggaaacaacaaaacaugcagucaguagagguacagcuaaauuaagaugguucguugaaaggaauuuaguuaagccagaagguaaaguaaucgauuuaggaugugguaggggaggauggagcuacuauugugcggguuugaagaaaguuacagagguaaaagguuauacgaaaggaggaccgggucaugaggaaccaauaccaauggcuacguacggguggaaucucgucaaacuccauucgggaaaggacgucuuuuucauuccaccugaaaagugugacacauuacuuugugauauaggggagucaaguccaaaucccacuauugaagaagggcgaacacuaagaguucuuaaaaugguagagccuugguuaagaggaaaucaauuuugcauaaagauucuuaaucccuauaugccuagcguaguagaaacuuuagaacaaaugcaacgaaaacauggaggaauguuaguaagaaauccccuaaguagaaauucaacgcaugaaauguauuggguaagcugcgguacagguaauauagugucagcagugaauaugacuucgaggaugcuucucaaccgguuuacgauggcucacagaaaaccaaccuaugaaagagauguagaccucggcgccggaacacgucaugucgcagucgagcccgaaguugcaaauuuagacauuauagggcaacgcauugaaaacauuaaacaugagcacaagucgacauggcauuacgaugaagacaaccccuacaagaccugggcuuaucacggcucuuacgaagugaaaccuaguggaucggcgaguucuaugguuaacggaguagugaaacuucuaaccaaaccaugggacguuauacccaugguuacucaaauugcaaugaccgauacaacucccuuugggcagcaacgcgucuuuaaggaaaaaguggacacuaggaccccuaaagcaaagagaggaaccgcgcaaauuauggaaguaacugcgaaaugguuauggggguuucuaucaagaaacaagaaaccacgaaucugcaccagggaggaguucacaagaaaagugagauccaacgcagcuauuggggcuguauuuguugacgagaaucaauggaauagcgcuaaagaagcuguagaagacgaacgauucugggauuugguucacaaagaaagggaguuacauaaacaagggaagugugcaaccugcgucuauaacaugaugggaaagagagagaagaaauuaggagaguuugguaaagcaaaagggucaagagcaauaugguacaugugguuaggugcccgauucuuagaguucgaagcguuaggauuuaugaacgaggaucauugguuuucuagagaaaauagccucagcggaguugagggggaaggauuacauaaacuuggauacauacuuagagauauaucgaagauuccgggaggcaacauguaugcggacgacacagcgggaugggacacacgaauuacagaggacgaucugcaaaacgaagcucguauaacugauauuauggaacccgagcaugcacuauuggccaaaucuauuuuuaaacuuacuuaucaaaacaaaguagucaggguucagagaccagccaaaaacggcacuguaauggacgugauaagccgaagagaucaacgaggauccggucagguaggcacauacgguuuaaauacauuuaccaacauggaagcacaacuaauaagacagauggaaagugaaggcauuuuuaguccguccgagcuagagacuccuaaucuggcugaaaggguguuagauuggcuagagaaauauggcgucgagagacuaaagaggauggccauuucaggcgaugauuguguaguuaagcccauagacgacagauucgcaacggcucuaacagcucuuaacgauauggguaaaguccggaaagauauuccacagugggaaccuaguaaaggauggaacgacuggcagcaagucccauuuugcagucaucacuuucaucagcuaauuaugaaagauggcagagaaaucguaguaccaugucguaaccaagaugaacugguggguagagcuagggucagucaaggagcgggauggucuuugcgagaaacggcuugccuggguaaaucauacgcacagauguggcaacuuauguauuuucacagacgcgaccuuagauuagcggcaaacgccaucuguucagccgugcccguagauuggauuccaacgagucgaaccacguggaguauacaugcccaucaucaauggaugacaacggaggauaugcuaagugucuggaaccgaguguggaucgaagagaauccguggauggaggauaaaacacacauuaguucauggggugaugugccuuaucuaggaaaaagagaggaucagugguguggaucacugauuggacugacugcacgggcaacaugggcgacuaacauccagguugcuaucaaucaaguuagacgauuaauaggcaacgaaaauuaucucgauuauaugaccagcaugaaaagauuuaaaaaugaaucggauccagagggagcauugugguga

SEQ ID NO: 21164 - RNA, 9879 nt, Artificial Sequence
  derived and/or modified CDS sequence (opt6) from DENV-1__GQ868632__SS-prME
ucaguuacaaugcuucucaugcucaugccaacagcucuagccuuccaccugacuacacgcggaggggaaccacauaugauugucucaaaacaagaacggggaaaaagucuacuauuuaaaacaucugcgggaguuaauauguguacgcuaauagcuauggacuugggagaacuuugcgaagacacaaugacguauaaaugcccccguauuacagaagcugaaccggaugauguagacugcugguguaaugcaacagauacuuggguaacauacggcacaugcucucaaacgggggaacaucgaagagauaaacguucggucgcccuggcgccacauguuggacuaggccuugaaacacguaccgaaaccuggaugucuagugaaggagcauggaaacaaauccagcgcguugaaacaugggcacuucgccauccgggauucacuguaauagcacuauuucuggcucacgcaaucggcaccucgaucacucaaaaaggaauaauauuuauuuuauuaauguuaguuacacccucaauggcaaugagauguguuggaaucggaagcagagacuuugucgaaggucuaucaggggcaacguggguagauguggucuuagaacacggauccugugucacuaccauggcgaaagacaaaccaacucuugauauugaacuacuaaaaacugaagucaccaauccagcaauacuuagaaaacuuuguauagaagccaaaauuaguaacacgaccacagauucuaggugccccacccaaggggaagccacccuaguagaagaacaggaugcaaauuuuguauguaggagaacguuuguagaucgagguugggggaauggaugcgggcuauuuggaaaagguuccuugauaacaugugcaaaguuuaaauguguaacgaaauuagaagguaagauuguacaauaugaaaaucuaaaauacucagugauugucacaguucacacuggugaccagcaccaaguagguaaugaaagcacagagcacgguacaacugcaacuauaaccccucaggcuccaacaaccgagauucagcuaacagauuauggagcuuuaacucucgauugcucuccccgcacuggauuggauuuuaaugaaaugguauuauugaccaugaaagaaaaaucguggcuaguacacaagcaaugguuucuugaccuaccccugccuuggacaucuggagcuaguacgucacaagaaacuuggaauagacaggaucuucuggucacauucaagacagcacaugcgaagaaacaagagguugugguauuagguucucaggagggggcaaugcacacagcacuaacgggagcaacugaaauucagacuucuggaacuaccacaauauuugcaggucaucucaaaugccgacugaaaauggauaagcuaacgcuuaaagguguuucauauguaauguguacuggaaguuuuaaauuagaaaaagaaguggcugaaacgcagcauggaacaguuuuaguacaaauaaaauaugaagguaccgaugcaccuuguaaaauaccauuuucgacucaggacgagaaagguguaacucaaaacggacgacuaauaaccgcaaaucccauaguuacugauaaggaaaaaccggugaauauugaagcugagccaccauuuggagaaaguuacauaguaauaggugcaggggagaaagcacuaaaauuaagcugguucaagaaagguucuucaaucggaaaaauguucgaagcaacggcuagaggcgcuagaagaauggccauacuaggugauaccgcgugggauuuugguuccauuggugggguauucacuagcguaggcaaauuaguucaucagauauucgguaccgcguacggcguacuauucucagggguuagcuggacaaugaaaauagggauugguguguuacuuacauggcuugggcuaaacaguaggucuacgucacugucaaugacauguaucgcuguuggauugguaacauuguacuugggcguuaugguccaagcugauaguggcugcgugauuaauuggaagggacgagaacuaaaauguggaucaggaaucuucguaacaaacgaaguccauacauggaccgaacaguacaaauuccaggcagacucaccaaagagguugucagcagcaaucgguaaagcaugggaagaggggguguguggaauuagaucugcaacuagacuggaaaauauaauguggaaacagauaucaaacgaauugaaccacauuuuauuagaaaaugacaugaaauuuacgguaguaguuggugaugucgccggcauucuagcccagggcaagaaaaugaucagaccacagccaauggaauauaaauacucauggaaaagcugggguaaagcaaaaauuauuggagcagacguacagaauaccaccuuuauaauagacgguccgaauacaccugaauguccggaugaacagagggcuuggaauauaugggaaguugaagacuacggcuucggaauuuuuaccacgaauauauggcuaaaauugagagauucauacacacagguaugugaccaccguuugaugagugcagcaauuaaggauaguaaagcaguucacgcggacauggguuauuggauagaaagcgaaaagaaugaaacauggaaguuggcuagagcaucauuuauagaaguuaaaacuuguaucuggccaaaaucucacacauuguggucuaacgguguacuagagagcgaaaugauaauacccaagauuuauggaggacccauaucucaacacaauuaucgaccaggguauuucacccaaacagcugguccauggcauuuagguaaauuagaguuagauuuugaucuaugugaaggaacgacagugguuguggaugaacauuguggaaaccgcgguccaucuuugcgaacaaccacggugacggguaaaauaauacaugaaugguguuguagaaguugcacauuaccaccacuacguuucagaggggaggaugguugcugguaugguauggaaauuagaccaguuaaggagagagaagaaaaucuaguuaagagcauggucuccgcaggcuccggagaaguggauucuuuuucauuggggcuacuguguauaagcaucaugauugaagaaguaaugagaagucgguggucacgaaaaauguuaaugacagguacacuggcuguauuuuugcuacuaauaaugggucaguuaaccuggaacgacuuaaucagauuguguauaaugguaggagcaaaugcaucagaucgcaugggaauggguaccaccuaucuagcauugauggcaacuuucaaaaugagaccaauguucgcaguaggacugcuuuuuagaagacucacaagcagagaaguguuacuccuaacuauuggauuaucauuaguagcuagcguagaauuaccaaauagucuugaagaguuaggggacggccucgcuauggguaucaugauacugaaacuccugacagauuuccaaucccaucaacucugggccacccugcugucacuaacuuucauuaagacuacauuuagccuucauuaugccuggaaaaccauggcuaugguccuuagcauuguaagucucuuuccgcuguguuuaucuacuacuucccagaaaacgaccuggcuaccaguuuugcuaggcaguuuaggcugcaaaccguuaacuauguuucuaauugcggaaaacaaaauauggggccgcagauccuggccacucaacgaaggaauaauggcaguugguauaguauccaucuuauuaagcucguuucucaagaaugacgugccacuagcaggaccauugauagcgggaggaaugcugauagcuuguuaugucauaucagguuccucagcggaucucucuuuagaaaaagcagcagaaguaucaugggaagaagaagccgaacauucaggugcuagccauaacauccuaguggaaguccaagaugauggaacgaugaaaauuaaagacgaggagagagaugauacacuaacuauuuuauuaaaagccacuuuacuagcuguaagugggguauaucccuuaucaaucccagcaacauuauucgucugguauuucuggcagaagaagaaacaaaggucuggcgugcuaugggauacccccuccccuccugaaguagaaagagccguacuugacgauggaauuuaucgaauuaugcaaagaggacuacucggccggagucaaguuggcguuggcguauuucaggagaacguuuuccacacuauguggcaugugaccagaggugcaguacuaauguaccaagguaagcgccuagagccuucuugggcaucuguaaagaaagaccugauuucauauggcggugguuggcgauugcagggaucuuggaacaccggagaggaaguacaaguuauagcgguagaaccaggcaaaaauccgaaaaacguacagaccgcaccgggaacauuuaaaacgccggaaggagaaguaggugcgauugcauuagacuuuaaaccuggaacgucaggaucaccuaucguuaauagagaaggaaaaaucguaggacucuacgguaacggcguaguaacaacaucugggaccuacguuagugcaauugcucaagcaaaagccucccaggaggggccguuaccagaaauagaagacgaaguauucagaaaacgcaaccuaacaaucauggaccuacacccuggcagcggcaaaaccaggagauacuuaccagcaauaguacgagaagcgauaaaaagaaaacuaagaacauuaauuuuagcacccacacgcguugucgccucggaaauggcagaggcacuuaaagguaugccaauccgcuaccaaacgacagcgguaaaaagugagcacacugggaaagaaauaguggaccuuaugugucaugcgacauucacaaugagacuccuaagcccuguucgagugccaaacuauaauaugauuauaauggacgaagcacauuuuacagacccuaguucaaucgcugcacgaggauacaucuccacaaggguagguaugggugaagcagccgcuauauucaugaccgcgacaccaccagggucuguagaggcuuucccccaguccaaugccguuauccaagaugaggaacgagacaucccagaacguucguggaacucagguuacgaguggaucacagauuuuccaggaaagacugucugguuugucccaucaauaaaaaguggaaacgauauagccaacugucuuaggaaaaaugguaaaagagucauacaacugucgcgcaaaacauuugauacagaauaccagaaaaccaaaaauaacgacugggauuaugucgugaccacggacaucagugagaugggcgccaauuuuagggcugaucgugucauugacccaagaaggugcuuaaagccagucaucuuaaaagacgguccugaaagaguuaucuuagcagggccgaugccuguuacaguagcaucagcggcccaacguagaggcagaaucggucguaaccauaauaaggaaggcgaccaguauauuuauaugggucagccucugaauaacgaugaagaccacgcgcacuggacugaagcuaaaaugcuauuagauaacauaaauacacccgaagggaucauaccugcucuauuugaacccgaacgggagaaaagugcagcgauagacggagaauaccguuuacguggugaagccagaaaaacuuucguagaacucaugcgacgcggagaccuacccgugugguuaucauauaaaguggcgagcgaaggauuucaauauuccgaccgaagguggugcuuugacggggaaagaaauaaucaaguacuagaggaaaacauggauguugaaauuuggaccaaggagggagaacgcaagaaacuacgcccacgaugguuagaugcaaggaccuauagugauccguuagcguuaagagaguuuaaagaauuugcugcgggacgaaggucagucucgggugaucuaauccuggaaauaggaaaacugccucagcaucuuacucagagggcacagaacgcucuagacaacuuggugauguuacacaacagugagcagggagggagggcuuauaggcaugccauggaagaauuaccggacacaauagagacacucauguuacucgcauuaauugcaguucucacgggaggcgucaccuuauuuuucuuaucuggccgagggcugggcaaaacaagcauugggcuucuuugcguaauggcuaguucaguguuauuauggauggcuucaguugagccgcauuggauugcggcuagcauuauauuggaguucuuucuaaugguucuacuaaucccugaaccugauagacagagaacaccacaagauaaccaauuagcauacguuguuauaggccuccucuuuaugauucuaacugucgcggcuaaugaaaugggguuguuggaaacgaccaagaaagaucuaggaauaggacauguagcuguagggaaucaucaucaugcagcaauguuggauguagacuugcacccggcaucugcauggacgcuauaugccgucgccaccaccauaauaacuccuaugaugcggcauacgauagaaaauacaaccgcuaauauaucccuaacugcgauagcaaaccaagcagccauucuaaugggguuggacaaaggauggccaauaagcaagauggacauaggcguuccccucuuggcacugggcuguuauucacaggugaacccauuaacacuuacagcagcuguccuuaugcugguagcccauuacgcaauaauaggaccuggccuacaagcaaaagcaacuagggaagcacaaaagagaaccgcggcaggcauuaugaagaauccuacuguagacgggaucguagccauagaccuagauccugugguuuaugacgcaaaauuugaaaaacaacuaggccagauaauguuacuaauucugugcacaucucaaauacuacuaaugaggacuacaugggcucuuugugaaaguauaacauuagcaacaggaccgcucacgacauugugggaaggaucaccggguaaguucuggaacacaaccaucgcaguuucuauggccaauauauuuagggguucauaucuagcuggggcugggcuugcuuuuucacuuaugaaaucacucggcgguggccguagaggaacuggagcucaaggugagacuuugggcgaaaaauggaaaaggcaauugaaucaauuguccaaaagugaauuuaacacuuauaaaaggucuggaauuauggagguagaccguucugaggcaaaagaagguuuaaaacggggagaaacgaccaaacaugcagucucaagaggaaccgcaaaacuacgaugguucgucgaaaggaaucuugucaaaccugaaggaaaagugauagacuugggauguggaagagguggguggaguuauuauugugcaggauuaaagaaaguuacugaagucaaggguuauacgaaagggggaccaggccaugaagaaccaaucccgauggcaacguauggcuggaauuugguaaaauuacauaguggaaaagauguguucuuuauucccccggaaaaaugugauacacuuuugugcgauaucggagaaaguucgccaaauccaacuauagaagaagguagaacauugcggguacuaaaaaugguagaaccuuggcugcgagguaaucaguuuuguauuaaaauuuugaacccuuauaugccaagcgugguagagacguuggaacaaaugcaaagaaaacacggaggcauguuaguaaggaauccacucucaagaaauucuacucaugaaauguauugggugucaugcggaaccggcaacaucguaucagcuguaaauaugacaucucgaaugcugcuaaacagauucacaauggcacaucguaagccuacauaugaaagagauguagauuugggugcuggcacucgacauguagcuguagaaccagaaguugcaaaccuagauaucauuggccaaaggaucgaaaacauaaagcaugaacauaaaucuacuuggcauuaugacgaagauaacccuuacaaaacgugggcauaucacggcagcuacgaagugaagccuagcggaagugcuucuagcaugguaaacggugucguuaaauuacugacgaaaccaugggacguaauccccaugguaacacaaauugcaaugacugauacuacacccuuugggcaacaaagaguauuuaaagaaaagguagauacaagaacccccaaggccaagagagggaccgcacaaaucauggagguuacagcaaaaugguuaugggguuuucuuagucgaaauaagaaaccgaggauuugcacucgcgaggaauuuacuagaaaaguaaggaguaaugcugcaaucggugcaguuuuugucgaugagaaucaauggaacuccgccaaagaggcuguagaagaugaacgcuucugggaccuaguacacaaagaaagagaguuacacaaacagggaaaaugugcaacauguguauacaauaugaugggaaaaagagagaagaaauuaggugaauuugggaaagcaaaaggcuccagagcaauaugguacaugugguuaggagcaagauuuuuggaguucgaagcauuaggcuuuaugaacgaagaucauugguuuaguagggaaaauucacugagugguguagaaggcgaagggcuucauaaauugggauauauccugcgagauauaucuaaaauucccgguggaaauauguaugcagaugacaccgcaggaugggauacacgaauaacugaggacgaccuacaaaaugaagcaaggauaacagauauaauggagccugaacaugcguuacuugcgaaaucaauauuuaaacuuacuuaccagaauaaggucguuaggguccaaagaccugcuaaaaacggcacagugauggacguuauaagcaggagggaucagagaggaucgggucaaguggggacuuauggguuaaauacguuuacgaauauggaagcucaauuaauacgucaaauggaaucugaaggaauauuuuccccaucagaacuagagacaccgaauuuagcagaaagaguccuugauuggcucgagaaguacggaguggaacgcuuaaaacguauggcgauaagcggagacgauugcguuguaaaaccaauugacgaccgauucgcaacggcgcucaccgcauugaaugacauggguaaaguacgaaaggacaucccgcaaugggaacccucaaaggguuggaacgauuggcaacaaguacccuucuguagucaccauuuucaucaacuaauaaugaaagacgguagagagauuguaguuccuugucggaaucaagaugagcuagucggccgagcgcggguuucgcagggggccggauggaguuuaagggaaacagcuuguuuagguaaauccuacgcgcaaauguggcagcuaauguacuuccaucggcgagacuugaggcuggcugccaacgcaauuuguagugcaguaccgguugauuggauuccuacguccaggacuacauggucuauacaugcacaccaucaauggaugacaacagaagauauguugucaguauggaaccgcgucuggaucgaggaaaauccauggauggaagauaaaacacauauaaguucuuggggcgacguaccuuaucucggaaagagggaagaccaauggugcgguucacuuauaggucugacugcacgugcaacaugggcuaccaauauucaaguagcaauuaaucaagucaggcgccucauaggaaacgaaaacuacuuggauuauaugaccaguaugaagagguucaaaaaugaaucggacccugaaggcgcucuuugguaa

SEQ ID NO: 21165 - RNA, 9879 nt, Artificial Sequence
  derived and/or modified CDS sequence (opt6) from DENV-1__GQ868633__SS-prME
ucagucacuaugcuacuaaugcuaaugccuacugcccuagcauuccaccugacgacaagaggaggggaaccacauaugaucguaucgaaacaagaacgagggaaaucauuacuauucaaaacaagugcgggagugaauaugugcacauuaauugcaauggacuuaggggaacuaugugaagacacuaugacauacaaaugcccacguauuacugaagcggaaccggaugaugucgauuguuggugcaacgcgacagacacuugggugacuuaugguacuuguucucaaaccggugaacaucgaagagauaaacgaagcguugcucucgcaccccaugugggcuugggccuggaaacacguacugaaacuuggaugagcucugaaggagcauggaaacaaauucaaagaguugaaacgugggcacugagacauccaggauucacagucauagcuuuauuucuugcacaugcgauagggaccaguauuacgcaaaaaggaauaauuuucauucugcuuaugcuuguuacaccaucaauggcuaugagaugcgucggcaucggcucuagagacuucguggaaggacuuagcggugcuacauggguggauguaguacuagaacauggaaguugugugaccacgauggcaaaagauaaacccacgcucgauaucgaguuacuaaaaacagaaguuacuaacccagcaaucuugaggaaauuaugcauugaagcuaagauuagcaauacgacaacagauagucgcugcccaacccaaggugaggcuacgcuaguagaagaacaagacgcaaauuuuguauguagacguacguucguagaucgaggauggggaaacggauguggguuauuuggcaaaggcucauuaauaacgugcgcgaaguucaaaugugugacaaagcucgagggaaagauaguacaauaugagaacuuaaaauacagugugauaguaacuguacacaccggagaucaacaucaagugggaaaugaaucgacggagcauggaacaacugcuaccauuacuccacaagcacccacaacagaaauccaauuaaccgauuauggggcgcugacacuagauugcucgccaagaacagguuuggauuucaacgaaauggugcucuugacgaugaaagaaaaaucguggcuaguucacaaacaaugguuuuuagaucuuccgcucccguggaccucaggugccucaacgagucaagaaacauggaauaggcaagacuuacugguuaccuucaaaacagcucaugcuaagaaacaagaagucguaguacuagguagccaagaaggagcgaugcacacagcauuaacaggcgcaacagaaauacaaacaagugggaccaccacgauauuugcuggucauuuaaaaugcagauuaaaaauggauaaacucacacuuaagggcaugaguuauguaaugugcaccgguucguucaaguuagagaaagaagucgccgaaacgcaacacgguacaguguuaguucaaauuaaauacgaaggaacagaugcuccaugcaagauuccuuuuuccacccaagacgaaaaagggguaacgcaaaauggaagauuaauaacggcaaauccuauaguaacagacaaagaaaaaccuguaaacaucgaagcggaaccuccauuuggggaaagcuauauaguaauuggcgcaggcgaaaaagcucuuaaguuaucgugguuuaagaaaggaaguaguauagguaagauguuugaagcgacagccagaggagcgagaaggauggcuaucuuaggugacacagcgugggacuucggaucaauaggaggugucuuuacaaguguugguaagcuaguacaucaaauauuuggaacagcuuauggaguguuguuuagcggcguaucauggaccaugaaaauaggaauaggaguauugcucacauggcucggccuuaauucuagaagcacaagucuaaguaugacuuguauagcagucggacuuguaacacucuauuuaggaguuaugguacaggcagauucaggauguguaaucaauuggaaaggccgcgaguuaaaauguggaaguggaauuuucguaacaaaugagguacauaccuggacugagcaauacaaauuucaagcagauucuccgaagcgcuuguccgcagcgaucggaaaagcgugggaagaagguguuuguggaaucagaagugcaacuagacucgagaacauuauguggaaacaaauuucaaacgaauuaaaucauauccuacuggaaaacgauaugaaauucacaguuguaguaggcgacguagccggcauucuagcacaagguaaaaagaugauuagaccacagccaauggaauauaaauacagcuggaagaguugggguaaggcuaaaauaauaggagcugauguacaaaacacaacauuuauuauagauggaccaaacacgcccgagugccccgaugaucaacgagcuuggaauauuugggaaguugaagauuauggcuuugguauuuucacuaccaacaucugguugaaacuacgugacaguuauacucaaguuugcgaucauaggcucaugucagcagcgaucaaggauaguaaggcgguucaugccgauauggguuauuggaucgagucagaaaagaaugagacuuggaaauuagcuagggcaucauucauagagguuaaaacuugcauauggccuaaaagucacacauugugguccaauggcguguuagaauccgaaaugauuauuccaaaaauauauggcggaccgauaucacaacacaacuaucggccgggauacuuuacgcagacugcgggaccuuggcacuuggguaagcuggaacuugauuucgaucuaugugaaggaacaacuguaguaguugaugaacauuguggaaaccguggcccuucucucagaacgacaacaguaacagggaagauaauacaugaaugguguugcagaaguugcacucuaccaccauuacgcuucaggggagaggauggauguugguauggaauggaaauaaggcccguaaaagagaaagaagaaaauuugguaaagagcaugguuagugcagguucaggagaagucgauagcuucagucuagggcuucuaugcauuagcauaaugauagaggaaguaaugaggaguagguggaguagaaaaaugcuuaugacuggaacgcuagcaguauuccuuuuauuaauuaugggacaacuaacauggaaugaucuaauaagauuauguaucaugguuggugccaacgcaagcgacagaauggguaugggcacgacauaucucgccuuaauggcaacauuuaagaugagaccgauguuugcggugggacuacucuuucgacgacuaacaucccgagaaguuuuacuccuuacaaucggacuuagucuaguagcuagcguagaguugccaaauucauuggaggagcuaggagauggauuggcuauggggauuaugauccugaaauuacuuacagauuuucagagccaccaauugugggcaacucugcugaguuuaacguucauuaaaacaaccuucucgcuacauuaugcauggaaaacgauggcgauggugcuauccauuguaucacuauuuccccuaugcuugagcacuacgucgcagaaaaccaccugguugccggucuugcuaggcagucuaggauguaagccgcuaaccauguuuuugaucgccgagaauaaaauauggggccggagaagcuggccacugaaugaagguauuauggcugugggaauagucucaauacuauugagcucccuucuuaaaaaugaugucccuuuagccgguccacugauugccggaggcaugcuaaucgcaugcuacguaauaucagggucaagugcugaucucaguuuggaaaaagcggcagaaguuucgugggaagaggaagcggaacacucuggcgcuagucauaacauucucguggaggugcaggacgauggaaccaugaagauaaaagacgaagaaagagacgacacucuuacaauccuauugaaggccacacuacucgcaguaagcggagucuacccuuuaaguauaccagcaacacuauucguaugguacuuuuggcagaagaagaaacaaagaagcggaguguuaugggauacaccaaguccacccgaaguugaacgagcgguauuagaugaugguauuuaccgaauaaugcaacgaggacugcuggggcggagccaagucggaguaggcguauuccaagaaaacguauuucacacaauguggcaugucacacgaggugcaguacuuauguaccaagguaagcgauuagagccuagcugggcaucaguuaagaaagaucuaauaaguuacggcggagguuggagguugcaaggaaguuggaauaccggugaagaaguacaagucauugccgucgaaccagguaaaaaucccaaaaacgugcaaacagcgccggggacuuucaaaacaccggagggggagguaggagcaaucgcauuagacuucaaaccggguaccucgggaucaccaauugucaaucgggagggaaagauagucggacucuaugggaacggcguuguuacaacgucaggaacauaugucucugcuauagcacaagcaaaggcaagucaagagggcccucugccggaaauagaagacgaaguauucagaaagcgaaauuuaacaauaauggaucuucaucccgguaguggaaagaccagacgcuaccugccagcuauaguacgugaagcaaucaaacguaaacuucgaacuuugauucuagcuccaacccgcgugguggccucugagauggcagaggcuuugaaaggaaugccaaucagauaucaaacaaccgcgguaaaaucagaacacacagguaaagaaauuguugacuuaaugugccacgccacauuuaccaugagguuauuaucgccgguuagaguaccaaacuauaacaugauaauaauggacgaagcccacuuuacagauccgucuagcauagcagcaagagguuacauaagcacacgcgugggaaugggagaagcugcagcuauauuuaugacagccacuccaccagguagugucgaggccuuuccucagucaaaugcgguaauucaagaugaggaacgagauaucccggaacgaucuuggaacucugguuaugaauggauuacagacuuuccagggaaaaccgucugguuugugcccucuauaaaauccgguaaugauauagcuaauugcuugcggaaaaaugguaaaagaguaauacaauuaagucgaaagacauucgacacagaguaucagaaaaccaagaauaaugauugggauuacguaguaacuacggauauaagcgagaugggagcuaauuuuagagcagaucgcgucauugauccacgucgaugcuuaaagcccguuauuuugaaagaugggcccgaacgaguuauucuagcaggcccaaugcccguaacagucgcuucagcagcacagcggcgcggacgaauaggaagaaaucacaauaaagaaggagaucaguauauauauauggggcagccuuuaaacaaugacgaggaccacgcucauuggacagaagccaagaugcugcuggauaauauuaacacaccagaagguauaauuccugcacuauuugaaccggaaagagaaaagagcgcagcaauugauggagaguaccguuugaggggugaggcgagaaaaacguucguagaacuaaugagacgaggugaccucccagucugguugaguuauaaagucgcaucagaaggguuucaauacucagauagacgcuggugcuuugacggcgaacgaaacaaccaaguccuugaagagaacauggauguagaaauauggacaaaagaaggugaacgaaagaaacuuagaccacgaugguuagaugcacgaaccuacagugauccacucgcauuaagagaauuuaaagaguuugcagcugguagacguaguguuagcggagacuuaauauuggaaauugguaaacuaccucaacaucuuacacaacgagcacaaaaugcucucgauaaucuaguaauguuacauaauagugaacaaggagggagggcuuacaggcacgcaauggaagaguuaccugauacuauagagacacugauguuguuggcccuuauagcuguauuaaccgguggaguaacauuauuuuuccuaaguggccgaggucuuggcaaaacaucuauaggucuacugugcguaauggcgucaucuguccuguuauggauggcaucaguagaaccacacuggaucgcagcgaguauaaucuuagaauuuuuccuaauggugcuacuaauacccgaacccgacaggcagagaacaccucaagacaaccaacuugcauaugucguaauaggccuccucuuuaugauucuuacgguagcagcuaaugaaaugggcuuguuagaaacaacuaagaaagaucuaggaaucggacauguagcuguuggcaaccaucaccaugccgcgauguuagacguugauuuacacccagcaagugcguggaccuuauacgcaguagcaaccacaauuauaacgccaaugaugcgccauacaauugaaaauacaaccgcaaacauuucacuaacugcaauagcuaaccaagcagccauacuuaugggguuagauaaagguuggccaauaagcaaaauggacauaggaguuccacuuuuggcuuuaggaugcuacucacaaguaaacccucuaacuuuaaccgcggcaguccuaaugcugguagcacacuacgcuauuaucgggccaggauuacaagcgaaggccacuagagaagcacagaaaagaaccgcggccgguauaaugaagaaucccacgguagauggaauaguagcaauugacuuagacccaguaguguaugaugcuaaauuugaaaaacagcuaggacaaaucaugcuuuuaauuuuaugcacgucgcagauauuauuaaugcgcacaaccugggcguuaugugagucuaucacgcuagcgacagggccacuaaccacauuaugggaaggauccccuggaaaauuuuggaacacgacaauugccgucucuauggcaaacauuuuuagaggcucuuaucuggcaggggcuggauuagcuuuuagucuuaugaaguccuuaggugguggaagacgagguacuggagcgcaaggagagacguuaggagaaaaguggaagaggcaauugaaucaauuaaguaaaucugaauuuaauacauauaaacguaguggaaucauggaaguggauagaagcgaagcaaaagagggacuuaagagaggcgaagcaacaaagcacgcaguuucuagggggccugccaaauuaagaugguuuguggaaagaaauuuaguuaacccagagggaaaaguuaucgauuuagguuguggaagagguggauggucguauuacugcgcaggucuaaagaaaguaacugaaguuaaagguuacacuaagggaggcccaggucaugaagaaccaaucccuauggcuacauauggauggaauuuaguuaaguugcacucagguaaagauguauucuuuauaccaccagaaaagugcgacacauuacugugcgacauaggagaauccuccccuaauccaacgauugaagagggaagaacacugaggguuuuaaaaaugguagaaccguggcuuagagggaaucaguuuugcauaaaaauacugaaccccuauaugccaagcguaguugaaacucuagaacaaaugcaacguaaacauggcgguauguuggugagaaacccccugucacgcaauuccacccaugaaauguauugggucucaugcggaacaggaaacauugucagugcgguaaacaugacgucgcguauguuacuaaaccgauuuacgauggcacaucguaaaccuaccuaugagcgggaugucgaccuaggugcggggacccgacauguagcgguagaaccugaaguugcgaaucuagauaucaucggccaacgaauagaaaacauuaaacaugagcauaaaucgacauggcauuaugaugaggacaacccauacaaaacgugggcauaucacggaaguuacgaaguuaaacccucugggucggcgucuuccauggugaacgguguugucaaacugcugacuaaaccgugggaugugauuccaaugguuacacagauagccaugaccgauacaacaccguucggucaacaaagaguguucaaggagaaaguagauacaagaacaccaaaggccaaacgagguacagcucaaauaauggaaguuaccgcaaaauggcuauggggguuucuaucaaggaauaaaaagccgcggauaugcacacgugaagaguuuacacgaaaaguacggagcaacgcugcuauaggugcgguuuucguagaugaaaaccaauggaacuccgcaaaagaagcaguugaagaugaaagguucugggaccuagugcauaaagaacgagaacuucacaagcaaggaaaaugcgccacgugugucuacaauaugauggguaaacgagagaagaaacucggagaguucggaaaagcgaaaggaucaagagcgaucugguacauguggcuaggugcaagauuccuugaauuugaagcgcucggguuuaugaaugaagaccauugggugucacgagaaaacucacuuucuggaguagagggagagggauuacauaagcuaggauauauucuaagagauaucaguaaaauuccagguggcaauauguacgcggaugauaccgcaggcugggauacccgaauaacagaagacgauuuacaaaaugaagcgaggauaaccgacauuauggaaccugaacacgcccuucuggccaaaagcauauuuaaacuaaccuaucaaaacaaaguaguuagaguacaaagaccagcgaaaaauggcacugugauggauguaauuagccgaagagaucaacggggcaguggucaaguaggaaccuacggucuaaacaccuuuacuaacauggaggcgcaacuaauaagacagauggaaucagaaggcauuuuuaguccaucagaacuagaaacaccaaaucuggcagaaagaguauuagauuggcuugaaaaauacgguguggagagacuuaaaagaauggcaauuaguggagacgacugcguaguaaaaccuauugaugauagguuugcuacagcccucaccgcuuuaaaugauauggguaaaguccguaaagacauuccacaaugggaaccuucuaaaggguggaacgacuggcaacaaguuccauucuggagucaucauuuccaucaacuuauaaugaaggacggaagggaaauaguuguacccugcagaaaucaagaugaauuaguaggccgugcacggguaucucaaggagcaggguggucauuaagagagaccgcuugccuaggcaagucguaugcucaaauguggcaacucauguacuuccaucgaagagaccugagauuagccgcaaacgcuauuuguagcgcuguaccaguagauuggauaccaacaagucggacuacauggucaauccacgcacaccaucaauggaugaccaccgaagauaugcucagcgucuggaacagaguauggaucgaagaaaauccauggauggaagauaagacucacaucucuucguggggugacgucccguaucuaggaaagagagaagaucaauggugcgguagcuuaaucgggcugacugcucgagcuacuugggcaacaaauauacaaguagcaauuaaucaaguccggcgccuuauaggaaacgagaauuaccuugauuauaugacuucgaugaaacgcuucaaaaacgaaucggacccagaaggugcccuaugguag

SEQ ID NO: 21166 - RNA, 9879 nt, Artificial Sequence
  derived and/or modified CDS sequence (opt6) from DENV-1__GU131919__SS-prME
ucagucacuauguuacuaaugcuuaugccuacagcacuugcuuuccaucuaacaacuaggggaggggaaccgcauaugauagucucgaaacaagaaaggggaaagagcuuacucuuuaaaacaucagcaggagucaauauguguacgcuaaucgcaauggacuuaggagaauuaugcgaagacaccaugaccuauaaaugcccaaggaucacggaggcugaacccgaugacgucgauuguuggugcaaugcaacagauacuugggucacauacgguacuuguucacaaaccggugagcaucgucgagauaaacgaucaguggccuuagccccacaugucggauugggacuagaaacaaggacagaaacguggaugaguucugagggagccuggaaacaaauacaaaggguagaaacgugggcgcuuagacauccaggauuuacagugauagcgcuauuucuggcacacgcuauaggcacguccaucacgcaaaaagggauaauauuuauacuucuaaugcuaguaacuccaucaauggcaaugagaugcguaggcauagguagucgggauuuuguagagggauuaagcggggcaaccugggucgauguaguacuugagcacggaaguuguguaaccacaauggcaaaagauaaaccaacacuggauauagaacucuuaaaaacagaaguaaccaauccagccauacuucgcaaauuaugcauugaagcaaaaaucagcaacacaacgaccgauagucgaugcccaacgcaaggagaggcuacacugguugaagaacaagaugcgaacuuuguaugccgacguacauucguagacagaggguggggaaauggauguggacuauuuggcaaagguuccuuaaucacaugugcuaaauucaaaugugucacgaaauuagaaggcaaaauuguccaguacgaaaaccuaaaauauaguguuauagucacaguacauacaggagaucagcaccaaguagggaacgaaucgacagaacauggaacgacggcgacuauaacaccacaggcaccuacgacggagauucagcuaacagauuacggagcccugacacucgauugcaguccuaggacaggucuagauuucaacgagaugguguuacuuacaaugaaagaaaaaucuuggcucguacauaaacaaugguucuuagauuugccgcuaccuuggacuucaggagcaucuacgagccaagagacauggaaucgccaggaucuauuaguuacuuucaaaacagcgcacgcgaagaaacaggaagucgucguuuuaggaagucaagagggagcuaugcauacagcucugacaggggcaaccgagauucaaacgucgggcacaacaacuauauucgcaggacaccuuaaaugcaggcucaaaauggacaagcuaacuuuaaaggggaugucguaugucauguguacaggaucauucaaacuagaaaaagagguagccgaaacacaacauggaacugugcuaguucagauaaaauacgaagguacagacgcaccauguaaaaucccauuccuaacacaggaugaaaaaggagugacucagaaugggagacuuaucacagcaaauccuauagucaccgacaaagaaaagccuguuaauauugaagcagaaccucccuuuggggagaguuauauagucauuggagccggugaaaaagccuugaagcugucaugguucaagaaagguaguagcaucggcaaaauguuugaggcuacagcaagaggggcgagaaggauggccauauugggggacaccgcaugggauuucggaaguauagggggcgucuuuacgagugucggaaagcugauccaccaaauauuuggaacugcauacggcguguuauucagugggguaucauggaccaugaaaauugggauuggugucuuauuaacuugguuaggacuuaacucucgaucaacgagccugucaaugacauguauagcuguaggccuaguuacacuauaccuagggguaauggugcaagcagacucuggaugcguaauuaauuggaaagggagagagcuaaaguguggaucagggauauuuguaaccaacgaaguucacacauggacugagcaguauaaauuccaagcugacucuccgaaacgacuaucugcagcaauuggaaaggcaugggaagaagguguauguggaauaaggagugcaacuagguuggagaauauaauguggaagcaaauaucuaacgaacuaaaucacauucucuuagaaaaugacaugaaauucacgguagugguaggggauguugcaggcauccucgcucaaggcaagaaaaugauuagaccucaaccuauggaauauaaguauucauggaaguccugggggaaagcuaaaauaauaggugcagauguacaaaacacaacuuucauuauugaugggcccaauacaccagagugcccagaugaccaacgugcauggaauauuugggaaguggaagauuauggguuuggaauauuuacaacgaacaucugguugaagcuacgugacagcuauacccaggucugcgaucaucgauuaauguccgcagcaauaaaagauucuaaagcgguucacgccgauaugggguauuggauugaaucagagaaaaaugaaacuuggaaguuagcucgagccagcuucauagaagugaaaacgugcauauggcccaagagccacacgcuuuggaguaacgguguauuagaaagugaaaugaucauaccuaaaauauacggggguccaauaagucaacauaacuaccgaccagguuauuuuacccaaacggccgguccauggcacuuggggaaguuagaacuagacuucgauuugugcgaaggaacaacggucguaguagaugaacauuguggaaauaggggaccuucacuacggaccacuacugucacugguaaaauaauacacgaaugguguugcaggagcugcacauugcccccacuacgcuuucguggcgaggacggaugcugguaugggauggaaauuagaccagucaaggagaaagaggaaaaccuagugaagaguaugguuucggcugggucuggggaaguggacuccuucucacuaggauuauuauguaucucaauaaugauugaagagguuaugagaaguagguggucaagaaaaaugcuuaugacaggaacacuagcaguguuccuuuuacucauuaugggucaacuaacguggaaugaccucauccgucucuguaucaugguuggggcgaacgccugcgaucguaugggaaugggaacaacauaccucgcguuaauggccacuuuuaaaaugcgaccaauguucgcaguuggguuauuguuccgacgcuuaaccuccagagaaguauuacucuuaacuaucggauugucauuaguggcaucaguagaguuaccaaauuccuuggaagaauuaggggauggucuugcgaugggaauaaugauucuaaaacuuuugacagacuuccagucauaucagcucugggccacauugcucucucugacauuuauaaaaacaacauucucuuugcauuacgccuggaagacuauggcaaugguccuaucuauaguuaguuuauucccguuaugucucucaacuacaagccaaaagaccacauggcuuccaguauuauuaggaucacuaggaugcaagccauuaacuauguucuuaaucgcagaaaauaaaauaugggggagacgcucauggccauuaaacgaaggaauaauggccgugggcaucguauccauauuauuaucaucacuacucaaaaaugauguuccccuagcuggacccuuaaucgcuggcgguaugcuaaucgcauguuaugugaucagugguaguucugcugaccuuagcuuagaaaaggccgcugaaguaagcugggaagaggaagcggaacacucuggugcgucgcacaacauauugguugagguacaagaugacgguacuaugaaaauaaaagaugaagaacgugaugauacacugacgauauuacuaaaagcaacuuugcuggcuguaagugguguauacccuuugucaauccccgcaacacuguucgugugguauuucuggcagaagaagaaacaacggagcgggguauuaugggauacuccaagucccccugaaguggaaagagccguacuggaugaugggauauacagaauaaugcagcgcggacugcugggucgaagucaaguagguguuggaguauuucaggaaaauguuuuccacacaauguggcaugugacucgaggugcaguccuaauguaccaaggaaaaagacuagaaccuucgugggcuagcgucaagaaagaucugauuucuuauggaggaggauggcgccuacaagggucauggaauacaggggaagaagugcaagucauagcggucgaaccaggcaaaaaccccaaaaacguccaaacagcaccgggcacuuucaaaacuccugaaggugaagucggugcaauagcacucgauuucaaacccggaacaucagggucaccgauagugaauagagaaggaaaaauuguuggauuauacgggaacgggguagucacuacaucgggaacauauguauccgcuauagcacaagcuaaagccagucaggaggguccauuaccagaaauagaagaugaaguuuucagaaagagaaacuugacuaucauggacuuacacccagggucaggcaaaacucgacgauaucucccagcaauuguuagagaagcaauuaaaagaaaguuaagaacguuaauacuugcuccuacccgaguuguagcaucugaaauggcugaggcuuugaagggcaugcccauccguuaccagacgacugcggucaagucagaacacacagguaaggagauaguagaucuaaugugucaugcaacauuuacaaugagacuauugagucccguuagggugccuaauuauaauaugauaaucauggacgaagcucacuuuacggauccuucaagcauugcugcuagagguuacauuucuacucgagugggaaugggcgaagccgcugcaaucuuuaugacagccacuccaccaggcagcguggaagcguucccccaaagcaaugcaguuauucaagaugaagaaagggacauaccugaacgaaguuggaacuccggcuacgaguggauaacugauuucccaggaaaaacuguuugguucgucccgucgaucaaauccgggaaugacauagcaaacugcuugcggaaaaacgguaaacgcgugauacagcuaagcagaaagacguucgauacagaauaucagaagaccaaaaacaaugauugggacuauguuguuacaacagacauaucagaaaugggugccaauuuuagggcugacagagugauagauccaagaaggugucuaaaaccgguaauacuaaaagacgguccugaaagagucauucuugcaggccccaugccugucacuguugcgucagcagcucaaaggcgcgguagaauuggaaggaaccacaacaaagaaggagaucaauauauauauaugggacaaccacucaacaaugacgaggaucacgcucacuggacugaagcaaaaauguugcuagauaacaucaacacaccagagggcauuauaccggcguuauucgagccagaacgugaaaaaucagcggcaauagauggagaauauagauugcgaggagaagcacguaaaaccuuuguagagcuaaugagacgcggagaucucccggucugguuaaguuauaaggucgcgucugagggcuuccaguacagcgauaggagguggugcuucgauggggaaagaaauaaucaagugcuagaggagaacauggacguugaaauauggacuaaggagggcgagaggaagaaacuaagaccacgaugguuagaugcgagaacauauagcgauccucuagcauuaagagaauuuaaagaauuugcagcagggagaagaucaguuucuggggaucuuauauuggagauugggaaacucccacaacaccuuacgcaaagggcucaaaacgcccucgauaaccuaguaaugcuacacaauucugagcaaggcgggagagcauaccgccacgcaauggaagaacuaccggacaccauagaaacauugauguuacucgcccuaaucgcaguucuuacgggaggaguaacccuauucuuuuugucaggucgagguuugggaaaaacgagcaucggguuacuuugugucauggcuucaucaguucuauuauggauggcuaguguagaaccacauuggauagcagcaucaauuauuuuagaauuuuuccuaaugguauuauuaaucccugaaccugauagacagagaacaccgcaagacaaccaacuagcuuauguagugauaggccuacuguuuaugaucuuaacaguagcggcuaaugagauggggcuucuagagaccacuaagaaagaccucgguaucggucacgucgcagugggaaaucaucaucaugcagcaaugcuagaugucgacuugcauccggcaucagcguggacauuauaugcaguggcuaccacgaucauaacaccuaugaugcgacauacaauugaaaacacgacagcaaacauaaguuuaacggcaauagcaaaucaagccgcaauauugaugggccuagacaaaggcuggccuauuuccaaaauggauauaggaguacccuugcucgcucuaggcuguuauucucaaguuaaccccuuaacucuuacagcggcagucuuaauguuaguagcucacuaugcaauuauaggaccuggguugcaagcaaaggcaacacgcgaagcccaaaaacgaacugcugcaggaaucaugaaaaacccaaccguagacgggauuguggcuaucgauuuagauccugucguuuaugacgcaaaguucgaaaaacaacuggggcaaauaauguuacugauacuguguacgucgcaaauccucuugaugagaacgacgugggcuuugugcgaaaguauuacacuggcgaccggaccuuuaacaacuuuaugggaagggucgccgggcaaauuuuggaacacaacaauugcugucaguauggcaaacauauuucggggcuccuaccuagccggcgcuggucuagcguucagccuaaugaaauccuugggcgguggccgaagagguaccggagcacaaggagaaacacuaggggaaaaauggaagagacaauuaaaccaauuaucaaagagcgaguuuaauaccuauaagaggagugggauuauggaaguggacagaucagaggcuaaagaaggacuuaaaagaggggaaacgacaaagcaugcuguaagcagagguaccgcgaaauugcgaugguucgucgaaagaaaccucguaaagccagaaggcaaaguaauagaccuuggaugcgguagaggggguugguccuauuacugcgcugguuugaagaaaguaacugaaguaaaagguuauacgaaaggagggccggggcacgaagaaccaaucccuauggcgacauauggcuggaacuugguuaaacuacauagcggaaaagauguguucuuuauaccuccugagaaaugcgacacacucuuaugcgauauaggagagucaucaccaaauccaaccaucgaggaggggaggacacuaagaguauuaaaaauggucgaaccauggcuaagaggaaaccaauuuuguauaaagauacuuaacccguacaugcccucggucguugaaacuuuagaacaaaugcaacgaaaacauggcggaauguuaguaagaaacccguugucaagaaauucaacacaugaaauguauuggguuucaugugggacagguaauauaguauccgccgucaacaugacaucgagaaugcuuuugaaucgcuuuacaauggcccaucguaaaccaacauaugaaagagacguagacuugggcgcaggaacuagacacgucgccguggaaccugaaguggcuaauuuagauauaauaggucaaagaaucgaaaauauaaagcaugaacacaagaguaccuggcacuaugaugaagacaacccauacaaaacaugggccuaccacgguucuuaugaaguaaaacccagcggaucugcgaguucgauggucaaugggguaguuaaauugcuaacgaagccaugggauguaauuccgaugguaacucaaauugcaaugacggauacaacccccuuugggcaacaacgaguauucaaagaaaaagucgacacacgaacgccuaaagcgaaaagggguaccgcgcaaauaauggaaguaacagcgaagugguuauggggauuucuaaguagaaauaagaaacccaggauuuguacgagggaagaauuuacacgaaaaguaagaaguaaugcugccauuggagcagucuuugucgaugagaaccaauggaacucagcaaaagaagcaguagaagaugaaagauucugggauuuggugcaucgcgaacgugaguugcauaaacagggcaaaugcgcaacauguguauauaauaugauggggaagagagagaagaaacuaggggaauuugggaaagcaaaaggaucaagagcuauaugguauauguggcucggggcaagauuuuuggaauuugaggcuuuaggcuucaugaacgaagaccauugguuuucaagagaaaacucacuuucagguguggagggggagggacugcacaaauuaggguauauacugagagauauaaguaaaauuccaggagggaauauguaugcggaugacacagcgggaugggacacgagaauuacagaggacgacuuacaaaaugaagcucgcauuacagauauuauggagccagaacaugcguuauuagcgaaauccaucuuuaaacuuacauaucaaaauaaaguaguacguguccagaggccagcaaagaaugggacugugauggauguaauaagcagacgugaucaaagggguaguggacaaguagguacauauggacuaaacacauucacaaacauggaagcacaacuuauaagacaaauggaaucagaaggaauauucuccccaagugaacuugagaccccaaaccuugcggaaaggguacuagauugguuggaaaaauauggagucgaaagauuaaaaagaauggcaauauccggugacgauugugucguaaaaccaaucgacgauagauucgcuaccgcauuaacagcccuaaacgacaugggcaaaguacgaaaagauauuccacagugggagccgagcaaagguuggaacgacuggcaacaaguuccauuuugcagucaucauuuccaccaauuaauaaugaaagauggcagagaaauugugguaccuugucgaaaccaagaugagcuuguaggacgggcacgcguaucucaaggagcaggcuggagcuuaagagaaacagcuugucuaggcaaaucauaugcucaaauguggcagcuaauguauuuucaucgaagagaucuuagacuagcggcaaaugcgauaugcucagcagugccaguugauuggauuccaacuucaagaacuacguggucgauucaugcccaucaucaguggaugacgacagaagacaugcugucaguuuggaaucgagucuggauugaggaaaauccauggauggaagacaaaacacauaucucuagcuggggcgauguaccguaucuagguaagagagaggaucaaugguguggaucucuuaucggacuaacugcgagagcgaccugggcgaccaacauucaagucgcaaucaaucaaguuaggcgguuaauaggaaacgagaauuaccuugauuacaugaccaguaugaaaagauuuaaaaaugaaagugaucccgagggugcucucugguga

SEQ ID NO: 21167 - RNA, 9879 nt, Artificial Sequence
  derived and/or modified CDS sequence (opt6) from DENV-1__GU131920__SS-prME
ucagugacuauguuacuaaugcuaaugcccacagcguuagcguuccaucuaaccacgagagggggugaaccucauaugauuguaaguaaacaagaaaggggaaaaagucuguuauucaaaaccuccgccgguguaaauaugugcacauuaaucgcuauggaccuaggggaacugugugaggauacgaugaccuauaaaugucccaggauaacagaagcagagccagacgauguagacuguugguguaaugcuacagauacgugggucacauaugggacguguagucaaacgggagagcaccgccgcgauaaacggucuguugcacuggcgccgcauguuggacuuggauuagagacccgcacagaaacauggaugucauccgaaggcgcauggaagcagauucaacguguagaaaccugggcauuacggcacccaggauucacaguaauagcacuauuccuagcacaugccauagguaccucaauuacucaaaaaggaauaauauuuauacuguuaauguuaguuacaccauccauggcaaugcgaugcguugggauuggaucccgcgauuucguggaaggccuauccggugcaacauggguagauguaguccuagagcaugggucuugcgucacaacgauggcaaaagacaaacccacgcucgauauugaacuauugaaaacugaaguaacgaacccugcaauccugaggaaauugugcauugaggcaaaaauaucuaacacuaccaccgacagccguugucccacccagggagaagcuacauuaguagaagaacaagacgcaaauuuuguuuguaggcgaacauuuguugaccgcgggugggguaauggauguggccuauucgggaaaggcucccuuauuacaugcgcaaaauuuaaaugugugaccaaacuagaaggcaaaaucguacaauaugaaaaucuaaaauauucggugauaguuacgguucauacgggagaccaacaucagguagguaacgaaucaaccgaacauggaacuacagcaaccaucacaccgcaagcaccaacaacagaaauacaacuuacagauuauggugcacuaacucuggacugcucaccaagaacaggucuagacuucaaugagaugguauuauuaacgaugaaagaaaagucuugguuaguacauaaacaaugguuucuagaucugccuuugccauggacuuccggcgcuaguacaucacaagaaacauggaacagacaggaucuuuugguaacauuuaaaacagcucaugccaaaaagcaagaaguagucguucuaggaagucaagaaggugccaugcauacugccuuaacaggugccacagaaauccagacaucaggaacuacaaccauuuuugccggccaccugaaauguaggcuaaaaauggacaaacuuacacuaaaggggauguccuauguaauguguacaggaucauuuaaauuagaaaaagagguagcugaaacacagcauggaacagugcuuguccaaauuaaauaugaagggaccgacgcucccuguaaaauuccguucucgacgcaagaugaaaagggaguaacgcaaaacggaaggcucauaacggcaaauccuauaguuacggauagagagaaaccaguuaauaucgaagcggaaccacccuucggcgaaucauauauaguuauaggagcgggugaaaaagcacuuaaacuuagcugguuuaaaaagggaaguaguaucggaaaaauguuugaagccacagcucgcggagcacgcagaauggcaauacucggugacacugccugggauuucggaaguauuggagguguauuuacaucagucgguaagcuaguacaucaaaucuuugguacagcauacggcgucuuauuuucagggguaucguggacaaugaaaaucgguauaggaguguuauuaacaugguuaggccuuaauaguagauccacaucccugagcaugacauguauagcaguuggauuaguaacguuauaccuuggaguuauggugcaagccgauucagggugcgugauaaauuggaaaggacgagaguuaaaauguggcagugguauuuucguaacaaacgaaguacacacauggacggagcaauauaaguuucaagcagauuccccgaagagacucucagcagccauuggcaaagcaugggaagaaggcguauguggcauacgaucggcaacaagacuagaaaacauaauguggaaacagaucucuaacgaacuaaaucauauuuuguuggagaaugauaugaaguuuacuguugugguaggcgauguagcagggauuuuagcucaagggaagaaaaugauaagaccucaacccauggaauauaaauauuccuggaagaguuggggaaaagcgaaaauaauaggagccgacguccagaauacaacauuuauaauugaugguccgaacaccccugaaugcccagaugaccagagagcauggaacauaugggaaguugaagacuacggauucgggauauucacuacaaacauauggcucaaacuaagagacaguuacacucaaguuugugaucauagguuaaugucagcggcuauuaaagauucuaaagcgguccacgcggauauggguuauuggauugaaucugagaagaacgaaacauggaaauuagcaagagcgaguuucauagaggugaaaacaugcauuuggccgaaaagccauacacuauggagcaaugguguauuagaaucagaaaugaucauuccuaaaauauauggugguccaauuagccaacauaacuauagaccaggauacuuuacacaaacagcagggcccuggcaccuaggaaaguuagaauuagauuuugauuuaugcgaagguacgacuguuguugucgaugaacauugugggaauaggggcccaucacuuagaaccaccacagucacgggcaaaauaauacacgaauggugcugucgaucaugcacauuaccaccgcuuagauuucgaggcgaagaugggugcugguauggaauggagaucagaccggucaaagaaaaagaagagaaucuuguaaagucaauggugucggcugguucuggggaaguugauaguuucagucugggucuauuauguauaaguauaaugauugaagaaguaaugcgaagccgauggagcaggaaaauguugaugacaggaacacuagcuguauuccuacugcuuauaaugggucaauugacguggaacgaccuuauacguuuguguauuaugguaggagcaaaugcuagugacagaaugggcaugggaacaacauaucuagcgcuaauggcuaccuucaagaugcguccaauguuugcugucggguuauuguuucgacgauugacaucaagagaaguacuacuguugacuauuggcuuaaguuuggucgccagcgucgagcugcccaauucacuagaagaauuaggagauggacuagccaugggaauuaugauauuaaaauuacuaacggacuuccaaagucaucagcuuugggcaacguuacuuaguuuaacauucauuaaaacaacuuucucgcuucacuaugcauggaaaacaauggcuauggugcucaguauagucagucucuuuccacuaugcuuaaguacaaccagucagaaaacgacauggcucccuguuuuguuaggcagccugggcuguaaaccccuuacuauguuccuuauugcagagaauaaaauuuggggaaggagaucuuggccauuaaacgaaggaaucauggcagugggaauugugucgaucuuauuaucaucguugcucaaaaaugauguuccguuggcuggacccuuaauagcuggugggauguugauugccugcuauguuauaagcggcagcagcgcggauuugucguuagaaaaagcagcagaaguuaguugggaagaagaagcggagcacucaggggcaucacauaauauucuaguagaaguucaagacgaugguacgaugaaaauaaaagaugaggaaagggaugauacuuuaacgauacuguuaaaagcgacacuucuagcagugucuggaguuuauccacuuagcauccccgcaacccuuuucgucugguauuucuggcaaaagaagaaacaacgcagcgggguccuaugggacacgccaucaccaccagaagucgaacgagcaguacuagaugauggcauuuauagaauaaugcaaaggggauuguuaggaagaucacaaguaggaguaggagucuuucaagagaauguuuuccacacaauguggcacgugacacgaggagccguauuaauguaucaagguaagagauuagaaccauccugggcaucagucaagaaagaucuaauaaguuacggggguggauggagauuacagggcaguuggaauacgggugaagaaguccaggucauagccgucgaaccuggcaaaaauccaaagaauguucaaacagcaccaggcacauucaaaacaccagaaggugaaguuggggcaaucgcacucgacuucaaacccggaacuuccggaagcccuauaguaaaccgagaggggaaaauuguggguuuguacgguaauggaguaguaacuacgucaggaacauaugucagcgcaauagcacaggcaaaagcaucucaagagggucccuuaccagaaaucgaggacgaagucuuucgaaaaagaaaccuuacaauuauggaucuucauccggggucaggcaagacaaggagauaucugccugcuauuguaagagaggcaaucaaaaggcgauuaagaaccuuaauucuggcacccacuagaguuguggccagugaaauggcugaggcuuuaaaggguaugccaauccgcuaccaaacuacagcagugaaaagugaacauacugguaaggaaauaguagacuuaaugugccaugcaacguucacaaugcgucuauuauccccuguuagagugccgaacuacaauaugauaauaauggacgaagcccauuucacagacccuucaaguauagccgcuagaggauacauuagcacaagaguuggaaugggagaagcugcggccauuuuuaugacggcgacuccacccgguagcguagaggcauuuccacagucaaacgcugucauacaggacgaggagcgcgauauucccgaaagaucauggaacucgggauaugaauggauaaccgauuucccaggaaagaccguuugguuuguuccgaguauaaaaucagggaacgacauagcaaacugucuaaggaaaaauggcaaacgggugauucaauuauccagaaaaacguuugauacagaguaucagaaaaccaaaaauaaugauugggacuauguaguaacuacugauauaagcgaaaugggugccaacuuuagagcugauagaguuauagacccaagacgcuguuugaaaccaguaauuuugaaagaugggcccgaacgggucauauuagcagguccaaugcccguaacuguagccucagcugcucaacgacgcggaagaauaggcagaaaccauaauaaggaaggagaucaguauauuuacaugggacagccucuuaauaaugaugaagaucaugcacauuggacugaagcaaaaaugcuccuugacaacaucaauacaccggaggguauuauuccugcccucuuugagccggagagagaaaaaucagcagcaaucgacggcgaauauagguuacguggcgaagcgcguaaaacuuucguagaguuaaugagaagaggagauuuaccaguguggcuaaguuacaagguggcgucagaaggauuucaauacucggauagaagguggugcuuugacggagaaagaaauaaucaaguccuagaagaaaauauggauguagaaauuuggacaaaagaaggugagcguaagaaguuaagacccagauggcucgacgcacgaacauacuccgauccacuugcacuuagggaguuuaaagaauuugcggcgggacgacguuccguaucaggugaucugauacuagaaauuggaaaacuaccucaacaccuuacucaacgagcacaaaacgcguuagauaauuuggugauguugcauaacagugaacaaggcggucgugcguauagacaugcgauggaggaauuaccugauacaauagaaacgcugauguuacuagcacuaauagcuguuuugacagggggugucacuuuauucuuucugucagguagaggguugggaaagacaucaauaggacucuuaugcgugauggccucgagugucuugcucuggauggcaagcgucgaaccacauuggauugccgcaaguauuauauuagaguucuuucuaaugguucuucuuauaccagaaccugauagacaaaggacaccgcaagacaaccaguuagcguauguaguuauaggacuucuuuuuaugauccucacuguagcagcaaaugaaaugggcuuauuagaaacaacuaagaaagauuuaggaaucgggcauguagcggucggaaaucaccaccacgccgcuaugcuagacguagaccuacauccggcaucggcauggacgcuuuaugcugucgcaaccacaauaauaacaccuaugaugaggcacacuauugaaaauacgacagcgaacaucucacugacugcuauagcaaaccaggcggccauauuaaugggacucgacaaaggcuggccaauaucaaaaauggauauaggcguuccucuucuugcgcuagguuguuauagucaaguaaacccccuuacuuugacagcugcuguuuuaauguuagucgcccacuaugccauaauugggccaggccuucaggcuaaagcaaccagagaggcucaaaaacggacugccgcagggauaaugaaaaauccaaccguagauggcauuguagcgauagauuuggauccagucguauaugaugccaaguuugaaaagcaacuaggacaaauaauguuauuaauacugugcacaagucaaauccuauuaaugagaacuacuugggcacuaugcgaaaguauaacauuagccacuggaccuuuaacaacauugugggaaggaucaccagguaaauucuggaauacgacuauagcuguaaguauggcaaacauauuucgggguucuuauuuagcuggagcaggguuggccuuuucacucaugaaguccuuaggaggugggagaagagguacgggugcccaaggagaaaccuuaggggagaaauggaaacgacagcugaaucaacuauccaaaucagaauuuaacaccuauaagcgcuccgguauuauggaggucgauagaucggaagccaaagaaggacucaaacgaggcgagaccacaaagcacgccgucucgagaggaacugcaaaacucagaugguucgucgagcgaaaccuggugaaaccagaaggaaaaguuauugaucuuggaugcggaagggguggauggucauacuacugugcagggcucaaaaagguaacagagguuaaaggguacaccaaaggcggacccggucacgaggaaccuauucccauggcaacguaugguuggaaccuagugaaacugcacucaggcaaggacguauucuucaucccgccugaaaagugcgauacguuacuaugugauauuggagaaucaaguccgaauccuacaauugaagaaggucguacguuacgaguacuaaagaugguugaacccugguugagaggaaaucaauuuuguauuaaaauccugaauccauacaugcccaguguuguagaaacauuagaacagaugcaacggaaacauggagggaugcugguacguaacccacucagccguaacucaacacaugaaauguauuggguaagcugugggacagguaauauagucuccgcuguuaacaugacaucacgaaugcuguuaaauagguuuacgauggcccauaggaaaccuacuuacgaaagagacguugaucuaggagccgggacgagacauguagcuguggaacccgaaguagcuaaccucgauaucauaggccagcggauagaaaacauuaaacaugagcauaaaucaacauggcauuaugacgaagauaauccauacaagacaugggcauaucacggcaguuacgagguuaagccaagcggcagcgcaucuucaaugguaaauggagugguaaaacuacucacaaaaccuugggacgugauuccaaugguuacacaaauagcuaugacagacacuacaccauuuggucaacaacgcguauuuaaagagaaaguagacaccagaacuccuaaagcaaagagaggaaccgcccaaauaauggaaguuacagcuaaauggcucuggggguuucuaucacgaaauaaaaagccacguauauguacgcgagaagaauuuacaagaaaagugcgaucaaaugcagcaauuggagcugucuuuguggacgaaaaccaauggaacagugcaaaagaagccguugaggaugagagauuuugggaucuagugcauaaagaaagagaauuacacaaacaaggaaaaugugcuacauguguguacaauaugauggguaaaagagagaagaaauuaggugaauuuggaaaagcaaaaggaucgagagcaauaugguauaugugguuaggcgcaagauuuuuggaauuugaagccuuaggcuucaugaaugaagaucacugguucagucgcgaaaacagccuaagcggaguagaaggagaaggacuucacaaacuuggauacauucuaagggacauaagcaaaauaccagguggaaauauguacgcagacgacacugcuggaugggauacgcgaauuacagaagaugacuuacagaaugaagcacgcaucacagauauaauggaaccagaacaugcguuacuggcgaagaguauauucaaacuaacguaccagaauaaagucgugagggugcagcggccagccaaaaaugguacuguuauggauguaauaagucggagagaucagcgugguucgggacaagucgggacauacggauuaaauacguuuacuaauauggaagcucagcuuauacgccaaauggaaagcgaggguaucuucaguccuucggaauuagaaacgcccaaccuagcugagcgcguucuggacuggcuggaaaaauauggaguugaaagguuaaaaaggauggcgauuuccggagacgacuguguggucaaaccuauugaugaccgguucgccacagcauuaacagcacuaaaugacauggggaaaguuaggaaagacauaccgcaaugggagcccaguaaaggauggaacgauuggcaacaaguaccauucuguucacaccacuuucaucaguuaauaaugaaagacgggagagaaauuguuguaccuugcaggaaucaagaugaauugguggggagagcaagagugucccaaggagcuggcuggagcuugcgcgaaacggcuugcuuaggcaaaaguuacgcgcaaauguggcaauugauguauuuucaucgcagagaccugaggcucgccgcuaacgcaauuuguagugcaguaccaguagauuggauuccaacuucacggacaaccuggucaauacaugcacaucaccaauggaugacuacggaagauaugcugagugucuggaauaggguguggauagaagagaauccguggauggaagauaaaacacacaucaguucguggggagauguacccuauuuggguaagagggaggaccaaugguguggcagcuugauuggacuaacggcaagagcaaccugggcuacaaacauacaagucgcgaucaaccagguuagacggcuaauagggaaugaaaauuacuuagacuauaugacaaguaugaaaagguucaaaaacgaguccgauccggagggugcacuuugguga

SEQ ID NO: 21168 - RNA, 9879 nt, Artificial Sequence
  derived and/or modified CDS sequence (opt6) from DENV-1__GU131921__SS-prME
ucgguaacgaugcuauuaauguuaaugccgacugcuuuagcguuucaucuuacuacuagagguggggaaccucacaugauuguaucuaaacaggaaagagguaaaucucuucuauuuaaaacaucugcugguguaaauauguguaccuuaauugcaauggaccuaggggaacucugugaagauacgaugacuuauaaauguccuagaauaacggaagcagaaccggacgauguagauuguugguguaacgcaacagacacuuggguuaccuacgggacguguucacaaacaggggaacaccgacgggacaaaagauccguggcacuggcaccacacguaggacuugguuuagaaacucgaacagaaacauggaugucuagugaaggcgcauggaaacaaauacaaagaguugaaacaugggcacuccgucaucccgguuucacuguuauggcacuauuucuagcacaugcuauagggacgucaaucacucaaaaaggcaucauauuuauauugcuuauguuaguaacacccagcauggcgaugaggugcguggguaucggaucucgcgauuucguagaaggguuaaguggugcaacauggguagaugucguccuagagcacggaucauguguaacuacaauggcaaaagacaaaccaacauuagacauagaacugcuaaaaacugaaguuacuaacccggcaauacuacguaaauuauguauagaagcuaaaauuucaaauaccacaacagacucacguugcccgacucaaggagaagcgaccuuaguagaggaacaggacgcuaacuuugugugccgucgaaccuuuguugaccgaggcugggguaauggcuguggauuauuuggaaaaggaucauuaauuacuugcgcaaaauuuaaauguguuacaaaauuagaaggaaaaauuguucaauaugaaaauuugaaauauucuguaauaguaaccguucacacaggugaucaacaccaagugggaaaugaaaguacagaacauggaacgacagcaacaauaacaccgcaggcaccuaugacugaaauucaguuaacugacuacggagcguuaacacuagacugcucaccuagaacagguuuagauuuuaaugagaugguacugcuuacgaugaaagaaaaaucaugguugguacacaaacaaugguuucuggaucucccauuaccguggacaucaggagcgucuaccagccaagaaacauggaauaggcaagacuuacuuguuacguucaaaacagcgcaugccaagaaacaagaaguggugguauuggguagccaagagggggcaaugcacacagcacuuacaggggcaacugaaauucaaacaucagggacuaccaccaucuuugccggucauuugaaaugccgcuuaaaaauggauaaauugacucuaaaaggcaugagcuaugucaugugcacugggagcuucaaauuggagaaagagguagcagaaacacaacauggcaccguauuaguacaaauuaaauaugaaggcacagaugcccccugcaaaauaccuuuuucaacacaagaugaaaaaggagucacacaaaaugggcgucuuauuacggccaacccaauuguuacagauaaagaaaaacccgugaauauugaagcggagccaccguuuggcgaaaguuacaucgugauaggagcuggcgaaaaagcauuaaaauuaagcugguuuaaaaaggguucuuccauuggcaagauguucgaggcuacagcaaggggcgcucgaagaauggcaauucucggugauaccgccugggacuuuggaaguaucggagguguauuuacuucaguaggaaaacugguccaucaaauuuuuggagccgcauacgggguucuguucaguggcgucaguuggacgaugaaaauuggaauaggaguauuguuaacuuggcuaggccugaauagucgcucuacaaguuuaucuaugacauguauugcugucggcuuaguaacauuguauuugggcguuaugguucaagccgacucugguugcguaauaaacuggaaagguagagaacuaaaauguggcuccggcauauucguuacuaaugaaguccauacauggacagaacaguauaaauuucaggcugauucuccaaaaagauuaagcgccgcgauaggcaaagcaugggaagaggguguaugugguauaagaucggcgaccagauuagaaaacauaauguggaaacaaauaaguaaugaauugaaccacauacuuuuagaaaaugauaugaaauuuacagugguaguaggagacgucgcgggcauccucgcccaagguaagaaaaugauaagaccacaaccaauggaauauaaguacuccuggaaaaguugggguaaagcuaaaauaauaggggcugauguacaaaauacgacauuuauuaucgauggacccaauacucccgaauguccugaugaucaaagagcguggaacauaugggagguagaagauuauggauucggcauauuuacaacuaauaucuggcuaaaacugagggacuccuauacccagguaugcgaccauaggcuuaugucagcggcaaucaaagauucuaaagccguacacgcggauaugggauacuggauagaaucagagaaaaaugagacauggaaacuugcaagagcuucguucauagaagucaagacuugcauuuggccaaagucacauacacuauggagcaacggaguccuagaauccgaaaugauaauacccaaaauauauggcggaccgauuagccaacauaauuaucggcccgguuauuuuacacaaacggcaggacccuggcauuugggaaaauuagaacucgacuuugauuuaugcgaagggacuacagugguuguagacgaacauugcgguaacagagggccuagcuuaagaaccacaacgguuacuggaaaaauaauacaugagugguguugcaggagcuguacacuuccaccgcuacgauucagaggugaagacgguugcugguacggcauggaaauacgaccgguaaaggaaaaggaagagaacuuggucaaaucuaugguaagugcagggaguggagaagucgauuccuuuuccuugggacuguuauguaucaguauaaugauugaagaggugaugcggucacgauggucaaggaagauguugaugacaggaacauuagcuguguucuuacuauugauuaugggacaacuaacauggaaugauuuaauaagacuauguauuaugguaggagcaaaugcuagcgacagaauggguauggguacuacauauuuagcacugauggcaacauuuaagaugagaccgauguuugcgguagggcuucucuuucgccggcugacaagccgagaaguacucuuacuuacaaucgguuugagcuuaguugcuagcguugaacuaccgaacaguuuagaagaguugggugauggucuggcaaugggcauaaugaucuuaaaauuauuaacagauuuucagagccaucaacuuugggcuacacuacuuucuuuaacuuucauaaaaacaacauuuagucuucacuaugcuuggaaaacaauggccaugguccuuucaaucgucucacuauucccacuuugucucucuaccacaagucagaaaacuacauggcuuccuguauugcuaggaagccuggguuguaaaccguuaacaauguuuuugaucgcagaaaacaaaauuuggggacggagaucauggccauuaaacgaagggauaauggcagucggcaucguuucaauccugcuaagcagucuauuaaagaacgacguuccgcuagcuggaccacuuauagcaggaggcauguuaauagcuuguuacguaauuagcgggaguagugcggaccuaaguuuggaaaaagcagccgaagucaguugggaagaggaagccgaacacuccggugccagucauaacauccuaguugaagugcaggaugacggaacgaugaaaauuaaagacgaagaacgggaugacacauuaacaauacuucuuaaagcaacgcuacucgcaguuucaggagucuauccguuaaguauccccgcaacccucuuugucugguacuucuggcagaagaagaaacaaagaucaggaguacugugggacacuccaucuccuccugagguugaaaaggcaguauuggacgauggcauauauagaauaaugcagcgaggguugcuaggucggucucaaguuggagucgggguauuucaggagaaugucuuucacaccauguggcaugucacuagaggcgcaguacugauguaucagggaaaaagacucgaaccuucuugggcaucagucaagaaagaccuaauuaguuacggaggaggguggcgccuucaagguaguuggaacaccggggaagaaguacaaguaaucgcaguagagccuggcaaaaacccgaaaaacguacaaacagcgccaggaacuuucaaaacuccagagggagagguuggagcuauugccuuagauuuuaagccuggaacguccgguagccccauaguaaacagggaaggcaaaauuguaggauuauaugggaacggagugguaacgacaaguggaacuuacguaucagcaauugcacaggccaaagcaucgcaagaaggaccguuaccagaaauagaagacgaggucuuccguaagaggaaccuaacaauaauggaucuacaucccgggagcggaaaaacgaggagguaccuaccagcaauaguuagagaagcaauaaagcgaaaguuacguaccuuaauauuagcgccuacaagagucguagcaagcgaaauggccgaagcauuaaaaggaaugcccaucagguaccaaacaacagccgugaaaucugaacauacagggaaagaaauaguugaccuaaugugucaugcaacguuuacgaugagauuacuaucaccuguuagaguuccuaacuauaacaugaucauuauggaugaagcgcacuuuacggacccuucaucgauugcugcacgcggauauauuucuacacgaguggguaugggugaggcagcugcuaucuuuaugacagccacaccgcccggaucaguggaagcguuuccucaaaguaaugcaguaauucaagaugaggagagagacaucccugaacgauccuggaacaguggguaugaauggauuacggauuuuccgggaaaaacaguuugguuugucccgagcaucaagucuggaaaugauauagcuaacugucuuaggaaaaaugggaaacgcgucauacaacucaguagaaaaacauuugauaccgaauaucaaaagaccaagaacaaugauugggauuauguuguuacuacggauaucagugaaaugggagcuaauuuucgugcagaucggguuauagaucccagaagaugccuaaaaccaguaauacuaaaagacgggccagaacgaguaauuuuagcugggcccaugccaguaacugucgcaucggccgcacaacguagaggucggauaggaagaaaucauaacaaagaaggcgaccaauauauuuauaugggacaaccuuuaaacaacgaugaagaccaugcacacuggaccgaagcaaaaauguuauuggauaacauaaauacgccagaagguauuauuccugcccuuuucgaaccagaaagagagaaaagugccgcaauagacggugaauaccgcuugcguggugaagcacggaaaaccuucguggagcuaaugagacgaggcgaucuaccuguauggcuaagcuauaagguagcuagcgaagguuuucaguauuccgacaggcggugguguuucgacggugaacgaaacaaccaaguccuugaagagaacauggaugucgaaaucuggaccaaagaaggcgaacgaaagaaacuucgaccccgguggcucgaugcucgaacauacucagauccauuggcuuugcgggaguucaaggaguucgcagcagguaggagaagcguuucaggugaccuuauacuggaaauugggaagcugccacaacacuuaacacagagggcucagaaugcccuugacaauuuaguaauguugcauaauagcgaacaaggggguagagcuuacagacaugcuauggaagaauuaccagacacgauugaaacacugauguugcuugcguuaauugcggucuugacaggaggaguaacguuauucuucuugucaggucgcgggcuuggaaaaacaaguauaggccuguuauguguaauggcaucuuccguacuauuauggauggcgucgguugaaccacauuggauugcggcuucuaucauucucgaauuuuucuuaauggucuuacuaauaccagaaccagauagacaaaggaccccucaggauaaccaacucgcauauguugucauaggucuacuauuuaugauacuaacaguugcugccaaugaaauggggcuauuagaaacuaccaagaaagaucucggaauagggcacguggcuguuggaaaucaccaucaugcugcgauguuagacguugaucuacauccugcaucugccuggacuuuguacgcaguagcaacuacaauaaucacgcccaugaugcgacacacaauagaaaauacaacugcuaauauuucgcugacugcaauagcuaaccaggcagcgaucuuaaugggucuagauaagggauggccaaucucuaaaauggauauuggggugccauuguuggcauuaggcugcuauagccaaguuaauccacuuacacugacggcagcgguuuuaauguugguagcucauuaugccauaauagguccaggguugcaggcuaaagcaacacgugaagcacagaaacgaacagcagcgggaauaaugaaaaauccuacuguugauggcauuguggcuauugaccucgacccaguaguauaugaugcaaaauucgaaaaacaacuaggucagauuaugcuacuuaucuuaugcacaagucaaauacuuuuaaugagaacgacuugggcucuaugcgaaaguauaacauuagcaacuggucccuuaacaacacuaugggaggguucaccgggaaaauuuuggaauacuacaauagcugugaguauggcgaauauauuuagagguucuuacuuagcuggagcgggucuagcguuuucguuaaugaaaaguuuaggaggagggcgaagaggaacgggagcgcagggcgaaacgcuuggagaaaaguggaaacgacaacuaaaccaacuuucuaaaucugaguucaauacauauaaacgcuccggaauuauggaaguagauagaucugaagcuaaagaaggauuaaaaagaggugaaacuacgaaacaugcaguaucaagagguacugcaaaacuuagaugguucguggaaagaaaucucguuaaaccugaaggaaaaguaauugaccuaggaugcggacggggcggauggucguacuauugcgcaggacuaaagaaaguaacagaaguaaaaggcuauaccaaaggggguccaggccacgaagaacccauaccaauggcuacuuaugguuggaaucuugucaaacuucauucgggaaaagacguguucuuuauuccaccugagaaaugcgauacucuucuuugugacauaggcgaauccucaccaaauccuaccauagaggagggaagaacauuaagaguacuaaagaugguggagccuuggcuucgcgguaaucaauucugcauaaagauauuaaaucccuacaugccuagugucguagaaacucuugagcaaaugcaacguaagcacgguggaaugcucgugaggaacccguuaagcaggaauagcacucaugagauguauuggguaagcuguggaacugggaacauagugagcgcgguuaauaugacgaguagaauguuauugaauagguuuaccauggcccauagaaaacccacauacgaaagagauguggauuuaggagcagggacuaggcacguggcggucgaaccugagguagcuaacuuggauauaaucggacagcguauagagaacauaaaacaugaacauaagucaacguggcacuaugacgaggauaauccuuauaaaacaugggcauaucaugggucuuacgagguaaaaccgucagguucagcaucguccauggucaauggcguuguaaagcuauuaacuaagcccugggauguaaucccuaugguaacucaaaucgcaaugaccgacacuacuccauuuggccaacaaagaguuuuuaaagagaaaguagauacaagaacaccuaaagcgaagagagguacagcgcaaauaauggaaguuaccgccaaguggcuuuggggauucuuaucaagaaauaagaaaccaagaaucugcacuagagaagaguucacucgaaaaguacggaguaaugcagcgauuggggcaguguucguugaugaaaaccaauggaacuccgcuaaagaagccguagaggaugaaagauuuugggacuuaguacaccgagaacgcgaauugcauaagcaagguaaaugugccaccugugucuauaacaugaugggcaagagagagaagaaacuaggcgaauuuggaaaagcaaaagguucacgugcaauuugguacaugugguuaggggcaagguucuuagaauuugaagcgcugggauuuaugaacgaagaccauugguucucaagagaaaauuccuuaagcggaguagaaggggaaggauuacacaagcucgguuauauacuaagagauauuucaaaaauuccagggggcaacauguaugcagaugauaccgcagguugggacacaagaauaacugaagacgauuuacaaaaugaggcuagaauuacagauauuauggagccagagcaugccuuacuagccaaaagcauuuuuaaauugacuuaucagaauaagguagugcggguccaacgcccggccaaaaacggaacaguaauggacgucaucucccguagagaucaaagggguucaggacagguggguacauauggacucaacacguucacuaauauggaggcacaacugauucgucaaauggagagcgagggaaucuucucgccaucugaacuagagacccccaacuuagcagagcguguacuagauugguuggaaaaauaugggguagaaagauugaaacggauggcuauaucuggugaugauugugucguaaagccuaucgacgacagauuugccacagccuuaaccgcuuuaaacgacauggguaaaguccgaaaagacauuccucaaugggaaccuucaaaagguuggaaugacuggcaacaaguuccguuuugcagucaucauuuucaucaauugauaaugaaagauggaagagaaauaguagucccaugucgaaaucaagaugaacucgugggucgggcgagagugucacaaggugcuggguggaguuuacgagaaacugcgugucuagggaagucauacgcacaaauguggcaacuaauguauuuucaccggagagacuuaagauuagccgcaaaugcuaucugcagugcaguucccguagauuggauucccacaucaagaacgacuuggaguauccaugcgcaucaucaauggaugacgacggaagacauguugucugucuggaaccgcguauggauagaagagaauccauggauggaagauaagacccauauaaguaguuggggagacgugcccuaucuugguaaacgagaggaccaauggugugggaguuuaauaggucuaaccgcaagagcuacgugggcaaccaauauacaaguagcaauuaaccaaguaaggcgacuaauagguaacgaaaauuaccuagacuauaugacgucuaugaaaagguucaaaaaugaaagcgacccggaaggugcucuuugguaa

SEQ ID NO: 21169 - RNA, 9879 nt, Artificial Sequence
  derived and/or modified CDS sequence (opt6) from DENV-1__GQ868635__SS-prME
ucagucaccaugcuucugaugcugaugccgaccgcauuggcuuuucaccuaacaacaagaggaggagaaccacauaugaucgugagcaaacaagaacgcggaaaaucucuauuguuuaaaacuucggccgguguaaacauguguacuuuaauagcaauggacuuaggcgaauuaugugaggauaccaugacguauaaauguccaagaauuacagaggcugaaccagacgacguagauuguugguguaaugcuacggauacuugggugacauacgggacauguagucaaacgggugagcacaggcgagauaaacgauccguugcuuuggcuccccacguaggauuaggacuagaaaccagaacggaaacauggaugucaucugaaggggcauggaaacaaauccaaagaguagaaacaugggcuuugcgacacccgggauuuacugucauggcuuuauuccuagcucacgcuaucggaacuagcauaacgcaaaaaggaaucauauuuauacuauuaaugcuugugacaccgucgauggcuaugcgcuguguagguauaggaucaagagacuucguagaggguuuauccggggcaaccuggguagacgucguucuagagcacggaucaugugugacaacaauggcuaaagacaaaccaacacuggacauagaacuauugaaaaccgaaguaacgaaucccgccauuuuaagaaaacuuuguauagaagcaaaaauaucaaauacaaccaccgacucaagguguccaacgcaaggggaggcaacguuaguugaggagcaagaugcuaauuucguauguagaaggacauuuguagacagaggauggggaaauggcuguggguuauucgggaaaggaucacucauaacaugcgcaaaauucaaaugcguaacuaaacucgaggggaaaauaguccaauaugaaaaucuaaaauacucuguaaucgucacuguucauacgggagaccaacaucaaguaggaaaugagucuacugagcacggaacaacugcuaccauaacuccgcaggcgccuacaaccgaaauucaauuaacggauuauggugcacucacacuugauuguagcccacggacuggccuggacuucaacgaaaugguauugcucacaaugaaagagaaaaguugguuaguucacaaacaaugguuuuuggauuuaccauuaccauggacaucuggcgcaucgacuucacaagaaacuuggaaccgccaagaucuuuuagugacauucaaaacagcgcaugcuaagaaacaagagguagugguacuaggcucgcaggaaggugcuaugcauacggcgcuuaccggagcaaccgaaauacaaacguccggcaccacaaccaucuuugcuggccauuuaaaaugcagguugaaaauggauaaauugacuuuaaaaggaaugaguuacguaauguguacaggcucauucaaauuagaaaaagaaguugcagaaacacaacaugguacagugcuagugcaaauuaaauaugaagguacugaugcaccgugcaaaauuccguuuagcacacaagacgaaaaggguguaacgcaaaauggacggcucaucaccgcaaacccaauugucacugacaaagagaaaccagugaauauagaagcagagccgccauuuggggagagcuauauugugauaggggccggagaaaaagcucuaaaauuaucaugguuuaagaaaggcucgucaauuggaaagauguuugaagcuaccgcucguggagccagacgaauggcuaucuuaggcgacaccgcgugggauuuuggaagcauaggugguguauuuacuucgguaggaaaacuuguacaucaaaucuuuggagcggcauacggcgugcuguucaguggaguuaguuggacuaugaaaauagggauuggaguacuucuaacgugguuaggucucaauagcagguccacaucgcuaaguaugacuuguauagcuguaggccuaguuacacuuuauuuaggugugaugguacaagcugacucaggauguguaauuaauuggaaaggucgagagcugaaaugcggcaguggaauuuuugucacuaaugaaguacauacauggaccgaacaauauaaguuucaagcugauucuccgaaacgguugagugcugcgauagguaaagccugggaagaggguguuuguggcaucagaucagcaacacguuuggaaaacauuauguggaaacaaauuaguaaugaauuaaaucacauucuauuagaaaaugauaugaaauucacagucguaguuggagaugucgcaggcaucuuagcacaagggaagaaaaugauacggccucagccaauggaauauaaauauucauggaaaucaugggggaaggcaaagaucauuggugcggauguacaaaacaccacuuucaucauagaugguccgaauacucccgaaugucccgaugaccaacgagcauggaacauaugggaaguagaggauuacggcuuugguauauuuacgacaaacauuuggcuaaaacuuagagauaguuacacucagguuugugaucacagacucaugagcgcagccaucaaagauucgaaagcuguacaugcagauaugggguauuggaucgagagcgagaaaaacgaaaccuggaaauuagcaagggcaaguuuuaucgaagucaagaccugcauuuggccgaaaucacacacgcuuuggaguaacgggguccuagaaagcgaaaugauaauaccaaaaauauaugguggcccgaucucucagcacaacuacaggccaggauauuucacgcaaaccgcaggaccguggcauuuaggaaaauuagaauuggacuucgauuuaugugaaggcacaacggucguaguugacgaacauuguggaaauagaggcccauccuuaaggacaacuacaguuacagggaaaauaauacaugaaugguguugcagaaguuguacauuaccaccacugcgauuucguggcgaagacgguuguugguaugguauggaaauccguccuguaaaagagaaagaggaaaauuuagucaagagcauggugucagccggcaguggagaaguugauucguucagccuaggcuuauuaugcauaagcaucaugauagaagaagucaugagaucccgauggucacgaaaaaugcucaugacgggcacgcucgcgguauuccuauuacucaucaugggacagcuaacguggaaugacuugauccguuugugcauaaugguaggcgcaaacgcaucagacagaaugggaaugggaacuacuuaucucgcuuuaauggcuacguucaaaaugagaccaauguuugcagugggauuauuauuucguaggcuaacaucgagagagguuuuacuauuaacaauaggacugagucucguggcaagcgucgaacuaccaaauucgcuagaagaguuaggagacggucuugcgauggggauaaugauacucaaacuauuaacagauuuccaaucucaucaguuaugggccacauuauuaucacuaacauuuaucaaaacuacauuuucacuacauuaugcauggaagacgauggcuauggucuugagcauaguaucccuauuuccuuuaugucugagcacaacgucacagaaaacuacuuggcuaccaguucuacuagguagccuaggcuguaaaccguuaacaauguuucuaauagcggaaaacaagauuuggggaaggaggagcuggccucuuaaugaaggaauaauggcuguagggauugucucaauuuuacucaguucacuauugaaaaacgacguuccccuagccggaccccuaauagcggguggcauguuaauugccugcuauguaaucucaggauccagcgcagacuuaucuuuagaaaaagcggcggaagucagcugggaagaagaagcagaacauucaggagcuucucauaacauucuuguugagguacaagaugaugguaccaugaagauaaaagacgaagaacgagaugacacgcucacaauacucuugaaggcuacauuauuagcgguaagcggaguauacccuuuaaguaucccagccacacuauucgucugguacuucuggcagaagaagaaacaacgcagcgguguucugugggauacgccaucgccaccugaaguugaaaaagcaguauuagaugacgguauauaccgaauaaugcaaagaggcuuguuggguagaagccaaguaggaguaggaguauuucaagaaaauguauuucacacaauguggcauguuacuaggggugcaguguuaauguaucaagguaaaagauuagagccaucaugggcaucggucaagaaagauuuaaucucuuauggugguggauggagacuacaaggaucauggaauacaggggaagaaguacaaguaauagcaguagaaccaggcaaaaauccaaagaacguucaaacagcgcccgguaccuuuaagaccccggaaggcgagguaggcgccauagcccuagauuuuaaaccggguacgagcggcucaccaauaguaaaccgcgaaggaaaaaucgucgguuuauacggaaauggaguuguuacuaccucggguacauacguuuccgcuauagcgcaggcuaaggcuucgcaagaagggccgcuaccagaaauagaagacgagguauuucgaaaaagaaacuuaacaauaauggauuugcauccaggcaguggaaaaacuagaagauaucucccagcaauaguuagagaagcgaucaaacgaaaauugagaaccuuaauccuugcgccaacaagagugguagcaagugagauggccgaagcauugaaaggaaugccaauaagauaucaaacuaccgccguaaaaucugaacauacagguaaagagauaguagaccuuaugugucacgcaaccuucacgaugagacuucuaagucccguccgggucccgaauuauaauaugauaauaauggaugaagcucauuuuacagauccaucaucaauugcagccagagguuauauaaguacuaggguggguaugggcgaagccgccgcuauauuuaugacugcuacacccccuggaagcguagaagcguucccacagagcaaugcuguaauacaagacgaagaacgagacauccccgaaagauccuggaauagcggauaugaguggaucacugacuucccgggaaagacuguaugguuuguuccaucuauaaaaucgggcaaugauauagcuaacuguuuacggaaaaaugguaaacguguuauacaacuuaguagaaagaccuucgauacagaauaucagaaaaccaaaaauaaugacugggacuauguaguaaccacggacauaagugaaaugggcgcaaacuuucgugcagaucgaguuauugauccccgucguugucuuaagccgguaauauuaaaggaugguccugaaagagucauuuuggcaggaccaaugccaguaacgguugcaucagccgcucaaagacggggacguauuggacgaaaccauaauaaagagggugaccaguauauauauaugggacaaccacuaaacaacgacgaggaccaugcccacuggacagaagcaaaaauguuacuggacaauaucaauaccccugagggaauuaucccggccuuauucgagcccgaaagagaaaagucagcagcaaucgauggagaauaccgacuaagaggagaagcccggaaaacuuuuguagaauuaaugaggagaggagaucuaccaguauggcuaucauauaaaguugcauccgaaggauuucaauauucugaucgacgaugguguuuugauggggaaagaaauaaucaagucuuagaggaaaauauggacguagaaauauggacaaaagagggugaacguaagaaacuccgucccagauggcuagaugcacggacguauucagauccacuugcgcuucgggaguucaaagaguucgcugccggccggagauccgucucuggggauuuaauacuagaaaucgggaaauuaccucaacaucuaacgcaacgugcacagaaugcuuuagauaaucuaguuauguuacacaacagugaacaaggaggacgggccuaccgacacgccauggaggaguugccagauacaauagaaacucucauguuauuagcguugauugcuguuuuaacaggcggaguaacgcuguucuuccuuucaggaagaggccuagggaaaacaaguauugguuuguugugugucauggcaucgucaguacuacuuuggauggcaaguguggagccacacuggauagcagcuucaauaauucuagaauuuuucuuaaugguccuacugauaccagaaccagaccgccaaaggacaccgcaagacaaucaacuagcauacguagucauaggguuauuguuuaugauuuuaacgguagcggcuaacgaaauggguuuauuggaaacuaccaagaaagaucuaggaaucggacaugucgccguagguaaucaccaucaugcagcaaugcuugaugucgaucuacauccugcauccgcauggacacuuuaugcuguugcuaccacuauaauaacaccgaugaugagacacacaauagagaauaccaccgcuaacauaaguuugacggccauagcgaaccaagcugccauucuaaugggacuugacaagggauggcccauuucaaagauggauauaggcguaccgcuacuggcacuggguugcuauagucaggucaacccucugacauuaacagcugcaguguuaauguugguugcgcauuaugccauuauaggaccaggccugcaggcaaaggcaaccagagaagcccagaaacguacagccgcagggauaaugaaaaaucccacagucgauggaauaguagcuauagaccuagauccggucgucuacgacgcuaaauuugaaaaacaauuaggccaaauaauguuauuaaucuuaugcacgagccaaauccuucugaugaggacaacaugggccuuaugugaaucuauaacucucgcuaccggcccacuuaccacauuaugggaggggucaccgggaaaauuuuggaauacgacgauagcggucucaauggccaacauuuuuagaggcucguaccuugcgggugcagguuuagcauucuccuuaaugaaaagucucggagguggaagaaggggaaccggagcgcagggagagacccuaggagaaaaguggaaaagacaauuaaaucaguuaagcaaaagcgaauuuaauacguauaaaagaucgggaaucauggaaguggaucggagcgaggccaaagaaggcuugaaacgcggggaaacgacaaaacacgcgguguccagagguacagcgaagcuaagaugguucguugaacguaaucuaguaaagccagaaggaaaaguuaucgaccugggauguggcagaggaggauggucuuacuauugcgcaggacuuaaaaagguaacggaaguuaaaggauauacaaaaggcggaccagggcaugaagaacccauaccaauggcaacguauggauggaaccuuguaaaacuucacucaggaaaagacguauucuuuauaccgccagaaaaaugugacacacugcugugugacauaggggaaucuucccccaauccgacaaucgaagaagggaggacacuacggguccuuaaaauggucgagccuugguuacggggaaaucaguuuugcauaaaaauacucaauccguacaugccaucaguaguagaaacacuagaacagaugcagcggaaacauggagggaugcuaguuaggaauccucuaucaaggaacucuacacacgaaauguacuggguaagcugcggaacaggaaacauaguaagugcuguaaauaugacaaguaggaugcuguugaaccgauucacuauggcacauagaaaaccaacuuaugaaagagacguugaucuaggagcggguacacgacauguggccguugaaccugaagucgcgaaucucgauauaauaggacaaagaauugaaaauauaaaacaugaacauaaaucuaccuggcauuacgacgaggacaacccauauaaaaccugggcuuaccacgguucauacgaagucaaaccauccgguucugcaucuucaauggugaauggagucgugaaauuacuaaccaaaccaugggauguuauaccuaugguaacacaaaucgcgaugacagauacaacgccauucggucaacaaagaguauuuaaagaaaaaguagauacacgaacaccuaaagcuaagcgaggaacagcacagauaauggaagucaccgcaaaaugguuguggggauuccugagucggaauaagaagccgcguauuuguacccgugaagaauuuacaaggaaaguaagaucuaaugcagcaauaggcgcaguauuugucgaugaaaaucaauggaauagugcaaaagaagcuguugaagaugaacgcuuuugggacuugguucaucgagaacgugaacuacauaaacaggguaagugugcaacuuguguauacaacaugaugggcaaacgcgagaagaaauuaggcgaauuuggaaaagcaaaaggaucucgugcuaucugguacauguggcuaggagcuagguuuuuagaguucgaagcacugggauucaugaacgaagaucauugguuuuccagggaaaacaguuuaaguggaguagaaggggaagguuuacacaaacuuggguauauauugcgagacauaucuaagauaccuggagguaauauguacgcagacgauaccgccgggugggauacucggauaacugaagaugauuuacaaaaugaagcgcggauaaccgauauaauggaaccagaacacgccuuacuagcgaaguccaucuuuaaauugaccuaucaaaauaagguagugagaguacaacguccagcgaaaaacggaacagugauggacguaauaucccggagagaucagagagggagcggacaagucggaacuuaugguuuaaauacauuuacaaauauggaagcgcagcuaauccgucagauggagagugaagguauauuuucaccgagugaguuagagacgcccaacuuggcagaacgcguucuugacuggcuagagaaauaugguguugaaagacugaaacguauggccauaaguggugaugauugugucguuaaaccuauagacgacagauuugcaaccgcauugacugcuuuaaacgauaugggaaaaguccgaaaggacauaccccaaugggaaccuuccaaaggguggaaugacuggcaacaggugcccuuuuguucacaucauuuucaucaacucauuaugaaagaugggagagaaauaguaguuccguguaggaaucaagaugaauugguaggccgagcgagggugagucagggagcugguuggucucuccgagagacagcaugucucggcaaaucauaugcacaaauguggcaauuaauguacuuucacagaagagaucuaaggcuagcagcuaaugccauaugcagugcagucccuguggauuggauaccaacaaguagaacuaccuggaguauacaugcucaucaucaauggaugacgacggaagauauguuaagcguauggaaucgagucuggauagaggagaacccguggauggaagauaaaacucauauaucaaguuggggugacguaccauaccuugguaagcgagaagaccaaugguguggaagccuaauaggauugacagcgcgagcaacaugggccacaaacauucagguugcuauaaaucaaguucgaagacuaauaggaaaugagaauuaucuagacuacaugaccucgaugaaacgcuuuaaaaacgaaagugacccggaaggagcauugugguaa

SEQ ID NO: 21170 - RNA, 9879 nt, Artificial Sequence
  derived and/or modified CDS sequence (opt6) from DENV-1__GQ868636__SS-prME
ucgguaacaaugcuucuaauguuaaugccuacugcauuggcauuucaccuaaccacgcguggaggggaaccacauaugaucguaacaaaacaagaacggggaaaaagccuguuguucaaaacaucagccgguguaaauauguguaccuugauagccauggauuuaggagaacuuugugaagauacaaugaccuauaaauguccaagaauuacugaagcugaaccagacgacgucgauugcuggugcaaugcgaccgauacaugggucaccuauggaacuugcucgcaaacaggagagcaccgaagagauaaacgcucuguagcuuuggcaccacaugugggacuaggucucgagacgagaacugaaacuuggaugucuucagaaggggcauggaaacaaauacaaagaguagagacuugggcauugagacaucccggauuuacugugauagccuuauuccuggcacacgcaauaggaaccaguauaacccaaaaaggaaucauauuuaucuuguuaauguuaguaacaccaucuauggcuaugagguguguaggaauuggaucaagagauuuugucgaggggcuaucaggugccacuuggguggacguuguucuagaacauggaucuuguguuacaaccauggccaaagacaaacccacgcuugauauugaacuccucaaaacagaaguuacaaacccugcuguucucagaaaacuaugcauagaggcgaaaaucucaaauaccacaacagacucacgaugccccacacaaggagaagcuacauuaauggaggaacaagacgcaaauuuuguauguagaaggacguucguugaucgcggauggggcaacggcuguggauuguuugguaaaggcucguuaauaacaugcgcaaaauuuaagugcguaacaaaauuagaagggaaaaucgugcaauaugaaaauuuaaaauacucaguuauuguaacgguccauaccggagaucaacaucaaguagguaaugaaagcacugaacauggaacuacugcuacuauaacuccgcaagcuccgacgucggaaauucagcuaaccgacuauggcgcccucacucuagauuguucccccaggacggggcucgacuuuaaugaaaugguucuucuaaccaugaaagaaaagucgugguuaguccauaaacaaugguuccuagacuugccauuaccuuggacaaguggagccucaacuucgcaagagacauggaacagacaagaucuucuuguaacauucaaaacagcucacgcuaagaaacaagaaguuguuguccugggcagccaagaaggggcaaugcauacagcgcucacaggggccacugaaauacaaacgagugggaccacgacuauauuugcaggacaucuaaaaugucgcuuaaaaauggauaagcuaaccuuaaaagggaugucuuacguaauguguaccggguccuucaaacuugaaaaggaagucgcagaaacacaacauggaacaguccucguucaaauaaaauaugaaggaacggaugccccuugcaaaauuccauucaguacacaagacgagaagggugucacucaaaacggacgccugaucacugcaaauccuauaguuaccgacaaagaaaaacccguuaauauagaggcagaaccacccuuuggggaaucguacaucgucauuggugccggggaaaaagcucuaaaacuaaguugguucaaaaagggaucuaguauaggaaaaauguuugaagcgacagcaagaggagcacgacgaauggcaauucucggugauacggcaugggauuuugggucuauagguggaguauucacaucaguggguaaauuaguacaucagauauuugguaccgccuauggaguuuuguucucuggugucaguuggaccaugaaaauagguauagguguauuacuaacgugguuaggccuuaacagcaggaguaccucauuaaguaugacuuguauugcuguagggcuggugacucuauauuuaggcguaauggugcaagcugacucaggaugcgucauaaauuggaagggccgugaacuuaaauguggaaguggaauauucguuacaaaugaaguacauacuuggacagaacaauacaaauuccaagccgacaguccaaaaagguugagugcugcaauagguaaggcuugggaagaaggagugugcggaauacgaagugcaacacgucuagaaaauauuauguggaaacaaauaucaaaugagcuuaaucacauacuacucgagaacgacaugaaauuuacaguaguaguaggagauguaguagggauccuugcucaaggcaagaaaaugauaaggccccaaccgauggaacauaaguacaguuggaaaucauggggaaaagcuaagauaauaggugcagacguacaaaauacaaccuuuaucauugauggcccaaacacgcccgaaugucccgaugaccagagagcguggaauaucugggaaguagaggauuacggauucgguauauucacuacaaauauaugguuaaaauugagggauucauacacacaagucugcgaccaucggcuuaugucagcagcaauaaaggauaguaaagcuguucacgcugauaugggauauuggaucgagucugagaaaaaugaaacguggaaguuagcucgcgccagcuucaucgaaguaaaaacuuguauauggccuaaaucucacacgcucuggucaaacgggguauuggaaagugaaaugauaauacccaaaauauacggcggcccaauuucgcaacauaacuaucggccaggcuacuucacgcaaacagcggguccuuggcaucuaggaaaacuugaacuagacuuugauuuaugugagggaacuacaguagucguggaugagcauugugguaacagggguccuucucuucggacgaccaccguuacaggaaaaauuauccaugaauggugcugucgcagcuguacacuacccccacuuagguuuaaaggggaagauggauguugguacggaauggaaauuagacccguuaaagaaaaagaggaaaaucuaguaaaaaguauggucuccgcugggcuaggcgagguagauuccuuuucguuagggcuccuauguauaucgauaaugauagaagaagugaugagauccagauggucacguaaaauguuaauggccggaacacuggcuguauuucuacuuuuaauaauggggcaacuaaccuggaaugaucuuaucaggcuuugcauuaugguaggagcaaacgccagugaucggaugggaauggggacuacuuaccuagcccuaauggcgaccuuuaagaugaggccaauguucgcaguuggacuccucuuuagaagacuuacgucccgagagguccuccuucuuacuauaggacuaagucuaguugcgucaguagaauuaccuaauaguuuagaagaacucggggauggacuagcgauggggauaaugauacuaaaauugcuaaccgauuuccaaucgcaucaauuaugggcuacucuacuaucuuuaacauucauuaaaacaacauuauccuuacaucaugcauggaaaacuauggcaaugguauuaucuauuguaucacuauuuccauuaugucuuucaacaacgucccagaaaacaacuuggcugccgguacuucuagggagucuuggauguaaaccucuuacaauguuuuuaaucgcagaaaacaaaauuugggggagaaaaucuuggccauugaacgaaggaauuauggcaguagguguagugucuauuuuacuaucaaguuugcuuaaaaaugauguaccuuuagcuggaccccuaauagcaggcggcauguugauugccuguuacgugaucuccgguuccuccgcugauuugucguuggaaaaggcagcagaggucagcugggaagaagaagcagagcauagcggagccagccauaauaucuuggucgaaguucaagaugauggcaccaugaaaaucaaagaugaagaaagagacgacacauuaacaauuuugcuaaaagcaacuuuauuggcuauaaguggcguuuacccauuaucaauuccagcaaccuuauuugucugguacuuuuggcaaaagaagaaacaaagaucuggcguacuaugggauacuccaucgccgccagaaguagaaagagcaguucuagacgacggaauuuacaggauuaugcaacgaggucuguuaggccgaucgcaaguaggggugggaguuuuucaagagaaugucuuccacacgauguggcaugucacaaggggugccguauuaauguaucaaggaaaacgucuggaacccucuugggcgucagucaagaaagaucugauuucguauggcggaggauggaggcuacaagguagcuggaauacaggugaagagguccaagugauagcuguggagccuggcaaaaaucccaaaaacguacaaacagcaccaggaacauucaaaacgccugagggagaaguaggugcuauugccuuggauuucaaaccaggaacguccgguagucccauagucaauagagaaggaaaaauagucggacucuaugguaacggcgucguaaccacguccggaacuuaugucucagcgauagcacaagcgaaagccucucaagaagggccgcuaccagaaauagaagaugaaguauuuaggaaaagaaaucuaacaauaauggauuuacauccuggguccgguaagacacggagguacuuaccugcgauaguucgugaggcgauaaaacgcaaacuucgaacacuaauucuugcaccuacaagaguagucgcgagcgaaauggccgaggcacucaaaggcaugccaauuagauaccaaacgacagcgguaaagagcgaacauacuggaaaagagauuguagaccuuaugugucacgcgacauucaccaugagauuacucucccccguuaggguaccaaacuauaauaugauuaucauggacgaggcacacuucacugaccccucuagcauagcagcacgaggcuauauaucuacgagagugggaaugggagaggcagcugcuauuuucaugacagcaacaccuccaggaagcguugaagccuucccucaaagcaaugcaguuauccaagaugaagaaagagacauuccugaacgaucauggaacagcggauaugaguggauaaccgacuucccugguaaaacuguaugguuuguccccagcauaaaaucaggaaaugauaucgccaauugucuuaggaaaaaugguaaacgaguuauacaacugagcagaaaaacguuugauacggaauaccagaaaaccaaaaauaaugauugggauuacguaguaacuacagacauuucagaaaugggagcgaacuuuagagcggaucggguuauagauccaagacgauguuuaaagccagugauacuuaaagaugguccggagcgagugaucuuagcaggaccaaugccaguuacaguggccagugcggcacagagacgcggacggaucgggagaaaucauaauaaagagggugaucaguacaucuacaugggucaacccuuaaauaaugaugaggaucacgcccauuggacagaggcaaaaauguuauuggacaacaucaacacaccagaagguauuauuccugcccuauuugaaccggaaagagaaaaaucagcagcaaucgacggagaauacagacugcgaggagaggcuagaaaaacuuucguagagcuuaugaggcgaggagauuuaccgguauggcuaucuuauaaaguagcgucagaggguuuccaauacucugacagaagguggugcuucgacggagagaggaauaaccagguauuagaagagaacauggacguagaaauauggacaaaggaaggugaacggaaaaaguuaagaccccguuggcuagaugcuaggacauacagcgauccacucgcccuacgagaguuuaaggaguuugccgcagggcgaagaagugugucaggagacuuaauauuagaaauagggaaacuuccacaacaucuaacgcaaagagcacagaaugcauuggacaauuuaguaauguuacacaauucagaacaaggggguagggcuuacagacaugcgauggaagaacuaccugauacaauagaaacgcuaaugcuucuggcucuaauagcgguauugaccggaggcguaacccuguucuuuuuaucaggaaggggcuuaggaaaaacaagcauaggauugcuuuguguaauggcaaguagcguccugcuauggauggcgucaguggagccacauuggauagcggcaagcauuauacucgaauuuuuccuaauggugcuacucaucccagaaccagaccgacaacguacaccacaagauaaccaacucgcauauguuguaaucggucuauuauucaugauuuuaaccguagcagcgaacgaaaugggacuucuugaaacaacaaagaaagacuuggggauaggacauguugcgguagaaaaucaccaccaugcgacuaugcuugauguggauuugcauccggcaucagcuuggacauuguaugccguugcuacaacaaucauaaccccuaugaugagacauacaauugagaauacgacagcaaauauaaguuugacugcaauagcuaaucaagcugcgauacuuaugggauuggauaaagguuggccaauauccaagauggauauaggaguaccacuuuuagccuugggauguuauucgcaagugaacccccucacacugacggcagccguccuaauguuaguagcacacuacgcgauaauagggccaggauuacaggcuaaagcaacucgugaagcccagaaaagaacggcagcugggauaaugaaaaauccaacugucgauggaauaguggcgauugaucuggacccuguaguauaugaugcaaaguuugaaaaacaacuuggacagauaauguugcuaauacuaugcacaagucaaauauuacuaaugcgcacuacuugggcucuaugcgagucaauaacauuagcaacaggaccuuuaacaacacuaugggaaggaucaccaggaaaguuuuggaauacaacgauugcugucucaauggcuaauaucuuccgaggcucuuaccucgcuggggccggauuagcuuuuucacuuaugaaaagccugggaggaggucgccgggggaccggagcccagggggagacauuaggggagaaguggaaacgucaacuaaaccaauuaucuaagucagaguuuaacauauauaaaaggagugguauuauggaaguagauaggagugaagcuaaagaaggauugaaaaggggcgaaacgacacgccacgccguuucgcgaggcacggcgaaacuaagaugguuuguugaacggaaccucguuaaaccggaggguaaaguuauugacuugggaugcggccgagggggcugguccuacuauugugccggucuuaagaaagucaccgaaguaaaaggauauaccaaaggaggaccugggcacgaggagccaauucccauggcuaccuauggguggaaccuaguuaagcuccauucugggaaggacguauucuuuacaccuccagaacguugcgauacucuucuaugugauauaggagaaagcagcccaaauccaacuauagaagagggacgaacacuaagaguacuaaaaauggucgagccauggcuuagagggaaccaauucuguauuaaaauucuuaaucccuauaugccaucgguugucgaaacucuagagcaaaugcaacgaaaacacggaggcaugcuuguacgcaaccccuugagccguaacagcacccaugagauguacugggugucaugcgggacugggaauauaguuagcgcaguaaacaugacuucacgcauguugcugaauagguuuacuauggcacauagaaaaccaacauaugagagagacgucgaucuaggggcagggacgcgacauguugcuguagaacccgaagucgcuaacuuagacauaaucggacaaagaauagaaaacaucaaacaugagcauaaaagcacauggcauuaugaugaagauaacccguauaaaacuugggcuuaucauggcucuuaugaaguuaaaccuagcgguucagcauccaguaugguaaauggagucguaaaacuacuaaccaaaccaugggauguaauacccauggucacccagauugccaugacagauacgacucccuucggacaacaaagaguguuuaaggaaaaaguagauacuaggacuccuaaagcuaaacgagggaccgcucagaucauggaagucacugcacgguggcuauggggcuuuuuaagcaggaauaagaaacccaggaucuguacuagagaagaguuuacacgcaaaguacgaaguaaugcagcaaucggagcaguguucguugaugagaaucaguggaacucugcuaaggaggcuguugaagaugagcgauuuugggaccuaguacaaaaagagagagaacuacauaaacaagguaagugcgcuacauguguuuacaauaugauggguaaaagagagaagaaauugggugaauuugguaaggcuaaagguaguagagcgauaugguauaugugguuaggagcacgauuucuugaauuugaagcauuaggauuuaugaaugaagaucauugguucucaagagaaaauucguugagcggugucgaaggagagggacuucauaaguugggauauauacuuagagauaucucaaaaauaccagguggaaauauguacgcagaugauacugcagggugggacaccagaauaacugaagacgaccuccagaaugaagcuaaaauaacagauauaauggagcccgaacaugcuuuacuagcaaccucaauauucaaacuuacauaccaaaauaagguggugaggguucaacguccagccaagaacgguacaguuauggauguaaucucaagaagggaucaaagagguaguggacaaguuggaacauauggguugaacacauucacaaauauggaagcucaacuaauucgacaaauggaaagugaaggaaucuuucuaccauccgaauuggaaacaccaaacuuagcagaaagaguacuagacuggcuagaaaaacacggaguugagagauuaaagcgcauggcaauaucaggggacgauugcguggugaaaccuauagaugauagauuugcuacggcacuaaccgcauuaaaugacaugggaaaagucagaaaagauauuccacaaugggaacccuccaaaggauggaaugacuggcagcaaguaccuuuuugcucacaucacuuucaccaguuaaucaugaaggaugguagagaaauaguuguuccaugucguaaccaagaugaauugguaggucgugcgagagucucacaaggugcuggauggagucuuagagaaacagcaugcuuagggaaaucauacgcacaaauguggcagcucauguauuuucauagaagggaucucagacuggccgcuaaugccauuugcucggcaguaccuguggacuggguaccaaccucaaggacuaccuggaguauucacgcucaucaucaguggaugacaacugaagauaugcuaaguguguggaaccgagucuggauagaagagaacccuuggauggaagacaaaacacacguaaguaguuggggagauguaccguaucuugguaaacgagaagaccaaugguguggaaguuuaauuggacucacugcaagagccacuugggcaagcaacauacaaguagcaauaaaccaaguaagaagacuaauaggcaaugaaaauuaucuagauuacaugaccucaaugaaacgauuuaaaaaugaaggcgacccggaaggagcauuaugguga

SEQ ID NO: 21171 - RNA, 9879 nt, Artificial Sequence
  derived and/or modified CDS sequence (opt6) from DENV-1__GU131922__SS-prME
uccguaauaaugcugcuaaugcuuaugccuacagcuuuagcuuuccaucuuacaaccagaggaggggaaccacauaugauaguaagcaaacaagaaaggggaaaaucacuacuauuuaaaacuagcgcaggaguuaacaugugcacacuaauagcgauggauuuaggugaacuaugcgaagacacgaugacauacaaaugcccucguauaaccgaagcggaaccggaugauguagacuguuggugcaaugcgacugauaccuggguaacuuacgggacaugcagucaaacuggugaacaucgcagagacaaaagguccguggcucucgcaccucauguaggacuaggacuagaaacuagaacagaaacauggaugucguccgaaggugcuuggaaacaaauacaacggguugagaccugggcguuaagacaucccggauucacagucauugcacuauucuuagcacaugccauagguacuucgauuacacaaaaagguauaaucuuuauauuacuaauguugguaacaccaaguauggcaaugagaugugugggaauuggauccagagauuucguagaaggacugagcggagcuacgugggucgauguuguauuggagcauggaagcugugugaccacaauggcaaaagacaaaccaaccuuggauauugaacuucuaaaaacagaagucacgaaucccgcgauacuuagaaaauugugcauugaagcaaaaaucaguaacaccacaaccgacuccagaugcccaacacaaggggaggcuacuuugguggaagaacaagaugccaacuucgugugucgaaggacauucgucgaucgaggauggggaaauggauguggauuauuuggaaaaggaagucuuauaacaugcgcaaaauuuaaauguguuacaaaauuggaagggaaaauuguucaauaugagaaucuaaaauacucagugauaguaacaguacacacgggugaucaacaucaagucgggaaugaaucaacagaacacggaacgacagcaaccauaacaccacaagcgccuacuacagaaauacaauugacggauuauggagcacuaacucuggauuguucaccaagaacaggauuggauuuuaaugaaaugguucugcugacaaugaaagagaaaaguuggcuagugcauaaacaaugguuuuuggauuugccacuuccauggaccuccggugcuucgacaagccaagagaccuggaauaggcaagaccuauuaguuacauucaaaacagcccaugccaagaaacaagaggucguuguguuaggaucacaggaaggcgcaaugcauacggccuuaacgggggcuacagaaauccagaccucagguaccacaacaauauuugcaggacaucuaaaaugcagauuaaaaauggauaaacucacuuuaaaaggcaugaguuacgucauguguacagguaguuucaaacuagagaaagaaguugcugagacgcaacauggaaccguuuuaguucagauuaaauacgaaggcaccgaugcccccugcaaaauaccuuuuagcacccaagacgaaaaaggaguuacacagaauggccgguuaaucacagcgaauccaaucguuacugauaaagaaaaaccagugaacauagaagcugaaccaccauuuggagagaguuacaucgucauaggagcgggggagaaagcccugaaacuauccugguuuaagaaaggaagcaguauaggcaagauguuugaagcaacggcucgaggcgcaagacguauggcgauacuuggagauacagcgugggacuucggaaguauaggagggguauucacgucuguggguaagcuggugcaucagaucuuuggcaccgcauaugggguccuuuucagcggggucucuuggacaaugaaaauugguauagguguguuguuaacauggcugggguuaaacucacgauccacaaguuuaucaaugacuuguauagcagucggccuagugacccuguauuuaggaguaaugguucaagccgacaguggaugcguaauaaauuggaaagggcgcgagcuaaaaugugguagcggcaucuuuguaacgaacgaagugcauacauggacagagcaauauaaguuucaagcugacaguccuaagcgcuuaucggcugcaauaggaaaggcuugggaagaaggaguaugugguauuagaagugcgacucgccuugaaaauauuauguggaagcaaauuucaaaugaacuuaaucacauacugcuagagaaugauaugaaauucacgguuguaguuggagacguagcugguaucuuagcccaaggaaagaagaugauacguccacaaccuauggaguauaaauauucuuggaagaguuggggaaaggcaaagaucauaggggcagauguccagaacaccacguuuauaaucgauggacccaauacgcccgaaugcccggaugaccagagagcuuggaauauaugggaaguugaagauuauggauucgguauuuuuacgaccaauauauggcuaaaacuuagagacucuuauacgcaaguaugugaccaccgauuaaugagcgcugcaauuaaagauagcaaagcgguucacgcagauaugggauacuggauagaaucagaaaagaaugaaaccuggaaauuagcaagagccucguucauugaagucaagacaugcauuuggccgaaaagucauacacucuggucaaacggcguacuggagucggaaaugauaaucccaaaaauauacggagguccuauuucgcaacauaauuaucgcccaggguacuucacacagacugcaggaccguggcauuuagguaaacuagaacucgauuuugaccucugugaaggaacaaccguugucgucgacgaacacugcgguaaucgaggacccucucuuagaacaacaacgguaacuggaaagauaauucaugaaugguguuguagauccugcacauuacccccuuugagauuucgaggagaagacggguguugguauggaauggaaauacgcccaguaaaggaaaaagaagaaaauuuagugaaaucaauggucagugcagguagcggggaaguagauuccuucagucucggucugcuaugcauaucaauuaugauagaagaagugaugcguucacgguggucuagaaaaaugcuuaugacaggaacuuuagcuguguucuuacucuuaaucaugggacagcuuaccuggaaugauuugauacgauuauguaucaugguaggcgcuaaugccucagauaggaugggaauggguacgacauauuuagcuuuaauggcaacauuuaaaaugcgaccuauguuugcuguuggguuauuauuuaggagacugacaaguagggaaguacugcuacuuacgauaggguuaagucuuguagcgagcguagagcugccaaauucguuagaagaauuaggagaugguuuagcgauggggauaaugauccucaaguuacuaacagauuuccaaucucaucaauuaugggccacacuguuaucacuuaccuucauuaaaacaacuuuuucacuucauuacgcguggaaaacgauggcuaugguauugagcauuguaucguuauucccguuaugccuuaguaccaccucacagaaaacuacauggcucccgguacuccuaggaaguuuaggguguaaaccauuaacaauguuuuuaauagcugaaaauaaaaucugggguagaagaucuuggccucucaaugaaggaauaauggcagugggcaucguaucgauacuacuaagcagcuuacucaaaaaugauguaccacuagcagggccauugaucgcaggagggauguuaauagcuugcuauguaauuucgggguccucagccgaccuaucgcuagaaaaggcugcagagguuaguugggaagaggaggcggaacacucaggagccagucacaauauucuuguggaaguacaagaugacggaacaaugaaaauaaaggacgaagaaagggaugauacucuaacuauuuuauugaaagcaacuuuauuagcuguaagcggaguauacccacuuaguauaccagcaacacuuuuuguaugguauuuuuggcagaagaagaaacaaagaagcggagugcuaugggauacgccgucaccacccgaaguggaaagagcaguacuagaugacgguaucuaucguauaaugcaaaggggucuauuagguagaucucaagugggaguuggugucuuccaggagaauguuuuccacacuauguggcacguaaccagaggggcaguuuuaauguaccaaggaaaacgauuggagcccucuugggcgagugucaagaaagaucuaaucucauacggaggagguuggcguuugcagggaucuuggaauacuggagaagaggugcaaguaauugcugucgaaccaggcaaaaaucccaaaaauguacaaacugccccagggacauuuaaaacaccagaaggggaaguaggcgcuauagcguuagauuuuaaaccgggaacaaguggaagccccauuguaaacagagaaggaaaaaucguaggauuauauggcaacggaguaguuacuaccuccgggacuuaugucuccgcgaucgcacaggcgaaagcaagccaagaaggaccacugccugagauugaagaugaaguuuucaggaaaagaaauuuaacgauaauggaccuacauccagguuccggcaaaacacguagauauuuaccugccauuguaagagaggccaucaaaaggaaauugcgaacacuaauccuggcucccacgaggguaguugcuagcgaaauggcugaggcauugaaaggaaugcccauucgauaucaaacaacagccguaaaauccgagcauacgggaaaggaaauuguagacuugaugugucacgcaacuuuuaccaugcggcuuuuaucuccagugcgcguaccaaauuauaauaugauuauaauggacgaagcacauuuuacugauccaucuuccauugcagcaagaggauauauauccacucgaguaggaaugggagaagcugcggccauauucaugacagcuacuccaccaggaaguguugaagcauucccacaguccaaugcggucauucaagaugaagagagggauauaccagaaaggaguuggaacucagguuacgaguggaucacggauuuuccugguaaaacuguaugguuugugccaucaauuaagaguggcaaugauaucgcaaacugucuucgaaagaaugguaagcgagucauccaauuaagcagaaaaacauucgacacugaguaccagaaaacuaaaaacaaugauugggauuacguaguaacaacagauaucagugaaaugggggcaaacuucagagcugauagaguaaucgauccuagaagguguuuaaaaccggugauacuaaaagauggaccggaacgugucauauuggcaggcccuaugccgguuacaguagcuucagccgcacagcgaaggggucguaucgggcgaaaucauaacaaagaaggugaccaauauauauauaugggacaaccgcuaaacaacgacgaagaccaugcacauuggacggaagcaaaaaugcuucuugacaacauuaacacaccagaggguauaauacccgcccuuuuugaaccugaacgcgagaaaagugccgcuauagacggagaauauaggcuccgcggagaagcaagaaaaacuuuuguggaacugaugagaagaggagaucuuccaguauggcucagcuacaaaguugcauccgagggguuucaauauuccgauagacguugguguuuugacggagagagaaacaaucaaguacuugaagaaaacauggaugucgagauauggacaaaagaaggagaacguaaaaaguuacgcccaagguggcuugaugcccguacauacagugauccacucgcccuccgcgaauuuaaagaguucgcugcuggccgacgcagugucagcggugauuugauccuagaaauaggaaaauugccacaacaucuaacgcagagagcccagaacgcauuagacaauuuagucauguuacacaacucugaacaagguggacgagcuuaucgacaugcgauggaagaauuaccagacaccaucgagacgcugaugcucuuagcccuuauagcaguguuaacgggcggcguuacacuauucuuccuuucuggaagaggccugggaaaaaccucuauaggauuacuuugcguaauggccuccuccguucuacucuggauggcaaguguagaaccacacuggauagcggccaguauaaucuuagaguucuucuuaaugguacuauugauacccgaaccagacagacagagaacgccacaagacaaccaacuugcuuaugucguuauuggcuuacuauuuaugauauugacgguagcagcgaaugagauggggcugcuggaaacaacuaagaaagaccuugguaucggacauguagcagugggaaaccaucaccacgcggccaugcuggaugucgauuuacauccugcuucugcauggacacucuaugcugucgccacgacuauaauuacaccaaugaugcgucauacaauagaaaauacaaccgcaaacaucucacugacagcaauagcaaaucaagcggcuauuuugaugggucucgauaaagguuggccuauaucaaaaauggacauaggcgucccacuacucgcuuugggauguuauagucaggugaauccacugacauuaacggcagcgguacuaaugcugguagcacauuaugccauuauuggccccggacuccaggcgaaagcgacacgagaggcccagaaacgcacggcagcggggauuaugaaaaacccaacugucgauggcauuguugcgaucgacuuagauccaguuguauacgaugcuaaauucgagaaacaacuaggacagauaaugcuacuuauacucuguacuucccaaaucuuguuaaugcgaacaacuugggcguuaugugagucgaucacacuugccacuggaccauuaacaacauuaugggaagggagucccggaaaauuuuggaacacuacaauugcaguaaguauggcaaauaucuuccgagggaguuauuuagcuggggcaggauuagcauucucucuuaugaagagucuagggggugggaggagggggacaggugcacaaggugaaacacugggugagaaauggaaaagacaauuaaaccaauugucaaaaucugaguucaauacuuacaaaagaagcgggaucauggaagucgacaggucugaagcaaaggaagguuuaaaacgaggagaaacgacgaaacaugcaguuucacgaggaacagcgaaacugaggugguuuguagaacguaaccuaguuaaaccugaagggaaaguaauugaucuaggaugcgggaggggugguuggucauacuacugugcagggcucaagaaaguaacagaagugaaaggauacacgaagggagggccaggacaugaagaacccauccccauggcaacauauggguggaaucucguuaaguugcacucgggaaaagacgucuucuucauuccuccggaaaaaugcgauacgcuauuaugugauauaggugagucaucacccaaccccaccauagaagaagggagaacgcucagaguacuaaaaaugguugaaccuuggcuaagagguaaucaguuuuguauaaaaauucuaaauccuuauaugccuaguguugucgaaacauuagaacagaugcaaagaaaacacggagggaugcuuguaagaaauccacuuucucgaaauuccacccaugagauguauuggguaagcugcgguaccgguaauauugugagugcaguaaauaugaccagcaggauguuacuuaaccguuucacuauggcacauagaaaaccaacuuaugaaagagacguagaucuaggagcuggcacacgucauguagcaguggaaccagaaguagcuaauuuagauauaauaggucaacgcauagagaauauuaaacaugaacacaaauccacauggcauuaugaugaagauaauccguauaaaacaugggcauaucacgggaguuaugaaguuaaaccaagugguucugcaucuagcaugguaaacggugucgucaaauuauugacgaagccaugggaugucaucccgaugguuacacaaauugcuaugacggauacaacuccauucggucaacagcgaguauuuaaagaaaaaguagacacucgaaccccuaaagcgaaaagagguacagcucaaaucauggaaguaacugcaaaguggcuguggggcuuucuaucgcguaacaagaaaccacggauauguacgcgugaggaguucaccaggaaaguaagaucgaaugcugcaaucggggccguauucgucgacgaaaaccaauggaacagcgcaaaggaggccguugaagacgaaagguuuugggauuugguccacaaagaaagagaauugcauaaacaagggaaaugugcaacaugcguguauaacaugauggggaagcgagagaagaaauugggugaauuugggaaggccaaaggaaguagagcaauaugguacauguggcucggagcucgguucuuagaguucgaagcguugggauuuaugaaugaggaccauugguucucucgggagaacucucuaagcggaguugaaggugaagggcugcauaaauuaggauacauacuucgagauaucucuaagaucccuggugguaauauguaugcagaugauacagccggaugggauacaagaauuacugaagacgaucuucaaaacgaagcaagaauuacagauaucauggaaccggaacaugccuuauuggcaaaaucaauauuuaaacuaacauaucaaaacaaaguaguuagaguccaaagaccagccaaaaacggaacggugauggacgucauaagucgucgagaucagagagggaguggacaaguaggcacauauggcuuaaacacauuuacaaauauggaagcgcaacuaauuaggcagauggaaagugagggcauauuuuccccaagcgagcucgaaacaccgaaccuggccgaacggguacuagauugguuagaaaaauauggagucgagcggcuaaaacgaauggcaauauccggagaugauugugugguuaaaccaauugacgauagauucgcuacagcuuuaaccgcccugaaugauaugggcaagguucgaaaggauauaccucaaugggagccaaguaaggguuggaacgacuggcagcaaguaccuuucuguucucaccacuuucaccagcuuauuaugaaagauggaagggaaauaguagugccuugucgcaaccaagacgagcuagucggcagagcacgugugucucaaggcgcaggguggucucuaagggaaacagcgugucuuggcaaaagcuaugcgcaaauguggcaacucauguauuuucacaggagagauuuacgacuagcagcgaacgcuauuuguagcgcaguucccguugacuggauaccuacaagccgaacuacauggaguauacacgcucaucaucaauggaugaccaccgaagauauguuaagcguauggaacaggguauggauagaagagaauccauggauggaagauaaaacccacauaucaagcuggggagauguaccauaucuugggaagagagaggaucaauggugcgguucucuaaucggacuuacagcacgcgcuacaugggcaacgaauauucaaguugcaauaaaucaaguaagaagacuuauaggcaacgaaaacuaccuugacuauaugacuucaaugaaacgguucaaaaacgaaucagauccggaaggagcguuaugguaa

SEQ ID NO: 21172 - RNA, 9879 nt, Artificial Sequence
  derived and/or modified CDS sequence (opt6) from DENV-1__GU131923__SS-prME
agcguuacgaugcuacuaaugcuuaugcccacugcccuggcauuucaucuuacaacacgcggaggagaaccacauaugauaguauccaaacaagaaagagguaagagucuucucuuuaagacaagcgcgggagugaauauguguacuuugauugcaauggauuugggagaacucugcgaagauacaaugacauauaaauguccucgaauuacagaagcggaaccagacgacguagauugcuggugcaaugccacagauacauggguaaccuaugguacuuguucacaaacaggugaacaucgaagagauaaaagaagugucgcacuggcaccccauguuggucuaggucuagaaacuagaacagaaacauggaugaguagugaaggugcauggaaacaaauacaaaggguugaaacaugggcauuaagacauccuggauucacagugauagcucuuuucuuggcacacgcuaucggaaccuccauaacacagaaagguauaaucuucauauuauuaauguuagugacgccaucuauggccaugagaugcguugggaucggaucaagagauuuuguugaaggauugucaggagcaacuuggguagaugucgucuuagaacauggaaguuguguaacgacuauggcaaaggauaaaccaacauuggauauagaacuacugaaaacugaaguaacaaaccccgcuaucuuacgaaaauuguguauugaagcgaagaucagcaacacuacuacugauucucguugcccaacgcaaggagaagcgacccugguagaagaacaggaugcaaacuuugucugcagaaggacaguugucgacagggguuggggcaacggcuguggauuguucggcaaggguucauuaauuaccugcgccaaauucaaaugcguuacuaaauuggaaggaaaaauaguccaauaugaaaauuuaaaauacaguguuauaguuacagugcauaccggugaucaacaucaaguaggcaacgaaucuacagaacacgggacuacagcaaccauuacgccgcaagcuccaacaacugaaauccaguugacagauuacggugcucucacauuagauuguuccccucgaaccggguuggacuuuaaugagaugguucugcuaaccaugaaggagaaaucauggcuaguucauaaacaaugguucuuagacuugccacucccauggacaagcggugcuucuacaagccaagaaacauggaauagacaagacuuauuaguaacuuuuaaaaccgcacaugcaaagaaacaagaaguuguaguacucggaucacaagaaggugcaaugcacacugcguuaacgggggcaacugaaauacaaacaucuggcacgacuacuauauucgcuggacacuugaagugucgacucaagauggauaagcuaacacuuaaaggaaugucguauguuauguguacugguucguucaaauuagagaaagaaguugccgaaacacaacauggcacuguauuaguucaaauaaaauacgaaggaacagaugccccauguaaaauuccguucagcacacaagacgaaaaaggaauaacccaaaaugggcgacugauaaccgcaaacccaauaguaacggauaaggaaaaaccagucaauauugaagcugaaccaccuuucggcgaguccuauauuguaauaggagcaggagaaaaggcuuuaaagcugucaugguucaagaaagguucgucaauagguaaaauguuugaagcaaccgccaggggcgcuagaagaauggccauuuuaggggacacggcaugggauuucgggaguaucggcggaguguuuacaucuguuggcaaauuagugcaucaaauauucggaacugcauauggagugcuauuuucaggaguaagcuggaccaugaaaauaggaauuggaguguuguuaacuuggcucggccuaaauucaaggucuacgaguuuaaguaugaccugcauagcaguaggauuagucacguuguaucuggguguuauggugcaggcugacucaggcugcgucaucaauuggaagggaagagaguuaaaauguggaaguggcauuuucguaaccaacgagguucacacguggacagaacaauauaaauuucaggcggacucaccuaagcgcuuaagugcagcuauagguaaggcaugggaggaaggaguaugcgguauccgaagugcgacacgacuggaaaacauuauguggaagcaaauaaguaacgaacugaaccauaucuuauuagaaaaugauaugaaguucaccgucgugguaggugacguagcagguauucucgcgcagggcaagaaaaugauccguccccaaccaauggaauauaaauauucauggaaaagcuggggaaaagcaaaaauuauaggagcagacguacaaaauacgacuuucauuauagauggaccuaacacuccugaauguccagaugaucaaagagcuuggaauauaugggaagucgaagauuacggauuuggaaucuuuacaacaaacauaugguuaaaacuuagggauucauauacgcaagucugcgaccaucgucuuaugucugcugcgauuaaagauagcaaagcagugcacgcugauauggguuacuggauugaauccgagaaaaaugagacuuggaaacuagcaagagccucauuuauugaagugaaaacuuguauuuggcccaaaagucauacacuauggucaaaugguguauuagaaagcgaaaugauaauacccaaaaucuauggggguccaauaagccaacacaacuaucggcccggauacuuuacacaaacugcaggccccuggcaccuaggaaagcuagaauuagacuucgauuuaugcgaaggaacaaccguuguuguggacgaacacugugggaaccgggguccaucucuccgcacaacuacagugacuggaaaaauaauacacgaauggugcuguagaaguugcacucuaccaccacucagauucagaggggaagauggcuguugguaugggauggagauccggccaguuaaggaaaaagaagaaaaccucguuaaaucaauggugucugcagguagcggagaaguagacuccuucucguugggauugcucuguauaaguauaaugauagaagaaguuaugcgaucucgauggagucgaaaaaugcuaaugacagggacccuggcaguguuucucuuacucaucaugggacaacuuacauggaaugaccuuauaagauuaugcauaauggugggugcuaaugcguccgaucgaaugggcauggguacuaccuacuuggcacucauggcuaccuuuaaaaugagacccauguuugcuguugguuuauuguuuaggagauuaacaucacgagaaguguuauuacucacgauaggacuuucccucgucgcuuccguugaguugcccaacaguuuagaagaacuaggugauggauuggcaauggguauaaugauuuuaaaacuauuaacugauuuucaaagucaucaacugugggcaacguuacuaucucucacuuuuauaaaaacaacuuucucguuacauuacgccuggaagacgauggcaaugguuuuaucaaucguaagucuauuuccauuaugccuaucgacaacaagccagaaaacuacgugguuaccaguauuauuagguagucuugguugcaagccacugacgauguuccuuaucgcggaaaauaaaauauggggcaaaagaucuuggccuuuaaaugaaggaauuauggcuguugguauagugaguauucugcuaaguucacuuuugaaaaacgauguaccgcuagcuggacccuuaauagccggugguaugcuaauugcaugcuacguaauaaguggaaguagugcagaucucucgcuugagaaagcggcugaaguaagcugggaagaagaagccgagcauaguggagcuucacauaacauccuaguggaaguccaggaugacgguacuaugaaaauaaaggaugaagaaagagaugacacgcuuacaauacugcugaaggcgacccuacucgcuguaagcggaguuuauccacuaaguauacccgccacgcuuuuuguaugguacuucuggcagaagaagaaacaacguucagggguuuugugggauacaccaucacccccggaaguagaacgcgcugugcuagaugacgggauauacaggauuaugcaacguggccugcuaggaaggucacagguugguguugguguauuccaagagaacguauuucacacuauguggcacguuacucgaggagcaguacuuauguaucaagggaaacgauuagaaccaucuugggcuucagucaagaaagaucuuaucucguauggaggaggauggcgacuacaagggucguggaacacaggagaagagguacaaguuauugcagucgaaccgggcaaaaauccgaaaaaugugcaaacagcucccggcacuuucaaaacaccagaaggugaaguaggagcaaucgcacuugauuucaaaccugguacaagcggcucccccauaguaaaucgagaaggaaaaauagugggccuauacggaaauggaguaguaacaacgucagguacauauguaagugcgaucgcgcaagcaaaagcaucccaagaaggacccuuacccgagauagaagacgaaguguuucgaaaaagaaaucugacuauuauggauuuacauccaggaagugggaaaacgcgucgguaccuaccagcuauagugcgagaggcgauuaaaagaaaguuacgcacacuaauacuagcaccuacuagagucgucgcuagcgaaauggcugaggcuuuaaaagguaugccaauaagauaucaaaccaccgcagugaagucagagcacaccgguaaagaaauaguagaccuuaugugccaugccacuuuuacaaugagacuacuuucacccgugagaguaccaaacuauaauaugauaauaauggacgaagcgcacuuuaccgauccaucuucuauagcugcaaggggguauauaaguacgagaguaggaaugggagaggcugcagccaucuucaugacugcuaccccuccggguucggucgaagcauuuccacaaagcaacgccguaauacaagaugaagaaagagauauuccagaacgaucuuggaauaguggcuaugaauggauuacagacuucccaggaaaaacugucugguucgugccgucuauaaaaucaggaaaugacauagcgaauugcuuaaggaaaaaugggaaacgaguaauacaacuaucaagaaagacauuugacacagaauaucaaaagaccaaaaauaaugacugggauuacgucguaaccacugauauuucagaaaugggagccaauuuuagggccgauagagucauugauccucggcguugcuuaaaaccggugauacuaaaagacggaccagaaagagucauacuagcugguccaaugccugucacaguugcaucagcugcacagcgacguggucggaucgguagaaaccauaauaaggagggugaucaauauauauacauggggcaaccacuuaauaaugacgaagaccaugcccauuggacagaagcaaaaauguuauuagauaauaucaacacuccagaagggauaauaccggcauuauucgaacccgagcgcgaaaagagugcugcaauagauggagaguacagauuaagaggagaagcuagaaaaacuuucguagaguuaaugcguagaggugaccuaccaguaugguugagcuauaaaguugcgagcgaagguuuucaauauucugaucgucgcugguguuuugacggcgaaagaaauaaucaaguccuagaagaaaauauggauguggagauauggacgaaggagggagaacgcaaaaagcugcguccccgauggcuggaugcaaggacauacucugacccccucgcauuaagggaauuuaaagaauuugcagccggccggagguccgucagcggugaccuaauccuagaaauuggaaaauugccccaacauuuaacgcagagagcgcaaaaugcucucgacaaucuaguaauguuacauaauucagagcaggguggcagagcauaucgucaugcuauggaagaacuaccagacacuauagaaacucuaaugcugcuggcauuaauagcuguacuaaccggaggggugacauuauucuuccuaagcggaaggggucuaggaaaaacgucaauaggccuacuaugcguaauggcuucaucaguucucuuguggauggcaaguguugagccacauuggaucgcugcgucaauuauuuuagaguucuuucucaugguauuacuuauaccugaaccagacagacaaaggacuccccaagacaaccaauuagcauauguaguaauuggccuccuauuuaugauuuuaacuguagcugcgaaugagaugggauuacuggaaacgaccaagaaagauuuggggauaggccacgaagcugucggaaaccaucaucacgcagcuaugcuagacguagaccuacauccggcuagugcguggacucuguaugcuguggcaacgacaauaauuacacccaugaugcgacacacaauagaaaacacaacagcgaacaucucuuugacagcuauagcaaaucaagcugcaauucuaaugggacuagauaagggauggcccauuucuaaaauggauaucggaguuccucuucuugcacuugguugcuauucgcagguaaauccacuuacgcuaacagccgcuguauuaaugcuuguggcccacuaugcgauaauaggaccaggacuccaagcaaaggcgacacgcgaagcacaaaagcguaccgcugcaggaauaaugaagaauccgaccguggacgggauaguugcaaucgacuuagacccaguaguauacgacgcuaaauuugaaaagcaacucggacaaauuaugcuucuuauacuguguacgucacaaauauugcuaaugaggacaaccugggcucuaugugaaucaauaacgcuagcuacaggaccgcuaacuacguuaugggagggaucuccuggaaaguucuggaacaccacaauugcaguaucuauggcgaauauuuucagaggaucauaccucgcgggcgcaggguuagcauuuagccucaugaaaagccuaggagggggucgucgaggaacaggagcucaaggugaaacauuaggagagaaguggaaacggcaacucaaccaauuaagcaagucggaguucaauacuuauaaacguucagggaucauggaaguagauagaagugaggcaaaagaaggccuuaaacggggagaaacaacaaaacacgcagugagucgcggaacagcaaaguuacgaugguuuguggaaagaaauuugguaaagcccgaagguaaagucauugaucuugguugugggagaggaggcuggagcuauuacugugcgggcuuaaagaagguaacugaagucaaagguuacaccaaggguggacccggacacgaagaaccuaucccaauggcuacauauggauggaauuuaguuaaacuacauaguggaaaggacguuuucuuuauaccuccagaaaaaugugacacucucuugugugauauaggcgaaucgucaccgaacccaaccauagaagaagggcgaacucuaaggguauuaaaaauggucgaaccuuggcuccguggaaaucaauuuugcauaaaaauacuuaacccauauaugccgucaguaguggaaacccuggaacagaugcaacgcaaacauggaggaaugcucguaagaaauccccuuagucggaauagcacccaugaaauguacuggguaucuugcgggacuggcaacauaguuuccgcuguaaauaugacaagcagaauguuacuuaaucgcuucacgauggcgcauaggaaaccaacauacgaacgagacguugauuuaggggcaggaacaagacauguugccguugaaccggaaguagcaaauuuggauauuauagggcaacgcauugagaauauuaaacaugaacacaaaaguaccuggcacuaugaugaagauaauccuuacaaaacgugggcuuaucacggaucauaugaaguaaaaccuucuggaucagcaaguucuauggucaauggaguuguaaaauuauugacaaagcccugggacgugauaccaauggugacccaaauagccaugacagauacaacaccauucggucaacaaagagucuuuaaggaaaaaguugauacuagaacaccuaaggcuaaacgugggacugcacagauaauggaggugacagcaaaauggcuuuggggauuucugucacguaauaagaaaccaagaauaugcacacgcgaagaguucaccaggaaagugcgaucaaaugcggcaaucggagcaguuuucguugacgagaaucaauggaacucagcaaaggaagcgguagaggaugaaagauuuugggauuugguucaccgugaacgagaacuacauaaacaaggaaagugcgcaaccuguguauauaacaugauggggaagcgagaaaagaagcucggagaguucgguaaagcaaagggaucaagagccauuugguacaugugguugggugcuagguuucucgaauuugaggcuuuaggauuuaugaacgaagaccauugguucucucgcgagaauagcuuaucuggaguugagggggagggcuugcacaagcuggguuacaucuuaagagauauuucaaaaauaccaggagguaauauguaugcggaugacacagcuggcugggauacaagaauaacagaagaugauuuacaaaacgaagcucgaaucacugacauaauggagccagaacacgcuuuacucgcuaaaucuauuuuuaaacuaacauaucagaacaagguuguuagagugcaacgaccugcuaaaaauggaacaguaauggacguaauaucucgaagagaucaacguggaucgggacagguuggcacauacggacucaauacuuucacgaacauggaagcucaauuaauuagacaaauggaaucugagggaauauucucucccagugaacucgaaacccccaaccuagcagagagaguuuuagauuggcucgaaaaguauggagucgaacgcuuaaagagaauggccaucuccggagaugacugugucguuaaacccauagaugauagauuugcaacagcguuaaccgcuuugaaugauauggggaaaguccgaaaggacauuccacaaugggagcccagcaaaggauggaaugauuggcaacagguaccuuucugcucacaccacuuucaccaacucauaaugaaagacggacgugaaauugugguuccuugcagaaaucaagaugaacugguugguagggcgcgagucagccaaggugcaggcuggucccuucgcgaaacagcuugccuuggcaaaucauacgcacaaauguggcaacucauguauuuucaucggcgagauuuaagauuggcggcuaacgcaauaugcagcgcaguaccaguagacuggauaccaaccucgcgcacaaccuggucaauacaugcacaucaucaauggaugacuacggaagauaugcuaucgguauggaaccgagucuggauagaagagaaccccuggauggaagauaaaacgcacauaaguagcuggggagauguaccauacuuagggaagcgggaagaccaaugguguggcagcuuaauaggucugacagcucgcgcaaccugggcaacuaauauucaaguugcuauaaaccaaguccgcagguuaauaggcaaugagaauuaucuagauuauaugacaagcaugaagcgauucaaaaacgagucagauccagagggagcgcuuugguag

SEQ ID NO: 21173 - RNA, 9879 nt, Artificial Sequence
  derived and/or modified CDS sequence (opt6) from DENV-1__GQ868637__SS-prME
aguguuacuauguugcuuaugcugaugccuacugcacuagcguuucaucugacuacucgaggaggagaaccacacaugauuguuuccaaacaagaacguggaaaaucccugcuauuuaaaaccagugcugguguaaauaugugcacuuugaucgcuauggaucuuggugaacuaugugaggauacuaugacuuauaaauguccgcggauaaccgagguugagccagacgauguagauuguugguguaacacuaccgauacguggguuacuuaugguacaugcagccaaaccggugagcauagaagagacaaacguucgguagcacucgcaccucacguuggacucgguuuagaaacaagagcagaaaccuggaugaguucggaaggggcauggaaacaaauacaaagaguagaaacaugggcucugaggcacccuggauuuacaguaauagcuuuauuuuuagcgcaugcgauugggacaucaauuacucaaaaagggaucauauuuauccuucuaaugcuuguaacaccuagcauggcuaugagaugcguuggaaucgggucaagagauuuuguagagggucuuucaggggcuacguggguugauguaguacuagaacaugggaguugugucaccacgauggccaaagacaaaccaacacuggauauagaacugcuaaaaaccgaagugacuaauccugcggucuugcgaaaauuguguauagaagcaaaaauaaguaacacaacaacugacagucgaugcccuacacaaggggaagcuacgcucguagaagaacaagaugcuaacuuuguaugccgccgcacuuuuguugaccgaggcuggggcaacgguuguggccucuucgguaaaggaucgcuaaucacaugcgcaaaauucaaauguguaacaaaacuggaggguaaaaucgugcaauacgaaaauuugaaauacaguguaaucgugacgguucacacaggagaucaacaucaaguugggaacgaaucuacugagcauggcacuaccgccaccauaacuccacaagcuccuacaucugaaauccaauugacggauuacggcgcuuuaacuuuagacuguaguccaagaacaggccuugacuuuaacgaaaugguucuacuaacaaugaaagagaaaagcugguuaguacauaaacaaugguuuuuggacuuaccucugcccuggaccaguggggcuaguacaucucaagaaaccuggaacagacaagauuugcucgucacauuuaaaacggcacaugccaagaaacaagaaguagucguguuagguucccaagaaggcgcgaugcacaccgcacugacgggugcaacagaaauucaaaccucagguacaaccacaaucuuugccggacacuuaaaguguagauuaaagauggauaaacuaacauuaaaaggcaugucuuaugucauguguacagguaguuuuaaacuagaaaaagagguagcagaaacccaacacgggaccguuuugguacagauaaaguaugaaggaacggacgcacccuguaaaauaccauuuaguacgcaggaugaaaagggaguaacgcaaaauggcagguuaauaacagcuaacccuauaguaacagauaaagaaaagccaguuaauauagaagcggagccgccauucggugaaagcuauaucguaauuggcgccggagaaaaggcgcugaaacuuucaugguucaaaaagggauccucgaucggaaagauguucgaagcaacagcuagaggagcuagacgaauggcaauacucggcgauacagcaugggacuucgguucaaucggaggaguguuuacaaguguaggaaaacuuguacaccagauauucgguacugcuuaugguguucuauuuagcgggguaucauggacgaugaaaauuggaaucgggguucuacugacuuggcuaggauuaaacucgcgaaguacgucacuaucaaugacauguauugccguaggcuuaguuacacuauaucucggaguaaugguacaagccgauaguggaugcguuauuaacuggaaagguagagagcuuaaaugcgggaguggaaucuuuguaacuaaugaaguucacacauggaccgaacaauacaaauuucaggcugacucaccaaaaagguuaagugcagcuauugggaaagcaugggaagaggggguauguggcaucagaucugcuacgagacuagaaaauauuauguggcgacaaauaucaaacgaacuaaaucacauuuuguuagaaaaugauaugaaauuuacugucguaguaggggacguuguagggauccuagcacaaggaaagaagaugauccgaccucaaccuauggaacauaaguacagcuggaaaucauggggaaaggccaaaauaauuggcgcagacguacaaaacaccacuuuuauaauugauggaccuaauacaccagaauguccagacgaccaacgugcauggaacauuugggaaguagaggauuauggguuuggaaucuucacaacaaacauaugguuaaagcucagagauuccuauacucaagugugcgaucaucgacucaugagcgcagcuauuaaagauucaaaggccgugcaugcagauaugggguauuggauagaaagcgagaaaaaugaaacauggaagcuagcacgugcgucguucauagaaguuaagacaugcauauggccaaagucacacacuuuauggucaaacggaguguuggaauccgaaaugaucauaccgaaaauuuauggagggccgauaagccaacauaauuaucgcccaggauauuuuacccaaacugcuggaccuuggcacuuaggaaaauuggagcuagauuuugauuugugcgaagguacaacagucguuguggaugaacacugugguaaucgaggaccaucuuuaagaacaacaacagugaccggaaagaucauacacgaaugguguugccgaagcugcacauugccuccacuaagguucaaaggggaagaugguugcugguaugguauggaaauaagaccuguaaaagaacgagaagaaaaccuagucaaguccaugguaagugcugggucgggugagguagauucguucaguuuaggguugcucugcauuaguauaaugauagaagaaguaaugcguucuagauggagucgaaaaaugcugaugacuggaacgcuugcaguauucuucuuauugauaauggggcaacugacauggaaugauuuaauaagacuauguaucaugguaggugcaaaugcaagcgaccguauggggaugggaacuacauaucuugccuugauggcuacauuuaaaaugcggcccauguuugcaguaggucuacucuuuagaaggcuaacgaguagagaaguuuuauuacuaacuauuggccucagccugguagcgucgguagagcucccuaauucgcucgaggagcuuggcgaugggcuggcaaugggaauaaugauauugaaacucuuaacagacuuucaaagccaccagcuuugggcaacacuacugucguuaacauuuauaaaaacgacauucucacuacauuacgcguggaagacaauggcaaugguacuuaguauuguuaguuuacuaccgcugugucuguccacuacgucgcagaaaacgaccuggcucccuguucuauuaggaucuuuaggguguaagccauuaacaauguuccugauagcugaaaacaagauauggggucguaagucuuggccuuuaaacgaaggaauuauggcaguaggaauagucucaauacucuuguccucacuacuuaaaaaugauguaccgcuagccggaccacuuauagcuggaggaaugcucauugcguguuauguaauaucugguaguucagcggaccuuaguuuagaaaaagccgccgaggugucuugggaagaggaagcugaacauucaggggccucucauaauauccugguagagguacaagacgauggaacaaugaagauaaaagaugaagaacgcgaugacacacuaaccauacuuuuaaaggcuacacucuuagcaguuucagguguauauccucucucaauuccagcgacucuguucgugugguacuuuuggcagaagaagaaacagagaagcggcguguuaugggauaccccaagcccgccagaaguugaacgagcagugcuagacgaugguauauaccgaauuaugcaaagaggccuccuaggacgaucccaaguuggagucggagucuuucaagaaaacgucuuucauacaauguggcauguuacaagaggagcuguucuuauguaccagggcaagagacuggaaccuucgugggcaucugucaagaaagacuuaauaucguacgggggcgguuggcggcuccagggaaguuggaauacgggagaagaagugcaaguuauagcaguagagccaggcaaaaaucccaaaaauguccaaacagcuccuggaacauucaaaaccccagagggagagguuggugcaauugcuuuggacuuuaaaccagguacaagugggucuccuauaguaaauagagaaggaaagauaguuggauuguacgggaacggaguugucaccacaucuggaacauauguauccgcaauagcccaggccaaagcaucacaagaagguccauugcccgaaauugaagacgaggucuuuagaaaaaggaauuuaacuauaauggaucuucauccagggucugggaaaacaagaagguaccuaccagcgauaguaagagaggcuauuaaaagaaaacuucguacuuuaauccucgccccaacuagaguaguugccuccgaaauggcugaagccuuaaaaggaaugccaauuagauaucaaaccacugcuguuaaaucagaacacacuggaagggaaaucguagaucuuaugugucaugcaacuuuuaccaugagacuauuaagucccguucgaguuccaaacuauaauaugauaauuauggaugaagcucauuuuacagauccaaguucaauugcagcgagagguuacauaucaacaagaguugggaugggugaagccgcugccauauucaugacagcaacacccccaggaagcguugaagcauuuccacaaaguaaugcaguaauccaagacgaggaacgagacauucccgagagaucguggaacagcggauaugaauggauuacagauuuuccgggaaaaacuguaugguuuguuccuaguauaaaaucaggaaaugacauagccaacugccuaaggaagaacggaaaacgcgugauccaguuguccagaaaaacauucgacacugaauaucagaagacgaagaauaaugacugggacuacgucguaacgacagauauuucagaaaugggagcuaacuucagggcggauagaguuauagauccacgacguuguuugaagccuguaauauugaaagauggaccugagagagugauacuggcaggcccgaugccaguaacugucgcuuccgcagcccaaaggagaggucggauuggaagaaaucacaacaaagaaggggaucaauauauuuauaugggacaaccacuuaauaaugacgaagaucacgcccauuggacagaagcaaagauguuacuagauaacauuaauacaccagaggguauaauaccagcuuuauuugaaccagagcgugagaaaagcgcugccauugauggggaauacagacuaagaggugaagcacgaaaaacuuuuguagaauuaaugagaagaggagaucuucccguauggcuaaguuauaaaguugcauccgaaggauuccaauacuccgauagaagauggugcuucgacggcgaaagaaauaaucaaguacucgaggagaauauggauguugaaaucuggacuaaagaaggugaaagaaagaaguuaagaccaagaugguuggacgcccgaacguacagcgacccacuggcguuaagagaauuuaaggaguucgcagcaggacgacgaagcgucagcggagauuuaauacuagaaauugggaaauuaccgcaacacuuaacccaaagggcacaaaacgcgcuagauaaccuagucauguugcauaacuccgaacaaggagggcgggcauaccgacaugcuauggaagaacucccagauacaauagaaacuuuaaugcuuuuagcauuaauugcaguacugacaggaggaguaaccuuauuuuucuugagcggaagaggucugggcaagacaaguauaggacucuugugugucauggcaucaucagcccugcuauggauggcgaguguggagccacacuggauagcugcaaguauaauccucgaguucuuucuuaugguauuguuaauuccagagcccgaccggcaacgaacuccacaagauaaccaacucgcguaugugguuaucggguuauuauuuaugauuuuaacuguagcugcaaacgaaaugggacugcuggaaacuacaaagaaagaucuaggcauaggccaugucgcgguagaaaaucaccaucaugcaacaauguuagacguagaucuacauccugcuagcgcuuggaccuuauaugcagucgcuacuacaauuauaaccccaaugaugagacauacgauugagaacacaacugcgaacauaucucucaccgcaauugcaaaucaagccgccauccuaaugggauuagacaagggguggccgaucagcaagauggacauuggggugccccuacuugcuuuaggcuguuacucccaagugaauccccugacucucauagcugcgguauugaugcucgucgcacauuaugcaauaaucgguccaggucuacaggcaaaggcuacaagagaagcacagaaaagaacugcagcuggcauuaugaagaacccaaccguugacggcauuguagcgauugaucuugauccuguaguauacgacgcaaaauucgaaaaacaacuaggacagauaaugcuacuaauauuguguaccucccaaauauugcuaaugagaacaacaugggcccuaugugaaagcauuacuuuagcuaccggcccauugacuacucuuugggaagguucgccaggaaaauucuggaacacgaccauagccgugucuauggcaaacaucuuccgugguucauaucuagccggagcuggacuugcguuuucuuuaaugaagaguuuagggggugggcgccguggaacuggagcacagggagaaacauugggugagaaauggaaaagacagcuuaaucaacucucuaaaagugaauuuaauaccuauaaaaggucugggauuauggaaguagaucguucggaagcaaaagagggacugagacguggugagacgacaaaacacgcugugagucgagggacagcaaaacucagaugguuuguugaaagaaaucuuguuaaaccagaaggaaagguaauagacuugggauguggccgagguggcugguccuauuauugugcuggccuaaagaaagucacagagguaaaaggauauacgaaaggaggcccgggccaugaggaaccaauaccaauggcuacguauggauggaacuugguaaaauuacauagugggaaagaugucuucuuuauaccaccugaaaaaugugauacacuccuaugugauauaggagagucaucuccaaacccaacuauugaagaggggagaacguuaaggguucuaaaaaugguagaaccguggcuacgugguaaucaauucugcaucaaaauacucaauccauauaugccuucagugguagaaacucuagaacagaugcagagaaaacauggaggaaugcuaguaagaaauccacuaucgcggaacagcacucacgaaauguacugggugaguugugguacuggcaauauagugucagcuguuaacaugacaaguagaaugcuuuuaaaccgcuucacuauggcacaucgcaaacccacauacgaacgagauguagaccucggugcaggcacgagacauguugcuguugaaccagaaguagcgaauuuagauauaauagggcaacguauagagaauauuaaacaugaacacaagucaaccuggcacuaugacgaagauaauccauacaaaaccugggcuuaccacggaucuuaugaaguaaaaccaagcggaagugcaucgucaaugguaaacggaguagugaaauugcuuacaaagccaugggaugucauuccuaugguuacucaaauugcgaugaccgacacuacccccuucggucaacagagaguauucaaagaaaaaguugauaccagaaccccuaaggcuaaaagagggacugcccaaauaauggaggucacagcacgauggcuauggggauucuugagucguaacaagaaaccucggauaugcacaagagaagaauuuacucgaaaaguccgaucuaacgcggcuauaggugcaguauucguagaugagaaccaguggaacucagccaaagaagccguagaagaugaaagguuuugggauuuaguccaucgagaacgagaauuacauaaacaggguaaaugugcuacuugugucuacaauaugauggggaaaagagagaagaaacuuggggaguuugggaaagccaaggguucuagagcgauaugguacauguggcucggugcuagguucuuagaguuugaggcauuagguuucaugaaugaagaucacugguuuuccagagaaaauagccucucaggaguagaaggugaaggacuacauaaacucgguuauauacuacgugauaucaguaaaauuccaggagguaauauguaugcagaugauacugcuggaugggacacgcgaauaaccgaagacgaucugcaaaaugaagcaaaaauuacagauaucauggagcccgaacacgcauuauuagcaaccucuauuuuuaaauuaacauaucagaauaagguaguacggguccagcgaccggcaaagaauggaacugucauggauguuauaucuagacgagaucaaagaggaagugggcaaguagguacauacggacugaauacguucacuaauauggaagcccaguugauucgacaaauggaguccgaagggauuuucucaccaucagagcucgaaaccccgaaccuggcugaaagaguucuugauuggcucgaaaaauacggggucgaaagacugaaaagaauggccauaucuggugaugacuguguaguaaagcccauagacgauagauucgcaacagcgcuuacagcacugaaugacauggggaaaguuaggaaagauauuccacagugggaacccagcaagggauggaaugauuggcaacaaguaccguucugcucccaccacuuccaccaacuuauaaugaaagacggucgggaaauuguaguacccugccguaaccaagacgaauuaguaggcagagcuagggugagccagggagccggauggucacuuagggaaacagcauguuuagggaagucauaugcgcagauguggcaacucauguauuuucaucggcgggaucugagauuagcggcuaacgcuauuuguucagcaguaccaguugauuggguuccaacaucaagaacaacuuggucaauacacgcacaccaccaauggaugacaaccgaagauaugcuuucaguguggaauagaguuuggauagacgaaaauccuuggauggaagauaagacccacauaucuagcuggggagauguaccuuaucuugguaaacgcgaagaucaauggugcgguucacuaauuggacuaacugcuagagcaacaugggcuacaaacauucaaguagcuaucaaccaaguacgcagauuaauaggaaaugagaauuauuuggacuauaugacaaguaugaaacgauucaagaaugagagcgauccagaaggugcauuaugguaa

SEQ ID NO: 21174 - RNA, 9879 nt, Artificial Sequence
  derived and/or modified CDS sequence (opt6) from DENV-1__GQ868639__SS-prME
aguguuacuauguugcuuaugcugaugccgacggcacuugcauuucaucuaacaacaagaggaggggaaccucacaugauuguaucaaaacaagaaagaggaaaaagucuacuauuuaaaaccuccgcuggaguuaauauguguacguugauagcaauggaccuuggagaauuuugugaagacacuaugacauacaaauguccgagaauuucagaagcagaacccgaugauguggacugcuggugcaacgcuacagauacguggguaacguacggaacaugcagccaaacuggagaacaccgacgagacaaaagaagcguagcucuagcuccacacguggggcuaggcuuggaaaccaggacagaaacguggaugagcucagaaggggcuuggaaacaaauacaacgaguagaaacgugggcauuaaggcacccaggauuuaccguaauagcacuuuuucuagcacaugcgauuggcacuucuauaacucaaaaaggcauuauauucauacuguuaauguuggucacucccucuauggccaugagauguguaggcauugggucacgagacuuuguugaaggguuaaguggagccacuuggguggauguaguauuggaacacgguucuuguguuaccacaauggcaaaagacaaacccacuuuagacauagaacuacugaaaacugaaguuacaaauccagccguguuacgcaaauuaugcaucgaagcuaaaauaucuaauacaaccacagauuccaggugucccacucaaggugaggcaacucuaguggaggaacaagaugcgaauuuuguaugucggcgaacauuuguugauagagguugggguaacggcugcggauuauuugguaaaggaucauuaauaacuugcgcaaaauucaaauguguaacaaaauuagaagggaaaauuguacaauaugaaaacuugaaauacucuguaauaguaacaguccauacuggagaucaacaccaagugggaaaugagaguacugaacaugguacuacggcuacaauaacuccucaggcgccaagcacagaaauacaacuaacugauuauggugcacuaacauuggauugcagcccgcgcacuggacuagacuucaaugaaaugguguuacuuacaaugaaagaaaaaucguggcuaguacacaagcaaugguuccuagaccuaccacuaccauggacgaguggagcaaguacaucccaagaaacauggaauaggcaggaccuccuagucacauuuaagacagcacaugcgaagaaacaagagguuguaguauuagggagucaagagggggcuaugcacacagcacucacgggggccacagaaauccaaaccucuggcacaacaacaauauucgcaggacauuugaagugccgccuuaagauggacaaacucacuuuaaaaggaaugaguuaugugauguguaccgguaguuucaaguuagaaaaagaaguugcugaaacccaacacgguacugugcuuguacaaauuaaguaugaggggacggaugcaccuugcaagauaccguuuuccacucaggaugaaaaaggggugacucaaaacgggcgguuaauaacagcaaacccaaucguaacagauaaggagaaaccaguaaauauagaagcagaaccucccuucggcgagaguuauauaguaauuggugcuggagaaaaggcauuaaagcugucuugguucaagaaaggaaguagcauaggaaaaauguucgaggcaacagcacgaggugcuagaagaauggcaauuuugggggacacugccugggacuuuggaucuaucgggggaguauucacuucagugggaaaauuaguucaucaaauauucggaacagccuacggcguccuauuuucgggcguuucuuggacuaugaagauuggcauaggaguacuguuaacauggcucggucuaaauucaaggucaacaucauugucaaugacguguauagcaguuggcuugguuacauuauaccuaggaguaaugguacaggccgauuccgguugcguuauaaauuggaaaggccgagaauuaaaguguggaucaggaauauucguaacuaaugaaguccauacuuggacugagcaguauaaauuucaagccgauucuccaaaaagacuuagcgcagcaauaggaaaggcuugggaggaagguguuuguggaauuaggucagcgacaagacuagagaauauuauguggaaacaaauaucaaaugaauuaaaucauauacuauuagagaaugacaugaaauucacaguaguaguaggagaugucgcaggcauucuagcacaagggaagaaaaugauaaggccucaaccaauggaguauaaguauucauggaaaagcuggggaaaagcaaaaauuauuggugcagacguacagaacacuacauuuauaauagauggucccaauacuccagaauguccagacgaucaacgugcauggaacaucugggaggucgaagauuauggauuuggaauauucacgacaaacauauggcuuaagcuccgggauucauacacccaaguaugugaucaucgacuuaugucagcugccauuaaagauagcaaagcaguccacgcagacaugggguauuggauagagucagagaaaaaugagaccuggaaacucgcccgagcaucauuuauagaaguuaaaaccuguauauggccaaaaucacacacucuauggaguaauggaguacuagaaagugagaugauaauacccaaaauauauggagggcccaucucacaacauaauuaucgcccaggcuauuuuacgcagacggcggguccauggcaccuuggcaaacucgaguuagacuuugaccuuugcgaagggacaacaguagugguagaugagcauuguggcaaucgggguccaagccuaagaacuacaacugugacugguaaaauuauacaugaaugguguugucguucuuguaccuuacccccucuaagauucaagggcgaggauggcuguugguauggaauggaaaucagaccaguaaaagagaaagaagaaaauuugguuaaaaguaugguuagugccggcucaggagaaguugacucuuuuucucuagggcuacuaugcaucucgaucaugauagaggagguaaugaggaguagaugguccagaaaaaugcugaugaccggaacccuggcaguauucuuucuuuugauuauggggcaacuaacauggaaugaccugauuagacucuguauaauggucggcgcaaaugcgucagauaggauggggaugggaaugacuuaucucgcacugauggcuaccuucaagaugaggccaauguuugcaguuggauuguuauuuaggagguuaacgucaagggaggugcuuuuguuaacaauaggucuaucauugguagcguccguagaauuaccaaauaguuuggaagaauuaggugauggucuagcgaugggcaucaugauauugaaguuguuagccgauuuccaaucucaucaauugugggcuacucugcuuucucucacguucaucaaaacuaccuuuucacugcacuacgccuggaaaacaauggcuaugguucuaucaauuguaucuuuauuuccccuaugccuaagcacaacaucacagaaaaccaccugguugcccguuuuacuugguagucuaggcuguaaaccccucacaauguuccuaauagcggaaaacaaaaucugggguagaaaaucauggccauugaaugaaggaauuauggcuguaggaauuguaucuauucuguugaguagccuacuuaagaacgacguaccacuagccggaccucuuauugcaggagggauguuaauugcguguuaugucauaucuggcagcucugcugaucuaaguuuggaaaaagcagcagaagucucaugggaagaagaagccgagcauucaggggccucccauaacauucuggucgagguacaagaugacggcaccaugaagauuaaggacgaggagcgugacgauacccuaacuauuuuguugaaggcgacuuuauuagcggucuccggcgucuauccauuaaguaucccagcuacauuauuugucugguauuucuggcagaagaagaaacaaagauccggugugcuaugggauacaccgaguccaccagaaguugagagagcaguguuagaugauggaauuuacagaauuaugcaacgcggauugcuggguagaucacaagucggggugggggucuuccaggaaaauguauuccauacaauguggcauguaacacggggagcagugcucauguaucaagguaaaagacuagagcccucaugggcgucuguaaagaaagaccuaauuagcuaugguggcggguggagacugcaaggaucuuggaauacuggagaagaagugcagguaauagccguagaacccggcaaaaauccgaaaaacguacagacagccccagguacuuucaaaaccucagaaggugaaguuggggccauagcauuagacuucaaaccggggacgagcgggaguccuauaguaaauagggaaggaaaaauaguagguuuguacgggaacgguguaguaacaacaucagguacguacguuucagcgaucgcacaagcgaaagcaucucaagaagguccacuacccgagauugaagacgaggucuuuaggaaaaggaauuuaacuauuauggacuugcauccaggaucgggaaaaacgagaagguacuugccagcgauuguucgugaagcgaucaaaagaaaacuaagaacguuaauucuugcaccgacucgagucguugccagcgaaauggcagaggcauuaaaaggaaugccaauuagauaccaaacgacugcagugaaaucagagcauacggggaaagaaauagucgaccugaugugccaugcgaccuucacuaugcgccuauuaucaccagucaggguaccaaauuacaauaugauuauuauggacgaagcucauuuuacagacccgaguucgauugcggcuagggguuacaucucaacgagagucgguaugggagaagcagcugcaauuuuuaugacggcaacacccccggguuccgcugaggcauuuccacaaucaaacgcaguaauccaagacgaagaaagagauauuccagaaaggucuuggaacucugguuaugaauggauaacagacuucccugguaaaacaguaugguucgucccaucuauaaaaagugggaaugacauagcaaauugucuucgcaaaaauggcaaaagaguaauacaguuaaguagaaagacauuugauacugaguaucagaaaaccaaaaauaaugauugggauuaugugguaacaaccgauauuagcgaaaugggagcaaacuuuagagcugauagggucauagauccgcgucggugcuugaagcccguuauucuaaaagacggaccugaaagagugauccuugccgguccaaugcccgucacagucgcaagcgcagcgcaacgcagagguagaauuggaagaaaucauaauaaagaaggggaucaauauauuuacaugggacagccacuuaauaacgaugaagaccaugcacauuggaccgaggcaaaaauguuacuggacaauauaaacaccccggaggggauaauaccugcgcuauucgaaccugaaagggaaaaaucagcagcuauagauggagaauauagacuaagaggagaagcacgaaaaacauuuguugaacugaugagaaggggagacuuaccaguuuggcucagcuauaaaguugcuucggaaggauuucaauauucggaucgaagauggugcuuugacggagaaaggaauaaccaggucuuggaagaaaacauggauguagaaauauggacgaaagaaggcgagcggaagaaacugcgaccgagguggcuggaugcuaggacuuacagugauccacuagcgcugcgcgaauuuaaggaauuugcagcuggacguagaagugugucaggggaucuaaucuuggaaauaggcaaauuaccucaacaucuaacgcaaagagcacagaaugcuuuagauaauuuggucauguuacacaacuccgagcaaggaggacgugcguaucgacaugcuauggaggaauuaccagauaccaucgaaacccuaaugcuauuagcauuaauagcgguauuaacuggaggggucacauuguucuuccuuucaggaaggggacuaggaaaaacuucgauaggacuacuaugcguuauggcuucaucaguuuuacuuuggauggcguccguagagccacauuggauugcugcaucaauuauacuugaguucuuuuuaauggugcuuuuaauuccggaacccgacaggcaaagaacaccucaagacaaucaacuggcauauguugucauuggacuccuauucaugauucugacaguagcagcgaaugagauggguuugcuagaaacgacuaagaaagauuuaggaaucggucacgucgccgucgaaaaccaccaucacgcggcaaugcucgauguggaucugcacccagcaagugcauggacauuauaugcagucgcaacaacgauaauaaccccaaugaugagacauacgauagaaaacacuacugcuaacauuaguuugacggcgaucgccaaucaagcagcaauucucaugggcuuagacaaaggauggcccauuaguaaaauggauauugggguaccucuauuagcauuagggugcuauucacaagucaacccauugacuuugacugcagcaguauugaugcuugucgcacauuacgcgauuaucggccccggucuacaagcuaaagcgacucgagaagcgcaaaaacgaacagccgcggguauaaugaagaauccaacaguagauggaauagucgccaucgaucucgauccagugguuuaugaugccaaauuugaaaagcaacuaggccaaauuauguuacuaauuuuaugcacaucgcaaauuuuacuaaugagaacgacgugggcucuaugugaaucgauaacgcuagcaacgggcccacugaccacuuuaugggaaggaagcccaggaaaauucuggaacacaacgauagcgguaagcauggcaaacauauucagaggaaguuacuuggcgggugcaggacuagcauucagccuuaugaaaaguuuaggagguggacguagaggcaccggggcccaaggcgagacucuuggagaaaaguggaaaagacaacuaaaccaauugagcaaaucagaguucaauaccuauaaaagaucaggaauaauggaaguagauaggucagaggcaaaggaaggacuaaagcguggugagacaaccaaacacgcuguaagccgagguacggcaaaauugagaugguuuguggaacgcaaucuaguaaaaccugaagggaaaguuaucgaccuuggcugcgguagagguggguggucauauuauugugcgggauuaaagaaaguaacagaaguaaaagguuauacgaaaggagguccaggacacgaagaaccgauuccaauggcaacauauggcuggaacuugguuaaacuccauucagguaaagauguauucuuuguuccgccagaaaaaugcgacacacuccucugugacaucggagaaucaucaccaaauccuacaauagaagagggccgaaccuuacguguauugaagaugguugaaccaugguuacguggcaaucaguucugcauuaagauucuaaacccauacaugccaaguguuguagagacucuggagcaaaugcaacggaaacauggagguauguuggucagaaacccacuaucccguaauucgacacaugagauguauuggguauccuguggaaccgggaauauugucuccgcuguaaauaugacuucccgaaugcuauuaaacagauuuacuauggcgcaccgaaaaccaacauaugagagggauguggacuuaggagcggggacccgccacguagcuguugaaccugaaguggccaacuuagacauaauuggacaacguaucgaaaauauuaagcaugaacauaaaucaacauggcauuacgaugaagauaauccguacaagacaugggccuaucacggaaguuacgaagucaaacccucugggucagcaagcuccaugguaaacggcguaguaaagcuacuuaccaaacccugggaugucauuccaaugguaacacaaauagcaaugaccgauaccacacccuuugggcagcaaagagucuucaaagaaaaaguggacacacgaaccccaaaagcaaagcgggggacugcucaaauaauggaagucacagcgaagugguuguggggcuuuuugucaaggaacaagaaaccuagaauuuguacgcgagaagaauuuacuagaaagguaagaucuaacgcagcgauaggagcuguguuuguagaugagaaccaauggaacucagccaaagaagcaguagaggaugaacguuucugggacuuagugcaccgugaaagagaauugcauaaacaaggaaaaugcgcaacuuguguauauaacaugaugggaaagagagagaagaaacuaggcgaauuuggaaaagcaaaagggucaagggccaucugguauaugugguuaggagcuagauuucuagaauuugaagcauuggguuuuaugaaugaggaccauugguuuucgagagaaaauucauugucaggcguggaaggggaagggcuacauaaacuaggauauauauugcgagacauuucuaaaaucucagggggcaauauguacgccgaugauacagcuggcugggauacucggauaacugaagacgacuuacaaaacgaagcaaaaauaacggacauaauggaaccagagcacgcauuauuagccaagucuauauuuaaauugacauaucaaaauaagguggugaggguucagaggcccgccaaaaaugguacgguaauggacguuauuaguaggagggaucaacgaggcagcggacagguuggaacauacggacugaauacauucaccaacauggaagcccaacucauccgucaaauggagucggaaggaaucuuuagccccagugaauuagaaaccccuaacuuggcggaacgggcuuuggacugguuagaaaaacacggaguagaaagguuaaaaagaauggcaauaagcggugacgauuguguaguuaaaccgauagacgacagauuugcuacggcucugacggcacuuaaugacauggguaaagugagaaaggacauuccucaaugggaaccgucaaaaggcuggaacgacuggcaacagguaccuuucuguucucaucauuuucaucaauuaauuaugaaagacggccgagaaaucgucguuccuugucguaaccaagaugagcugguuggcagagcuagaguaagucaaggggcaggauggucucuucgggagacugcaugcuuagggaaaaguuaugcacaaauguggcaacuaauguacuuucaucggcgugaccuuagguuagcagccaaugcaauauguucagcagucccgguugauuggguaccuacaagucggacaacguggagcauccaugcacaccaucaauggaugaccacggaagacauguugucaguuuggaaucggguuuggauagaagaaaauccauggauggaagauaagacccauauauccucaugggaggacguacccuauuuagguaaaagagaagaccaauggugugguagcuuaauaggauugacugcucgggcaaccugggcgacaaauauacaaguugccauuaaucaaguacggagacucauaggaaaugagaauuacuuagauuacaugacgagcaugaaaagauuuaagaaugaguccgacccagaaggugcuuuaugguaa

SEQ ID NO: 21175 - RNA, 9879 nt, Artificial Sequence
  derived and/or modified CDS sequence (opt6) from DENV-1__GU131925__SS-prME
agcguuacuauguuauugauguuaaugccgacggcuuuagcguuccaucuaacaacaagagggggcgaaccacauaugauuguaagcaaacaagaaagagguaaaagucuacuuuucaaaacaucagcuggaguaaauaugugcacauuaaucgcuauggaucugggugaacugugugaagauacuaugacauacaaaugcccucgcauuacugaagcugaaccggacgauguagacugcuggugcaacgccacugauaccuggguuacuuaugggacuuguagucaaacgggagaacaccggagggauaaacguucaguagcccuagcuccacacguaggguugggacuggaaacaagaacugaaacguggaugucaucugaaggggccuggaaacaaauucagaggguggaaacuugggcuuuaaggcauccagguuuuacugucauagcauuguuuuuagcucaugcgauuggaacaucaaucacacaaaaaggcauaauuuucauauuacuaaugcuaguuacuccaucaauggcuaugagauguguagggauaggaucaagggacuuugucgaaggauugaguggagcuacuugggucgauguuguauuagaacacggaucgugcgugacaacuauggcaaaagauaaaccaacucuagauaucgaauuauuaaaaacggaagugacaaacccagcuauauugcgaaaauuauguauugaagcaaaaauuaguaauaccacaaccgauagucguugucccacacaaggugaagcaaccuuggucgaagaacaagaugcgaacuucgugugcagaagaacuuuuguagacagaggguggggcaauggauguggccuauuugguaaaggcagucuaauuaccugcgccaaauucaaaugcgugaccaaacuagaagguaaaaucguucaauaugaaaacuuaaaauacucugugaucguuacgguacauacuggggaucaacaucagguaggaaacgaaaguacagaacauggaacaacggcgacaauuaccccucaagcaccuacgacggaaauacaguugacagacuacggcgcucuaacuuuagauuguucaccgagaacaggauuagauuuuaacgaaaugguguuacucacuaugaaagagaaaaguugguuaguacauaaacaaugguuuuuagauuuaccucuaccauggaccucaggagcaucgacaagucaagaaaccuggaaucgccaagauuuacuggucacauuuaaaacugcucaugcuaagaaacaagaaguaguaguauuggguagucaagaaggugcaaugcauaccgcuuuaacgggagcaacggaaauccaaacuagcgguacgacuacaaucuucgcaggacauuuaaaauguagacucaaaauggacaaauugacauuaaagggaaugucauauguuaugugcacgggcaguuucaagcucgaaaaagaaguagcagaaacacaacaugguacuguauuaguacaaaucaaauaugaaggcacggaugcccccugcaagauucccuucaguacacaggaugaaaaagguguaacgcaaaacgggaggcuaauuacggccaacccgauaguuacugauaaagaaaaacccguuaacauagaagcagaaccaccauucggagaaucuuauauagucaucggggcaggagaaaaggcuuuaaaacuuuccugguucaaaaagggguccucgauagggaaaauguucgaagcaacagcccgcggugcuagaagaauggcgauacuaggagauacggcgugggauuuugguaguauaggaggcguauucaccucuguuggaaaacuuguacaucaaaucuucgguacagccuauggaguccuauuuucaggaguaucuuggaccaugaaaauaggcauaggaguccuguuaacuuggcuaggucuuaacucaagaucuacaaguuuaagcaugacguguauagcaguugggcuaguuacuuuauauuuaggagucauggugcaagcagauucuggguguguuauuaacuggaaggguagagaauuaaaauguggauccgguauauuuguaacuaacgaaguucauacauggacagagcaguauaaguuucaagcugauucaccgaaaagguuaucagcggccauugguaaagccugggaagaagguguuuguggcauacggagugccacaagacuugaaaacaucauguggaaacaaaucucgaacgaacucaaccauauucuucuugaaaaugacaugaaauuuacugucguagugggagauguugccgguauuuuagcgcaagggaagaaaaugauccgcccucaacccauggaauacaaguacaguuggaagaguugggggaaggcaaagauaauaggcgcggacguacaaaacacgacauuuaucaucgauggcccgaacacaccugaaugucccgacgaucaacgagcuuggaacauuugggagguggaagacuacggauuuggaauuuucaccacaaacauauggcuaaagcugagagacuccuauacacaaguaugugaucacagacuaaugagugccgcuauuaaagauaguaaagcuguacacgcagauaugggauacuggauugaaucagagaaaaacgagaccuggaagcucgcaagggccucauuuauagaaguuaagaccugcauauggccuaaaagucauaccuuauggucuaauggggucuuagaguccgagaugauuauaccaaaaauauauggaggaccaaucucucagcacaauuaccgcccgggguacuucacacaaacggcuggaccauggcaccuuggaaaguuagaguuggacuucgacuugugugaaggaacgacaguaguaguagacgagcacuguggaaacagaggaccgucucuucgcacaacgacggucacaggcaaaauuauacaugagugguguuguaggucaugcacguugccaccgcugagguuuagaggagaagaugggugcugguauggcauggaaauuagaccaguuaaagagaaagaagaaaacuuaguuaaaucuaugguaagcgcagguuccggagaaguugauucauuuagccucggguuacuaugcauuucuauaaugaucgaagaggugaugcgaucucguuggucacguaaaaugcuaaugacugguacucuugcugucuucuugcuacuuaucaugggucaauuaacauggaacgaccuaauaagacucugcaucauggucggggcaaaugcaagugaucguaugggaaugggaacgacguaucuagcguuaauggcaacguucaaaaugagacccauguuugcagugggccuucuauuucgaagauugacuucgcgugaaguuuuauuacuuacuauaggcuugucacucgucgcgucuguugaauuaccaaacucgcuagaggagcuuggagauggguuagcaauggggauuaugaucuugaaacuccuuacagauuuccaaagucaccaguuaugggcaacacuucuuucuuuaacauucauaaaaacaacauuuucacuccauuacgcauggaaaacuauggcuaugguauuaagcauugugagucucuuuccauuaugcuugucaacaacuagccaaaagacuacguggcugccgguacuauuaggaucauuaggauguaaaccacucacaauguuucuuauugcggaaaacaaaauaugggggagacgaagcuggcccuuaaacgaaggcaucauggccgucgguauaguaaguauacuacugaguagccugcucaaaaaugaugugccacuagcugguccacucaucgcugggggaauguuaauagcaugcuaugugauaucagguucuagcgcagauuuaagucuugaaaaagcugcggagguuucaugggaggaagaagccgaacacucuggggcuucacacaacaucuuagucgaaguacaagaugaugggaccaugaagauaaaggacgaagagagagaugacacucugacaauccuguuaaaagcaacucuucuagcgguaucugggguguacccucugucaauaccagcaacacuuuucguuugguauuucuggcagaagaagaaacaacgcucugggguacuuugggauacgccgucaccaccggaaguagaaagggcaguucuugacgacgguauuuaccguaucaugcaaagaggauuauuaggacgaagucaaguagguguaggcguauuccaagaaaaugucuuccacacuauguggcacguaacuaggggagcaguccuuauguaucaaggaaagcgauuagaaccgucuugggcuagcgucaagaaagauuuaauaaguuauggcggcgguuggagauugcagggaucuuggaacacgggugaagaaguccaaguaauagcaguugaaccugguaaaaaccccaaaaauguucaaacagcacccgggacuuuuaagacucccgaaggagaaguuggcgccaucgcguuagauuucaaaccagguacaucagguucaccaauaguuaaccgcgaagguaaaauaguuggauuguacggaaauggggugguuacaaccucaggaacauauguuucggcuauagcgcaagcgaaggccucacaagaggguccauuaccagaaauagaagaugaaguguuucgaaaacgcaaucuaacuauaauggaucuacacccaggaagcggcaaaaccagaagguaucuuccagcaauuguaagagaagcuauaaaaagaaaacuaagaacuuugauucuggcacccaccaggguuguagcgagugaaauggcugaagcauuaaaaggcaugccuauuagguaccaaacgacggcuguaaaaucggaacacaccggaaaggagauagucgaccuaaugugucaugcuacuuucacuaugagauuauuaaguccuguccguguaccaaauuauaauaugauuaucauggacgaagcccacuuuacagauccuagcuccauagcagcuagaggauacauaucgacgcguguagguaugggggaagcugcugcaauauucaugacugccacaccaccagguucuguagaagcauuuccacagucaaacgccguaauucaagacgaagaacgugauauuccugaaaggucauggaacuccggcuaugaauggauuacggauuuuccuggaaaaaccguaugguuuguaccaucaauaaaauccgggaacgauaucgccaauugcuuacguaagaauggaaaaaggguuauucagcuuucgagaaaaacuuucgauacagaguaucagaaaaccaaaaacaaugauugggacuaugucguuacuacggauauaagcgaaaugggugccaauuuuagggcagacagagugauagauccuagaagaugucucaaaccgguaauucuaaaagacgggccugagcgcguuauacuagcuggcccgaugccagugacaguagcaagugccgcacaaagacgcggcagaauaggaaggaaucauaauaaggaaggagaucaauacauauauaugggacaaccacuaaauaacgaugaagaccacgcccacuggacugaagcaaagauguuauuagauaacaucaauacaccugaggguaucauuccagcgcuauucgaaccugaaagagagaaaagcgcugccauugacggcgaauacagauuaagaggugaagcaagaaaaacauuuguagaguuaaugcgccgaggagauuuaccaguauggcugaguuauaaaguagcuucugaggguuuccaauacagcgauagaagauggugcuucgauggagaacgcaacaaucaaguguuagaagaaaacauggacguagaaaucuggacaaaagaaggagagcgaaagaaauuaaggccacgguggcuggacgcuagaaccuacucagacccauuagccuuacgcgaauuuaaagaguucgcggcagguagacguucuguaucaggagacuuaauuuuggaaauaggcaaacuaccacaacaucuaacucagcgugcccagaacgcccuagacaaccuagucauguuacacaauucagaacaaggugggagagccuaucgccacgcaauggaagaauuacccgauacaauagaaacacugauguuacucgcgcuaauagcgguucuaacagggggcguaacauuauuuuucuuaucaggaagaggacuaggcaaaacaucaauagggcuauuaugcguaauggccucaucaguuuuacuuuggauggcuucuguugaaccacauuggauagccgcaucaaucauuuuagaguucuuuuuaaugguuuuauuaauaccagaacccgaccgacagcgaaccccgcaggauaaucaacucgcauaugucguaauuggguuacucuuuaugauacugacaguggcggcaaaugaaauggguuuacuagaaaccacuaagaaagaucucggaauuggacacguugcaguggguaaucaccaccacgcugccauguuagauguagaccuacaucccgcuagugcguggaccuuauaugcuguagcaacuacaauaauuaccccaaugaugcgacacaccauugaaaacacaacagcgaauauuucauuaacagcaauagcaaaucaggcggcaauacuaaugggccucgacaaaggguggccaauuagcaaaauggauaucggggucccucuucuggcauuagguuguuauucucaaguaaacccguuaacauuaacagcagcuguucuuauguugguagcacacuacgcaauaauaggaccgggacuucaagccaaggcuacaagagaagcucaaaaacgaacggcugcagguauaaugaaaaauccuacuguugacgguaucguugccauagaccuagauccagugguauaugaugcgaaguuugaaaagcaauuaggucagauaaugcuucuaaucuugugcacaucucaaaucuuacuuaugaggaccacuugggcgcuaugugaaagcaucacuuuagccaccgguccauuaaccacgcuuugggaagguucgccgggaaaauuuuggaacacgacaauagcuguuucuauggcgaacaucuuucgaggaucguacuuagccggagcagggcucgccuucucauuaaugaagucuuuaggagguggacgaagagguacuggagcccagggugaaacgcuaggugaaaaauggaaacgacaacucaaucaacuaagcaaaagcgaguucaauacauauaaaagaaguggaaucauggagguugauagaucagaagcaaaggaagggcugaaaagaggugaaacaacuaagcacgcaguaucgaggggaacagccaaauuaagaugguuuguagaaagaaaucugguaaaaccggaaggaaaggucauagacuuaggaugugggcgaggaggauggaguuacuacugcgcaggccuuaaaaagguuacagaagugaaaggguauacuaaagggggucccgggcacgaggagccaauuccaauggcaacauauggauggaaucuugucaaacuacauaguggaaaggacguauuuuucauaccgccugaaaaaugugacacgcuacugugcgacauaggagaaucgucaccgaauccuacuaucgaagaagguaggaccuuacguguguuaaaaaugguugaaccgugguuacgugguaaucaauuuugcauaaaaauacuaaauccauauaugccaucugucgucgagacccuagaacagaugcagcgaaaacacgggggaaugcuaguuagaaacccauuaucacgaaauaguacacacgagauguauugggucucguguggaacggguaauauagucucggcuguaaacaugacaagucggaugcucuugaauagguucaccauggcucacagaaaaccaacauacgaaagggauguagauuugggagcaggcaccagacacguagcaguagaaccggaggucgccaacuuagauaucauuggccaaagaaucgaaaacauaaaacacgaacacaaaucuacauggcauuaugacgaagacaauccuuacaaaacuugggcuuaucacggaagcuaugagguuaaaccaucaggcagugccucuucaaugguuaacggggucguaaaauuguuaacaaaaccaugggaugugauuccgaugguuacacaaaucgcuaugacagacacuacaccauuuggucaacagaggguauucaaggaaaaagucgacacaagaacaccgaaagcaaaacgaggaacugcgcaaaucauggaaguaacugccaaguggcuuuggggauuucuaagcagaaauaaaaagcccagaauuugcaccagagaagaguucacccgaaaaguuagaucuaaugcugcuauaggagccguguucguagaugaaaaccaauggaacagugcuaaagaagcuguagaagacgaaagauuuugggaccuuguacaucgagaacgugaacuacacaaacaggggaagugugcaacauguguauacaauaugauggguaaaagagagaagaaacuuggugaauuuggcaaggccaagggaucgagagcgauaugguauaugugguuaggcgcaagguuuuuagaguucgaagcgcuaggguuuaugaaugaagaccauugguuuucuagagaaaacucuuuauccggcguugagggugaagggcuccauaaacuggguuauauccugcgugauauuucaaaaaucccaggaggaaauauguacgcagacgauacagcggggugggacacucgaauaacagaggacgauuuacaaaacgaagccagaauuacagauauaauggaaccagaacacgcauuauuagcaaaaagcauuuucaaauuaacauaucaaaauaaagugguacgaguccaaagacccgcuaaaaaugguacgguaauggacguuauaucaagacgugaucagagaggcucaggacagguaggcaccuacggccuaaacaccuuuacuaacauggaggcucaacucauaaggcagauggagucagaaggaauuuuuagcccaucagaacuggaaaccccgaaccucgcugaacgaguacuggauuggcuggaaaaauauggugucgaacgacuaaaacgcauggccaucaguggggacgacugcgugguuaaaccaauagaugaccgcuuugccaccgcauuaacagcacucaaugauaugggaaaaguaagaaaggacauuccacaaugggagccgucgaaaggauggaaugauuggcaacaaguucccuuuuguagucaucauuuucaccaguuaauuaugaaagaugggcgcgaaauugucgugccgugcagaaaccaagaugaauuaguuggucgggcgaggguaucgcaaggggcgggcuggucacuacgugaaacagcaugccuggggaagucuuaugcucaaauguggcaauuaauguacuuucauaggagggaucugagacuagcagcuaaugcaauauguucagcuguuccgguggauuggauaccaacguccagaacaacaugguccauccaugcucaucaucaauggaugacgacagaagauaugcuaucuguuuggaauaggguguggauagaagaaaacccuuggauggaggauaaaacgcauauuucuuccuggggcgauguuccuuaucuagguaagcgggaagaccaauggugugggucccuaauaggguuaacagcacgcgcuacuugggcaacuaacauccagguagccaucaaccaagugagaaggcuaauuggaaacgaaaauuauuuagauuacaugacgucaaugaaaagauucaaaaaugagucugauccugagggagcguugugguag

SEQ ID NO: 21176 - RNA, 9879 nt, Artificial Sequence
  derived and/or modified CDS sequence (opt6) from DENV-1__GU131926__SS-prME
ucgguaaccauguuauuaauguuaaugccaacagcucuugccuuucaccucaccacccgcggaggggaaccccauaugaucgucagcaaacaagaacggggaaaaucuuuauuauucaaaacaagugccggaguaaauaugugcacuuuaaucgcgauggauuuaggagaauuuugugaagauacaaugacguauaaaugcccacgaaucuccgaagcagaacccgaugacguagauuguugguguaaugcgacugauacuuggguaaccuacggaacauguagccaaaccggagaacaucggcgagacaaacgaucaguugcucucgccccacacguuggauuagggcuugaaacuagaacagaaacguggaugagcucggaaggagcuuggaaacaaauacaacggguagaaacaugggcacuucgucacccgggauucacuguaauagcgcuuuuucuagcacaugcaauuggaacauccaucacacaaaaaggcaucauuuuuauuuuacuaaugcuagucaccccuucuauggcaaugagaugcguagguauugguaguagagacuuuguggaaggauugagcggggcuacguggguggaugucgugcuagaacacgggucauguguaacaacaauggccaaagacaaaccaacuuuagauaucgaacuucuuaaaacagaagucacaaaccccgcaguacucaggaaacugugcaucgaagcgaaaauaucuaauacuacgaccgauucuagguguccgacacaaggagaggcuacucucguugaggaacaagaugcaaacuuugucuguagacgaacguucguagauagaggaugggggaacgguuguggacuguuuggaaaaggcagcuuaauaacaugcgcaaaauuuaaaugcguaacuaaacuagaaggaaaaauaguacaauaugaaaaucugaaauacucuguuauugugacaguccauacaggggaccaacaucaagucggaaaugaaaguacugaacacgggacaacugcaacuauaacgccacaagcaccuagcacagaaauacaacuaacggacuacggggcauuaacucucgacuguuccccaagaacaggucuagauuuuaaugagaugguucuuuuaacgaugaaagagaaaaguuggcuuguccauaaacaaugguucuuggauuuacccuuaccguggacaaguggcgccagcacaagucaagagacauggaauagacaagaucuauuaguaacauucaaaacagcucaugcgaagaaacaagaaguagugguccuuggcucgcaagaaggcgcgaugcauacagcuuuaacuggugccacugaaauucaaacaucuggaaccacaacaaucuucgcgggacaccugaaaugcaggcucaaaauggacaaacuaacacuuaaagguauguccuaugucauguguacagggagcuuuaaacuagaaaaagaaguggcagaaacacagcacggaacaguacucguucaaauaaaauacgagggaacagacgcuccauguaaaaucccauucagcacacaagacgagaaaggggugacccagaauggaagauuaauaacggcaaacccaauaguuaccgacaaagaaaaaccgguaaacauagaagcagaaccuccauucggagaaucauacauuguaauaggcgccggagaaaaagcauuaaaacugucuugguucaagaaagguagcucaaucggaaagauguucgaagcuaccgcaagaggggcacgacgaauggccauccucggugacacugcuugggauuuugggucaaucggugggguauuuacaagugucgggaaacuuguccaccaaauauucgguacagcauacggaguacuuuucucaggggucaguuggacaaugaagauugguauaggcguacuucuaacuugguuagguguaaauagccgaucaaccucuuuaucuaugaccuguauagcuguuggccuuguuacucucuacuuggguguaaugguacaagcugauaguggcugcguuaucaauuggaaggggcgugaguuaaaaugcggaucgggcauuuuugugaccaaugaggugcauacuuggacugaacaauauaaauuucaagcugauuccccgaaaaggcuuagugcagcaauuggaaaggcuugggaagaagguguaugugguauucggagcgccacucggcuagaaaacauuauguggaaacaaaucaguaacgagcuuaaucacauacuauuagaaaaugauaugaaauucaccguagucgucggagauguugccgguaucuuagcccagggcaagaaaaugaucagaccacagcccauggaauauaaguacagcuggaaaucuuggggcaaagcuaaaauuauaggagcagauguccaaaauacuacguuuauuauagauggaccuaauacaccugaauguccagacgaucagagagcauggaauauuugggaaguagaggauuacggguucggcauauucaccacgaauauuuggcucaaacuaagagacucuuacacacaaguuugcgaucacagacugaugucagcagcuauuaaagacucuaaagcaguacacgcagacaugggcuacuggauagaaucagaaaagaaugaaacguggaaauuagcccgggcauccuucauugaagucaaaacguguauuuggccuaaaucucacacucuauggucgaacgggguucuggaaagcgagaugauuauuccaaaaaucuauggagguccaauuucccagcauaauuauagaccaggguauuucacucaaacagccgggccauggcacuuagggaaguuagaauuggauuucgaucuaugugaagguacuacaguaguugucgaugaacacuguggaaaucgugguccaucuuuaagaacuaccacuguaacagguaaaaucauacacgaaugguguugcagaucauguacgcugccaccccugagguuuaaaggggaggauggaugcugguauggaauggaaauacgcccggucaaagaaaaagaagaaaaccuuguuaaaaguaugguaucugccggaucaggagaaguugauagcuucagccuagggcuuuuauguauuucaauuaugauugaggaaguaaugagaucaagauggucucgaaaaauguuaaugaccggaacucuugcuguauuuuuccuuuuaauuaugggacagcuuacauggaaugacuuaauuagauugugcauaaugguaggagcuaaugcuucagacagaaugggaaugggcaugacauaucuagcgcuuauggcaacguuuaaaaugcgcccaauguucgcugucggacuauuauuuagaaggcuaaccucaagagaaguacuccuguuaacaaucgggcucucuuugguagcuagcgucgaauugccaaacucacuggaagaacucggagauggucuagcuauggggauuaugaucuuaaaacuauugacagauuuucaaucgcaucaguuaugggcuacacugcuaucgcucacauucauuaagacgacuuuuucauuacacuacgccuggaaaaccauggcgaugguucuaucaaucguaucauuguuuccacucugucuuucgaccacaucacagaaaacuacgugguuaccgguauuacucggcucguuaggcuguaaaccucuaacaauguucuugauagcagaaaacaaaauuugggguagaaaaucuuggccuuuaaacgagggaaucauggccguugguaucguaucgauuuuauuaucuucacuauuaaagaaugauguaccauuagcggggccguuaauagcgggagggauguuaauugcauguuauguaaucagcggaucuucagccgacuuaagccuagaaaaagccgcugaaguaaguugggaagaagaggcugagcauucgggcgcgucccacaauauacuuguagaaguacaagaugaugggaccaugaagauuaaggaugaggaaagggacgacacacuaacgauauuauugaaagcgacauuauuggcuguaagcggaguguauccuuuaucuauaccugcaacauuauuuguuugguauuuuuggcaaaagaagaaacaacgaagcgguguuuuaugggacacacccagucccccugaaguagaaagagccguacuagaugaugguauauauagaauuaugcaacguggccuacuagguagaucacaaguaggagugggcgucuuucaagaaaauguuuuucacacaauguggcauguaacaaggggagcagugcugauguaucagggcaaacgacuugaacccagcugggcaucggucaaaaaggaucuuauaucauauggaggcggauggagacuucagggcaguuggaacacuggggaagaaguacagguuauugcaguggaacccggaaagaaccccaaaaauguacaaacggcuccugggacauucaagaccagugagggggagguaggagcaauagcacuugacuucaaaccugggacaucaggaagccccauagucaauagagaggguaaaauagucggauuauacgguaaugggguaguaacgacuucugguacauacguuagugcaauugcacaagcgaaggcuagccaagaaggaccacuaccagaaauugaagaugaaguauuuagaaaaagaaaccugacaaucauggacuuacauccggguagugguaaaacucguagguaccuucccgcaauuguaagagaagcuauuaagcggaaacuucguacuuuaauccuagcgcccacuagaguugucgccagugagauggcugaagcacugaaaggcaugccaauaagguaccagacaacagcggucaaaagugaacauacagguaaagaaauaguagaucuaaugugucacgcaacguucacuaugcggcuuuuaucaccaguaaggguaccgaauuauaacaugauuauaauggaugaggcucacuuuaccgauccuucaaguauugcggcaagaggauacauuucaacaagaguugguaugggugaagccgcugcuauauuuaugacagcaacaccaccaggcucagcugaagcguuuccacaaucaaaugcgguaauucaagaugaggagagggacauaccagaaagaucuuggaacagcggauaugaauggauuacagauuuccccgguaaaacgguuugguucguaccaaguauaaaaagcgggaaugauauagcaaacugccuucgaaagaaugguaaaagagucauucaauugagccguaaaacguuugauacagaauaucagaaaacuaaaaauaaugauugggauuacguuguuacaacagacaucuccgaaaugggagcaaauuuccgagcggaucgagucauagacccaagaagaugucuaaaaccgguuauauuaaaagacggacccgaaagaguaauucuggcugggccuaugccggucacuguggccucggcagcccagagacgugggaggauuggaaggaaccauaauaaagaaggagaccaauauauuuauaugggccaaccucuaaauaaugaugaagaccacgcacacuggacggaggccaaaauguuauuggacaauauuaacacaccagaagggaucauaccagcauuguuugaaccagagcgagagaaaagugcagcuauugacggugaguaccgccuaagaggagaagccagaaaaacauuugucgaacugaugcgacgcggagacuuacccgucugguugucuuacaaaguugccagcgaaggauuucaauacuccgaccguagaugguguuuugauggggaaagaaauaaccaaguccuagaagagaacauggauguagaaauauggacgaaggagggugaaaggaagaaauugagaccaagauggcuugaugcucgaacuuacucggacccacuagcacugagagaguuuaaagaauuugcugcuggacgccguucugucaguggagaucuuauucucgaaauaggcaagcucccucaacaucuaacgcagagagcgcaaaaugcauuggauaacuuaguaauguugcauaauagugaacagggaggacgggccuauagacaugcaauggaagaauuaccugauacuauagaaacccuuauguuauuagcacuuauagcuguucuaacaggagggguaacccuguucuuucucaguggaagaggcuuggggaaaacaucuauugggcucuuauguguaauggcgucuuccguacugcuauggauggcgucuguagaaccacacuggauugcugcgucaaucauuuuggaguucuucuuaaugguacuguuaauaccagaaccggaccgucaaagaacaccccaggacaaucaacuugcauauguggucauugguuuacuuuuuaugauuuuaacagucgcagcaaaugaaaugggauuacuggaaacaacgaagaaggaucuaggaaucggccauguugcaguagaaaaccaccaucaugcugcuauguuggacgucgauuugcauccagcgagugcauggacauuauaugcuguggcuacaacgauaauaaccccaaugaugagacauaccauagaaaacacaacagccaauauaagucucacggcaauagccaaccaagcagcaauauugauggguuuagacaaaggauggccuauuagcaaaauggauauuggagucccucuacuagcacuaggauguuauucacagguuaauccuuuaacacuaacggcagcaguguuaauguuaguagcgcacuaugcuauaaucgguccaggauuacaagccaaagcgacucgcgaagcacagaagcgaacugcagcuggcauuaugaagaauccgacuguagacggaaucguggcaauugaucuagauccagucguauacgacgcuaaguucgagaagcaauuaggccaaauaaugcucuuaauacucugcacuucgcaaauacuuuuaaugaggacuacgugggcguugugcgaaucuaucacacuggcaacuggaccuuugacaacauuaugggaaggcucgccuggcaaauuuuggaauacuacaauugcaguaagcauggcuaauauauucagagguucuuauuuggccggagccgggcuagccuuuagucuaaugaagucguugggaggaggacgacgaggaacaggagcucaaggagaaacguuaggugaaaaauggaagagacaacucaaccagcucagcaaaagcgaguuuaacacauauaagagaucggguauaauggaaguugaccggucugaagcaaaagaggggcuaaaacgaggcgaaacuacaaaacacgcagucucaagagguacagcaaaguugaggugguucguugaaaggaaucuagugaaaccugaaggcaaagucauugacuuagggugcggaagggguggauggaguuacuauugcgccgggcuaaagaaagucaccgaaguuaaaggguacacuaaaggaggaccaggacacgaagaacccauaccuauggcgacguacggauggaauuugguuaaguugcauucuggaaaagacgucuucuuuguaccaccagaaaaaugugacacucucuugugcgauauuggggaauccagucccaauccaaccauagaagaaggcagaacacuuagagucuuaaaaaugguagagccaugguuaaggggaaaucaguucuguauaaagauccuaaauccuuacaugccauccguaguagaaacauuagaacagaugcagcgaaaacacggagguaugcuaguucgaaauccuuugucaagaaacaguacgcaugaaauguacuggguaucaugugggaccggaaacauuguuagcgcuguaaauaugaccucgaggaugcuacucaauagauuuacaauggcgcaucgcaagcccacuuacgaacgugauguagauuugggagcaggaaccaggcacguugccgucgaaccggaaguugccaauuuagauauuaucggacaacguauugaaaacauuaagcacgaacauaaaucuacauggcauuaugaugaggauaauccguauaagaccugggcauaccacgguuccuacgaaguaaaaccuaguggaucggcaaguucaaugguaaaugguguuguaaagcugcugaccaaacccugggaugucauacccaugguaacucaaauagccaugacugauacaacuccguuuggacaacaaagagucuuuaaagagaaaguagacacacgaacgccaaaggccaagagggguacagcgcaaauaauggaaguaacugcuaaaugguuauggggauuuuuaaguagaaacaaaaagccuagaauaugcacaagggaggaauuuacucgaaaaguuagaagcaacgcagccauaggcgcaguauucguugacgaaaaucaguggaacucugcaaaagaagcaguagaagaugaaagauuuugggauuuaguacaucgcgaaagggaauuacauaaacaggguaaaugugcuacauguguauauaacaugauggggaaaagagagaagaaguuaggagaguucgggaaagcuaaaggcaguagagcaauaugguauauguggcuaggcgcaagguuucucgaguucgaggcuuugggcuuuaugaaugaagaccauugguucaguagggaaaacucacucucuggaguagaaggagaaggcuuacauaaauuaggauauauccucagagacauuagcaaaauaucuggaggcaacauguacgccgacgauacagcaggcugggacaccagaauuacagaagaugaucuccaaaaugaagcaaaaauuacagacauuauggagccagagcacgcuuuacuggcaaaaucaauauuuaaauugacauaucaaaauaaaguaguacgaguucagagaccugcaaagaaugggacuguuauggacguaaucaguagaagagaccaacgaggaucaggacagguagggacauauggucuaaauacuuucaccaauauggaagcacaguuaauccggcaaauggaauccgaaggcauuuucagucccucugaacucgaaacuccaaaucuugcagagagagcuuuagauuggcucgaaaagcauggaguggaacgucuaaaaagaauggccauaucuggugacgauuguguagugaaaccuauugaugauagauuugcgacggccuuaacagcacucaacgauauggggaaagugcggaaggauauaccucaaugggaaccaaguaaaggguggaaugauuggcaacagguacccuucugcucccaucauuuucaucaacuuauuaugaaagacggcagggagauagucguaccauguaggaaucaagaugagcuugucggcagagcuagagucagucaaggcgcagguuggucccucagggaaacagcaugucuaggaaaaucauaugcacagauguggcaauuaauguauuuccauagaagagaccucagacuagcggcuaacgcgaucugcagugcugugccgguagauuggguaccuacgucuagaacgaccuggaguauacacgcucaccaccaauggaugacgacggaggacaugcucaguguguggaauagggucuggauugaagaaaauccauggauggaagauaaaacacauauaucaucuugggaagacguaccguacuugggaaaaagagaagaucaauggugcggcucguugauaggcuugacagcaagagcaacaugggcaacgaauauacagguugcuauuaaucaagugcgaagacuuauagggaaugaaaacuacuuggacuauaugacauccaugaaaagauuuaagaacgagagcgacccugaaggggcauuaugguag

SEQ ID NO: 21177 - RNA, 9879 nt, Artificial Sequence
  derived and/or modified CDS sequence (opt6) from DENV-1__FJ639669__SS-prME
aguguaacuaugcuacuuaugcuuaugccaacugcauuagcauuucaucuaacgacucgggguggggaaccacacaugauaguaucuaaacaagaaagggggaaaagucuucuuuuuaaaacaucagcuggaguaaauaugugcacuuugauagcgauggacuugggagaacuuugugaagacacuaugacauauaaauguccaagaaucaccgaagcagaaccugaugauguagauugcugguguaacgcuaccgacacaugggugacuuacggaaccugcucacaaacuggugaacacaggagggauaaacgcucuguugcacuagcaccacauguaggguugggauuggaaacgcgaacagaaaccuggauguccucagaaggugcauggaaacaaauucaacguguagaaacaugggcccuaagacauccaggauuuacaguuauagcccuauuuuuagcgcacgcaauaggaacaucuauaacccaaaaagggauaauauucauucuacucaugcuagugaccccuucaauggcuaugagguguguaggcauaggaagucgcgauuuuguagaagggcuaucuggagcaacguggguagauguaguucuugaacaugggucuugcgugacaacuauggcaaaagauaaaccuacauuagauauagaauuauuaaaaaccgagguaacaaacccggcaguguuaagaaaacuaugcauagaggccaaaauaaguaacaccacaacggacagcagaugcccaacccaaggagaggcuacacucguggaggaacaagaugccaacuuuguauguagacguacuuucguagacaggggauggggaaacgguugugguuuauuuggaaaaggaucccuuauaacaugugcaaaauuuaaaugcgugacuaaacucgaaggaaaaauaguucaauaugaaaaucucaaauauucagucauuguuacugugcacacuggagaccaacaucaagucggaaacgaaucaacggaacacggaacuacugcaacuauaacgccgcaagcacccacaaccgaaauucaacucacagauuauggcgcacuaacguuagacugcuccccgagaacgggauuagauuucaaugaaaugguacuacuaacuaugaaagaaaaauccuggcuugugcauaaacaaugguucuuggaccuacccuuaccauggacaaguggagcaagcacaucccaagaaacauggaaccgacaagauuuguugguuacguucaagacugcccacgccaagaaacaagagguuguaguauuaggaucucaagaaggcgccaugcauacagcguuaacaggcgccacggagauacaaacaaguggaacaacgacaauauuugcuggucaucugaaauguaggcuaaaaauggacaaauugacauuaaaaggaaugaguuaugucauguguacaggaucauucaaauuagaaaaggaaguagccgaaacucaacacggaacaguuuuaguacaaauaaaauacgaagguacugacgcaccuuguaagauuccguuuucaacacaagacgaaaaaggcguaacacaaaauggaagauuaauuacugcaaacccaauuguaacggacaaagagaaaccgguuaacauagaagcggaaccgccauuuggggaaagcuauauaguaauaggcgcgggggaaaaggcacuaaaacuaagcugguuuaagaaaggaucaucaauuggcaaaauguucgaggcaaccgcaaggggugcccggcguauggcaauuuugggagauacggcaugggacuucggaucuaucggaggaguguucaccucaguagggaaacugguacaucagaucuuuggaacugccuauggcguccucuuuagugggguaucuuggacaaugaaaauagggauuggagugcuuuuaacgugguuaggucuuaauagcaggagcacaaguuugaguaugaccugcauagcggucggcuuaguaacacuauacuuagggguaaugguucaagccgacaguggcugcguaaucaacuggaagggcagagaacuaaaaugugggucgggaauuuuuguaacaaaugagguucacacguggacggaacaguacaaguuucaagccgauucacccaaaaggcuuagcgcagcaauugggaaagcaugggaagagggaguuugugguauaagaagugcaacaagguuagaaaauauuauguggaaacagauauccaaugaacuaaaccacauuuuacuggaaaacgacaugaaacucacugucguuguaggcgaugucgcugggauuuuagcgcaaggcaagaaaaugauucgaccucaacccauggaguacaaauauucauggaaguccugggguaaggcuaaaaucauaggugcagauguucaaaacacaacauuuauaaucgauggcccaaacacuccugaguguccagaugaucaaagagcuuggaacauuugggaaguggaagacuauggauuugguaucuuuacuacuaacauuugguugaaauuaagagauucauauacucaaguuugugaccacagauuaaugucggcugcaauaaaagauucaaaagcgguccaugcagauaugggcuauuggauagagucagagaaaaaugagaccuggaaacuagcuagggcgucuuuuauugagguuaagacuuguaucuggccuaaaucccauacucuauggagcaauggggucuuagaaucugaaaugauuauacccaaaauuuacggcgggccaauuucgcaacauaauuacaggccaggauacuucacgcaaacugcgggacccuggcaucuggguaaauuagaguuagauuucgaucuaugcgaaggaacuacuguuguaguugaugaacauugugguaaucgaggcccaucauugagaacuacuacaguaacugguaaaaucauacaugaaugguguugcagaucauguacauuaccgccacuuagguuccguggggaagacggcugcugguauggaauggagauuagacccgucaaagagaaagaggaaaaucuaguuaagaguaugguaucugccgguucaggagagguagacucguucucucuuggguugcuauguauaucaaucaugaucgaggaaguuaugaggucaagauggagucguaaaaugcuuaugacugggacguuggcaguguucuuucuacucaucaugggacaauuaaccuggaaugaucugauucgauuauguauuauggugggggcuaacgccagcgacaggaugggcaugggaacaacuuacuuggcauuaauggcuaccuuuaaaaugcgccccauguuugcaguaggucuacuauuuagacgacucacaaguagagagguguuauugcuaacaauuggccucagccugguagccucaguggaauugcccaauucucuagaagaacuuggagacgggcuugcaauggguauaaugaucuuaaaguuguuaacugacuuucaaucccaccaacuaugggcgacacugcuuucccuaacguucauuaaaaccacauucucauuacacuacgccuggaaaacgauggcaauggucuuauccauaguaucccuauucccuuuaugcuuaucgacuacaucccaaaagacaacuugguuacccguccuacuuggaagucuaggauguaagccauugaccauguucuuaauagcugagaauaaaauuuggggaagaaaauccuggccccuuaaugaaggcaucauggcaguaggcauuguaucuauacuucuaaguucacugcucaaaaacgacguaccgcuagcaggaccacuaauagcuggcggaaugcuaaucgcuugcuauguaauaucugguucuagugcggaucuaagccuggaaaaagcagcggaaguuaguugggaagaagaggccgaacauucaggagccucacacaauauccuaguugaaguucaggaugacggaaccaugaaaauaaaagaugaggaaagagaugacacauuaacuauacuauugaaggccacucuacuugcaguaagcggcguuuacccuuuaaguauaccugccacucuauuuguuugguacuuuuggcagaagaagaaacagagaucaggaguguuaugggauacuccgucaccuccagagguagaacgcgcaguguuagaugaugguauauauagaaucaugcaaagaggucuguuaggacgaucgcaagucggaguaggaguguuucaggagaaugucuuucauacaauguggcauguuacacgaggcgcaguccuaauguaucaaggaaagcgcuuagaaccuucuugggcauccgugaagaaagaucuaauaagcuauggaggaggauggcgguuacagggauccuggaacacaggugaggaaguucaaguuaucgcuguugagccaggcaaaaacccgaagaauguucaaacagcucccgguacauucaaaacacccgaaggugaaguaggagcgaucgcccuggauuuuaaaccagguacgaguggauccccuauaguuaauagagaaggaaaaauugucggacuuuaugguaauggggugguuacaacaagugggaccuacguaucggcaauugcacaggcaaaagcgucccaagaagguccgcuaccugaaauagaagacgaaguauuuagaaaacggaacuugacaauaauggaccuccauccagguucaggaaaaacacgacgcuacuuaccagcuauaguucgagaagccauuaaaagaaaacugcguacuuuaaucuuggcgccaacacgcgucgucgccagugaaauggcugaggcauuaaagggaaugccuauaagauaccaaacgacugcaguuaaauccgaacauaccgguaaagagauaguugaucuaaugugccacgcuacuuuuaccaugcgucuauuaucucccguacguguaccuaauuauaauaugauaauaauggaugaggcacauuuuacagaccccaguuccauugcggcaaggggauacauuucuacaagagucgggaugggagaagcagcugcaauauucaugacagccacaccgccaggaucaguugaagcauuuccucaguccaacgcaguaauacaagacgaagaacgugacauaccugaaaggucauggaacaguggauaugaguggauaacugacuuucccggaaaaacaguaugguucguaccgucaauaaagucgggcaaugauauugcaaauugucuacguaaaaauggaaaaagaguaauucaguuaagucgaaaaacuuuugacacagaguaccagaaaacuaaaaauaacgacugggauuacgucgucacuacggauauaucugaaaugggugcuaacuuucgggcugauagaguaauagacccgcgucgcugucugaaaccaguaauccuaaaagacggaccugaacguguaaucuuagcaggaccaaugccaguuacugucgcuucagccgcacaacgaaggggcagaauuggcagaaaccauaacaaagaaggagaucaauauauauauaugggacagccucuaaacaacgaugaagaccacgcucacuggacagaggcaaagauguuacucgauaauauuaauacaccggagggaauaauaccagcuuuguuugaaccagaaagagaaaagagcgcagcuauagauggagaauaucgccuaagaggugaagcaagaaaaaccuucgucgagcuuaugcgacguggcgacuuaccuguauggcucaguuauaagguagcgucggaaggguuucaauauagugauagaaggugguguuucgauggggagagaaacaaucaaguauuagaagaaaauauggacguagagauauggacuaaagaaggcgaacgaaagaaacuuagaccuagguggcuagaugcaagaaccuauagugacccauuggcauuacgagaauuuaaagaguucgcagcuggaagaagaagugucucaggagaccucauacuagaaauuggaaaacuaccucaacacuuaacucagagagcucagaaugcacuugauaaucucguaaugcuucauaauagugaacaagggggccgagcauaucggcacgcgauggaggaacugccagauacgauagaaaccuugaugcuucucgcuuuaauagccguccuuacagggggcguaaccuuauucuuccuauccggacgaggccuaggaaaaacauccaucggauuguuauguguuauggcaucgagcguacuucucuggauggcaagcguagaaccacauuggaucgcggccucaaucauacuggaauuuuucuuaaugguauuauuaaucccugaaccagacagacagcgaaccccacaggauaaccaauuagcauauguugugauaggguuauuauucaugauacuaacgguggcagcgaacgaaaugggucuacuugaaaccacgaagaaagacuugggaaucggucacgucgcuguugaaaaccaucaccacgcggcuauguuggauguagaccuucacccggcaucagcguggacacucuaugcaguagccacaacuauuaucacaccaaugaugaggcauacuauagaaaauacgaccgccaauauaucacuuacagcuauagcuaaucaagcagcuauacuuauggguuuagauaaaggauggccaauaagcaaaauggacauuggcguaccuuuacucgcacuagguuguuauucgcaaguaaauccccuuacguuaacugccgcuguucuuauguuaguagcgcacuacgccauuauugguccgggccuccaagcuaaagcuacaagagaagcacagaaacgcacugcagcuggcauaaugaaaaaccccacuguagacgggaucguugcgaucgauuuagacccgguuguguacgaugcaaaauucgaaaaacaauuagggcaaauaaugcuuuugauacuauguacaagucaaauacuacugaugcguaccacuugggcauuaugugagaguauaacauuggcaacaggaccccuuacgacauuaugggaagguuccccugggaaauuuuggaauaccaccaucgcaguaucaauggcaaauaucuuuagaggaagcuaucuagcuggcgcuggauuggcguuuucacuaaugaagucacuaggagggggaaggagaggaacuggugcacaaggggaaacacugggcgaaaaauggaaacgacagcuaaaucaacuuucaaagucugaauuuaauacguauaaaagaucaggcauaauggaaguagaucggucugaagcaaaggaaggcuugaaaagaggagaaacaacaaaacaugcagucagucgaggaacagcaaaacuacgaugguuuguagaacgcaaccuugucaaaccggaagggaaaguaauugacuugggauguggccgagguggauggagcuacuauugcgcuggccuaaagaaaguaacggaaguuaaaggauauacuaaaggugguccgggucacgaagaaccgauaccgauggcaacguauggcuggaaucuagucaaacuucauucugguaaagauguauucuucauaccaccagaaaaaugcgacaccuuacugugugauaucggugaaagcagcccgaacccgacgauagaggaaggccgaacucuaagaguccuaaaaaugguggaaccauggcuuagaggaaaucaauuuugcauaaaaauauuaaacccauauaugccuuccgugguggagacccuagaacaaaugcagcgcaaacauggcgguaugcuggugagaaacccauuaucaaggaacaguacccaugagauguauuggguuucaugcggaaccgguaacauuguaagugcagugaauaugacauccagaauguuauuaaaccgauucacuauggcacauagaaaaccaacuuacgaaagggacgucgaucuagguacuggaacuagacauguggcaguugaaccagagguagccaauuuagacauaauagggcaaagaauagagaacauaaaacacgaacacaagucaacauggcauuacgaugaagauaauccuuauaaaacaugggccuaucacgggucauaugaaguaaaaccuucagguucggcauccucaaugguuaacgguguaguaaaauuacuuacuaaaccaugggaugugauuccuauggucacacagauugcaaugacagauacgacaccuuuuggucagcaacgcguguucaaagagaagguugauacaagaacaccaaaagccaaaagaggaacugcacagaucauggaggucacugcgagauggcuguggggauuuuuaaguagaaauaagaaaccucguauuugcacuagagaagaguucacacgaaagguccggaguaaugcggcuaucggagccguauucguggaugaaaaccaauggaacuccgccaaagaagccguagaagaugagagauuuugggaucucguccaucgagaacgggaacuucacaaacaaggaaaaugugcaacuugcguauauaauaugaugggcaaaagagagaagaaacuuggcgaguucggcaaagcaaaagggucacgagccaucugguacaugugguuaggggcaagauucuuggaauuugaagcacuugguuucaugaaugaagaucauugguucagcagggagaauagccuaucaggaguugaaggagaaggguuacauaaauuaggauacauacucagggacauaucuaaaauucccgguggaaauauguacgcagacgacacugcgggaugggauacacgaauaaccgaagaugauuuacaaaaugaggcaaaaauaacugauauuauggaaccugaacaugcauuacuggcaaaagcaauauucaagcucacauaucaaaacaaggucguaagaguacaaagaccggcuaagaacggaacaguaauggacguuauaaguagacgagaucagagagguagcggucagguagggacauauggacuaaauacuuuuacaaacauggaggcucaacugaucaggcaaauggaaagcgaagguauauuuucuccuucggaguuagaaacaccuaaccuugcagagcgagcacuagauugguuggaaaaauauggugucgagagacuaaaaagaauggccauaucuggugacgauugcguagucaagccaauagaugaucguuucgcaacugcucucacugcgcucaacgacauggguaaaguucggaaagacauaccgcaaugggagccaagcaaaggauggaaugauuggcaacagguuccuuuuuguucacaccacuuucaccaguuaauaaugaaagacgggagggaaauaguggugccgugucggaaucaggaugaauuagugggcagggcaagagucucacagggagccggcuggagucuccgagaaacagcgugucucggcaaaucuuaugcucagauguggcaauuaauguacuuucaucggagagaccuacgauuagcggcgaacgcgauaugcucugcaguccccguugacuggguccccacuucacgaacaacauggucaauacaugcacaucaccaauggaugacaacugaagacaugcucuccguuuggaauagagucuggauugaggaaaauccuuggauggaagauaagacacacauaucaagcugggaagaugugccuuaccuaggaaaaagagaagaccaauggugcggaucguugauaggacuuaccgccagagcgacaugggcuacgaauauucaggucgcuauuaaucaaguacgucgucuuauaggaaaugaaaacuaccuagauuacaugaccucaaugaaaagguuuaagaaugagucggauccugagggugcucuuugguaa

SEQ ID NO: 21178 - RNA, 9882 nt, Artificial Sequence
  derived and/or modified CDS sequence (opt6) from DENV-1__FJ639670__SS-prME
uccguuacgaugcuuuuaauguugaugccaacagcguuagcauuccaucuaacuacaagggguggggaaccgcauaugauagugucuaaacaagaaagagguaaaucccuauuauuuaaaacgucggcggguguuaauaugugcacacuaauagcaauggaucuaggugaacuaugcgaagauacuaugacguacaaauguccccguauuacagaagcagaacccgacgauguugauugcuggugcaacgcaacagauacaugggugacauacggaacauguucacaaacgggugaacaucggagggauaaaagaucgguagcuuuagcaccccauguagggcucggauuagaaacacgaacagaaacauggaugagcagugaaggagcguggaaacaaauacaaagaguggaaacaugggcgcuacgccauccuggguuuacaguaauugcguuguucuuggcccaugcaauaggaacuucgaucacacaaaaagggaucauuuucauauuacugauguuaguaacaccuuccauggcgaugcgauguguagguauuggaucuagggacuuuguugaaggucuaucaggugcaacuuggguugacguaguauuagagcacggaaguugugugacuacaauggccaaagauaaaccaacguuggauauugagcuauuaaaaacagaaguuacaaauccagcuguguuaagaaaacucuguauagaagcaaaaauaucgaauacuacuacggauucccgaugcccaacucaaggagaagcgacucuaguagaagaacaagaugcgaacuucguaugccggagaacauuuguagauaggggauggggaaaugguugugguuuguuugguaaagguucuuuaauuacaugcgcaaaguucaaauguguuacgaaacuugaaggaaaaauaguacaauacgaaaacuuaaaauauucaguaauagugacuguacauacaggagaucagcaucaggucgguaaugaaaguacagagcacggaacaacugcuacgaucacaccgcaagcuccaacuacagaaauacaacuaacagacuauggcgcccugacacuugauugcagcccccgaacgggccucgauuuuaacgaaaugguccugcuaacuaugaaagaaaaauccugguuaguucacaaacaaugguuucuugaccuacccuugccauggacgaguggcgcaagcacaagucaagaaacauggaacagacaagaccuauuagugacguuuaagacugcucaugccaagaaacaagaagucgucguccuggggucacaagaaggcgcuaugcauacugcguuaacuggagcuacugaaauacaaaccucaggcacaacuacgauauuugcuggacaucuuaaaugucgauuaaaaauggacaaacuaacucuaaagggcauguccuauguaauguguacgggaaguuuuaaacuggagaaagagguagcggaaacucaacacgguacaguucucgugcaaaucaaauaugaaggaacugacgcacccugcaaaauacccuuuagcacccaagaugaaaaaggcguuacccaaaauggaagauugauaacagccaaucccauugucaccgauaaggaaaaaccaguaaauauugaggcagaaccacccuucggugaaucauacauaguuauaggagcuggagaaaaggcuuuaaaauugucaugguucaagaaaggcaguucaauaggaaaaauguucgaagccacagcaagaggugcacgcagaauggccauacuaggggacaccgcgugggauuuuggaagcauaggagggguauuuacgagcgucggaaaacugguucaccagaucuucggaaccgcauauggaguccuauuuagcggugucaguuggaccaugaaaaucggcauagguguuuuacuaacgugguuggggcucaauucgagaaguaccucacuaucuaugacgugcaucgcuguuggcuuagucacgcucuaucuagguguuaugguccaggcagauagcggcuguguuaucaauuggaaaggacgcgaacuuaaaugugggucaggaauauucguuacaaaugaaguccauaccuggacagaacaauauaaguuucaagcugauucaccuaaaagacuaucagcggccauaggaaaggcaugggaagaaggagugugcggcauucgcucagccaccaggcucgaaaauauuauguggaagcaaaucucuaaugaauugaaucacauuuuacuugaaaaugauaugaagcuaaccguaguuguaggugauguugcaggaauauuggcacaaggcaagaaaaugaucagaccucagccaauggaauauaaauacucauggaagaguuggggaaaagcuaagauuauuggugccgaugcgcagaauacuacauucauaauagauggacccaauacaccagagugcccggaugaucaacgagcguggaacauuugggaaguagaggauuacggcuuuggaauauuuaccacuaauauauggcuuaaacuuagggacaguuacacacaaguaugcgaccaccggcuaaugagugccgcuauuaaggauucaaaagcaguacacgcagauaugggauacuggauugaaagugagaaaaaugaaacuuggaaacuagcuagggcgucuuucauagaagugaaaaccuguauuuggccuaaaucccauacauuauggucaaaugguguacucgagucagaaaugaucauaccuaaaauauacgggggacccaucucgcagcacaacuauagaccagguuacuuuacucaaacagccggcccguggcaucuuggcaaacuagaguuagauuucgauuuaugugaaggaacaacuguuguugucgaugaacacuguggaaaccgcggcccaagccuccgaacgacgaccguaacugggaaaauaauacacgaauggugcuguaggaguuguacauuaccuccacuaagguucaggggugaggauggaugcugguaugggauggaaauacggccagugaaagaaaaagaagaaaacuuagugaaaaguauggucagcgcggguucgggcgagguagauucuuuuagucugggacuuuuaugcauaucuaucaugauugaggaaguaaugcguucaagguggucucgcaaaaugcuaaugacugggacuuuggcuguauucuuccuacuaauuauggggcaauuaacauggaaugaccuaauaagguuauguauaaugguaggugccaaugcgagugacaggaugggaaugggaaccacauaccuggcacuuauggccacauucaaaaugcggccaauguuugcuguuggacuauuauuuagaagacuaacaagucgugaaguacuacuuuuaacuauaggucucagcuugguagcaaguguugagcuaccaaacucauuggaagaacuaggggauggauuagcaauggguauuaugauacuaaaguuauuaacagauuuucagucucaccaguugugggccacauugcuaaguuuaacuuuuauaaagacgacuuuuucucuacauuacgcauggaaaacaauggcuauggucuuaaguauugugagcuuauuuccacuauguuugucuacaacuucucagaaaacaacauggcuucccgugcuucuuggcucauuaggaugcaaacccuuaacuauguuuuugauugcugaaaauaaaaucuggggaaggaaaucguggccauuaaaugaaggaauuauggcggucggcauaguuagcauacuauuaagcucuuuacucaaaaaugacguaccauuagccgguccuuuaauagcaggaggaauguuaauugccugcuauguuauaagugguaguucagcugauuuaaguuuagaaaaagccgccgagguguccugggaagaggaagcagaacacaguggcgcuucacacaauauauuaguggagguacaagaugauggaacaaugaaaauaaaagacgaagaacgugacgacacauuaaccauacugcuaaaggcaacuuuacuugccguauccggaguuuauccgcuuagcaucccggcuacacuuuucguaugguacuucuggcagaaaaagaaacaaaggucugguguuuugugggauacuccgucaccgccagaaguagaacgggccguguuagaugaugguauuuacagaauaaugcaacgcggucuacuaggcagaucacaaguuggaguugguguguuucaagaaaaugucuuccauacgauguggcacguaacaagaggagcuguguuaauguaccaaggcaaacgacuagaaccgucaugggcaagcguaaagaaagauuuaauaucuuauggcggaggcuggcgucuucaaggcucauggaauacaggagaagaaguacaggucauagccguagaaccagguaaaaauccuaaaaaugugcaaacugcaccaggaacuuuuaaaacaccagaaggagaaguuggugcuauagcuuuagauuuuaaaccaggcacgagcggaucgcccauagugaaucgcgaaggaaaaauaguuggacuauauggcaauggaguaguaacaacuucggguacuuauguaucagcaauagcucaagcuaaagcaagccaagaaggaccauuaccggaaauagaagaugaagucuuuagaaagcguaaccuuacaauuauggaccuccauccggguucaggaaagacacgaagauaucucccugcgauaguccgagaggccaucaaaaggaaguuaagaacacuuauuuuggcucccacacgcguaguugcaucagagauggcagaagcguuaaaaggaaugccaauuagauaccaaaccacagcugugaaaucagaacauacggguaaggagauuguugaucucaugugucacgcaacguuuacaaugagacuccuuaguccuguucgcgucccuaauuacaacaugauaauaauggacgaggcacauuuuacggauccuaguucaauagcagccagggguuauauaaguacacgggucggaaugggggaggcagcugcaaucuucaugacugcuacucccccuggauccguggaggcauucccucaaaguaaugcuguuauucaggacgaggagagggauauaccagaacgcucauggaauaguggauacgaguggaucacagauuuuccggguaagacaguaugguucguaccauccaucaaaucaggcaaugacauagcuaauugcuuaagaaagaauggaaaaagaguaauacaauuaagccgaaaaacauucgauaccgaauaucagaaaaccaaaaauaaugacugggauuauguaguaacaaccgauauuucugagaugggugcaaauuuuagggcagauagaguuauugacccccguagauguuuaaaaccaguaauacucaaagauggaccagaacgaguaauauuagcagggccgaugccaguuacaguagccucagcugcacaacgacgagguagaauugggagaaaccauaauaaagagggggaccaauacauauauaugggacaaccucucaauaaugaugaagaucaugcgcacuggacggaagccaaaauguuacuagauaauauaaacacacccgagggaauaauaccagcucucuuugaaccagaaagagagaaaucagccgcuauugacggugaauauagacuucguggagaggcuagaaagacauucguagaauuaaugcgccggggugauuuaccagucuggcucagcuauaagguagcgucugaagguuuucaauacagcgacagaagaugguguuuugauggugaaagaaacaaucaaguauuagaagagaacauggauguggaaauauggaccaaagaagguguaucuagaaagaacuuaagaccuagauggcucgacgcacguacauauucggacccguuggcacuucgcgaauuuaaagaauuugcggcagggagaagaagugugaguggggaucuuauacucgaaauaggaaagcuaccgcaacauuuaacacagagagcucagaacgcucuagauaaucuagucauguuacauaauagcgaacaaggugggcgagcuuaucgacacgccauggaagaacuaccugacaccauagagacacuuaugcuguuagcucucauagcuguccuaacggguggagucacccuuuucuuccucucagggcgagggcugggaaaaacuucuauaggguuauuaugcgugauggcaucaucggucuuacuauggauagcaucagucgagccgcauuggauagcugcaucuauaauccuggaguucuuucuuaugguacuacugauccccgaaccggaucgucaacguacaccacaagacaaccaguuagcuuauguaguuauaggucuucuguucaugauacuaacuguggcagccaaugagaugggacuguuggaaacaaccaagaaagaccuaggcaucggucauguggccguugagaaucaccaccaugcugcaauguuagacguagacuuacacccagcuucugcguggacacuauaugcagucgcaacuacgauuaucacaccaaugaugcgccacacaauugaaaauacaacugcgaauauuucccuuacagcuaucgcaaaucaagcugcgauauugaugggacuugacaaaggauggcccauauccaagauggacauuggcgucccuuuauuagcacucggauguuauagccagguaaaucccuuaacuuugaccgcugcaguacuaauguuaguagcacauuaugcgauuaucggaccgggauugcaagcuaaagcuacccgcgaggcacagaaaaggacagcagccgguauaaugaaaaauccaacagucgaugguauaguagcuauugacuuggacccuguuguauacgaugcaaaauucgaaaagcaauuaggacaaauaaugcuccuuauacuuugcacaucccagauacuauugaugagaacaacaugggcauuaugugaaucaaucacacuagcgacagggccucuaacaacucuaugggagggcucgccaggaaaguuuuggaauacuaccauagcuguaagcauggcuaacaucuuccgggggucuuacuuagccggugcuggacuggcauuuaguuuaaugaagucauuaggggguggacggagaggaacuggagcccaaggcgagacgcuaggugaaaaauggaaacgacaauuaaaucaauugucaaagucugaguuuaacaccuauaaaagaagugggauaauggagguagacagauccgaagcaaaggaaggacucaaacguggggaaacaacaaaacaugcgguuucacggggaaccgccaaacuucgaugguucguugaacggaaccugguaaaaccagaggggaaaguaauagacuugggcugugggcgaggugguuggucguauuauugugcaggcuuaaagaaagugacagaggucaaaggauauacgaaaggcggucccggacacgaggaaccaauaccuauggcgacauauggguggaauuuaguuaaauuacauuccgguaaagauguauuuuucauaccgccugagaaaugugacacuuuacuuugcgauauuggcgaaucaaguaguaaccccacgaucgaagaagggagaacgcuuagggucuugaaaauggucgaaccaugguuacgaggaaaccaauuuuguaucaaaauccuuaacccauacaugccaucgguaguugagacucuagagcaaaugcaaagaaaacauggagggaugcuagugaggaauccgcuaaguagaaauuccacacacgaaauguacuggguauccugcgggacaggcaacauaguaagugccguaaacaugacaucacgcaugcuucugaauagguuuacuauggcgcaucgaaaaccaaccuaugagagggaugucgauuugggaaccgguacgagacauguggcgguugaaccagaaguagccaauuuagauauaaucggccaacgaauagagaacauuaaacacgaacauaaaaguacguggcacuaugaugaagacaauccuuauaaaacaugggcauaccacgguucauaugaagucaaaccaucaggaagcgccucgucuaugguuaauggcgucguuaaauuauuaacuaagcccugggacguaauaccaaugguuacgcaaauagcaaugacugacaccacaccuuucggacaacaacgcguauucaaagaaaaaguagacacaagaaccccaaaagccaaaagagguacugcucaaauuauggaaguaacugcuagaugguuauggggauuuuuaucacggaauaagaaaccuagaauuugcacgcgagaagaguucacaagaaaaguacggucaaacgcugcaauuggagcuguauuuguggaugaaaaucaauggaacucggcaaaagaagcgguugaagaugaacgcuuuugggaccuuguacaucgcgaaagagaacuacauaaacaaggaaaaugcgcuacgugcguauauaacaugaugggaaaaagagagaagaaauuaggggaauuugguaaagcaaaaggcuccagagcaauaugguauaugugguugggugcuagguuccucgaauuugaggcacuuggguucaugaaugaagaucauugguucucacgcgaaaauaguuuaucuggaguugaaggagaaggucugcauaagcucggauauauuuuaagggauauaagcaaaauaccuggcggcaacauguacgccgacgauaccgcugguugggauacacggaucacggaagacgacuuacaaaacgaggcuaaaauuacagauauuauggaaccagaacacgcuuuacucgccaaagccauauuuaaauuaacuuaucaaaauaaaguaguacgaguacagcgacccgcuaagaaugguaccguaauggacgugauuaguaggagagaucagagaggaucuggacaagugggcacguacggucuuaacacguucacaaacauggaagcccaguuaauaagacaaauggagucagaaggcauauucucuccgagugaauuagaaacaccgaaccucgcggaacgagcauuagauugguuagaaaaauacggugucgaaagguuaaaaagaauggcaauaaguggugaugacugugucguaaaaccgauagacgaucguuucgcuacugcguugaccgcacuaaacgauauggggaaaguacguaaagauauaccccagugggaacccucaaaagguuggaaugacuggcaacaggugccauucuguagucaccauuuccaccaacuaauaaugaaagauggcagagagaucguggugccgugucggaaccaggaugaauuaguugggagagcacggguaucucagggcgcgggaugguccuugagagaaacagccugucuggggaaaagcuacgcacaaauguggcaauuaauguauuuccaucgucgcgauuugagacuagcugcgaacgcaauaugcagugcaguuccaguugauuggguaccaacgucgcgaacgacaugguccauucaugcccaucaccaguggaugacgacugaagacauguuaaguguuuggaauaggguguggauugaggagaaucccuggauggaagacaaaacucacaucagcaguugggaggauguaccuuacuuaggcaaaagagaggaucaauggugcgggagccugauaggguuaaccgcaagggccacuugggcaaccaacauacaagucgcuauaaaucagguucgacgacuuauagguaaugaaaacuaccuugauuacaugacaucgaugaaacgguucaaaaacgaaagugauccugagggcgccuugugguag

SEQ ID NO: 21179 - RNA, 9879 nt, Artificial Sequence
  derived and/or modified CDS sequence (opt6) from DENV-1__FJ639671__SS-prME
ucagugacgaugcucuuaaugcuuaugccuacagcacuugcuuuucauuuaacaacaagaggaggagaaccucauaugauagucucuaaacaagagcgugguaaaagucuccuuuucaaaacaucugcaggaguuaauauguguacacuuauugcuauggaccuuggagaauuaugcgaagauacguuaacauauaaauguccaaggauuacugaaguugaaccggacgauguagacugcugguguaacacgaccgacacguggguaacauaugguacuuguucacaaacuggagaacauagaagagauaaaaggagcguugcacuugcgccccauguuggacucggccuagagacacgcgcugaaacauggaugagcuccgaaggagcauggaaacaaauacagcguguggaaacgugggcacuuaggcauccugguuuuaccgucauugcacuauuuuuagcacaugcaaucggcaccucgaucacucaaaaaggaauuauuuuuauauuacucauguuggucacgccgaguauggcuaugagaugcguugggauugguagucgagacuuuguagaaggacuaucaggggcuacuuggguagauguaguauuagaacacggaucuugcguaacaacuauggcaaaagauaaaccaacauuagacauagaguugcucaaaaccgagguaacaaacccagcgguuuuaagaaaacugugcaucgaagcgaagauaagcaauacaacaacugacucucggugucccacacaaggagaggcgacauuagucgaagaacaagaugcgaauuuuguaugccguagaacauucguggaucgaggcugggguaacgguuguggacuauuuggaaaggguucucucaucacuugugcaaaauuuaaauguguuacuaaauuggaaggcaagaucguucaauaugaaaauuuaaaauacucaguaauaguuacuguacauacaggugaccaacaucaagugggcaaugaaucaaccgaacacgguacgacugcaaccauaacuccacaagcaccaaccuccgaaauacaauuaacggauuacggagccuuaacuuuagauugcaguccgaggacaggauuagacuuuaaugaaauggugcuucuaacaaugaaggaaaaguccugguuaguacacaagcaaugguucuuagaucuaccacuuccuuggacaaguggagcuagcaccagccaagagacuuggaaccggcaagauuuacuugugacauuuaaaacagcgcaugcuaaaaagcaggaagugguuguucucgguagucaagagggugccaugcauacggcuuuaacaggagcuacagaaauccagaccucagggacaacaacuauauuugcaggccaccuaaaauguagguuaaaaauggauaaacucacucucaagggaaugucguaugucaugugcacagguucuuuuaagcuagaaaaggagguagccgaaacccagcacggaacgguccugguucagaucaaauacgaagguacagaugcaccauguaaaaucccauuuuccacccaagacgguaaggguguaacacaaaacggccgauugaucacagcgaacccuauaguaacugauaaggagaaaccgguaaacaucgaagccgaaccuccauuuggcgaaucauauauaguuauuggagcgggagaaaaagcguuaaaacugaguugguucaagaaaggaucuaguauaggcaaaauguuugaagcaacagcucgcggugcacguagaauggcaauauugggagacacagcgugggauuuuggcagcguaggcggaguguuuacaucgguuggaaaauugguccaucaaaucuucggcacagcuuauggaguacuauuuucuggcguaucuuggacaaugaaaauagggaucgguguauuauuaaccuggcugggacuuaacagucgaagcaccaguuuaucaaugacgugcauugcaguugggcuaguaacgcucuaucuaggaguaaugguucaggcugacuccggauguguuauaaauuggaagggccgugaacuaaagugcggaucugggauauuuguuacgaaugaaguacauacguggacggaacaauauaaauuucaagcagauucuccaaagagauuaucagcagcuauuggcaaagccugggaagaaggaguauguggcauuagaucggcaacgaggcuugaaaaugucauguggagacagauuuccaaugaguugaaucacaucuugcuggaaaaugauaugaaauuuacuguuguagucggugaugucguaggcaucuuggcgcaaggcaagaaaaugauacgaccacaacccauggagcauaaauacucauggaaaucuuggggaaaagcaaaaauaauaggcgcugauguacaaaacacgacuuuuaucauagauggucccaacacaagugagugcccagaugaccagagagcauggaauauuugggagguagaagauuacggcuuugguaucuuuacgacuaauauauggcugaaacuaagagacucauauacucaaguaugcgaucacagauuaauguccgcggcaauuaaggacucaagagcaguacacgcugacaugggauacuggauugaaucagagaaaaaugaaacauggaaacuagccagagccuccuucauugaaguaaaaacgugcauauggccaaagucccacacguuauggucaaacggcguucucgaguccgaaaugauaauaccaaaaauauacggagggccaaucagucaacauaacuauagacccgguuauuucacacaaacagcugguccauggcaccuuggaaaacuggaacuugauuuugauuuaugcgaagggaccacaguuguuguugacgaacauuguggcaaucgaggcccuaguuuacguacgacaaccguuacgggaaaaauuauacacgaaugguguugcaggagcuguacauuaccuccgcuaagauuuaaaggggaagaugguuguugguaugggauggagauuagaccuguaaaggaaaaggaagaaaaccuagucaaauccaugguuagcgcaggcucuggugaggucgauaguuuuaguuuagggcuccuuugcaucucgauaaugauagaagaaguaaugaggucaagguggagucgaaagauguuaaugacaggaacauuagcgguauucuuucuacucauaaugggucaacuuaccuggaaugaccuaauccgacuuuguaucaugguuggcgcaaacgcaucugacagaauggguaugggaaccacuuaucucgcguuaauggcgacauuuaaaaugcguccgauguuugcugugggccuacuauuccgucguuuaacaagccgcgaaguacuuuuauuaacuauagguuugagccuuguugcaucaguggaacucccaaauucgcuugaagaacuuggagauggcuuagcaaugggaauaaugauucuuaaacuguuaacggacuuccaauccuaccaacuaugggcaacucuacuaagccuaacuuuuauaaaaacgacauuuucguugcacuacgcauggaaaacaauggcaaugguucucagcaucguuucgcuauugccacucuguuuaucaacuacaucucagaaaacuacaugguuaccgguccuccuagguagcuugggcugcaaaccucuaacaauguuccuuauagcggaaaauaagauuuggggacgcaagucuuggccgcucaaugaagggaucauggcuguaggcauuguaucuauacuuuuaagcucgcuucuaaagaaugauguccccuuagcugggccacuaaucgcaggaggaauguuaaucgccuguuauguaauaucgggaucuucggcagaccugucuuuagaaaaagcagcagaaguuucuugggaagaagaagccgaacacucaggcgcgucucacaauauucucguugaaguucaagaugaugguacaaugaaaauuaaagaugaagaaagggacgacacacuuaccauucuauuaaaagccacauugcucgccguaaguggaguauacccccugagcauuccagcuacacuauuuguuugguauuucuggcagaaaaagaaacaaagaagcggcguacuaugggauaccccguccccaccugagguagagagagcgguacucgacgacgguauauacagaauuaugcagcguggacuauuaggaagaucucaggugggaguaggcgucuuucaagagaacguauuucauacaauguggcauguaaccagaggugcgguacuaauguaucaagggaaaagacucgagccgucuugggcgagcguaaagaaagaccugauuagcuauggcggggguuggaggcuucaaggaagcuggaacacgggugaagaagugcaagugauagcugucgaaccggguaaaaacccgaaaaacguccagacagccccaggcacauuuaaaacaccugagggagaaguuggcgcaaucgcacuagacuucaaaccuggaaccucaggcucuccuauuguaaauagagaaggaaaaaucguuggucucuaugguaauggagugguaacgacaucagggacuuauguuagcgcuauagcacaagcuaaagcaucucaagagggaccuuuaccagaaauugaggacgagguuuuuagaaaaaggaacuuaacuauaauggaccuucacccgggguccgguaaaacgcgacgauaucuaccagcuauagucagggaagcgauaaaaagaaaauuaagaacauuaaucuuagcaccuacuagggugguugcauccgagauggcagaagcauuaaagggaaugcccauaagauaucaaacuacagccguuaaaucagaacacacgggucgagaaauugucgacuuaaugugccaugccaccuucacuaugcgacugcuuagcccaguccgugucccuaacuauaauaugauaauaauggaugaagcucauuuuacagauccuucaucgauagcugcaagagguuauauuucuacacgcguuggaaugggugaagcggcagcaauuuucaugaccgcgacgccgccuggaucaguugaagcauuuccgcaaucuaaugcugucauccaagacgaagaaagggacaucccggaacgaucauggaacucggguuacgaguggauaacagacuuccccgguaaaacuguuugguuugugccuaguauuaaaucaggaaacgauauagcgaacugccugaggaaaaauggaaaaaggguaauucaacuuucgcgaaaaacauuugauacggaguaccaaaagacaaagaacaacgauugggauuauguaguuacgacagauauuuccgaaaugggagcuaacuuuagggcagaccggguaauagauccuagaagauguuugaaaccugucauuuuaaaagauggcccagaaagaguaauucuagccgguccaaugccggucaccguggcaucugccgcgcaacgaagaggacggauaggacgcaaccauaacaaagaaggagaccaauauauauauaugggucagccuuuaaacaacgaugaagaucacgcucauuggacugaagcuaagauguuacuagacaauauuaauacucccgaaggcauuauaccggcauuauuugaaccggaaagagagaaaagcgcggcuauagauggagaguaucgacuaagaggggaagcccgaaaaacuuuuguagaacucaugagaagaggugaucugccuguguggcucucuuauaaaguagcgagugagggcuuucaauacucugauagacgaugguguuuugauggagagcgaaacaaccaaguuuuagaagagaacauggacguugaaauauggacaaaggaaggcgaacgaaagaaauuacgcccaagauggcuagaugcuagaacauauucagaucccuuagccuugcgagaauuuaaggaauuugcggcaggacgaagaagcgucuccggugauuuaauucuugagauugguaaauugccucaacaucucacacaacgagcucaaaacgcuuuagacaauuuaguuauguugcauaacucagaacaaggaggaagggcuuaucgacacgcaauggaagaguuaccggagacaauagaaacguugauguuguuagcguuaauugcgguacuuacagguggcgugacccuauucuuuuuaucaggucguggucuagggaaaacuucgauuggucuauugugcguaauggccucaucggcacuacuauggauggcaagcguugaaccgcauuggauagcagcuagcauaauccuagaguucuuuuugaugguacuauugauaccagaaccagaucgacaacggacaccucaagauaaucaauuggcguaugucgugauaggauuauuauuuaugauccuaacuguagcagcuaaugaaaugggacuacuagaaacaaccaagaaagaucuugguauuggacauguugccguugaaaaccaucaucaugcaacuaugcuagauguggaccuacauccugccucugcauggaccuuguacgcaguugcaaccacuauuauaaccccgaugaugagacacaccauugaaaauacgacggcaaauauuaguuugacagcgaucgccaaccaagccgcaauccuaauggggcuagauaaagguuggcccaucaguaaaauggauaucgggguaccauuacuugcuuugggauguuauucacagguaaauccucucacgcuuaccgcggccguacuaaugcuuguugcccacuaugcgauuauaggaccaggccuacaagccaaagcaacacgagaagcacagaagaggacagcugcaggaauaaugaaaaauccuacaguggaugguauaguagcaaucgaucuugacccaguuguauaugaugccaaauucgaaaaacaauuaggccagauaaugcuacucauauuaugcacaucacaaauccuucuaaugaggacaaccugggccuugugugaaucgauaacauuagcgaccggaccgcuaacgacacuaugggaaggcucacccgguaaauucuggaacacaacaauugccgucagcauggcaaauaucuuucgugguucauauuuagcuggagcaggacucgcguucucauuaaugaaaucuuuagggggcgggcgaagggguacgggagcucaaggugaaacccuaggcgaaaaauggaagcgacaacucaaucaauuaucuaaaucagaguucaauacuuacaaaagaagcggaauuauggaaguagaccguucagaagcuaaagagggcuuaagaagaggagagacaacaaaacacgccguaagccgcggaacggcaaaguuaaggugguuuguugaaagaaaucuggugaaaccagaggggaaaguaauugauuuagguuguggacgugggggauggucauauuacugcgcgggguugaagaaaguaaccgaagugaaaggauauaccaaaggggguccaggucaugaagaacccauccccauggcgacauacgguuggaacuuaguuaaauuacacucaggaaaagauguauucuuuauuccacccgaaaaaugcgauacccuuuuaugcgacauaggugaaagcagccccaacccgacaaucgaagaaggcaggacgcugcgaguacuaaaaaugguagaaccauggcuacgugguaaucaauuuugcauuaaaauucuaaauccauauaugccaucaguuguugagacgcucgaacagaugcaacguaaacauggagggaugcuaguacgaaauccauugucucgaaacaguacgcaugagauguauuggguaaguugcgggacagguaauauagugagcgcaguaaauaugacgaguagaauguuacuuaaccgcuuuacaauggcacaucguaaacccacauaugagagagacguugaccuaggcgcaggaacuaggcaugucgcaguagaaccugaaguggcaaacuuagauaucauuggccagagaauagaaaacaucaagcaugagcacaaaucgacauggcauuaugacgaagacaacccauacaaaaccugggcauaucauggcuccuaugaaguuaaaccaucaggaagugcgucgaguaugguaaaugguguaguaaaauuacuaaccaagcccugggacgucauuccaaugguaacucagauagccaugacugauacuaccccguucgggcagcagcgaguauuuaaagaaaagguggacacacgaaccccaaaagcgaaacgcgggacagcacaaauaauggaagucacagcacgguggcuaugggguuucuuaucgagaaauaagaaaccuagaauuugcacgagagaagaauuuacacguaaaguaagaaguaacgcggcaauuggagcaguauucgucgacgaaaaucaguggaacuccgcgaaggaagcaguagaggaugaaagguucugggaccuuguacaucgagaacgggaauuacacaaacaaggaaagugcgcuacauguguauacaauaugauggguaagagagagaagaaacuuggagaguuuggaaaggcgaagggcuccagagccauaugguacaugugguuaggcgcuagauuucucgaauuugaagcauuagguuucaugaaugaagaucauugguuuagcagagaaaacucgcuaaguggcgucgaaggagaaggucuccacaaauugggauauauauuaagagauauaucgaaaauuccaggagggaauauguacgcugaugauacugcaggcugggacacacggauaacggaagaugacuuacaaaaugaagcgaagauaacagacauaauggaaccugaacacgcccuuuuagcaacuagcauauucaaauuaaccuaucaaaauaaaguagugcggguccaaaggccugccaaaaaugguacuguaauggaugugauaucucgaagagaucaaagagggucagggcagguagggaccuauggauuaaauaccuuuaccaauauggaagcgcaacuuauuagacaaauggaaucggaaggaaucuucagcccaagcgagcuagaaacaccgaauuuggcagaacggguccuugauugguuggaaaaauacggaguggagagacugaaacguauggcuauaagcggggaugacuguguuguaaagccuauagaugauagauucgccaccgcucucacugcucucaacgauaugggaaaaguacgcaaagauauaccacaaugggaaccuaguaaaggguggaaugauuggcaacaagucccauucugcagccaucauuuucaccaguugauuaugaaagacgggagggaaauaguaguaccaugcagaaaucaagacgaauuaguaggacgcgcgcgugugucucaaggagcugguuggucuuuaagagaaacagcaugcuuagggaaaucuuacgcacaaauguggcaacugauguacuuucaccggagggaucuuagauuagcugcaaaugcaauaugcucugcuguuccagucgauuggguacccacaaguaggacaacauggucaauacaugcgcaccaccaauggaugacgacugaagacaugcuaucaguguggaaccgcguuuggauagaggaaaauccauggauggaagauaaaacacacauuucuucuuggggugaugugccauaucugggaaaacgcgaggaucaauggugcggcagcuuaauuggauuaacggcacgugcgaccugggcaacgaacauucaaguugcaauaaaccagguuagacguuuaauugguaaugaaaauuauuuggauuauaugacaucaaugaaaagauucaaaaaugaaagcgauccggaaggagcacuaugguaa

SEQ ID NO: 21180 - RNA, 9879 nt, Artificial Sequence
  derived and/or modified CDS sequence (opt6) from DENV-1__JN819423__SS-prME
ucuguaacuaugcuguuaaugcuaaugccaacugcacuggcauuucacuuaacuacuagggguggagaaccacauaugaucguuucaaaacaagaacgagguaaaagucuacuguuuaaaacaagugcaggcguuaauaugugcacauugaucgccauggacuugggggaacuuugcgaagacacacuuacguacaaauguccacgaauuacagaagucgagccugaugauguagauuguugguguaauacuacggauacuuggguaacauauggaaccuguagucaaacaggagagcaucgaagggacaagcguucaguagcacuggcgccgcacguuggccugggacuugaaacacgggcagaaacuuggaugucgucugaaggagccuggaaacagauucagcggguagaaacaugggcucugagacacccgggauuuacaguaaucgcguuauuucuugcccaugcuaucgggacaagcaucacacaaaaggguauaauuuuuauauuacuuauguuagucacuccaagcauggcgaugaggugcgucggcauugggagcagagacuucguugaaggucucucgggagcaacaugggucgacguaguucuugaacacgguucauguguaacuaccauggcaaaggacaagccaacauuggauaucgaauugcuaaaaaccgaagugacuaaucccgcuguccuacgaaaacuaugcaucgaagcgaaaaucucgaacacaacuacugauaguaggugcccgacccagggcgaagcgacccuaguagaagaacaagacgcuaauuuuguaugccguagaacauucguagaccgggguugggggaaugguuguggauuauucgggaaagguagccucauaacuugcgcuaaauucaagugugucacuaaauuagagggcaagauaguucaauacgaaaaccucaaauacagugugauugucacuguucauacuggcgaucaacaucaaguuggaaacgaguccacugaacacggaacuacggcaaccauuacaccacaagcaccuacauccgaaauacaguuaacagauuacggggcguugacccuggauugcagcccuaggaccggccuagauuuuaaugaaaugguucuuuugacaaugaaagaaaagucauggcucguucauaagcaaugguuuuuggauuuaccccuaccauggacaagcggugccuccaccucccaagaaacuuggaaucgucaggaucucuuagugacguuuaaaacggcacacgccaagaaacaggagguaguugucuuaggcagccaagaaggagccaugcauacagcgcuuaccggugcaacagaaauacagacaaguggcaccaccacaaucuucgcaggacaucucaaauguagacuuaagauggacaaauuaacauuaaaagguauguccuacgugauguguacaggaaguuucaaguuagaaaaagaaguugcagaaacucaacacggaacgguauuaguacaaauaaaauacgaaggcacugaugcaccaugcaaaauucccuuuuccacccaagacgggaaagggguaacucaaaauggacguuugaucacagcuaauccuaucgucacagacaaggaaaagccaguaaacauagaagcugagccuccauucggugaauccuauauuguaauuggcgcaggagaaaaagcacucaaauuaucuugguuuaagaaaggaucuucaauagguaaaauguuugaagccacugcaagaggugcacgaagaauggcaauucuuggagauacggcgugggauuuuggcuccgucggagggguguuuacgucagucggcaaguuagugcaccaaauuuuuggcacugcauauggaguacucuucucuggugucuccuggacuaugaaaauagguauagggguguugcucacaugguuaggacugaauagccgcucaaccucuuuaucgaugaccuguaucgcgguugguuuggugacguuauacuuagggguuaugguccaagccgauucggggugcguuauaaauuggaaggguagagaacuaaaaugcggaucgggaauauucguaacaaaugagguucauacauggaccgaacaguauaaguuucaagcagauaguccaaaaagacuuuccgcugcuauagguaaggcaugggaggaagguguuugcggaauacgaucagcgacaagacuagagaaugugauguggagacaaauuucaaaugaacuaaaccauauuuuguuagagaaugauaugaaauucacuguaguuguuggagaugucguagguauauuagcacaagggaagaaaaugauuagaccacagccuauggaacauaaauauaguuggaaaucauggggaaaagcaaaaauaauaggagcugacguacaaaauacaacguucauuaucgauggaccuaauacaagcgagugcccggacgaccagagagcuuggaacauaugggagguggaggauuacgguuuuggcauuuuuacaacaaauauuugguuaaaauuaagagauucauacacccaagugugcgaucaccgcuuaaugucugccgcuaucaaggauagucgugcaguacaugcagacaugggauacuggauagaaagcgagaaaaacgaaacauggaaacuagcacgugcaucuuuuauugaggucaaaacuuguauauggcccaaaagccauacauuauggucuaaugguguucuagaaucagagaugaucauccccaaaauuuacggaggaccaauuagucaacacaauuaucgaccgggauauuuuacucaaacagcaggaccuuggcacuugggaaaauuagaauuagauuucgaucuuugugagggcacaacaguuguuguggacgaacacugugggaaucgagggccaaguuugcgaacgacuacaguaacagguaagauaauacaugagugguguuguagaaguugcacgcuuccgccauugcgcuuuaaaggagaggaugggugcugguauggaauggaaaucagaccaguaaaagaaaaagaagagaauuuaguaaaaucaaugguaucugcaggaucaggagaagucgacucauuuagccucggacuuuuaugcauauccauaaugauagaagaaguuaugcgcucacguuggaguaggaaaaugcugaugacagggacacuagccguauucuuuuuacuuauuaugggccaauuaaccuggaaugaucuuauccguuuguguauuaugguaggggcaaacgccucagacagaaugggaauggggacuacauacuuagccuuaauggcuacguucaagaugcgaccgauguuugcaguggggcuucuguuuagacgcuugacuucucgggaaguuuugcuacuaacuauuggacuuucuuuaguugcgagcguagaacuaccaaacucauuggaggaguuaggagauggacuagcuauggguaucaugauucucaaacugcuaacagacuuccaaaguuaccaauuaugggcuacacuccucucacucacauuuauaaaaacgacauucucauuacauuacgcuuggaaaacaauggcaaugguuuuaagcauaguuaguuuacuaccacuuugcuuaaguacgacuucacagaaaacaacaugguuaccgguauuacuaggaagucuuggauguaaaccauuaacuauguuucuaauagcugagaacaaaauuugggggaggaagucauggccuuugaacgagggcauuauggcgguugggauagugucaaucuuauuaucaagucugcuuaaaaacgauguuccccucgcgggacccuugauugcaggcggcauguuaauagcauguuauguaauuucaggcucaagugcggaucucagucuugaaaaggccgccgaagugaguugggaagaggaggccgaacacucaggggcuucacacaacauauuaguagaagugcaagacgacgguaccaugaaaaucaaggacgaagagagagacgauacccuaaccauccuacuuaaagcuacuuugcuagccgucucagguguauauccucuuaguauacccgcaacuuuauuuguaugguauuucuggcagaaaaagaaacaacgaucggggguacuuugggauacaccaaguccuccagaaguagaacgugcugucuuggaugauggcauuuacagaauaaugcagagaggacuucuagguaggagucaaguggguguuggagucuuucaagaaaacgucuuucauacgauguggcauguaacucgaggagcuguguugauguaucaagguaagcgucuagagccgucgugggcaucaguuaaaaaggacuuaauauccuauggagggggauggcggcuacaagggucauggaacacuggagaagaaguucaagugauagcggucgagccaggcaagaaucccaaaaauguacagacggcaccagguacuuucaagaccccagagggagaaguaggugcgauugcacucgauuuuaaaccggguacaucagguucaccgauagugaauagagaaggcaagauagugggguuauacgguaauggcguagucacuacaagcggaacauauguaagcgcaauagcccaggcuaaagccucccaagaaggaccucucccggaaauagaagacgaagucuuucgaaagagaaaucuaacaauaauggauuugcacccuggcucagguaagacgaggcgauaccucccagcaaucguacgggaggcaauaaaaaggaaacuuagaacguuaauccuagcaccaacccguguagucgccagugagauggcagaagccuugaagggaaugccuauaagauaucagacgacugcuguaaaaagcgagcacacaggacgggaaauaguagaccuuaugugccaugcaacauucacgaugagacugcuaucgcccgugagaguaccgaauuauaauaugaucauuauggaugaagcgcauuucacagauccuucuucuauagcagcuagggguuauauaaguacacguguaggaaugggagaagcagcggcaaucuucaugacggcgaccccuccagggucgguagaggcuuuuccacagucuaaugcgguuauccaagaugaagaaagagauauaccggaaagauccuggaacucuggcuacgaguggaucacagauuuuccugggaaaacaguuugguuuguaccgaguauaaagucuggaaaugauauugcgaauugucuucgcaaaaaugguaagagaguaauacaacuaagcaggaaaaccuucgauacagaguaccagaaaaccaaaaauaaugauugggauuacguaguaaccacagacauaucugagaugggugcuaauuuuagggcugacagggugauugauccuagaagaugcuugaaaccaguaauacugaaggauggcccugaaaggguaauacuugcugguccuaugccggugaccguggccagcgccgcacaaagacgaggaagaauuggcagaaaucauaacaaggagggggaccaauacauauacauggggcaaccgcucaacaaugacgaagaucacgcucauuggacagaagcuaagaugcuauuagauaacauaaauaccccugaagggauaauaccagcucuguucgagccggaacgugaaaagucagcagcuauagacggcgaauaucgccuucgaggagaggcuagaaaaacauucguagaacucaugagacguggagacuuaccugugugguuaaguuauaaaguugcguccgaaggcuuccaauauucagaucggcgaugguguuuugacggagaacguaacaaucagguguuggaagaaaacauggauguagaaauuuggacuaaggaaggcgaaagaaagaaauugagaccuagauggcucgacgccagaacguauucugacccguuagcgcuaagagaguuuaaagaguuugcugcuggacgaaggagcguuuccggggauuuaauauuggagauaggcaaauugccacaacauuuaacgcagagggcgcaaaaugcacuagauaauuuaguaaugcuacauaacucagaacaaggagguagggcauaucggcaugcaauggaagaacuuccggaaacuauagaaacacucauguugcuugccuuaaucgcuguacuaacaggugguguaacccuauucuuuuuauccggacgaggucuaggaaaaacaaguauagguuuacuuuguguuauggcgucaucugcacuauuauggauggcaagugucgaaccucacuggaucgcagcuucaauuauucuagaauuuuuccuaaugguccuauuaauuccagaaccugaucgucaaaggacaccccaagacaaucaauuggcauaugugguuauaggccuucuauucaugauauugaccgucgccgcuaaugagaugggacugcuugaaaccaccaagaaagaccuaggaaucggacauguagccguagaaaaucaccaucaugcuacaaugcucgacguagauuuacaucccgcuucagccuggacucuguacgcaguagcaacuacaauuauuacgcccaugaugaggcauacaauagaaaauacaacagcaaauauaucacuuacagccauugcgaaucaagcugcgauacuaaugggacuagacaaaggauggcccaucucaaaaauggauauaggaguuccuuuacuagcacucggaugcuauagccagguaaacccacuaacauuaaccgcggcuguuuuaaugcuaguggcacauuaugcaauaaucgguccaggauuacaggccaaagccacucgugaggcucaaaaacgaacggcagcuggaaucaugaaaaauccaacgguggacgggauuguugcaauagaccuugauccuguagucuaugacgcaaaauuugagaaacaauuaggucaaauaauguuauuaauccuaugcacuucccagauauuauuaaugagaacaacuugggcauugugcgaguccaucacauuagccacagggcccuuaacaacacuaugggaggguaguccuggaaaauuuuggaauacuacuauagcagucaguauggcuaauauauucagaggcaguuaccuagcaggcgcgggcuuagcauucagucuaaugaaaaguuuaggagguggaagacgggguacaggugcgcaaggggagacguuaggggagaaauggaaacgccaacuaaaccaacucaguaaguccgaauuuaauacguauaagcgcaguggaauaauggaaguugacagaucagaagcuaaagagggauuaagaaggggcgaaacgacuaaacaugccguuagcagaggcacugcaaaauuacgaugguuugucgaacgaaaccugguaaaaccagaaggcaaagugaucgauuuagguugcggaaggggcgguuggucuuacuauugcgcuggccuaaagaaaguuacugaggucaaagguuacaccaaagggggacccggucaugaagaaccaauaccgauggccaccuacggauggaauuugguuaaacuucauagcgguaaagaugucuucuuuauuccacccgagaaaugugacacacuucucugugauauaggagaguccuccccaaauccgacaauugaagaaggacgcacuuuaaggguccuaaaaaugguugagccuugguuacgaggaaaucaauucugcauaaagaucuugaacccguacaugccaagcgugguagaaacuuuagaacaaaugcaacggaaacacggaggaauguuaguccgcaauccacuuuccagaaauucuacccaugaaauguacuggguaagcugugguaccggaaauauaguaagcgcagucaacaugacguccagaauguuauugaaucgauuuacgauggcacauagaaagccaacuuaugaacgagauguagaccugggagccgguacacgucauguugcgguagaaccagagguagcaaauuuagauauaauaggccaaagaauugaaaacauuaaacaugagcauaaaucaacguggcauuacgaugaagacaauccuuauaaaacuugggcguaucaugggucauaugaaguaaaacccucaggaagugcaucaucuaugguuaacggugugguaaaauuacuaacaaagccaugggacguaaucccaaugguaacacaaauagcaaugacugacacuacuccguuuggacaacaacguguauuuaaagaaaaaguagauacacgcacaccaaaggcaaaaagagggacugcucaaaucauggaaguuacagcaagauggcuuugggguuuucuuagcaggaauaagaaaccacgaauuuguacucgcgaggaauuuacaaggaaggugagaucuaaugccgcaaucggagcagucuucguagaugagaaucaguggaacucugcaaaagaagcaguggaggaugaaagauuuugggacuuaguacauagagaaagagaguuacauaaacaagggaagugugcaaccugcguuuacaauaugaugggcaaacgggagaagaaauugggagaauuugguaaggcaaaaggguccagagcaauaugguauauguggcuuggagcaagauuucuagaguucgaagcacuaggauucaugaaugaagaucauugguuuucgagagaaaacaguuuaucaggaguggagggagaaggacuacacaaacuuggauauauauuacgugauauuucuaagauuccuggcgguaauauguaugccgacgacaccgccgguugggauacaagaauaacggaagacgaucuacagaaugaagcaaaaauuacugauauuauggaaccagagcacgcgcucuuagcaacuagcauauuuaaauuaacuuaucaaaauaaaguggugcgcguucaacgucccgccaaaaauggaacaguuauggauguaauuagcagaagagaccaaagaggcucaggucaggucggaacuuauggucuaaauacuuuuaccaauauggaagcucaacugauuagacagauggaaagugagggaauauucaguccgucugaguuagaaacaccaaaucuugcggaaagaguguuagacugguuggagaaauauggcguagagcgacuaaaaaggauggcaaucucaggagacgauugcgugguuaaaccaauagaugauagauuugcuacugcgcucacagcauuaaaugauauggggaaaguccguaaagacauaccgcagugggaaccuucaaaagguuggaacgacuggcaacaagugccauucuguucacaucacuuucaccaauuaauuaugaaagacggacgagaaauugucgucccaugcagaaaccaagaugaacuuguagguagagcaagggucagccagggagcgggauggucacuucgagaaaccgcuugucuagguaaaucguaugcccaaauguggcaauuaauguacuuucaucguagggaucuucgauuggcagcgaaugcuauauguucggcaguaccaguagacuggguuccgacgucuagaacuacauggucuauacacgcacaucaacaguggaugacaacagaagacaugcucaguguauggaauagaguauggauagaggaaaacccauggauggaagacaagacacacaucaguucguggggagaugucccguacuuaggaaaaagagaggaucaaugguguggcucgcuuauagggcuaacugcucgggcuacuugggcaacuaauauacaaguagcgaucaaccaggugcgaagacuaauuggcaaugaaaacuaucuagauuauaugaccucaaugaaacguuuuaaaaacgaaagugauccugagggagcucuaugguag

SEQ ID NO: 21181 - RNA, 9879 nt, Artificial Sequence
  derived and/or modified CDS sequence (opt6) from DENV-1__FJ639672__SS-prME
ucaguaacgauguuauuaauguuaaugccaacggcauuggcuuuucauuuaacuacuagaggaggagagccucauaugauaguaucaaaacaagaacguggcaaaucuuuauuauuuaaaacaagugccggugucaauaugugcacauugauugcaauggaccuuggagaauuaugcgaagacaccaugaccuacaaauguccuagaaucacugaagcagagccagaugacgucgacuguugguguaaugcgacggauacuuggguuacuuaugguaccuguagucaaacgggggaacaucguagagauaaacgaaguguagcccuugcuccgcacgugggccuaggcuuagaaacgaggacagaaacuuggaugagcagcgagggggcauggaaacaaauacaacguguggagacaugggcgcugagacauccgggguuuaccguuauugcucuauuuuuggcgcacgcgauugggacuucuauaacacaaaaaggaauaaucuuuaucuuacucauguuagucacuccgucaauggcaaugcggugcguugggauaucaaguagagauuucgucgaaggacuuagcggagcaaccuggguagaugugguccuagaacaugguucauguguaacuacaauggcgaaagauaaaccaacccuagacauagaacuguuaaaaacugaaguaacgaauccugcuguccuacguaaacuauguauugaagcaaaaaucaguaauacuacuaccgacucacgauguccaacucaaggcgaagcaacccuaguugaagaacaagaugcaaacuucguuuguagaagaacuuucguugaucgcggauggggaaauggaugcggguuauuugguaaaggaucacugauaaccugcgcgaaauucaaaugugucacaaaauuagaaggaaagauuguccaauacgaaaauuuaaaauauagugugauaguaacaguacacacgggugaccaacaucaaguaggcaaugaaucaacggaacauggaacuaccgccacuaucacuccacaagcuccaacuacagaaauacaauugacugacuauggagccuugacacuggauuguaguccacguacaggacuagauuuuaaugagauggucuuacugaccaugaaagagaaguccugguuaguacacaaacaaugguucuuggauuuaccucuaccauggacuucaggagcaucaaccucacaagaaacguggaauagacaagauuuguuagucacuuuuaaaacagcccacgcuaagaaacaagaaguagucguguuagggucucaagaaggcgcaaugcauaccgcacuaacaggagcuaccgagauacaaaccaguggaaccacuaccauuuucgcuggacaccuaaaaugucgcuugaaaauggauaaacuaacacuaaagggaaugucauacguaaugugcacuggcaguuuuaaauuagagaaggaaguagccgaaacucagcacggaacgguuuuaguacaaauaaaguacgaaggaaccgaugccccuugcaagauaccuuuuaguacacaggaugagaaaggaguaacccaaaacggaagauugauuacagccaacccaauugugacagacaaagaaaaaccagugaauauugaagcggaaccaccauucggcgagagcuauauugucauaggugcaggggaaaaagcauugaaacuaucgugguucaagaaagguucgagcauaggcaagauguucgaggcaacugcuagaggagcgcgacguauggcaauccugggagacacagcuugggacuuuggcagcauaggaggcguauuuacuucuguagguaaguuaguacaucaaauauucggaacagcguauggaguucuauuuucgggggucucauggacaaugaagaucgguauaggaguuuuauugacauggcuuggauuaaauaguagaaguacuucucuuucaaugaccugcaucgcgguuggauugguuacauuauaucucgggguuaugguacaagcggauucagggugcgugauuaauuggaaaggccgagaguuaaaaugugguagcggaauuuuuguaacuaaugaaguacauacuuggacagaacaguauaaauuucaagcagauucaccgaaacguuuaagugcggcaauaggaaaagcaugggaagaggguguuuguggcauaagaucugcaacuagacuagaaaauaucauguggaagcaaauuagcaacgaacugaaucauauauuguuagagaacgauaugaaacuaacugugguaguaggugacguagcagguauauuagcccaaggaaagaaaaugauacgcccucaaccuauggaauacaaauauaguuggaaaucuuggggaaaagcgaagauaaucggcgcugaugugcaaaauacaacuuucauaauugacggucccaauacuccugaaugucccgaugaucaaagggcauggaauauaugggagguagaagauuauggauuuggcauuuucacaacgaacauauggcuaaaacuacgagauucauauacucaaguaugugaucacagacuuaugagcgccgcaauuaaagacucaaaagcuguacaugcagauaugggauauuggauagaaucugagaaaaacgagacuuggaaauuagcgagggcuaguuucauugaaguuaaaacauguaucuggccuaaaucccauacacugugguccaauggcguucuagaaagugagaugauaaucccuaaaauuuaugguggaccaauuagucaacauaacuaucgaccagguuacuucacgcagacagccgguccauggcauuuagguaaguuagaauuagacuuugaucugugugaaggcaccacgguugucguugacgagcauugugguaauagagggccaagucuacgaaccacgaccguaaccggaaaaauuauacaugaauggugcuguagaaguuguacauuaccaccauugagauucagaggagaagauggcuguugguaugguauggaaauacgaccggugaaggagaaagaagagaaccuagucaaaucaauggugagugcggguagcggugaaguggauaguuuuaguuuaggauuauuauguaucucuauuaugauagaagagguuaugcgaagccgauggucacggaagauguugaugacaggaacucuugcaguguucuuucuacuaauuaugggacaauugacguggaacgaccuaauacgauuauguauaauggucggggcgaaugcuagugaccgcaugggcaugggaacgacauacuuagcccuuauggcuaccuucaaaaugcgcccuauguucgcaguaggauuauuauuccgaagacuuaccucuagagagguuuugcuauuaacaauuggguugucauugguagcaaguguagagcuaccaaauagucuggaggaauuaggcgacggucuggcuauggggaucaugauucucaaauuacuaacggauuuucagucacaucaauuaugggcaacuuuguuaagccuaacauuuauaaagacaacuuuuucccuucacuaugcguggaaaacaauggcgaugguuuuaagcauaguuagccucuuuccacuuuguuuaucuacaacaagucagaaaacuacaugguuaccaguauuacucggaucgcugggguguaaaccacuaacaauguuuuuaauagcggagaacaaaaucugggggaggaaaagcuggccacugaaugaagguaucauggcaguagguaucgugucaauucuacugucuucacuucuaaagaacgauguuccauuagcugggccacugaucgcagggggaauguuaauugcaugcuauguuauaaguggcaguucggcagacuugucacuagaaaaagcagccgaaguaucgugggaggaagaagcagaacauucaggagcuucacacaacaucuuaguagaaguucaggacgaugggacuaugaaaaucaaagaugaagaacgcgaugauacucuaacuauauuacucaaggcaacauugcuugcgguuuccgguguuuauccacuaucgaucccagccacauuguuuguuugguauuuuuggcagaaaaagaagcaacggucaggcguguugugggauacuccaaguccgccugaaguggagagggcugugcuggaugacgguauauacagaaucaugcaacgcggauuacucggcagaagucaaguugggguagguguguuucaagaaaacgucuuucauacaauguggcauguaaccaggggagccguacucauguaucaggguaagagauuagaaccuucuugggcgucagucaagaaagauuuaauuucuuacgguggagguuggcgauugcaagggucuuggaauacuggugaagaaguacagguuauagcuguagaaccagggaagaaucccaaaaacguacaaaccgcccccggaaccuucaagacuccagagggagaaguuggugccaucgcucuagacuuuaagccagguaccuccgguucgccgauaguaaauagagaagggaagauugucggguuguauggaaauggggucguaacuacaucagguacuuaugugucugcaaucgcccaagcuaaagcgucacaagaaggccccuuaccugaaauugaggaugaaguuuuucgaaaaagaaaucucacaauuauggaccuccauccagggucaggaaaaacacggagauauuuaccugccauaguacgagaggcaaucaaaaggaaacucagaacccuuauucuagccccaacaagaguggucgcaucagaaauggcggaagcacucaaaggaaugcccauccguuaucaaacaacagcuguaaaaagugagcauacuggaaaagaaauugucgaucuaaugugccacgcuaccuuuacaaugagauuauuaagucccguaagggugccaaauuauaacaugauaauaauggaugaagcacauuucacggauccuucaaguauugcagcaagaggauauauaucuacucgagugggaaugggcgaagcagcagcgauuuuuaugacugcuacuccacccggaagcguagaagcguuuccgcaaaguaacgcuguuauacaagacgaggaaagagauaucccagaacgguccuggaacagcggauacgaauggauaacagacuucccagggaaaacaguuugguuuguaccaucuauaaaaucagguaaugauauagccaacugucugcgcaaaaauggcaagagaguaauacaauuauccagaaaaacuuuugacacagaguaucaaaagacuaaaaauaacgacugggacuacguaguaacaacagacauuagugaaaugggggcaaacuucagagcggaccggguaauagacccucgcagaugccugaaaccaguaauacucaaagaugguccagaaagaguaauacuggcagguccaaugccaguaacaguugcuagcgcggcgcaacgucgcggucguauugguagaaaucauaauaaagagggagaccaauacaucuacaugggccaaccucuaaacaaugaugaggaucacgcccauuggacugaagcuaagaugcuucuugauaauauaaauacuccggaagguaucaucccagcuuuauucgaacccgaaagggaaaagucagcagcuauugauggagaauauagacuaagaggggaagcgcguaaaacguucgucgaacucaugaggagaggggaucuaccagugugguuaucguacaagguagcuucugaaggcuuccaauauucugaccgucgaugguguuuugauggugaacguaauaaucaaguccuggaagaaaauauggauguagaaauauggacaaaagaaggcgaaaggaagaaacuacguccacgaugguuagaugccagaacuuacucugaccccuuggcguuacgagaguuuaaagaguuugcagcuggaagaagaucuguaagcggggauuuaauauuagagaucgggaaauuaccacaacaucuaacgcagcgugcucaaaaugcauuagacaauuuaguaauguuacauaauuccgaacaaggugguagagcuuaucgccacgcgauggaagaauuacccgauacaauagaaacuuugaugcuuuuagcacuuauagcaguguugacggguggagugaccuuauucuuccucagcggacgagggcuuggaaaaaccaguaucggguuacucugugugauggcguccaguguguuauuauggauggcuagugucgaaccgcacuggauagcagcgucgaucauucuagaguucuuuuuaaugguguuguuaauaccagaaccagaucgacaaagaacaccgcaagacaaccaacucgcuuacguuguaaucgguuuguuguucaugauauugaccguagcggcaaaugaaaugggcuuacuugaaacaacaaagaaagacuuaggaauaggacauguagcugucgaaaaccaucaucacgcggccauguuagacguugaccuucaucccgcgagcgcauggacauuguacgcuguugcgaccacaauuauuacaccaaugaugagacacacaauugagaauacaaccgcuaacauuucuuuaacggccauagccaaccaggcagcaaucuuaaugggucuggauaaagguuggccgauaucaaaaauggauauuggaguaccauuauuagcacuagguuguuauucacagguuaacccgcuaacuuuaacggcagcuguuuuaaugcucguagcacauuaugccauuauaggcccagguuuacaagcaaaagcaacaagggaagcucagaaaagaacggcggcuggaauaaugaagaaucccacuguagauggaaucguagcaauagaucuagacccagucguauaugacgcgaaauuugaaaaacaacugggccaaauaauguuguugaucuuauguacaucacaaauucuauuaaugcguacuaccugggcucuaugcgaaagcauuacgcucgccaccgggccgcuaacuacauugugggaagggucucccgggaaguuuuggaacacaacuaucgcaguuaguauggcaaauauauuccgagguucuuaucuagccggcgcgggucucgcuuuuagucugaugaaaucucuaggagguggaagaagggggacaggugcacaaggagaaacauuaggcgaaaaauggaaaagacaguuaaaccaauuaucaaaaagcgaauuuaacacauauaaaagaucuggaaucauggaaguugauagaucugaggcaaaagaaggucuaaaaagaggugaaacuacaaaacaugcuguaaguaggggaacggcaaaauuacgcugguuugucgaacgcaaccucguuaaaccagaagguaaaguuauagauuuagguuguggaagaggaggguggucauacuauugugccggucuaaagaaagugaccgaaguaaaaggcuacacaaaagggggucccggacacgaagaaccaauacccauggccacauacggauggaauuuaguuaaguuacacaguggaaaagaugcguuuuucauaccuccagaaaaaugugauacguuacucugugacaucggagaaucaagucccaaucccacgauagaagagggaagaacauuaagaguacuaaaaaugguagagccgugguuacgagguaaccaauuuugcauuaaaauccuuaacccguauaugccuagcguaguggagacgcuagagcaaaugcaacggaaacacggagggaugcuaguuagaaacccacucucacgcaauucgacccacgaaauguacuggguaaguugcgggacagggaacauagucucggccguaaauaugaccucaagaauguuacuuaauagguucacuauggcacaccggaaaccaacuuacgagcgagauguagacuuagggacagguaccagacacguggccguggaaccugaaguagccaaucuggacauaauuggccaaagaauugagaauaucaaacacgaacacaagucgacguggcauuaugaugaagauaacccuuacaaaacaugggcauaucauggcaguuaugagguuaaaccaucaggaucagcaagcuccaugguaaaugguguggucaaauugcucaccaaaccaugggauguaauaccaauggucacccaaaucgccaugacagauacgacaccuuuuggacaacaaagaguguucaaagagaaaguagauaccagaacuccaaaagcuaaacguggaacagcacagaucauggaagucacagcgagaugguuguggggauuccuuuccagaaauaagaaaccuaggauaugcacacgggaggaauuuacucgcaaaguccgcucgaaugcugcgauaggugcuguauucguagaugaaaaccaauggaauagugccaaagaagcugucgaggaugaaagauuuugggaccuaguacauagagaaagggaacuacauaaacaaggaaaaugcgcgacaugcguuuauaacaugauggggaagagagaaaagaaauuaggagaauuuggaaaggcuaaagguucucgagcaauuugguauaugugguuaggagcucgauuucucgaauuugaagcacuagguuuuaugaaugaagaucacugguuuagucgugaaaauagucuguccggaguagaaggagaaggacuucacaaacuaggauauaucuuaagagauauuucuaaaauaccaggaggaaauauguaugccgaugacacagccgguugggauaccagaauaacggaagacgaccuucaaaacgaggcaaaaauaacggauauaauggagccugaacaugccuuauuagcaaaagcaaucuuuaaauuaacauaucaaaauaaaguggugcgaguacaaagaccggccaaaaacggaacgguuauggauguaauaucccgacgugaccaacgugggucaggacagguaggcacauauggauugaauacuuucacgaauauggaggcccaacugauacgccaaauggagucugaagggauauucagcccuucugaacuagagacaccuaaccucgcagaacgagcacuggacuggcucgaaaaauauggcguugaacgguuaaaaaggauggccauuaguggcgaugauuguguaguaaaaccaauugacgaucgauucgccaccgcacuaacagcgcucaacgauaugggcaaaguucguaaagauaucccccaaugggagccaucuaagggcuggaacgacuggcaacaaguuccuuucuguagucaucacuuccaccaacugauaaugaaagacggcagagagauuguagugccaugccggaaccaggacgaauugguuggcagagcuagagucagccaaggggcugguuggagcuuacgcgagacagcuuguuugggcaagucauaugcccaaauguggcaacuaauguacuuccacagaagagacuuaaggcucgcagcuaaugcaaucuguagcgcgguuccagucgauugggucccgacauccagaacgacuuggucaauucacgcacaucaccaauggaugacaacagaagauauguuaagcgucuggaacagaguauggauagaagaaaaccccuggauggaggacaaaacgcacauaucuucgugggaagauguuccauaucuugguaaacgugaagaccagugguguggcucccugauaggacuuacagcuagagcaacaugggcaacuaacauucaagucgcgauaaaucaagucaggcgccuuauaggaaaugaaaauuaucuagauuacaugacgucuaugaagcguuucaagaaugagucggacccagagggugcacuaugguaa

SEQ ID NO: 21182 - RNA, 9879 nt, Artificial Sequence
  derived and/or modified CDS sequence (opt6) from DENV-1__FJ639673__SS-prME
ucggugacaaugcuccuuaugcuaaugccaacagcauuagcuuuucacuugacaacacgugguggagaaccacauaugauaguaucaaaacaagaaagagguaaauccuuacuuuuuaaaacuagcgcaggaguuaauauguguacacugauagcaauggauuuaggagaacucugugaagacacaaugacguauaaaugcccacguauaacagaaguagaaccggacgacguugauugcugguguaauacaacugauacauggguaaccuacggaacuugcucacaaacaggcgaacacagaagagacaaacgguccguugcacucgcaccucauguugguuugggucuugaaacacgagcagaaacuuggaugucauccgagggcgcauggaaacaaauacaacguguagagacaugggcuuuacgucauccagguuuuacuguuauagcucuauuuuuggcucaugcaauaggcacuagcauaacacaaaaaggaauaauuuucauccuuuugauguugguaacuccuaguauggcaaugagauguguuggaauuggaagcagagauuucguugaaggguuaucaggugcaacuuggguugacguagugcuagaacauggguccugugugacgacuauggcaaaagauaaaccaacccuagacauagaauuguuaaaaacggaggugacgaauccagcaguucuaagaaaauuauguauagaagcaaaaauuaguaacacuacuacggacucaagaugccccacacaaggggaagcaaccuuaguagaggaacaggaugcuaauuucguuuguagacgcacuuucgucgaucgagguuggggcaauggauguggucuuuuuggcaaaggaagucuuauaacgugcgcaaaauuuaaaugugugacuaaacucgaagggaaaauaguacaauaugaaaaccucaaauacagcgugauagugacagugcacaccggcgaucaacaccagguagggaaugaaaguacagaacaugggacuacagcaacaauaacaccacaggccccaacuucagaaauucaauugacagauuauggugcccuaacuuuagacuguucaccuagaacgggccuagacuuuaaugaaauggucuuauuaacuaugaaagagaaaaguugguugguccacaaacaaugguuucuagaucuaccccucccauggacgagcggggcgucuacuagccaggagacuuggaauagacaggauuuacuuguuaccuucaaaacagcucaugccaagaaacaagaaguagucguacugggcucacaagaaggcgcuaugcauacugcuuugacaggagcaacggaaauccaaacaucaggaacaacuaccauauucgccggacaucuaaaauguagauugaaaauggacaaauuaacauuaaagggaaugaguuacgucauguguacagguucauucaaauuggagaaagaaguggcagaaacacagcauggcacaguucuaguucaaaucaaauaugaagggacagaugccccuuguaaaauaccauuuagcacacaagaugaaaaaggaguaacgcaaaacgggaggcuaauuacugcuaauccuauagucaccgauaaagaaaaaccagucaauauagaagcagaaccaccauuuggggagaguuauaucgucauuggggcaggggagaaagcccuaaaacuuucaugguuuaaaaagggaucaagcaucggaaaaauguucgaagcaaccgcgaggggugcucgaagaauggccauuuuaggagauacagcgugggacuuugguaguauaggaggaguuuuuacaagcgucgggaaauuaguucaucaaauauucgggacugcauauggaguauuguucagcggaguaucauggacaaugaaaauaggaauagggguacucuugacuuggcuuggcuuaaauaguagaagcacuagcuuaucuaugacauguaucgcaguagguuuagugacacuauacuuaggaguaaugguucaagccgacagcgggugcguuauuaacuggaaaggucgugaacugaagugugguuccggcauuuucgucacaaaugaaguccauacauggacggagcaauauaaauuucaagccgauaguccuaaaagacugucugcugcgauaggcaaagcaugggaagaaggaguaugcgguauccgcagugcaacuagacuggaaaacauaauguggcgacagauuagcaacgaacuaaaccauauauuacuugaaaaugauaugaaguuuacugucguuguuggagauguaguagguauacuugcucaaggcaagaaaaugauccguccccagccaauggaacacaaguacuccuggaaaagcuggggaaaggcuaagaucauuggagcggauguacaaaauacgaccuucaucauagacgggccuaacacaccagaguguccugacgaucaaagagcguggaauauaugggagguugaggacuauggguucggcaucuuuacuacaaacauuuggcuuaagcuacgagauucauacacgcaaguuugugaucauagacucaugucagcagcaaucaaagauagcaaagcuguccaugcagacaugggauacuggauagaaagugagaaaaacgaaacuuggaaauuggcucgcgcuaguuuuauagaaguuaaaacgugcauauggccaaagucacauacgcugugguccaauggcguccuagagucagagaugauuauaccuaagauuuacggggguccaaucucacaacacaauuacaggcccggauacuuuacacaaacggcuggaccuuggcacuuaggaaaauuagaacucgacuuugaucuuugcgagggaacaacagugguggucgacgaacauuguggaaaucgcggcccaucuuuaaggacuacuaccguaacagguaaaaucauucaugaaugguguugccgaucaugcacacuuccaccauuaagauucaaaggugaagauggcugcugguaugggauggagauccgccccguaaaagagaaagaagagaauuuggugaaaucuaugguuagcgcggguucgggggaaguugacagcuuuucucugggacuauuguguaucaguauaaugauagaagaaguuaugcgaagucgcuggagcagaaagaugcugaugacaggaacgcuagccguauucuuucugcuaauaaugggacaauuaacguggaaugacuuaauuaggaguuguaucauggucggagcaaacgcaagcgaucgaaugggcauggggacgacuuaccuugcgcuaauggccacuuuuaaaaugaggccaauguuugccguaggccuucuauuucgccgcuugacaucgagagaaguccucuuacuaacuauaggucucucacuuguagcguccguagaguuaccaaacucccucgaggaacuuggugauggacuugcaauggguauaaugauccuaaaacuauuaacagauuuucaaucauaccaacugugggcaacacuacucagucuuacauuuaucaaaacaacauuuagccuucacuaugcauggaagaccauggccaugguucuaaguauaguuucucuacuaccucuaugucuaucaacaacaucccagaaaacaacuugguuaccaguacuguuggguucacuaggguguaaaccccuaacaauguuucuuauagccgagaacaagauaugggggaggaaaagcuggccauugaaugaagguauaauggcagugggaaucguaucuauauuauugucuagucuacuuaagaaugacguaccucucgcuggaccuuugaucgcaggagguauguuaauagcauguuaugugauaaguggaucgucugcagaccuuucccuagaaaaggcagcaguagugagcugggaagaagaagcagaacacaguggagcaagccauaacauacugguagagguccaagaugauggcacaaugaaaauaaaagaugaagaaagggaugacacauuaacaauucuacuuaaagcaacauuguuagcgguaucuggaguuuauccguuaagcauacccgcaacccuauuugucugguacuuuuggcagaagaagaaacaacggucugggguauuaugggauacuccuucaccaccagaaguugaacgagccguacuagaugacgggauuuaccgcauaaugcaaagaggucuuuuggguagaagucagguuggagugggaguuuuucaagagaacguauuucauacaauguggcacguaacgagaggugcugugcuaauguaucaagguaaaaggcuagaaccaucaugggcaucagucaagaaagaucuuauaucguaugggggcgguuggcgauuacaaggaagcuggaauacaggggaagaagugcagguaauugccguagaaccggggaagaaucccaaaaauguccaaacugcaccagguacauuuaaaacaccggaaggggagguaggugccauagcgcuagacuuuaaaccaggaaccuccggauccccaauaguuaaucgagaaggaaaaauuguuggucuuuauggcaauggaguugugacgacaagcggcacauaugucuccgcaauagcccaagcgaaggcuucacaagaagggccucuaccugagauugaagacgaaguauuucguaagcggaacuugacgauuauggauuuacauccagguucuggaaaaacgagaagguaucucccagcgauaguaagagaagcaauaaagagaaaacugcgcacgcuuauacucgcaccaacaaggguaguugccucugaaauggcugaagcccucaaaggaaugccaauuagauaccagacuacagcgguuaaaagugaacauacagggagagaaauugucgaccuuaugugucacgcaacauuuacuaugagauugcuuucuccagucagagugccaaauuacaauaugauaauaauggaugaggcacauuucaccgauccuucgucaauagcagcaagaggauacauaucaacacggguaggaaugggugaagcagcagcaauauucaugacagccacgccgccgggcucgguggaggcauucccucaaucgaaugcaguaauacaagacgaagaacgagacauuccagagagaucuuggaacucagguuacgaauggauuacagauuuuccuggaaaaacggugugguucguuccuucuauaaaaagcggaaacgauauagcaaauugucugcgcaaaaacgguaaacgagucauccagcuaucuaggaaaacguucgacacagaguaucagaaaaccaaaaacaacgauugggacuauguaguaacaaccgauaucagugaaaugggugccaauuuccgggccgauagaguaauugauccgagacguugccuaaaacccgugauuuuaaaggauggaccggagcgcgugauacuugcgggaccgaugccuguaacaguggcuucagcagcacaaagaaggggaagaauuggaagaaaccauaauaaagaaggcgaccaguacauauauaugggucaaccgcuaaacaacgaugaggaccacgcacacuggacugaagcuaaaaugcuuuuagacaacauaaacaccccggaagggauuauaccggcuuuguuugaaccugaacgugagaaaagugcagcgaucgacggagaauaccguuuacgaggagaagcgaggaaaacuuuuguagaacuuaugcguagaggugauuuaccuguuugguuaaguuauaagguggcuucugaaggauuccaauauagugaccgucguuggugcuuugauggggaacgaaauaaucaaguauuggaggaaaacauggaugucgaaaucuggacuaaagaaggggaaaggaagaaauugagaccacgauggcuagaugcucgcaccuauucugauccauuggcacuacgagaguuuaaggaauuugccgcgggacgaagaucaguaucgggugaucuuauuuuagaaauaggaaaacuaccacaacaucuaacucaaagggcacaaaacgcucuagacaauuuaguuauguuacacaauagcgaacaagggggcagagcuuauagacacgcgauggaagaacuuccagauacuauagaaacucuaaugcugcuagcauuaauagccguguuaacuggaggcguaacacucuucuuuuugaguggaagaggacuuggcaaaaccagcauaggacuucuaugcguaauggcaucgucagcacuacuguggauggcaucaguagagccgcacuggauagccgcuuccauaauacuggaguucuuuuuaauggugcuacuaaucccugagccagacagacaaagaacgccacaagauaaccaauuagcauacguagucauuggacuacucuucaugauacuuacaguagcggcaaaugagaugggauuauuagaaacuacuaagaaagauuuggggauaggacauguagcuguugagaaccaucaucaugccacaaugcuugauguugauuugcauccagcuagcgccuggacauuguaugcaguggcaacuacuaucauaacaccuaugaugaggcacacgaucgaaaauacgaccgcuaacauaucacuuacugcuauagcuaaucaagcggcuauacuaauggguuuagacaaaggcuggcccauaaguaagauggacauaggaguaccacuguuggcauuaggaugcuauucgcaagugaauccauugacacucacagcagcagugcugauguuaguagcacauuacgccauaaucggcccuggauuacaagcgaaagcuacuagagaggcacagaaaagaacggcggcaggaauuaugaaaaauccaaccguagacgguaucguugcgauugacuuagaucccgucguuuaugaugccaaauuugaaaagcaauuagggcagauuaugcuacuuauucucuguacaucccaaauuuugcucaugaggacgacuugggcacucugcgagucaauaacccuggccaccggacccuugacgacucuaugggaaggaaguccgggaaaauuuuggaauacuacuauugcgguuagcauggcaaauaucuuucgcgggucauaucucgcuggcgccggacuagcauuuucauuaaugaaaucauugggcggcggaagacgagguacgggugcacaaggggaaacguuaggagaaaaauggaaaagacaauuaaaccaacuuucaaaaagugaauuuaauacauacaagagaucagguauaauggaagucgaccgaucugaagcgaaagaagguuuaagacguggggaaacaacgaaacaugcuguaucucgaggaacggccaaacuuagaugguucguggaaagaaaucuugugaaaccugaaggcaaaguaauugaucuaggcuguggccgaggcggcuggagcuauuauugcgccggccuuaagaaaguaaccgaagugaaagguuacacaaagggcggccccgggcacgaagaaccaauaccaauggcuacauacggguggaaucucguuaaacugcauaguggcaaagacguauucuucauaccaccugaaaaaugcgacacauuguuaugugacauaggggagagcaguccgaacccuacgauugaggaaggacgaacccuuagaguguugaaaaugguagaaccauggcuaagagggaaccaauucugcauaaaaauacuaaacccauauaugccuucugugguugagaccuuagaacaaaugcagcguaagcauggggguauguugguacgaaacccuuuaucacgaaacucgacccaugaaauguauugggugucaugcggaacaggaaauauugugucagcaguuaauaugacaucuagaaugcuucuaaaucgguucacuauggcucaccggaaaccaacauacgagagagauguugaucugggagcugguacacgacaugucgcggucgagccugaaguugccaaucucgauauuauaggacaacguauugaaaauauaaaacaugaacauaaaucaacauggcauuaugacgaagacaaccccuauaagacaugggcauaccaugggaguuaugaagugaaacccagcgguagcgcaucuucaauggugaacgguguugugaaauuacuaacaaaaccaugggacguuauaccuauggucacucaaauagcuaugaccgauacuacucccuuuggucaacaaaggguauuuaaagaaaaaguagacacgcgaacuccaaaggcuaaaagaggcacugcacagauaauggaagucacggcaagauggcuaugggguuuccuuucacgcaacaagaagccaaggauaugcacccgagaagaauuuacccggaaaguaagaaguaacgcagcuauaggugcgguuuuuguggacgagaaucaguggaacucagcgaaagaagcaguugaagaugagagauuuugggauuugguacauagagaacgagaauuacacaagcaagggaaaugugcaacauguguguauaauaugaugggaaaacgugaaaagaaguuaggagaauuuggaaaggcaaaaggaucgcgagccauaugguauaugugguuaggugcgcgguucuuagaguuugaagcacuaggauuuaugaaugaagaccacugguucaguagagaaaauucuuuaagcgggguugaaggagaaggacuccacaaguuagguuauauacuuagagauauuucuaaaauaccuggggguaauauguacgcugacgacacagcaggaugggacacgaggaucacagaagaugacuuacaaaaugaagcgaaaauaacagacauaauggaaccagagcaugcguuacuagccaccucaauauuuaaacugaccuaccaaaauaaaguugugaggguccaacgaccagccaaaaacggaacggucauggaugucauauccagaagagaccaacgaggaucuggccaaguaggaacguacggacuaaauacuuucacuaacauggaagcccaauugauuaggcagauggagagugagggaaucuuuucaccuucugaauuagagaccccuaaucuagcggaacgaguuuuggacugguuggaaaaauaugggguugagcgccuaaagaggauggcuauuuccggagaugauugugucgucaaaccaauagaugaccgauuugcaaccgcguuaacugcacuaaaugacauggguaaggugcgaaaagauauaccacaaugggaaccuuccaaaggcuggaaugauuggcaacaaguuccauucuguucacaucauuuucaucaacuaaucaugaaggauggacgcgaaaucguaguucccuguagaaaucaagaugagcuaguugggagagcccgaguaucccagggcgcuggguggagcuuaagagagacugcaugucuaggaaagucauaugcccaaauguggcaauugauguacuuccauagaagggaccuacgauuagcagcuaaugcgauauguagcgcugucccaguggauuggguaccaacuucuagaacaacuuggucuauccaugcccaucaccaauggaugacaacugaagacaugcucucaguuuggaauagaguuuggauagaagaaaauccauggauggaggauaagacacauauauccucauggggagauguaccauaucuuggaaagcgggaagaucaaugguguggaucuuuaaucgggcuuacugcccgagcuacgugggcgacgaauauacagguggcaauaaaucaaguuaggagacuaauaggaaacgaaaauuauuuggacuauaugacgagcaugaaacguuuuaagaaugaaagcgacccagaaggagcauuaugguaa

SEQ ID NO: 21183 - RNA, 9879 nt, Artificial Sequence
  derived and/or modified CDS sequence (opt6) from DENV-1__FJ639674__SS-prME
ucaguuaccaugcuacuuauguugaugccuacugcuuuagcauuucacuuaaccacaagaggcggggaaccacauaugauuguaagcaaacaagaacgcggcaaaucauuguuguuuaaaacuagcgcuggcguuaauauguguacguuaaucgcgauggaccuuggugaauuuugcgaagacaccaugacauacaaauguccuaggauuacagaagccgaaccugacgacguagauuguuggugcaacgcaacugauacuuggguaacguacggcacgugcucacaaacaggugaacaucgacgggauaaaagguccguagcccuagcaccacacguugguuugggucuugagacgcgaaccgaaacuuggaugucaagugaaggggcuuggaaacaaauacaacguguagaaaccugggcuuugcgacauccagguuucacuguaaucgccuuguucuuagcucaugcuauugggacaaguaucacucaaaaagggauuauauuuauuuugcuuauguuaguuaccccaucaauggcaaugagguguguugggauaggaagcagagauuuuguagaaggguugaguggggcgacauggguggauguagucuuagaacauggaaguuguguaacaaccauggcaaaagauaaaccuacccuagauauagaacuauugaaaacagaagugacuaacccagcuguacugagaaaauugugcauugaagcuaaaauuuccaacacgacgacggacucucgaugcccaacacagggggaggcaacucuaguagaagaacaagacgccaauuucguaugucgaagaaccuucguugacaggggauggggcaauggauguggauuauuugguaaaggcaguuuaauaacuugugcaaaauucaaaugugugacaaaacuugaaggaaaaaucguccaauacgaaaaccugaaauacagugucauuguuacaguacauacuggagaucagcaucaaguugguaaugaaucgacggaacacgguacaacggcuaccaucacgccacaagcuccaaguaccgaaauccaacuuacugauuacggagcccucacacucgauugcucaccaagaacugguuuagacuuuaacgagaugguguuauuaaccaugaaggaaaaaucaugguuaguucauaaacagugguuccuugaucuaccauugcccuggacuucgggagcaucuaccucucaagaaacauggaauagacaggaccuacuuguaacauucaaaacugcacaugcaaagaaacaggaaguagugguacucggaagccaagagggcgcaaugcacacagcauuaacgggagccacagaaauacaaacauccggaacuaccacaauauuugccggacauuuaaagugccgcuuaaaaauggacaaacuuacacugaaagggaugaguuacguaauguguacaggcaguuucaaacuagaaaaagaagucgcggaaacucaacaugggacaguauugguacagauaaaguaugaagggaccgaugcuccguguaaaaucccuuucaguacccaagacgaaaagggcgucacucaaaauggacgauuaauuacggcgaauccaauaguuacugauaaagagaaaccuguuaacaucgaagcagagcccccguuuggcgaaagcuacauaguaauaggcgcaggagagaaagcauuaaaauuaagcugguuuaagaaaggaagcucuauagggaagauguuugaagcgaccgcacgaggcgcucgcaggauggcaauauugggcgacacagcaugggacuucggaaguauaggcggaguauucacaucaguaggaaaauuaguccaccagaucuuuggaaccgcauaugggguccucuuuagcgggguaagcuggaccaugaaaauaggaauagggguauugcuuaccuggcuaggacucaacuccagaagcaugucauuaucaaugacuuguaucgcgguagguuuggugacucuauaccuaggcguuaugguucaagcggacucuggauguguuaucaacuggaaggguagagagcuaaaauguggcagcggcauauuugucacgaacgagguccauacuuggaccgagcaauauaaauuccaagcugacucucccaaaagauuaagugcagcaauaggaaaggcgugggaagaggguguguguggcauuagaucagcuaccagauuagagaauauaauguggaaacaaauaucgaacgaacucaaucacauucuccuggagaaugauaugaaauuuaccguuguuguaggagauguagcugguauccuggcucaaggcaagaaaaugaucagaccucagccaauggaauacaaauacucauggaaaucuugggggaaagcuaaaauaauuggggcagacguacagaacacuacauuuaucauagauggaccuaauacgccagaaugcccagacgaccaacgagcauggaauauaugggaaguugaagacuauggauuuggaauauuuacaacgaauauauggcuuaaguuaagagauucguauacacaaguuugugaccaccgauuaaugucagcugcgauaaaagauucuaaagcugugcaugccgauaugggcuauuggaucgagucugaaaagaaugaaaccuggaaauuagcuagggccagcuuuauagaagugaaaacuuguauauggccuaaaucgcacacucuauggagcaauggcguauuagaaucagagaugaucauaccuaaaauauauggcgguccgauaucacaacauaauuauaggccagguuauuuuacgcagacugcaggaccguggcacuuagguaaacuagaacucgacuucgaccucugcgaaggaacgacgguaguaguugacgagcacuguggaaaccgggggccuuccuuaaggacuaccacuguaacaggaaaaauuauucacgagugguguuguagaagcuguaccuuaccaccacuacgauuuaaaggagaagaugguuguugguaugguauggaaauacgaccagucaaagaaaaggaagaaaaucuaguuaaaaguaugguuagcgcuggcucgggugaaguggauucauucagucugggauuauuaugcaucucgauaaugauagaagaaguuaugcguagccguuggucaaggaaaauguuaaugacggguacguuggcuguauucuucuugcucaucauggggcagcuuacuuggaacgaucuaauccgccuauguauuaugguaggcgcuaaugccuccgacagaaugggaaugggaacaacuuaccucgcauuaauggcuacuuucaagaugagaccaauguuugcuguggguuuacuuuuuaggcgauuaacgucccgagagguucuauuacucacaaucggacuaucauuaguagcuucaguagaacuucccaauucucuagaagaacucggagauggucuggcuaugggaauaaugauauuaaaauuguuaacugacuuccaaagucaucaacugugggcaacucuguugucccuuaccuuuauuaagacaaccuuuagccuucauuaugcauggaaaacaauggccaugguacuaaguaucgucagucuauucccucuuugccuuucuacgaccucgcaaaagacgacuuggcuaccaguauuauuaggaagccucggaugcaagccacugacaauguuucucauugcagagaacaaaauuuggggucgaaaaucuuggccauugaacgaaggaauaauggcagugggaaucguaucgauucuauuaucuucucugcucaaaaaugauguaccccuagcaggcccgcucauugcuggcgguauguuaauagcuuguuaugugaucucaggaucuucagcugaccuaucucuagagaaggcagcagaaguaucaugggaagaagaagcagaacacaguggugcuagccacaauauauuagucgaaguacaagacgacggaacaaugaaaauaaaggacgaagaacgggacgauacuuugacaauucuacuaaaagcuacauugcuugcagucaguggaguauauccacugaguauccccgcaacccucuucgugugguacuuuuggcagaagaagaaacaaaggucugggguuuuaugggauacccccucuccuccagaagucgaacgugcuguuuuagaugaugguauuuaccgaauaaugcaacgcggauuauuaggucgcucacaaguaggaguugguguauuccaagaaaacgucuuccacacaauguggcaugucacucgaggugcagugcuuauguaccaaggaaaaagacuagagccuaguugggcguccguuaagaaagaucuaaucucuuauggcgguggauggcguuuacaaggaucauggaauacaggugaagaaguucaaguaauugcaguugaaccugggaagaaucccaaaaauguccaaaccgcgccugguacauucaaaacaucugaaggagaaguaggagcgauagccuuagacuuuaaaccagguacaagcggaucaccuaucguaaacagggaggguaagauuguaggacuauaugggaauggaguuguaaccacaagcggaacuuauguuagugcaauagcgcaagcaaaagcaucucaagaagguccauuaccugagauagaagacgaaguuuuuagaaaaagaaacuuaacuaucauggacuugcauccaggaagcgggaagacccggcgguaucuacccgcaauuguacgcgaggcaauaaaaagaaaauuacgaacuuuaauacuugcaccaacucgaguuguugccagcgagauggcggaagcacugaaaggaaugccaaucagauaucagaccacagccguaaaaucugagcacacagguaaagaaauuguagaccuaaugugucaugcaacauucacaaugcggcuacuuagucccguacgugugccaaacuauaauaugauaauaauggaugaggcacauuucacugauccgucuucaauugcagcuagaggauauauaaguacgcgugugggaaugggcgaagcugcugcaaucuuuaugacagcaacuccgcccggauccgucgaagcguuuccucagaguaaugcaguaauccaggaugaggagagagauauuccggaaaggucuuggaauaguggcuacgaauggauaacugacuucccagggaagacaguuugguucguaccaucuaucaaaucagggaaugacauagcuaacuguuuaaggaaaaacgggaaacgcguaauucaauuaucgcgaaaaacguuugacacggaguaucagaaaaccaaaaauaaugacugggacuacguagucacaacagacauaagugaaaugggugcaaauuuuagagcugauaggguaauugacccaaggagaugcuuaaaacccgugauauuaaaggacggcccugaacgcgugauauuagcaggaccgaugccuguaacuguagccagugcugcacaacguagagggaggauuggucggaaccauaacaaagaaggagaucaauacauauacaugggucaaccguuaaauaacgacgaagaucacgcucacuggacugaggcaaaaauguuauuagauaauauuaauacccccgaaggaaucaucccugcacuauuugaaccggaacgagaaaaaucugcagcgauugauggagaauaucgguuacggggagaggcaagaaagacauuuguagaacuaaugcgaagaggagauuugccaguuuggcuauccuauaaaguugcuagugaaggauuucaauauuccgaccgcagaugguguuuugauggagaaaggaauaaccaaguacuagaagaaaacauggauguagaaauauggacuaaagaaggcgaacguaagaaguuacgacccagauggcucgacgcacgaacuuauuccgacccuuuagcgcugcgugaauuuaaagaauuugcugccgggagacgcagugucucuggagacuugauacucgaaaucggcaaauugccacaacaucuaacccaaagggcacaaaaugcauuagauaacuuagucauguuacacaauucggaacagggaggacgggcauaucgccacgcaauggaagaauuaccagauacaaucgaaacguugaugcuucuugcacuaauagcaguuuuaacuggggguguaacgcuuuucuuuuugucuggucguggauuagggaaaacgucgauaggcuuauugugugucauggccaguucugugcuacucuggauggccagcguagaaccccacuggaucgccgcaaguauaauacuugaguucuuucuaaugguacuauugauaccugaaccugauaggcagcgaacuccccaagacaaucaguuagccuacguaguaauagguuuauuguuuaugauuuuaaccguagcagccaacgaaaugggcuuacuagaaacaacaaagaaagaccuuggcauaggucacguagcaguugaaaaucaucaucacgcagcaauguuggacguugaccuucauccggcuucagccuggacacuauaugccguagccaccacaaucauaacucccaugaugcgccacacgauagaaaacacaacggcuaauauuucacucacggccauugcuaaucaagcggcgauuuuaaugggauuagacaaaggcuggcccauaucaaaaauggauauaggcguuccacuauuagcucucggcugcuacagucaagugaaucccuuaaccuuaacggccgcuguacugauguugguugcacacuaugcaauuauuggcccuggccuacaggcgaaagccaccagggaagcucaaaaacgaacagcugccggaauaaugaagaaucccacaguugauggaauugucgcaauagacuuagauccaguaguauacgacgcgaaauucgaaaaacaguugggucaaauuaugcuacuaauauugugcacgucacaaaucuuguugaugcgaaccaccugggcccuaugcgaaagcauuacacuugccacagggccauuaaccacuuuaugggaagguagcccaggaaaauuuuggaauacuaccauugcugucagcauggcuaauaucuucagagggucuuacuuagccggagcggggcuugcuuuuucacugaugaagucauuaggaggagguagaagggguacaggcgcucaaggugaaacacugggggaaaaguggaagaggcaacuaaaucaacugucuaaaagugaguucaauaccuacaaaagaucaggaaucauggaaguagaccggucugaagcaaaagaaggucucaagaggggagaaacaaccaaacacgcuguaucucguggaacugcaaaacuuaggugguuuguagaaagaaaucugguaaaaccagaaggcaagguuauagauuuaggcugugggagaggggguuggucauauuacugugcuggacuaaagaaaguuacggagguuaaaggauacacaaaaggugguccaggccacgaagaaccaauacccauggcaacguauggauggaacuuagugaaacuacauagcgguaaagauguauucuuuaucccaccagaaaaaugcgacacacuucuuugcgacauaggagagucgagcccgaauccuacgauugaagaaggacgcacccuaagaguacuuaaaaugguagaaccauggcuccgaggcaaucaauuuugcauaaagauucugaauccauacaugccaaguguuguugaaacccucgaacagaugcaaagaaaacauggcggaauguuagugaggaauccucucucuagaaacaguacucaugaaauguauuggguaucauguggcaccggaaacauaguaucagcaguuaacaugacaucacguaugcuguuaaauagguuuacgauggcacaucguaaaccaacauacgaacgugauguagaccugggugcaggaacaagacauguggcuguugaaccugaaguugcaaauuuagauaucauaggucaaagaauugaaaacauaaaacaugagcacaaaucgacauggcauuaugacgaagacaauccuuauaaaacaugggcauaucauggauccuaugaaguuaagccguccggcucggcaucaucaauggucaauggaguugugaagcuccucacuaaaccuugggauguaauaccaaugguaacgcagauagccaugacggacaccacuccauuugggcaacaaagaguauuuaaagaaaagguugauacgagaacuccaaaggcuaagagaggaacugcucaaauaauggaagucacugcuaaauggcuauggggauuccuaucaagaaauaagaaaccaagaaucuguacaagggaagaguucacaagaaaggugagaaguaacgcagcaauaggagcgguuuucguugacgagaaucaauggaacucggcaaaggaggcuguagaagaugagcguuucugggacuuaguacacagggaaagggaauuacacaaacaagggaaaugugccacgugcguuuauaauaugauggggaaaagagagaagaaauuaggagaguucgguaaagcaaaaggaaguagggcaauuugguacauguggcuuggugcaagauuuuuggaguucgaggcuuuaggguuuaugaacgaagaccauugguuuagucgggaaaauucacuaucaggcguggaaggugaaggauuacauaaacuaggauacauauugcgcgacauaucaaaaauaccagguggaaacauguacgcagacgacacugccggcugggauacccgaauaacagaggacgaucuacaaaacgaagcuaaaauaacugauauuauggagccggaacaugcuuuacuggcuaaaagcauuuuuaaguuaacauaccaaaauaaaguuguuagaguccagcgcccggucaaaaaugguacuguaauggacguaauaucuagacgagaccaacgcggaucuggacagguaggaaccuauggcuuaaauacuuuuacgaacauggaggcccaauugauaagacaaauggaauccgagggaaucuuuagcccauccgaauuagaaacuccuaaucuugcagguagaguccuagacuggcuggaaaaacacgguguagagcguuugaagcguauggcaauuucgggagacgacugcguuguaaagccuauugacgacagauuugcaacagcccucacagcuuugaaugacauggguaaaguaaggaaagacaucccacaaugggaaccaaguaaaggcuggaaugauuggcaacaagugccuuucugcucucaccacuuccaucaacuaauaaugaaagacgguagagagauaguggugccauguagaaaccaagaugagcuuguugguagggcuagaguaagccagggagcaggauggucacuaagagaaacagcuuguuugggaaagucguaugcucagauguggcagcucauguauuuucaucgaagggauuuacgacuagcugcuaaugcuauaugcagugcuguccccguggacuggguaccuacaucuagaacaacuuggucgauccacgcccaucaucaauggaugacaaccgaagauauguugagcguauggaaucggguuuggauagaagaaaauccauggauggaagauaaaacacauauuaguuccuggggagacgugccauaucuugguaaaagagaagaucaauggugcgguucguugauugggcucacagcaagggcgacuugggcaacuaauauucaaguugccaucaaccaagugaggagauuaauaggaaaugaaaauuaccuagacuauaugaccucaaugaaacguuuuaagaacgagucggaucccgaaggugcuuugugguag

SEQ ID NO: 21184 - RNA, 9879 nt, Artificial Sequence
  derived and/or modified CDS sequence (opt6) from DENV-1__FJ639675__SS-prME
agcguuaccaugcuccuuaugcucaugccuacagcuuuagcguuucaccuuaccacgaggggaggcgaaccacacaugauuguuaguaaacaagaaagagguaaaucacucuuauuuaaaacaagcgcagggguuaauaugugcacguuaaucgcuauggaucucggagaauuuugugaagauacgaugacuuacaaauguccacguauaacagaagcagaaccugacgacguugacuguuggugcaacgcaacagauacaugggugacauacgguacauguagucaaacaggagaacauagacgagauaaaagaucaguugcacuggcaccacacguuggacuuggcuuagaaacuagaacagaaacauggaugaguagugaaggagcguggaaacagauucaaaggguggaaacaugggcacuuagacaccccggauucacagucauugcacuuuuucuugcucaugcuaucgguacaucaauaacacaaaaaggcauaauuuuuauccuguuaauguugguaacuccgucuauggcaaugagaugugucggcauuggcucucgugacuucguagaaggcuuaucgggagcaacguggguugauguggucuuggaacacgguucauguguaacaacaauggcuaaagauaaaccaacuuuagauauagaacuauugaaaacagaaguaaccaauccagcaguucuaaggaaauuauguauugaggccaaaauauccaauacaaccacagauagucgauguccgacgcaaggugaggcgacucuuguagaggaacaagaugcuaacuuuguauguagacguacauuuguugauaggggauggggcaauggaugcggacuuuucggcaaaggaucucugaucacaugcgcaaaauucaaauguguaacaaaauuagagggaaaaauaguacaauacgaaaaccuuaaauauaguguuauugugacuguucauacaggggaucaacaucaaguaggaaaugaaaguacugaacaugggacaacugcuacaaucacgccacaagcccccaguaccgagauccaacugaccgacuacggagcucuaacacuagauugcagcccaagaacaggguuagauuuuaacgagaugguacuauuaacaaugaaagagaaaucuuggcuaguccauaaacaaugguuuuuagaucucccacuacccuggacuucaggagcaucuacuucccaagaaacauggaacaggcaagaucuauuaguaaccuucaaaacugcgcacgccaagaaacaggaaguuguaguuuuaggaucucaagaaggagccaugcauaccgcacuaacuggugccacugaaauacaaacuucugggaccaccacaauauucgcaggacauuuaaaaugucgacugaaaauggacaaacuuacucuuaaaggcaugucguauguuaugugcacgggauuauucaaacuagaaaaagaaguagcggagacucaacaugguaccguauuaguacagaucaaauacgaggguacggaugcgccgugcaaaauaccguucucgacucaggaugaaaaagguguaacacaaaaugggcgguuaauaacugcaaauccgauaguaacggauaaagagaaaccuguaaauauagaagcugaacccccauucggagaaaguuauauaguaauuggagccggugaaaaagcguuaaaauuaucaugguuuaagaaaggaucaaguauaggcaaaauguucgaagcuacugcgagaggggcacgacgaauggcaauacuaggugauacggcuugggacuucgguucuauaggcgggguuuucaccuccguaggaaaacugguacaucaaauauucggaacugccuacgguguccuuuucagcgguguaucguggacgaugaaaauaggaaucggagugcuacucacaugguuaggacucaauagcaggaguacuucucuaucaaugacauguaucgcuguaggcuuaguaacgcuauacuuaggggugaugguccaagcggauucgggauguguaaucaauuggaaaggcagagagcuaaaaugcggaucuggaauuuuugucacaaacgaagugcauacauggaccgaacaauacaaguuccaagccgauaguccuaaacgacuaucuucugcuauaggcaaggcuugggaagaagguguauguggaauccguagugcgacucgacuugaaaauaucauguggaaacaaauuaguaacgaauugaaucauauucuuuuagaaaaugacaugaaauucaccgugguaguaggugacguugcaggaauccucgcacagggcaagaaaaugauaagaccccaacccauggaauauaaguauuccuggaaaucuuggggaaaggcaaaaauaauaggagcagauguccaaaacacaacuuuuauuauagauggaccuaauaccccugaguguccugaugaucagagagcguggaauauuugggaaguagaagauuacgguuuugguauauucacaaccaacauuugguuaaaguuacgcgacagcuauacccaagucugugaccauaggcuaaugucugcagcgaucaaagacucaaaagcuguacacgccgacauggguuacuggauagaaagugagaaaaacgaaaccuggaagcuagcacgugcuaguuuuauugagguuaaaacaugcauuuggccaaagucacauacacucuggaguaacggagucuuagaguccgaaaugaucauacccaagaucuauggugggccuauuucucagcauaauuaccgaccagguuauuucacucaaacagcaggaccguggcaccuaggaaaauuagagcucgacuuugacuugugcgaagguaccacagugguggucgacgaacauugugguaacaggggcccaucacucagaacuacaacgguuacaggaaaaauaauacaugaauggugcugucgaaguuguacauugccaccacuucgauuuaagggugaagaugguugcugguauggaauggaaauaaggccaguaaaagaaaaagaagaaaaucucguaaaguccauggucuccgcagggucaggggaagucgauucauucucacuuggacuauuaugcaucucgauaaugaucgaagaaguuaugcggucaagauggaguaggaagauguugaugacagggacacucgcaguauuuuucuugcugauuaugggacagcuaacuuggaaugauuugauacgauuauguauaauggugggggcuaacgcauccgauaggaugggaaugggaaugacguaucucgcguuaauggcuaccuucaaaaugcgacccauguuugcgguaggcuuacucuuucgaagguugaccucucgggaaguauugcuacuaaccauaggauuaucucuugucgccaguguggaauuacccaauagucuggaagaacucggugauggauuagcaaugggaauaaugauacuuaagcuauugaccgauuuccagagccaccaacuuugggcgacucuucuaucuuuaacuuucauaaaaacgacguuuucacuucauuacgcauggaaaaccauggcaauggugcuaucgauaguaucauuguuuccguuauguuugucuacgacaucacagaaaacuacauggcuaccugucuuacuaggaucauuaggaugcaagccguuaacaauguucuugauugccgaaaacaaaauauggggucgaaaaucuuggccacuaaaugaaggaauaauggcaguaggcaucgucaguauuuuauuaucaucacuucuuaaaaaugacguaccuuuggcugggccguuaauugccgguggaauguugauagcauguuacguuauaagcgguaguuccgcagacuuaucgcuugagaaggcagcugaaguaucgugggaagaggaagcggagcacucuggcgcuucacauaauaucuuaguugaggugcaagaugauggaaccaugaagauaaaggacgaagaacgggaugacacgcuuacuauacuguugaaagcuacacuacuagcgguaucugggguuuauccacuaaguaucccagcaacguuauucgugugguacuucuggcagaagaagaaacaacggucugguguucuaugggauacuccuucaccaccagaaguagagcgugccguauuagaugaugguauuuauagaauaaugcaacguggguuauuaggaaggagucaaguaggagucggcgucuuccaagaaaacgucuuccauaccauguggcacgucacuagaggggccguccugauguaucaaggaaagcgucuugaaccgaguugggccucugugaagaaagaucuaaucaguuacggaggaggauggagguugcaagguucauggaauacaggagaagaaguacaaguuaucgcaguagaaccggggaaaaauccuaaaaauguacaaacagcucccggcacauuuaaaacauccgaaggagaaguaggggccauugcuuuggacuucaaaccaggcaccagcgggaguccaauagucaaccgagaaggaaaaauagucggucuuuaugggaauggaguagucaccacaagugguacuuaugucucugcgauagcucaggcgaaagcuagucaagaaggaccacuaccagaaauugaggacgaaguguuucgaaaacgaaacuugacaauuauggauuuacauccagguucaggcaagaccagaagauauuuacccgcaauagucagagaggcgauuaaacguaaacuuaggacgcuuauccuggcgccaaccagaguuguagccucggaaauggcagaagcacuaaaagguaugccaaucagguaucagaccaccgcgguuaaaagugaacauacagguaaagaaaucguagauuuaaugugucaugcaaccuucacuaugcggcuauugucucccguaagagugccgaacuacaauaugauuaucauggaugaagcucauuuuacugacccaucaaguauagcggcuagaggauacauaaguacccgcguagggaugggcgaggcagcugccaucuuuaugacagcuaccccaccagggagcguagaagcauuuccucaaagcaacgcagucauacaggaugaggagcgagacaucccagaaaggagcuggaacaguggguaugaguggauaaccgacuuuccaggaaagacaguaugguucguaccuucgauaaaauccggaaaugacauagccaauugucucaggaaaaacggaaaacggguaauccaguuaucgcgaaagacguucgauaccgaauaucagaaaacuaaaaauaacgacugggauuaugugguaacaacagacauuagugagaugggcgccaacuuuagagcagauagaguaauagaccccagaagaugccuuaagcccguuauuuuaaaagacggaccggaaagagugauauuagcggguccaaugccaguaaccguugcauccgcagcacaacgucgaggcagaauaggacguaaccauaauaaggaaggcgaccaauauauauacauggggcaaccgcugaauaaugacgaagaucacgcacauuggacugaagcgaagauguuguuagauaauauaaacaccccagaaggaauaauaccagcucuuuucgagccggaaagagaaaaaucagccgcaaucgauggagaguaccgacuaagaggggaagcaagaaaaacauuuguagaauuaaugcgaagaggagaccugccuguuuggcucucuuauaaaguagcuucagaagguuuccaauauagugauagaagaugguguuucgacggugaaagaaauaaccaaguguuagaagaaaauauggacguagagauuuggacaaaggaaggagaacggaagaaauuaagaccgcggugguuagacgcacggacuuauagugauccauuagcccuacgggaauuuaaagaauuugcagcaggaaggagauccgucucaggggaucuuauccucgaaauuggaaaacuuccacaacaccugacucagcgugcgcagaacgcguuggacaaccuaguaaugcugcacaacuccgagcaagggggacgagcauaucgacacgcaauggaagaauugccugauacuauagaaacucugaugcuuuuagcgcuuauagccguguuaacagggggagugacacuauucuuucugucuggaagaggacuuggcaaaacuucuauaggacuacuaugugugauggcaucaucuguauugcucuggauggcgucugucgaaccccauuggauugcugcuucaaucauacuagaguuuuuccugaugguauugcucauaccagagcccgacaggcaaagaacuccucaagauaaccaauuagccuacgucguaaucgguuugcucuuuaugauuuuaacaguggccgccaacgagaugggacuacuagagacaacuaagaaagacuuaggcauaggacauguugcaguugaaaaucaucaccaugcggcaauguuagauguagaucuacauccagcgagugcauggacccuguaugcuguggccacgacaauaauaacgcccaugaugagacauacaaucgagaacacgacagcaaauauuagucuaacagcgauagcaaaccaagcagcaauccuaaugggguuagauaaaggguggccaauuuccaagauggauauaggcguaccucuacuagccuugggcuguuauagucaggugaauccucucacuuuaacggccgcaguccugauguugguagcucacuaugcaauaaucggaccaggacuucaagcuaaagcaacaagagaggcucaaaagaggacagcggcgggcauaaugaaaaauccuacaguagaugggauaguugccauugaucucgacccuguuguauacgaugcgaaauuugaaaaacaacuuggccagauaaugcuucucauacuaugcaccagucaaauauugcugaugcgaacuacuugggcauuaugugagucgauaacuuuagcgaccgggcccuuaacaacgcucugggaagguucaccgggaaaauuuuggaacacaacaauugcaguaucaauggcaaacaucuuuagggguaguuauuuagcaggagcggggcucgcauuuaguuuaaugaagucacuaggaggaggucgcagggguaccggagcgcaaggagaaacacuaggagagaaauggaaaaggcaguuaaaccaauugagcaaaucagaauuuaauacuuacaaaaggucggguauuauggaagucgacagauccgaggccaaggagggucuuaagagaggcgagacaaccaaacacgcgguaagcagaggcacagcgaaguugcgcugguuuguggaaagaaaucuaguaaagccagaggguaaaguuauagauuugggauguggaagaggaggcuggucguacuacugcgcaggacuuaaaaagguuacagaagugaagggauauacuaaaggagguccuggacaugaggaaccaauaccaauggccaccuacggauggaacuuaguaaaguuacacaguggcaaagacguauucuuuaucccaccagaaaaaugcgauacguuacugugugauauuggugaaaguaguccaaacccuacaauagaagagggucggacacuaagaguacuaaaaaugguagaaccuugguugcggggaaaucaguuuuguauaaaaauucuuaauccguacaugccaucuguuguugaaacgcuugaacaaaugcagagaaagcaugggggcauguuaguuaggaauccauuaucaagaaauucaacucacgagauguacugggugaguugcgguaccgguaacauaguuuccgccgucaacaugaccucucgaauguuauugaaccgauuuaccauggcacauaggaaaccaacuuacgaaagagacguggaucuuggugcuggaacaaggcauguagcagucgaacccgagguagcuaaccuagacauuauaggucagcgcauugaaaauauaaaacacgaacacaaaaguacauggcauuacgaugaagacaauccguauaagacaugggccuaucacgggucuuacgaaguaaaaccaucaggaucugcaucuuccaugguaaacgguguggucaaacucuuaaccaaaccuugggacgucauuccaaugguaacgcaaauagccaugacagauacaaccccuuuuggccaacaacgaguguucaaggaaaaaguagauacgagaacaccaaaagcaaagcgggguacugcacaaauaauggaaguuacggccaaguggcuuugggguuuccuuagucgaaauaagaaacccaggauuugcacaagagaggaguucacuagaaaaguaagaucaaaugccgcaauaggggcaguauucguugaugaaaaucaauggaacagugcgaaagaagcuguagaggaugaacgauucugggaccucguacaucgagagcgugaacuacauaagcaggguaaaugcgcgacaugcguauacaacaugauggguaaaagagagaagaaacuaggugaguucgguaaggcuaaagggaguagagcaaucugguacaugugguuaggcgcacgcuuuuuggaguucgaggcauuaggcuuuaugaaugaagaucauugguuuucgagagaaaauagcuuauccggaguagaaggcgagggccuccauaaacuagguuauauauuacgugacauuuccaaaauuccuggagggaauauguaugcugaugauaccgccggaugggacacacgaaucacagaagaugaccuucaaaacgaagccaagauaacugacauaauggaaccugaacaugcucuguuagcgaaaucaaucuuuaaacucacauaucaaaauaaaguuguccgagugcaacggccagccaagaacggcaccguuauggaugugauuagcaggcgagaccaacggggaaguggccagguaggaacuuauggauuaaacaccuuuacaaauauggaagcccaacuaauaagacaaauggagagugagggcauauucagcccgagugagcucgaaacuccgaauuuagcagaaagaguucuugauugguuagaaaaacauggcguagagagguuaaaaagaauggcaauauccggagacgauuguguaguaaaaccuauagaugacagauuugcuacagcguuaacagcauuaaaugauaugggaaagguuagaaaagauauuccccaaugggaaccuaguaaaggauggaaugacuggcaacaagugccauuuugcagucaccauuuucaccaguuaauuaugaaggacggaagggaaauaguggugccauguagaaaccaggacgagcuaguaggacgcgcaagggugucccaaggagcuggauggagcuuaagagaaacagcuugucucggcaaaaguuacgcacaaauguggcagcucauguauuuccaucgucgcgacuuaagacuagcagcaaaugcgauauguucagcggugccgguugauugggucccaacaagucgaacuacauggaguauucaugcgcaccaccaauggaugacaacagaagauaugcugucaguauggaaucguguuuggaucgaagaaaacccguggauggaagauaaaacccacauuagcaguuggggagacguaccauaucuaggcaaaagagaagaccaaugguguggaucuuuaaucgguuugacugcacgggcuacuugggcuacaaauauacaagucgcuaucaaccaaguuagaagauugauuggaaacgagaacuauuuagauuauaugacgaguaugaaaagauuuaagaacgaaagcgacccggaaggggcauuaugguaa

SEQ ID NO: 21185 - RNA, 9879 nt, Artificial Sequence
  derived and/or modified CDS sequence (opt6) from DENV-1__FJ639676__SS-prME
agcgugacuaugcuucuuauguuaaugccaacggcacuugcauuucaccuaacuacccgggguggggaaccucacaugauaguguccaaacaagaaaggggaaaaaguuuacuuuucaaaaccucggccgggguuaauaugugcacacuaauugcaauggaccuuggugaacucugugaggacacgaugacauacaaauguccacgcaucacagaaguggaaccugacgauguagauuguuggugcaauacuacagauaccugggugacauauggaacuuguucacaaacgggagaacauagaagagacaaaagguccguagcauuggcuccacacgcaggacuaggacuagaaaccagagcugaaacuuggaugucaagugaaggugcuuggaaacaaauucaacgaguagaaacaugggcacuaagacaucccggguucacagugauugcgcuguuuuuggcucacguuauugggaccagcauaacccaaaaaggaauuauauuuauucuccuaaugcuugugacuccuucuauggcuaugagauguguuggaauagggucucgagacuuuguagaaggguugaguggagcaacuuggguugauguuguucuagaacauggaucauguguaacgacaauggcuaaagauaaaccaacuuuagauauagaguuauuaaaaaccgaagucacuaacccagcaguacuacguaaacuaugcauugaagcuaaaauuucuaacacaaccacggacagucgcugcccuacucaaggugaagcaacuuugguggaagaacaagaugcgaacuuugucuguaggcguacauuuguggauagagguuggggaaauggaugcggacuauucgggaaaggaucccuaauaacuugugccaaauuuaaaugcgucacgaaacuagaaggaaaaauuguacaauacgaaaaccuaaaauacucgguuaucguaacaguucauacgggugaucaacaccaagucgguaacgagucuacagagcauggaacgacagccaccaucacaccccaggcaccaacaagugaaauucaacucacagauuacggagcccugacauuagacugcucaccaaggacaggacuugauuucaacgaaaugguacuacuuacuaugaaggaaaagagcuggcuuguucacaagcaaugguuuuuagauuuaccauuaccuuggacaucgggcgccaguacgagucaagagacuuggaacagacaagauuuauugguaacguuuaaaacagcacaugcgaagaaacaagagguaguaguauuggggagucaagagggcgcaaugcauaccgcucucacuggggcaacugagauucagacaucuggaaccacuacgauauucgcgggccaccugaaauguaggcugaaaauggauaagcugacgcuuaagggaaugaguuaugugauguguacuggaaguuuuaagcuagagaaagaggucgcagaaacucaacauggaacgguauuaguucaaaucaaauacgagggaacugacgccccuuguaagauuccuuucucaacucaggacgaaaaagggguuacucaaaaugguagauugaucacagcuaauccuauaguaaccgauaaagaaaaacccguuaacauagaggcagaaccaccauucggugaaaguuauauagugauuggagcuggagaaaaagcgcucaaacuguccugguucaagaaagggaguucuauugggaaaauguuugaagcaacagcucguggugcccguagaauggccauacuuggagauacggcaugggauuucggguccaucgguggaguguucaccaguguagguaaguuaguacaucaaaucuucggaacagccuauggaguacucuucucuggagugaguuggaccaugaagauagguaucggaguucuauuaaccugguuaggacuuaauucacgaucgacuucauuaaguaugacauguauugccguaggccuaguuacauuauacuuaggaguaauggugcaagcugauaguggguguguuauaaauuggaaaggucgugaacuaaaaugcgguucaggaaucuucgugacgaacgaaguucacaccuggacagagcaauauaaauuucaagcugacucuccaaaaagauuaucugcugcaauugggaaggcuugggaagaaggaguaugcgggauacgauccgcaacccgguuagaaaacauuauguggagacaaaucaguaacgaacucaaucauauacuauuggagaaugacaugaaguucacgguaguuguaggagauguuguagguauucuagcacaaggcaagaaaaugauuagaccccaaccaauggaacacaaauacagcuggaaauccugggggaaagcgaaaauaauaggcgcugauguccaaaacacgacauucauuauugacggacccaacacaccagaguguccagaugaccaaagagcauggaauauaugggaaguugaggauuacggauucgggauauucacuacgaauauauggcugaaauuaagagacaguuacacccaggucugcgaccaucgcuuaaugagugcugccauaaaagauucuaaagcgguccaugcagauauggguuauuggauugagagcgagaaaaaugaaacuuggaaacuggcaagagcgucuuucauagagguuaaaacuuguauuuggccaaagagccacacacuauggagcaacggaguacuagagucugaaaugaucauccccaagaucuacggugggccaauaagucaacauaacuaccgaccuggauauuuuacacagacagcggguccguggcaccucggaaaacuagaauuagacuuugacuuaugcgagggaacuacaguagucgucgacgagcauugcggcaaccgugggccaucuuugagaacaacaacgguuaccggaaaaaucauccaugaaugguguugcagaaguugcacacuaccacccuugcgauucaaaggugaagauggcuguugguacggaauggagauaagaccaguaaaagagaaggaggaaaaucucgugaaaucaaugguaagcgcaggauccggcgaagucgauucauuuagucuaggauuacucugcaucagcauaaugauagaggagguaaugcgcucaagauggucucggaaaaugcuuaugaccgggacucuagcgguguucuuccucuuaauaguaggacaguuaacguggaaugacuuaauccgauuaugcauaaugguaggcgcaaacgcgagugaccgaauggggauggguacaacauacuuagcucuaauggcaacuuuuaagaugagaccaauguucgcggugggauuauuguuccguagauuaaccucacgcgaaguccuuuuauuaacaaucgguuuauccuuggucgcuucaguugaauugcccaauucccuagaagaacucggagauggucuagcaauggguaucaugauucuaaaguuacuaacggacuuucaauccuaucaguuaugggcaacucucuuaucacugacuuuuauaaaaaccacguucucauuacauuaugcauggaagacgauggccaugguuuuaucuauugugucguuguuaccacuuugucuaucuacuacgagucagaaaacuacauggcuaccagucuuauugggaucucucggauguaaacccuuaacaauguucuuuauugcggaaaauaaaaucugggggaggaaaucguggcccuuaaacgaaggaauaauggcaguaggaauuguuucgauccuacugaguucccuauugaaaaacgauguaccacuugcuggcccccuuauagcaggaggcauguuaauagcuugcuacgucauaaguggaucuucagcugaccuaucauuagaaaaagcagcagagguuuccugggaagaagaagcagaacacagcggagcaagccauaauauacugguugaggugcaggaugauggcacaaugaaaaucaaggacgaagaacgcgaugacacauugacaauccugcugaaagcaacguuacuggcggucagcggcgucuacccucuuuccauuccugcaacauuguuugucugguauuucuggcagaagaagaaacaacgcagcgguguacuaugggauacgccaaguccgccugaagucgagagagcuguacuagaugacgguaucuaccgaaucaugcaacggggauuguugggacguucccaagucggaguugggguauuccaagagaacguguuccauacaauguggcacguaacaagaggugcuguuuugauguaucaaggcaaaagacuagagccaucuugggccucuguaaagaaagaccuaaucagcuaugggggagguuggagauugcaagguaguuggaauacaggagaagaaguucaggugauagcagucgaaccagggaaaaaucccaaaaauguacaaacagccccaggaaccuucaaaacgccugaaggagaaguaggggcaauagcuuuagauuuuaaaccgggaacgagcgguagcccgauuguuaaucgagagggaaaaauugucggcuuauaugguaauggagugguuacuacaucaggcacguacguaucagcuauagcacaggcaaaagccagucaagaaggaccauuaccugaaauugaagaugaagucuuucguaagcguaauuuaacaauaauggauuuacacccaggauccgggaagacacgcagauaccuaccugccaucguaagggaggcgauuaaacgcaagcuacgcacucuuauccuugcuccuacccgaguuguggccagugagauggcugaagcccugaaaggaaugccaaucagauaccaaaccacggcugugaagucagaacauaccggaagggaaauuguggaccugaugugccacgcuacauuuacgaugcgacuacuaucgccagugagaguuccgaauuacaauaugauaauaauggacgaagcacauuuuacugacccaucauccauagccgcucgaggcuauaucagcacacgagucggcaugggagaagcggcagccauuuuuaugacugcuacacccccaggcagcguugaagcauuuccucaaucuaacgcggucauacaggaugaagaacgagacauuccugaacgcagcuggaacucugguuaugaauggauaacagauuuuccagguaagacaguaugguuugucccaaguauaaaaucugggaaugacaucgcgaauugcuuacgaaagaauggcaaacguguaauucaacuaagcaggaaaacauuugauacugaguaccagaaaaccaagaauaacgacugggauuauguaguaacuacugauauaucagaaaugggugcuaacuuccgugcugacagagugauagauccuagaaggugucucaagccagugauucucaaagaugguccagaaagaguuauacucgcagggccaaugccaguaacagucgcaagcgcugcccagcgacguggcagaauagggagaaaccacaacaaagaaggagaucaauacauauauaugggacagccacuaaauaaugaugaggaccacgcacauuggaccgaggcuaaaauguuacuagauaauaucaacacaccugaagggauuauaccugcccuguuugaaccagaacgcgaaaaauccgccgcaauagacggagaguacagauuacgaggugaagcccgaaaaacauucgucgaguuaaugagaagaggugaucucccuguuuggcuauccuauaaaguagcgucagaaggcuuucaauacagugaucgcagaugguguuuugauggcgagcggaacaaucaaguauuggaagaaaauauggacguggaaaucuggacgaaggaaggagaaaggaagaaacuacguccucguugguuagaugcaagaaccuauucugacccucuugccuuacgugaguucaaagaauuugcagccggacguagaagcauaaguggagauuuaauacuggaaauagguaaacuaccacagcaucuaacacagcgcgcgcagaaugcacuagauaacuuaguaaugcuucacaauucagaacagggagggagagcauauagacacgcaauggaagaacuaccugacacaauagaaacacuaaugcuguuagcccucauagcaguauuaacaggaggcguaacccucuucuuuuuguccgggcgaggauuggguaaaacaaguauaggccuacuauguguuauggcgucuucagcccuauuauggauggcuagcguggagccgcauuggauugcugcgucgauuauacuugaauuuuucuuaaugguccuauuaauaccagaacccgaccgacaaagaacuccgcaggacaaucagcucgcauaugugguaaucggauuauuauuuaugauucucacuguggcggcaaaugaaaugggauuauuagaaaccacaaagaaagaccucgguauaggacauguagccguagaaaaccaucaucaugcaacuaugcuugacguagacuugcacccagcaagcgcguggacguuauacgcaguugcaacaacaauaauaacgccuaugaugcgacacacaaucgaaaacacaacugcaaauauuucuuuaacagccauugcaaaccaggcugcaaucuuaaugggacucgacaaaggcuggccaauaaguaaaauggauauugguguaccguuauuagcuuuaggguguuacagccaaguaaauccacuaacccuaacagcugcaguccugauguugguagcacacuacgcaauaauagggccaggauuacaagcuaaagcgaccagagaagcucagaaaagaacugccgcuggaauaaugaaaaacccaacaguagauggaauaguugcgauagauuuggauccugugguguacgaugcaaaauucgaaaaacaacuugggcaaaucaugcucuuaauuuuauguacuucccaaaucuugcuaaugagaaccaccugggccuuaugcgaaagcaucacucuugcaacggggccacuaacuacguuaugggaagggaguccaggaaaguucuggaacacuacaauugcugugaguauggcaaacauuuuccgaggaaguuaucucgcgggagcgggucuagcguuuucacucaugaaaucacuagggggaggaagaagagguacuggcgcacaaggagaaacucuaggcgaaaaauggaaacgacagcugaaccaacucuccaaaucagaauuuaacacauacaagagaucuggcauauuagagguugaucgaagugaggcaaaagaaggccuaaggcgaggagaaacgacgaaacaugcaguaucaagaggaacggcuaagcuaaggugguuuguagaaagaaaccuaguaaaaccagaaggaaaaguuauagaucuaggauguggucgagggggcuggucuuacuauugugcuggucuuaaaaaggugacagaagucaagggauauaccaaaggugggcccgggcaugaagaaccaauaccuauggcaaccuauggguggaaccucgugaaacuacauaguggaaaagauguguuuuucauacccccugaaaaaugugacacucuacugugcgauauaggagaguccucuccgaauccaaccauugaagaaggaagaacacuacguguuuuaaagaugguugagccuugguuacgcggaaaucaauuuuguauuaaaauauuaaauccuuauaugccuagugugguugaaacacucgagcagaugcaaagaaaacacggaggaaugcuaguuagaaauccguugucaaggaauagcacccaugagauguauuggguuucaugcgguacuggaaacauagucucagcagucaauaugacaaguagaaugcucuugaacagauucaccauggcgcaucgaaaaccaacauacgaacgagacguagacuuaggagccggcaccagacacguagccguagaaccagaaguagcaaacuuagacauaauaggacagcgcauugaaaacauaaaacacgaacacaaaucgacauggcacuaugaugaagauaauccuuauaagacaugggccuaucacgguagcuaugagguuaagccaaguggaucagcaucaaguaugguuaaugguguaguaaaacuacugacaaaaccgugggauguaauaccgaugguuacccagaucgcaaugacggacacgaccccauucggccagcagagaguuuucaaagaaaaaguugacaccagaacaccaaaagcaaaaagggggaccgcacaaaucauggaaguaacagcuagguggcuauggggcuuuuuaaguagaaacaagaaaccgagaauauguacgagagaagaauuuaccagaaaaguacgaaguaaugccgcaauaggugcgguauucguggaugaaaaucaauggaacuccgcaaaagaagcgguagaggaugaacgguuuugggaccuaguacaccgugaaagggaguuacacaaacaggggaagugcgcgacauguguuuauaacaugaugggaaagcgggagaagaaacucggagaauuuggaaaagcaaaaggauccagagcaauaugguauaugugguuaggagccagauuucuugaguuugaagcucuuggauucaugaaugaagaccacugguucagcagagaaaacagcuuaagcggaguggaaggagaaggcuuacauaaauuaggcuacauacuccgagauauuaguaaaauacccgguggaaacauguacgcagacgacacugccgguugggacacacgaauaacagaagacgaccuucagaaugaagcaaaaauuacggacaucauggaacccgaacaugcacuucuggcgacuagcauauuuaaauuaacguaucaaaacaaagugguaaggguccaaaggccagcuaaaaauggcacaguaauggauguaaucaguaggcgcgaucaacggggaaguggucaaguaggcacauacggccucaauaccuuuacuaacauggaggcccaacugauaagacaaauggagucagagggaauauuuuccccuagugaauuagaaaccccaaaccuagccgaaagaguguuagacugguuagaaaaauacggaguugaacgauugaagcggauggcgauauccggugaugacuguguaguaaaaccgaucgaugacagauuugcaacagcgcuaacugcacucaacgacauggggaaaguuagaaaagacauaccgcaaugggaaccuaguaaaggauggaaugauuggcagcagguaccauucuguagucaucacuuccaucaguugauaaugaaagacgggagagaaauugucguaccuugccggaaucaagaugagcuaguagggcgugcacgugucucacagggugcagguuggagccugagggaaacugcuugucuaggcaaaucauacgcgcaaauguggcaauuaauguacuuucauaggcgagaccuacgauuagcagccaaugcuaucuguagcgccgugccaguugauugggugcccaccucacguacaaccuggagcauacaugcacaucaucaauggaugacuacggaagauauguuaucaguauggaaucgaguauggauagaggagaaucccuggauggaagauaagacucacaucagcucgugggaggacgucccuuaucuaggcaaaagagaggaucaaugguguggcagcuugauaggccuaacagcucgugcgacuugggcgaccaacauucaaguugcaaucaaccagguacguagacuaauaggaaaugagaauuaucuagauuucaugacuuccaugaagagauuuaagaaugaaucugauacugaaggagccuuaugguaa

SEQ ID NO: 21186 - RNA, 9879 nt, Artificial Sequence
  derived and/or modified CDS sequence (opt6) from DENV-1__FJ639677__SS-prME
uccgucacuaugcugcuaaugcuaaugccuacggcuuuagcuuuucaccugaccacuagagggggagaaccucacaugauuguuucaaaacaagaacgcgguaaauccuugcuguucaaaaccucggcaggaguuaauauguguacccucaucgcuauggacuuaggugaacuaugcgaagauaccaugacuuauaaaugcccucgggucacugaagcugaaccagacgauguagacuguugguguaaugcgacugacacguggguuacuuaugguacauguucucaaaccggggagcacagaagagauaaaaggaguguugcgcuagcaccacauguagguuuagguuuggaaacuagaacugaaacguggaugucaucagaaggagcuuggaaacaaauacaacgagucgaaacgugggcacuucgccacccuggguuuacugugauagcauuauucuuagcccaugcuauaggaacuagcauaacccaaaaaggaauuauauucauauugcuaauguuagucaccccgaguauggcuaugcgaugugucgggauaggaucccgagacuuuguagaaggacuaucaggagcaacauggguugauguggucuuagaacaugguuccugcguuacuacaauggccaaagauaaaccgacccuagacauagaacuccuaaaaaccgagguaacuaaucccgcaguacuuaggaaacuuugcaucgaagccaaaauaucaaauaccacuacugauagccgaugcccaacacaaggagaagcuacguuaguggaagaacaagaugcuaacuuuguguguagaaggacguucguugacagaggcugggggaauggaugcggauuauuuggaaaaggaaguuugauuacaugcgcuaaguucaaaugugucacuaaauuagaaggcaaaauagugcaauaugaaaauuuaaaauauucagucauaguaacuguccacacaggcgaccaacaucaaguaggaaaugaaucuacagaacacggaacaacagcuacaauaacuccacaagcgccaacaaccgagauccaacugacagacuauggagcccuuaccuuagauugcuccccacguacaggauuagacuuuaaugaaaugguacucuuaacaaugaaagaaaaaucaugguugguucauaagcaaugguuucuggacuugccguuaccauggacaaguggagcgucaacuucucaagaaaccuggaaucgacaagaccuuuuggucaccuuuaaaacggcacaugcuaaaaagcaagaaguggucguacuuggaagucaagagggugcgaugcacacagcgcuaacaggugcgacugagauucaaacuagcgggacaacaaccauuuucgcuggacauuuaaaaugcaggcuaaaaauggauaaacuuacucuuaaaggcaugucuuaugucauguguacaggaucauucaagcucgaaaaggaaguagcagaaacucaacacggcaccguacuuguucaaauaaaauaugagggcacagaugcaccauguaaaauaccuuucucaacucaagaugagaaagguguuacgcaaaaugguagacuaauaaccgcaaauccaaucgugacugacaaggaaaaaccuguaaacauagaagcagagccaccauuuggugagaguuauauuguaaucggggcgggggaaaaagcauugaaauugagcugguuuaagaaagguagcucaauugguaaaauguuugaggcaacggccagaggggcccggagaauggcgauacuuggcgacacugcaugggacuuugggucaaucggcggaguauuuacaaguguuggcaaguugguacaucaaauauucggaacugcguacgguguauuauuuucaggcgucaguuggacuaugaaaauugguauugguguauuacucacauggcuaggucugaacucaagaaguacaagccuuuccaugaccuguauagcagucggacugguaacucuauaccugggaguuaugguccaagcugauucaggauguguaaucaacuggaaagguagagaacuaaaauguggcucgggaauauuuguaacaaaugagguacauacuuggacagaacaauacaaguuccaagcagauagcccaaaacgccucagugcugcuauaggcaaagcaugggaagaagguguuugcgguauaagaucggcgacuagacuagaaaacauaauguggaagcaaauaaguaaugaauuaaaccauauccuucucgaaaaugauaugaaacuaacuguaguagucggagacguggcaggaaucuuggcccaaggcaaaaagaugauaagaccacaaccgauggaauacaaauauaguuggaaaucauggggaaaggccaagauaaucggugcugaugcacaaaauacgacauuuauuauagauggccccaauacgccagagugcccagacgaucaacgagcuuggaauaucugggaaguugaagauuauggcuucggaauuuucacgacuaauauaugguugaagcuacgugacucuuauacucagguaugugaucauagacuuaugucugccgccauaaaagacaguaaagcgguacaugcagacaugggcuauuggauagaaagugagaaaaaugagacguggaaacuagcgagagccagcuucaucgaaguuaaaaccugcauuuggccaaagucucacacccuuuggucaaacggaguacuggaaucagaaaugauaauacccaaaauuuaugguggacccauuucgcaacacaacuaucguccaggguauuuuacucagacggcaggaccauggcaucugggaaaacucgaacuagacuucgaccuaugugaagguacuacgguugugguugaugaacauugcggaaacagaggucccagcuuacguacaacaaccgucacaggaaaaauuauacaugagugguguugccguuccugcacccuuccgccuuuaagauuuagaggcgaggacggauguugguacggaauggaaauaaggcccguaaaggaaaaagaagagaaccuagugaaaucuauggucagcgccgggaguggcgaagucgauaguuucucucugggccugcucuguauaaguauuaugauagaagaagucaugagauccagauggucaagaaaaaugcugaugaccggaaccuuagcaguguucuucuuacuaaucaugggacaauuaacauggaaugaccucauucgacugugcauuaugguuggcgcgaacgcaucagaccgaaugggaaugggaacgacuuaccucgcucuaauggcaacguucaaaaugagacccauguuugccauggggcuucuuuuccgacgccuuacuucuagagaaguucuccugcuuaccauaggguugagucuggucgcauccguagagcuaccaaauagucucgaagaauugggagacggguuagcuaugggcauuaugauuuugaaauuauuaaccgauuuccagucacaucaauuaugggcuacccucuuaucgcugacguucauaaagaccacauuuagucuccauuaugcguggaagacaauggcuaugguacuaucaauuguaucgcuuuuuccccuaugccuaucaacuacaagucagaaaacgacauggcuacccguacucuuggguucacuaggauguaagccacuaaccauguuucugauagcagaaaauaaaauaugggguaggaagucuuggccauuaaacgagggaauuauggcagugggaaucguaagcauucuguuauccucucuucugaaaaacgauguuccuuuggcagggccacuaauagcaggaggaaugcuuauagcaugcuacguaauaagcggaucaucagcagaccuuucauuggagaaagcggcugaaguaucuugggaggaagaagcagaacauucaggugccagccacaauauacugguggaaguacaggacgauggaaccaugaagauaaaagaugaagaacgcgaugacacacuaacgauauuauugaaagcuacacuacuugcagugaguggaguauauccacuaucuauuccggccacacuuuuuguaugguauuucuggcagaagaagaaacagcggagcggcguacucugggauacuccgucaccaccggaaguggaacgugcugugcuagaugaugggaucuaucgaauaaugcagagagguuuacuaggucgaucacaaguugguguggguguguuccaggaaaacguguuucacacuauguggcauguuacuagaggggcuguacuaauguaucaagguaaaagauuagaaccaaguugggcuuccguaaagaaggaucuuauaaguuacggcggcggcuggcgacuuaaaggcucauggaauacaggggaagaaguucaaguaauugcaguagaaccaggcaaaaauccuaaaaacguccaaacugcaccuggaacauuuaaaacaccggagggagaaguuggagccaucgcgcucgauuucaaaccagguacuucagguagcccuauagucaaccgagaagguaaaauaguuggccuauacgguaauggugugguuaccacaagugguacauacguuucagcgauugcacaggcuaaagcaucccaggaaggaccuuugccggaaauagaggaugagguauuuagaaaaagaaacuuaacgauaauggaccuacauccuggaucuggaaaaacacgcagauacuuaccagcuauagugagggaagcgauuaagagaaaacuuaggacauuaauacuggcaccaacucgaguaguugccucagagauggcugaagcauugaaaggaaugcccauaagguaucaaaccacugccguuaaaucugagcacaccggaaaagagauuguggaucuaaugugccacgcuacuuuuacaaugcguuuacuaagcccuguacgaguaccgaacuacaacaugauuauaauggaugaagcccauuuuacagacccgucaucuauagcugccaggggguauauaaguaccagaguagguaugggugaagcggccgcaauuuuuaugacugcuacaccaccuggcucggucgaagcauuuccccaaagcaacgcaguaauacaagaugaggaaagagacauaccugagcgaucuuggaacuccggauaugaauggauuaccgacuuuccaggaaagacaguaugguuuguuccuagcauuaaaaguggaaacgacauagcaaacuguuugcggaaaaaugguaaacgagucauacaacuuucuaggaaaacguuugacacugaauaucagaaaaccaagaauaacgacugggauuaugucguuacaacugacauuagcgaaaugggagcaaacuuuagggcagaucgaguaauugacccgaggcgauguuugaaaccugucauucuuaaagauggcccugagagggucauucuugcagggcccaugccugucacaguggccagugcugcacaaagacguggucguauuggccggaaucacaauaaagaaggugaucaauacauauauaugggacaaccguuaaacaaugaugaagaucacgcucauuggacagaagcuaaaaugcuauuagacaauaucaacacaccugagggcauaauuccagcuuuauuugaaccggagcgagagaaaagcgcggcaauagauggagaauacagacuacgcggagaagcgcggaaaacuuucguagaauuaaugcgccgaggugaucuacccguuuggcuuucauacaaagucgcuagugagggguuccaauacagcgaucgaagauggugcuuugauggagaaagaaacaaccaaguacucgaagaaaacauggacguugaaauuuggacaaaagaaggugaaaggaagaaauuacgaccacguugguuagacgcgagaacuuacucagauccacucgcucuaagagaauuuaaagaguucgcugcgggucggagaagugugucuggugacuugauauuagagauuggcaaauugccacaacaucuaacccagagagcccaaaaugcuuuggacaaccuuguuaugcuccauaacuccgaacagggagggagagccuaccgacaugccauggaggaacuaccagacacuauugagacguuaauguugcuagcgcucaucgcaguauuaacuggcggugugacacuauuuuuccuaaguggacgaggacuuggcaaaacauccauuggcuuacuauguguaauggcuaguuccgugcuguuguggauggcaucaguggaaccccauuggaucgcagccagcauuauucuagaguuuuuccuaaugguauuacucaucccugaaccggaucggcagagaacaccccaagacaaucaauuggcuuauguaguuaucggacuauuguuuaugauauuaacaguggcggcaaaugagaugggccuauuagaaaccacuaaaaaggaucuagguauuggacacguagcuguggaaaaucaccaucacgccgcuauguuagacgucgaucuucauccugcuucagcuuggacucucuaugcuguggccaccacaauuauuacuccgaugaugagacauacuauagaaaauacuacggcaaauauaucgcucacagcaauagccaaucaggccgcuauuuuaauggguuuggacaagggcuggcccauaagcaagauggacauaggaguaccauuacuggcuuuggggugcuacucucagguuaacccacuaacauugacagcugccguucuaauguuaguggcacacuacgcaauuauaggaccuggacugcaggccaaagcgacacgcgaggcucagaagagaacugcagcuggaauaaugaaaaauccaacaguugauggaaucguggcaauagauuuagauccagugguuuaugaugcaaaauucgaaaaacaacuaggacaaauaauguuguuaauauuaugcacaagucagauucucuuaaugaggacaacaugggcccugugcgaaucuauaacucuugcaacaggaccauuaacaaccuuaugggagggaucaccugguaaauuuuggaacacgacuauugcagucagcauggcuaauauauuuaggggaucuuaccuugcuggggcgggauuagcauucagccuaaugaaaagccuagggggugguagacgcggcacgggggcgcaaggagaaacauuaggagaaaaauggaagcgucaacuaaaucaauugucgaagagugaguucaauacauauaaaaggucagguauuauggaaguagauagaucagaagcaaaagaaggauuaaaacggggcgaaacgaccaaacacgcagugagucgaggaacggcaaaauuacgaugguucgucgaaagaaaucuugucaaaccagaagguaaaguaauagaucuggguugcggacgaggaggguggaguuacuauugugcaggacuaaagaaaguaacagaagucaagggauacacuaaggguggaccgggacaugaagaaccuauuccgauggcaaccuauggauggaaucuaguaaaauuacacucuggaaaggauguuuucuuuauuccaccagaaaagugugacacccuauugugcgacauaggagaaaguagucccaauccaacgaucgaagaagggcgaacacuucguguauugaaaaugguagaaccgugguuacgugguaaucaauuuugcauaaagauacucaauccguauaugccaucgguaguggaaacgcuggaacaaaugcagcguaaacauggagggaugcuaguaaggaauccauuaucccguaacucaacucacgaaauguacugggugucuugcggaacagggaacauaguguccgcagucaauaugacuagcaggaugcuacugaaccgauuuacaauggcccacagaaagccuacguaugagcgagauguagaucucggcacuggaacaagacaugucgcaguagaaccugaaguugcuaaucucgauaucauuggucaaaggauagaaaauauaaaacaugaacauaaaucaacauggcauuaugaugaagacaacccguauaaaacaugggcuuaucauggaagcuacgaggugaaaccaucgggaagugcuuccucuaugguuaauggagucguaaagcuguuaacuaagccuugggauguaauuccaaugguaacacaaauugcgaugacagauacgacuccguucggucaacaacgaguguuuaaggagaaaguagauacacgaacucccaaagccaaacgcggaacagcucaaauaauggaaguuacugcucgauggcuaugggguuuccuaagcagguccaagaaaccucguauuugcaccagagaagaauuuauacguaaggugcggucaaacgcagccaucggagcaguauucguggaugaaaaucaauggaauagugcaaaagaagcgguagaggaugaacguuucugggaccuagugcaccgugagcgagaacuucauaagcagggaaaaugcgcgacauguguguacaauaugaugggaaaacgggagaagaaacuaggugaguuugguaaagcaaaaggaucuagagccauaugguauauguggcuuggagccagauuuuuagaauuugaagcauuagguuuuaugaaugaagaucauugguuuaguagagaaaacucuuuaaguggaguugagggagaggggcuucauaaacucggcuacauacuaagagauauaucaaaaauuccgggcggcaacauguacgcagaugauaccgccggcugggauacucggauaaccgaggaugaccuacaaaaugaagcaaaaauuacagauauaauggaaccugaacacgcuuugcuagcuaaagcaaucuuuaaacuaacauaucaaaacaaaguaguucgcguucaaaggccagcgaagaacggaacaguaauggacguaauaaguaggcgagaccagagaggaucgggacaaguagguacuuauggauugaacacauucacgaacauggaagcucaacuuauaagacaaauggaaagugagggcauauuuucgccgucugagcuagaaacaccgaaucuagcugaacgcgcacuagauugguuagaaaaauauggaguugagcguuuaaaacguauggcuaucucuggagaugacugcguagucaagccaauugaugacagguucgcaacggcccuuacggcucuaaacgacaugggaaaaguuagaaaagauauuccccaaugggaaccuucaaaaggauggaaugauuggcaacaagucccauuuuguagucaucauuuucaccaacugauaaugaaggacgggcgugaaauuguagucccuuguagaaaucaagaugaguugguagggagggcaagaguaucacagggagccgguuggucauuaagagagacagcuugccuugguaagucguaugcccaaauguggcagcuaauguacuuucaccggcgcgaccucaggcuagccgcuaaugcaauaugcagugcaguaccuguagacugggucccuacaaguaggacuacguggaguauucaugcccaccaccaauggaugacgacugaagauauguuauccguuuggaauagggucuggaucgaagaaaauccauggauggaagacaaaacacacaucagcaguugggaggacguaccauaucuuggaaaaagagaggaccaguggugcgggucucuuauuggguuaacugccagggcaacuugggcaacaaacauacaagucgcaauaaaccagguaaggcgauuaauugguaacgaaaauuaucuggacuauaugaccucgaugaaacgguucaaaaaugagagcgauccagagggcgcauugugguaa

SEQ ID NO: 21187 - RNA, 9879 nt, Artificial Sequence
  derived and/or modified CDS sequence (opt6) from DENV-1__GQ868618__SS-prME
agugucacaaugcuuuuaaugcugaugcccacugcauuagcuuuucauuuaaccacgcgaggaggggaaccacauaugauugucucaaaacaagaacguggaaaaucucuccucuuuaaaacuucagcaggaguaaauaugugcacuuuaaucgcaauggaccuuggcgaguucugcgaagauacgaugacuuacaaaugccccagaauaacggaagcggagccagacgacguugauuguugguguaaugcuaccgauaccugggucacauacgggacauguucccaaacaggugaacauagaagagauaaacgaucuguagcacuagcaccucacguggguuuaggacuugagacucgaacagaaacuuggaugucaagcgaaggagcguggaaacaaauacaacgcguugaaacuugggcacuuagacacccgggauucacgguaauagcucucuuucuagcucacgccauuggaacaucuaucacccaaaaagguauuaucuucauccuuuuaaugcucgugacaccgaguauggcgaugagguguguaggcauaggcucuagagauuucguugaaggauuaagcggagcuacuuggguugacguugucuuagagcaugguucaugugugaccacaauggcaaaagauaagccaacucucgauauagagcuccugaaaacggaagugacaaauccugccguacuucgaaaauuauguauugaagcaaaaauuuccaauacaacaacagacagcagauguccuacacagggagaagccacauuaguugaagaacaagacgcgaauuuuguaugucgccgcaccuuuguagauaggggguggggaaaugguuguggguuauucgggaaagguagccugauuacaugugcuaaauuuaaaugcguaacaaaacucgaagguaaaauaguucaauaugaaaacuugaaauauuccguaauuguaacgguccauacuggagaucagcaccaaguaggcaacgagaguacagaacauggcacaacugccaccauuacuccccaagcaccuaguacugaaauacaauugacagacuauggagcucuuacucucgauuguucaccaagaacaggacucgauuuuaacgagaugguacuacuuacuaugaaagaaaagagcugguuaguucauaaacagugguucuuggaucucccccugcccuggacaucaggcgccucaacuagccaagagaccuggaaccgucaggauuuacugguaaccuuuaagacggcacaugccaagaaacaagaaguagucguucuuggcucccaggaaggagcaaugcauacagcccuaacuggggcaaccgagauucaaaccucuggaacaacaacaauuuuugcaggccaccuaaaauguaggcuaaaaauggauaaacuuacguuaaaaggaaugagcuaugucauguguaccggaaguuucaaacucgaaaaggaaguugcugaaacgcaacauggaacaguauuaguccaaaucaaauacgaaggaacagacgcaccaugcaaaauaccauuuaguacacaagaugaaaaaggggucacccagaacggcagauugauaacagcgaacccaauagugacggauaaagaaaaaccagugaauauagaagccgaaccaccguuuggagaaagcuacaucgugauaggugccggagaaaaagcauugaaauuaaguugguuuaaaaagggaucaucaaucgguaaaauguucgaagcuacagccagaggugcgagacgcauggcuauccucggagacacagcaugggauuuuggauccaucgguggaguauuuacgucaguaggaaaacuuguacaucaaauauucgggacagcauacggaguauuauuuagugguguaucauggaccaugaagauagguauuggaguauuguuaacguggcuaggacuuaauagucguucuacuagcuuaaguaugacauguauugccgugggucuaguuacauuauaucuagggguuaugguccaagcagacucugggugcguaauuaauuggaaaggcagagaacugaaaugcgguagcgguauauucgucaccaaugaaguacauacauggacugaacaauauaaguuucaagcagacuccccaaaaagacucagugcggcgauaggaaaggcaugggaagagggagucuguggaauaaggucggcuacuagauuagaaaacauaauguggaaacaaauaaguaaugaguugaaucacauccucuuagagaaugacaugaaauuuacagugguggucggagacguugcagguauuuuagcccaagguaagaaaaugauaaggccacaaccaauggaauacaaguacucuuggaaaagcuggggaaaggcgaaaaucauaggagccgauguacaaaacacuacauucauaauagaugguccaaauacucccgaauguccugaugaucagcgugccuggaacauuugggaaguggaagacuacggauucgguauauucacuacgaauauaugguuaaaauuaagggauuccuauacgcaaguuugcgaccauagacuaaugucugcggcuaucaaagauagcaaagcaguacaugcggauauggguuauuggauagaaucugagaaaaaugaaacauggaaauuagcacgagcgagcuuuauugaggugaaaacuuguauuuggccgaaaucacacacguuguggaguaaugggguauuggaaucagagaugaucauacccaaaauauacggaggcccgaucucacagcauaauuauagaccuggcuacuuuacccaaacggcagguccguggcauuuagggaagcuagaacuagacuuugaucucugcgaagggacgacggugguaguagaugaacauuguggcaacagaggacccucguuaagaacaacgacagucacuggaaaaauaauucaugaauggugcugcagaaguuguacauuaccgccgcuaagauucaagggagaagacggguguugguacgggauggaaauccggccugucaaagagaaagaggagaacuuaguuaagagcaugguaucagcuggaagcggagaaguagauaguuuuaguuugggccuacucugcauaagcaucaugauagaagaagugaugcggucgagauggucucgcaaaauguugaugacagggacauuagcaguauucuuucuacuaaucaugggacagcuaacauggaaugauuugauacgccuuuguaucaugguaggagcgaaugcaucugauagaaugggaaugggaacgacuuauuuggcccuaauggccacauuuaaaaugcguccaauguucgcuguaggacuacuuuuucgcaggcuaacgucgagggaaguacucuuguuaaccauaggacuaucauuaguggcuucgguagaacuaccaaacagucucgaagaacugggggacgggcucgcaauggguauaaugauuuuaaaauuacuuacggauuuucaaagccaucaacuuugggcaacauuacuaaguuuaacauucaucaaaacuacuuuuucacugcacuacgccuggaaaacuauggcuaugguauuguccaucguaucacuauucccacuuugcuuaaguacaacaagccagaaaacaacaugguuaccaguguuacugggauccuuaggauguaaaccauugacgauguuccucauugcugaaaauaaaauuuggggaagaaagucauggccucuaaaugagggaauaauggcaguuggcauaguaagcauucugcugaguaguuuacucaaaaaugauguuccucuagcgggcccauuaauagcaggaggaaugcuaauagcguguuaugucauaaguggaaguuccgcagauuugucgcucgaaaaagcagcagaaguaagcugggaagaggaagcagaacauucaggugcaagucacaauauucugguggaaguacaggaugacggaaccaugaaaauaaaagaugaagaaagagaugauacucugacaauuuugcuaaaggcgacacucuuagcugugagugggguuuacccucuauccauccccgcgacacuuuuugugugguacuuuuggcagaagaaaaagcaacguucaggcguuuuaugggacacaccaucaccaccugagguagaacgagcgguucuugacgacgggauauaucgaauuaugcaaagaggacuucucgggaggagucaaguaggugucggaguguuucaagaaaaugucuuucacacaauguggcacguaacuagaggagcgguucucauguaccaagggaaacggcuagaaccaaguugggccagcgucaagaaagauuugauaucauaugguggagguuggcggcuacaaggaagcuggaacacaggagaggagguacaaguuaucgcuguagaacccggcaaaaauccgaagaaugugcaaacagcuccuggcacguucaaaacaucagaaggggagguaggcgcuauugcgcuugacuucaaaccagggacuucagggucccccaucguaaaucgugaagguaagauagugggucuauacggcaacggagugguuaccacaucggguacauauguauccgcaaucgcacaagcuaaggccucacaagaagguccacugccugaaauagaagacgaaguauuuagaaagcgaaaccuaacuauaauggaccuacauccugguagcggcaaaacucggagauaucuaccugcaauaguacgggaagcgauaaaaaggaaauuacguacacuaauacucgcaccuacucgagucguagcuucagaaauggccgaagccuugaaagguaugccgauucguuaucaaacuacagcaguaaaaagcgaacauacugggaaagaaaucguugauuuaaugugucacgcaacguuuacuaugagauuauuaaguccuguuagagugccaaacuauaauaugaucauuauggacgaagcacauuuuacggaucccuccucuauagcagcaaggggauauauuagcacacggguugguaugggcgaagcagcggcuauuuuuaugacagcuacgccuccaggcucgguagaagcauuuccucagaguaaugcuguaauccaggacgaggagcgagacauuccagagagaucauggaacaguggauaugaguggaucaccgacuuccccggaaaaacaguuugguuuguaccuucgauuaaauccggaaaugacauugcaaacugucuacguaaaaacggcaaaagaguaauucaacuaucuagaaaaacguucgauacggaauaucagaaaacuaagaacaaugauugggauuacguaguaacaacggauaucucagagaugggagccaauuuuagggcggauaggguaauagauccuaggagaugcuuaaagcccguuauacugaaagacggucccgaacgcguuauacuggcaggacccaugcccguaacaguugcaucggcagcucagagacguggucgaaucggaagaaaucacaauaaagagggcgaucaauacaucuauaugggacaaccguuaaacaacgacgaagaucacgcccacuggacagaagccaaaauguugcucgauaauauaaacacgcccgaagguauaauuccagcacucuuugaacccgaaagggagaaaucugcagcaauagauggagaauaccgccuacggggcgaagccaggaaaacauucguagaauuaaugaggcgaggagacuugccgguuuggcugaguuacaaaguugcuucagaaggauuccaguauucggauagacggugguguuuugauggagaaagaaauaaccaagugcuagaagaaaauauggacgucgaaauuuggaccaaagaaggcgaacgaaagaaacugcguccuagaugguuagaugcucguacauauagugaucccuuagccuuacgagaauuuaaagaauuugcagcagguaggcguucgguaucaggagaucugauauuggaaauaggcaaacuaccucaacauuuaacgcaaagagcacaaaacgcguuagauaaucuaguuaugcuacacaauucagaacaagggggcagagcguacagacaugccauggaagaacuuccggauacgauagaaacgcuuaugcuucuagcacuaauugcagugcugacagggggcgucacucucuucuuucuauccggucguggacuuggcaaaacuucaauaggucuacugugcguaauggcuuccaguguucuacuauggauggcaucaguagaaccacauuggauugccgcaaguauaauuuuagaauuuuuccuaaugguucuguuaauaccugagccagacaggcaaaggacgccacaggauaaccaacuggccuauguagugaucggacuacuauuuaugauacugaccguugcugccaaugagauggguuuauuagaaacaacuaagaaagaucuagggaucggacacguggcagucgaaaaucaccaucaugcggcaauguuggauguugaccuacauccagcuucggccuggacgcuauacgccguugcaaccacuaucauuacaccuaugaugagacacacuaucgaaaacacaaccgccaacauuucacuaacggccauugcuaaucaggccgcuauccucaugggguuagacaaaggauggccaauaagcaaaauggauauaggaguaccccuacucgcguuagguugcuacagucaagugaauccucuaacauuaacagcagcaguauuaaugcuaguagcacacuacgccauaauagggccuggucuccaagcaaaagcgacaagagaagcacagaaaaggacagcagcuggcauaaugaagaacccuacaguagauggcauagucgccauugaucuagauccuguuguuuaugaugcaaaauuugaaaaacaacuuggucaaaucaugcuacuuauacuauguaccagccagauucugcuaaugagaacuacgugggcgcucugcgaaucaauuacacuagcaacaggaccccuaacuacguugugggagggaucaccuggaaaauuuuggaacacuacaauagcuguaaguauggcaaauauauuucguggaagcuauuuagccggagcagguuuggccuuuagcuuaaugaaaucguuaggugggggacgacgaggaaccggagcucagggagaaacgcuaggugaaaaauggaaaagacaacuaaaccaauuaaguaagagugaauuuaauacauacaaaaggucgggaauaauggaaguggaucggagugaagcuaaagagggucuaaaacgaggagagacaacgaaacaugcgguuaguagaggaacggcuaaguuacgcugguuugucgaacgaaaucuaguuaagcccgaagguaaggugauagaucuaggcugugggagaggcgguugguccuauuacugcgcaggguuaaagaagguuacagaaguaaagggcuauacuaaaggcgggcccggacacgaagaaccaaucccaauggcaacauaugguuggaauuuagucaaacuucacaguggaaaagauguauuuuucaucccaccagaaaagugcgacacuuuguuaugugauauuggagaaucaucaccuaauccuaccaucgaagaaggccgaacuuugagaguucuaaaaaugguggaaccaugguuacgagggaaucaauuuuguauaaaaauccucaacccuuauaugccgucuguaguugaaacccuagaacaaaugcaaaggaagcacgguggaaugcucgugagaaacccauugucucggaauagcacgcacgaaauguauugggugaguugcggaacagguaauauagugagugccguuaauaugacuucacguauguuauuaaaucguuucacaauggcgcaccgaaagcccacguacgaacgggacguagaucuuggcgcggguacucgacaugucgcggucgagccagaaguugccaaccucgauaucauuggccaacguauagaaaauauaaaacaugaacauaaaaguacauggcauuacgaugaagacaacccauacaaaacaugggcauaccauggcucuuacgagguuaagccuaguggcucagcuuccagcaugguaaauggaguuguuaaacuauuaacaaaaccaugggacguaaucccuaugguaacacaaauagcuaugacagauacuacaccuuuuggucagcaaaggguguuuaaagaaaagguggauacgcgaacgccaaaagcaaaaagaggaacagcacaaauuauggaggugacagcaaaauggcuuuggggguuuuuaaguagaaauaagaagccccguauauguacuagggaagaauuuacgcgaaagguacgcaguaaugcggcaauaggagccguguuuguagaugaaaaccaauggaacucagcuaaggaggcuguagaagaugaacguuuuugggacuuaguucauagagagagggaacuacauaaacaaggaaaaugugcgacaugcguguauaauaugaugggaaaacgcgagaagaaacuaggugaauuuggcaaagccaagggaaguagagccauaugguacaugugguugggggcccgauuuuuagaguucgaagcacuuggguuuaugaaugaagaucacugguucagucgcgaaaacucauuguccgguguagaaggugaagguuuacauaaauuaggcuauauuuugagggauauuaguaaaauaccagguggaaacauguaugcagaugacaccgcaggaugggacacuagaaucaccgaggaugaccuacaaaaugaagcgaaaauuacggacauaauggaacccgaacacgcccucuuagcaaagucaaucuucaaauuaacuuaucaaaacaaaguggucagaguacaaagaccggcaaagaauggcaccguuauggacguaauaagucggcgggaucaacgcgguucuggccaagucggcacauacgguuuaaauacauuuacgaauauggaagcgcaacuaauucgacaaauggaaagcgagggcauuuucucaccgucugaauuagaaacaccuaaccuagcggaaagagugcuagacuggcuagaaaaacauggaguggaacgauuaaagaggauggcaauaucgggagaugacuguguugugaagcccauugaugacagguuugcuacugcacuaaccgcacucaaugacaugggaaaaguccguaaagauauaccccaaugggaaccaaguaaggguuggaaugacuggcaacagguaccauucugcagucaucauuuucaccaguuaauuaugaaggacggccgugaaauuguuguaccaugucgaaaccaggaugaauuaguuggucgagcaaggguaucacaaggugcaggcuggagccuuagagaaacagcuuguuuagguaaguccuaugcacaaauguggcaguuaauguauuuccauagaagagaucuacgguuggcugcgaaugcuauaugcagugcuguaccuguagauuggguaccaacaucaagaaccacuuggagcauccaugcucaucaccaguggaugacgacagaagacauguuaucuguauggaauagaguguggaucgaggaaaauccauggauggaagauaaaacgcacauuucuagcuggggagaugucccauaucuagggaaaagagaagaucaguggugcggaucucuuauaggucucacggccagagcaacaugggccacaaauauucagguugcgauuaaucaaguaagacgauuaaucggaaaugaaaauuauuuagauuauaugaccagcaugaaaagguuuaaaaaugaaagcgacccagagggcgcgcugugguaa

SEQ ID NO: 21188 - RNA, 9879 nt, Artificial Sequence
  derived and/or modified CDS sequence (opt6) from DENV-1__GQ868619__SS-prME
ucugugacgauguuauuaaugcuuaugccaacagcgcuagcuuuucacuuaacaacacgaggaggggaaccacauaugauugugucuaaacaagaacgagggaaaucacuucucuucaaaacaagcgcaggaguaaacauguguacgcuaauugcaauggauuuaggugaauuaugugaagauacaaugaccuacaaauguccaaggauaacagaagcugagccugacgaugucgacugcuggugcaacgcgacugacacauggguuacauaugguacuugcucacaaacaggagagcacaggagagauaaacguucuguagcucuggcgccccauguuggacuaggauuggaaacacguacagaaacauggaugaguuccgagggagcuuggaaacaaauucaaaggguagaaacaugggcuuuaagacauccaggauuuacagucauagcgcuuuuccuagcacaugcgaucggaacaucaauaacacaaaaagggauaaucuucauauuauuaaugcuaguaacaccaaguauggcgaugcgauguguagggauagguaguagagacuucguugagggauuauccggcgcuacgugggucgauguagugcuugagcacgguucaugcguuacuacaauggcaaaagacaaacccacuuuagauaucgaacuacuaaaaaccgaagucacgaacccagcgguccuaagaaaacuaugcauugaagcaaaaauaucaaauacaacgacugacucuagauguccaacccagggggaagcaacccuuguugaagaacaagacgcaaauuucgucuguaggagaacuuuuguugacagaggauggggcaacggguguggguuauucgguaaagguucacuaauaacaugugcaaaauuuaaaugcguuacgaaacuagaaggaaaaauaguacaauaugagaacuugaaauacucaguuauaguaacaguacauacuggagaccaacaucaggugggaaaugagucaacugaacaugguaccacugccaccauuacaccacaagcaccgacuaccgaaauucaauuaaccgacuauggcgcuuuaacgcuugauugcaguccuagaacaggucuagacuuuaaugagaugguauuacuuacuaugaaagaaaaauccugguuaguacacaaacaaugguuuuuagauuuaccacugccauggacaucaggagcgucuaccagccaggagacauggaauagacaagaucuccucguuacauucaaaacugcgcaugccaagaaacaagagguaguugucuuagggucacaggaaggagcaaugcacacggcccuuacaggagcuacagaaauccaaacgagcggaacaacaacuauuuuugcuggacauuugaaaugucgauugaaaauggauaaacuuaccuugaaagguaugucuuacgugauguguacagguaguuuuaaauuagaaaaagaaguagcugaaacucaacauggcacgguccugguccagaucaaauaugaaggcaccgaugcgccauguaaaauuccauuuucuacacaggacgagaaaggcguaacccaaaauggcagauuaauuacagccaauccaauuguuacagauaaagaaaaaccaguaaacauugaagcugaaccaccauucggagaaagcuauauaguaauuggagcaggggagaaggcucucaaacuuaguugguucaagaaagggucaucaauagguaaaauguuugaagcaacagcaagaggagcacguaggauggcgauccuaggugauaccgcgugggauuuugguuccaucggggguguauuuacaagcgugggcaagcuaguacaucagauauucggcacugcuuauggaguacuuuucaguggagucaguuggacgaugaaaauuggaauugggguccuacuuacuuggcuaggguuaaauuccagauccacuucgcuaaguaugacuugcaucgcuguaggauuaguuacgcuauaccucggcguuauggugcaagcagauucaggcugcgugauaaauuggaagggucgagaacuaaaaugugggucaggaaucuuugugacuaacgaaguucacacuuggacagagcaauacaaauuccaagcugacucuccaaaacgucucagugcagcaauuggaaaggcuugggaagaaggcgugugugggauaagaucugcuacaaggcuggagaacauuauguggaagcagauuaguaacgaacuaaaucacauccuacuggaaaacgauaugaaauuaacagugguuguaggugauguagcagguauacuagcgcaaggcaagaaaaugauccggccgcagccuauggaauauaaauacuccuggaaaagcuggggcaaagcuaaaaucauuggagcagaugcacaaaacacaacauuuaucauagauggcccgaauacaccugaaugucccgaugaucaaagagcuuggaacauaugggaaguugaggauuauggauuugggauauucacaacuaacauaugguuaaaguugagagauaguuauacacaaguaugugaccauagauugaugagcgccgcaauaaaagauucaaaggcaguacacgcagauaugggauacuggauugaaagcgagaaaaaugagacauggaaacuagcucgagcaucauucauagaaguaaaaacuuguauuuggcccaaaagccauacucucuggaguaauggcguacuugaaagcgaaaugauaauuccgaagauauacggaggaccaauuucgcagcauaacuaccgcccaggguauuuuacgcaaacugcugguccuuggcaucuaggcaagcuggaguuagacuuugauuuaugugaggggacaacaguaguaguagaugaacacugcgggaacagggggcccucucugagaacuacaacggucacgggaaaaaucauucaugaauggugcugcagaucaugcacacugccuccauuacgcuuuaggggagaagacggaugcugguacggaauggaaauacgaccgguaaaggaaaaggaggagaaucuuguaaagagcaugguuucugcaggaaguggcgaagucgacaguuucucacugggucuauuguguaucagcauaaugaucgaggaaguuaugagaucucgauggucaagaaaaaugcuaaugacggggacauuagucguuuucuucuuguuaauaauggggcaauugaccuggaacgaucuuaucagguuaugcauuaugguaggagcaaacgccucagaucggaugggcauggggacaacuuauuuggcauuaauggccacauucaaaaugagaccaauguuugcaguaggcuuauuauuuagacgauugacgucacgggaaguacuucuuuuaaccauaggguugagucuaguagcuaguguagaguugccuaauagcuuggaagaacuuggagaugguuuagcuaugggaauaaugauuuuaaaauugcuuacagacuuucaaagucaccagcuuugggccacauuacuaucuuugacguuuauaaaaaccacuuucucuuuacacuaugccuggaaaacuauggcaaugguacuuucaaucgucagccucuuuccauuaugucucucgacuacuucucaaaagacuacaugguuaccagugcucuuagguagccucgguugcaaaccuuugaccauguuuuugauagcggagaacaagauauggggaagaaaaucauggccguuaaacgaaggaauuauggcagugggcauaguaagcauauuauuaucgaguuuauuaaagaaugacguaccuuuagcugguccuuuaauagcaggagguaugcuaauugcauguuauguuauaucuggaaguagugcagaccuuucucuggaaaaggccgcagaagucaguugggaagaagaggcggaacauagcggcgcaucucauaacauucuaguagagguacaagaugaugguacuaugaaaaucaaagaugaagagagagacgacacauugacaauauuauuaaaagcuacgcugcuagccgugucgggagucuacccauuaucaauacccgccacauuguucguaugguauuucuggcagaagaagaaacagagaagcggcguacuaugggacacaccuaguccaccagaaguggaaagagcuguacuagaugacggaauauaucgaaucaugcaacggggacuccuuggacgaucacaagucggcgugggaguauuucaagaaaauguauuccacaccauguggcacguaacccgaggagcaguccuuauguaucagggaaaaagacuagaaccuuccugggcaagcgugaagaaagauuuaauuaguuauggugggggcuggcgcuuacaaggcagcuggaauacgggagaggaaguacaggugauagcuguagagccaggcaaaaaucccaaaaauguacaaacagcaccgggaacauucaagacccccgagggagaagugggagcaauugcucuggauuuuaaaccaggaacgaguggaagcccuauagugaacagagaagguaagauaguuggcuuauaugguaauggaguuguuacgacuucggggacauacguauccgcaauagcacaagccaaagcaagucaggagggacccuugccagagauugaagaugaaguguuucgcaaaaggaaucuaacuauaauggauuuacauccaggaaguggaaagacgagacgauacuuaccagcuaucguuagggaagccaucaaacgaaaacuaagaacucuaauauuagcgccaacgcgagugguagcgagugagauggcagaagcauuaaaaggaaugccaauaagauaccaaacaacagcaguaaagucugagcacacgggcaaagagauaguagacuuaaugugucaugcuacauuuacaaugcgauuauuaucaccagugagaguaccaaauuacaacaugauaauuauggaugaagcacauuuuacggaccccucaucgaucgcggcaagaggguacaucaguacaagagucggaaugggagaagcggcagcuaucuuuaugacggcuacaccaccggggaguauggaggccuuuccucagucgaaugcugucauucaggaugaggaacgcgacauacccgaaagaaguuggaauaguggauaugaguggauaacugauuuucccggcaaaaccguaugguucguuccaucuauaaaaucaggcaacgauauugcaaauuguuuaaggaagaaugggaagcgaguaauacaacucucuaggaaaacauuugauacagaauaccagaaaaccaaaaauaacgauugggacuaugucguaaccacagacaucuccgaaaugggggcuaacuucagagcagauagaguaauagauccccgaagguguuugaaacccaucauacuaaaggauggacccgaaagaguaauauuagcagggcccaugccuguuaccguugcauccgcagcacagcgaaggggucguauugggcggaaucacaauaaagaaggcgaucaauauauuuauaugggccaaccuuuaaauaacgacgaagaucaugcacacuggaccgaagcaaagauguuauuggacaauaucaacacaccggaaggcauuauccccgccuuguuugaaccagaaagagaaaagucugcagcaauugacggugaauaucgccuacgaggagaggcucgaaaaacauuuguagaauuaaugaggaggggagaucuaccaguuuggcucagcuauaaaguagcgucggaaggauuucaauacucugauaggcgaugguguuuugacggcgaaagaaauaaccagguguuagaagaaaauauggacgucgaaauauggacuaaggaaggggaaagaaagaaauuacgaccccgaugguuagaugcacgaacguauucagauccccuagcccuaagggaguucaaagaguucgccgccgguagaagaucaguuucaggagaucuaauucuugaaauagguaaauuaccacagcauuugacgcagcgugcucagaacgcgcuagacaauuuaguuaugcugcauaacagcgaacaagguggucgugcauacagacacgcaauggaagaguuacccgauaccauagaaacccuaaugcuauuggccuuaauugcgguacugacaggagggguuaugcuauucuuucuaaguggacgaggacuugguaagacaucaauuggguugcuaugcguaauggcuucauccggccuccuguggauggcaucuguggaaccgcacuggaucgcggcaucuauaaucuuagaauuuuuccuaaugguauugcuaauaccagagccagauagacaaagaacuccucaagacaaccaguuagcauauguuguaaugggucugcuauucaugauacuuaccgucgcugcaaaugaaaugggacuacuggaaaccaccaagaaagauuuagggauuggacacguggcaguugaaaaccaucaccaugcggcaaugcuagaugucgacuuacauccugcuucggcguggacauuauacgccguugcaacaacgauuauaaccccuaugaugagacacacaauagaaaauacuacagcgaacaucucucuuacagcaauagcuaaccaagcugcaauccuaaugggcuuagauaaaggauggcccaucucaaaaauggauauaggaguaccuuuacuagcucuaggcuguuauucccaagucaaccccuuaacgcucacugcagcgguuuuaauguuggucgcgcauuacgccauaauugggccagguuuacaagcgaaggcgacaagggaagcucagaagcgaacugcggccgggauuaugaaaaaccccacaguagauggaauuguugcaauugauuuggaccccguaguuuaugacgcaaaauucgagaaacaauuaggacaaauuaugcuauuaaucuuguguacaagccaaauauuguuaaugcgcacuacaugggcacugugugaaagcauuacauuagcuaccggaccauugacaacccuaugggaaggaucuccuggcaaauuuuggaauacaacaauugcgguuagcauggcgaauauauucagaggaucauaucuugcuggagcugggcuagcuuuuucauuaaugaaaucguuaggcggaggacgaaggggaacuggcgcgcaaggugaaacuuuaggagaaaaauggaaaaggcaguuaaaccaacuaucuaaauccgaauuuaauacauauaaacgcucugguaucauggaaguugauagaucggaagccaaggaaggguugaaaaggggagagacaacgaagcaugcaguuucaagaggcacagcgaaauuaagaugguuuguagaacgaaaccucguuaagccugaggguaaaguuauugacuuaggauguggucgugguggauggaguuauuauugugcaggacuaaagaaaguaacugaaguaaaagguuauacaaaaggaggaccugggcaugaggaaccgauaccaauggccacuuauggcuggaaccugguuaaacugcauagugguaaagauguuuucuuuauacccccagaaaaaugugauacacugcucugugacauaggugaaucauccccaaacccuacuauagaggaagggcggacccuccgcguccuaaaaaugguagaaccauggcugcgagggaaccaauuuuguauuaagauucucaaccccuauaugccauccgugguggaaacccucgagcaaaugcaacgcaaacaugguggaauguuaguacguaacccauugucaaggaauagcacacaugaaauguauugggugucaugcgguacagggaacauaguuagugcugucaauaugacaucaagaauguuauugaauagauucacgauggcacaucggaaacccacauacgagcgagacgucgaucucggcacaggaaccagacauguagcaguggaacccgagguugcaaacuuagauaucauuggccaacggauagagaauauaaagcacgagcauaagucgacauggcauuacgacgaagauaauccauacaaaacaugggcauaucacgguuccuaugaagucaaaccuaguggaucagcaucaucaauggucaaugggguaguaaaacuacugaccaaaccaugggauguuauaccaaugguuacgcaaauagcaaugacagauacgacuccguuuggacagcaacguguuuucaaggaaaaggucgauacucgaaccccuaaagcgaagagaggaacagcacaaauuauggagguuacagcaagauggcuauggggguuucucucacgcaauaaaaagccucgaaucuguaccagggaagaguucacccguaaaguacgaaguaacgcagcaauaggcgcugucuucguagaugaaaaccaauggaacucggcaaaggaagcgguggaagacgaaagauuuugggaucugguucaccgggagcgggaauugcacaaacaaggcaagugcgcaaccugcgucuauaacaugaugggaaaacgcgagaagaaacugggcgaguucgguaaagcuaagggaucuagagcaauuugguacauguggcuaggugcacgcuucuuagaguuugaggcacuggguuuuaugaacgaagaccauugguuuucacgagaaaacucauuaagcggaguagagggagaaggacugcauaaguuagguuacauacuacgugauauaaguaaaaucccaggcgguaacauguacgcugaugacacagcagggugggacacaaggauuacagaagacgauuuacagaaugaagcaaagauaaccgauaucauggaaccagagcacgcacucuuggcuaaagcaauuuuuaaguuaacauaucaaaacaaaguaguaagagugcaacgcccugcuaagaacggaacaguaauggauguaauaucacguagggaccaaaggggaucaggucaaguggguaccuacggacuaaacacuuuuacaaauauggaagcgcaacuuauaagacaaauggaaucggaaggaauuuucuccccuagcgaacuagagacgccaaaucuggcggaacgagcgcucgacugguuagagaaauacggggucgagagacucaaaaggauggcuauaaguggagacgauugugugguaaaaccuauugacgacagauuugcuacagcccuuaccgcgcuuaacgauauggggaaaguccgaaaggauauaccucagugggaaccaucuaagggguggaacgacuggcagcagguaccauucuguagucaccauuuucaucaacucauuaugaaagauggucgugagauuguaguaccuuguaggaaucaggacgaguugguaggacgugcaaggguaagucaaggagccggauggagccuaagagaaacagcuugcuuaggaaaaucauaugcacaaauguggcaauugauguauuuucacagacgagauuuacgacuagcagcaaacgcgauauguucggcgguaccgguugauuggguucccaccucgagaaccacuuggaguauccaugcacaucaucaauggaugacgaccgaggauaugcucaguguguggaaucgaguauggauugaagagaauccuuggauggaagacaaaacacauauaucuaguugggaagacgucccauauuuagguaaacgagaagaccaaugguguggaagucuaauaggccuuacugcuagagcaacuugggcuacuaacauacaaguagcuauaaaucaagucagaagauuaauugggaacgaaaauuaucuggauuauaugaccucaaugaaacguuucaagaaugagucagauccagaaggagcccuaugguaa

SEQ ID NO: 21189 - RNA, 9879 nt, Artificial Sequence
  derived and/or modified CDS sequence (opt6) from DENV-1__FJ639678__SS-prME
ucggugacaaugcugcuuauguuaaugcccacagcuuuagcguuucaccuuacgacaagaggaggugagccccauaugauugucaguaaacaggaacguggaaaagcauugcuauuuaaaacuagcgcuggagugaacauguguacgcuuauagcgauggaccuaggagagcugugcgaggacacaaugacuuauaaauguccgcgaauaacagagguagaaccugaugacgucgauuguuggugcaaugcuacagauacaugggucaccuacggcaccuguccacagacgggagaacaucgcagggauaggcgcucgguagcucuugcuccgcauguaggacuaggguuagagacgagagcagaaacguggaugaguucagaaggugcuuggaaacaaauccagcgaguagaaacaugggcacugcgacacccggguuucaccguaauugcauuauuucuugcccaugccauaggcacgaguauaacucaaaagggcaucauauucauucuuuuaauguuaguuaccccuaguauggcgaugagaugcguugggauagguaacagagacuucguggaaggauuaagcggagccacauggguagauguaguccuagagcacggcucuugcguaacaacuauggcaaaagacaaaccuacucuagacauugaauuacuaaaaacagaaguuacaaauccggcggugcuaaggaaauuauguauugaagcaaagauaucaaacacgacaacggacucaagaugccccacccaaggugaagcaacucuagucgaagaacaagaugccaauuuuguauguagaaggacuuuuguggaccgugguugggggaauggaugcggauuguuuggaaagggcagucugauaacaugugcaaaauuuaaauguguaacgaaauuagaggguaaaauugugcaauaugaaaacuuaaaauacaguguaauaguuacuguacauacuggagaccagcaccagguuggaaacgaaucuaccgaacacgggacuacagcuacaauaacgccgcaagcuccgacgucugaaauacaacucacugauuacggggcuuugacucuugauugcucaccucgaacaggauuagacuucaaugaaaugguccuucucacgaugaaagaaaagaguugguuagugcacaaacaaugguucuuagaucuuccucuaccauggaccaguggugcaagcacaagucaagaaacuuggaaccgccaagauuuacuagugacuuucaagacagcucacgcuaaaaagcaagaagucguaguacugggcucacaggaaggagcaaugcauacggcacucaccggggcuacagagauacaaacaucgggcacuacaacaauauucgcuggacaccuaaaauguagacugaaaauggauaaacugacccuuaaaggaaugucuuacguaauguguacugggucguuuaaguuggaaaaggaagucgcagaaacgcaacauggaacaguccugguacaaauaaaauaugaaggaacugaugccccauguaaaauaccuuuuucaacacaagacgagaaaggaguuacgcaaaacggaagauuaauuacggcgaacccgauugugacagauaaggaaaaaccagugaauauugaagcagaaccaccuuuuggugaaucauauauaguuauaggugcgggagaaaaagcucuaaaacuaaguugguuuaagaaagguucuucgauugguaagauguucgaagcaacugcaaggggagcccgaagaauggcaauauuaggagacacggcgugggauuucgggucaauaggcggcguauuuacaucagucgggaaguuaguacaucaaaucuucgguacugcauacggcgugcuguuuucaggagugucuuggacaaugaaaauagguauugggguauugcugacaugguuaggauuaaacagcagaucuacaagucugucaaugacguguauugcuguaggguuagucacauuguaccuuggggugauggugcaagcugauagcggcuguguaauuaacuggaaaggaagggaauuaaaaugcgguucaggaauuuuugugaccaacgaaguccauacuuggacagagcaauauaaauuucaagcggacucuccaaaacgucuaagugcagcgaucggcaaagcuugggaagaaggaguuugcgguauacggucggccacgagauuggaaaacauuauguggaaacaaauuaguaaugagcuaaaucauauucuuuuggaaaacgauaugaaguuuacaguugucgucggagacgugguagggauccuugcccaaggaaagaaaaugauuagaccgcaacccauggaauacaaauauaguuggaagucuugggguaaagcgaagaucauaggugcagauauucaaaauacaacuuuuauaaucgaugggccuaauacuccagaaugucccgacgaccagcgggcuuggaauaucugggaaguggaggauuaugguuuugggauuuuuacaacgaauaucuggcuaaaguuaagggacaguuauacucaaguaugugaucacagguuaaugucugcagcaauaaaagauucaaaagcaguucacgccgauaugggauauuggauugaaucagaaaaaaaugaaacguggaaauuagccagagcaaguuucaucgaaguaaagacguguauauggccuaaaagucauacgcucuggaguaauggaguacuagaaucugagaugauaauuccaaaaauuuaugguggaccuauaucacaacauaacuauagaccgggauauuuuacgcaaacugccgguccauggcauuuagguaaacuggaacucgauuuugaucuaugugaaggcacaacaguaguaguugaugagcauugcgguaaccgugguccgucauuaagaacaacaaccguaaccgguaagauaauacacgaguggugcugucgaagcugcacucuaccgccgcuacgauuuaagggggaggaugguugcugguacggcauggaaauuaggccgguaaaggagaaagaggagaauuuagugaaaaguaugguuagugccggaagcggggaaguggauagcuuuucauugggccugcucuguaucucuauuaugauugaggaagugaugagaucaagauggucucgaaagaugcuaaugacugguacauuagcgguauuuuuucuucugauaaugggacaacuaaccuggaacgaccuaauacgauuaugcauaaugguaggcgccaacgccuccgaucgaauggggaugggcacuacguaucuagcguugauggcuacauuuaagaugcggcccauguucgcaguaggcuuauuauuuaggcgcuuaacaucacgugagguucuccuguugaccaucggacuuagccuaguagccaguguugaauugccaaacagccuagaagagcuaggugaugggcuugcuaugggaauaaugauccuaaaauuauuaacagacuuccaaucgcaccaacuaugggcaacauuauuaagccucacauucauaaaaacaacguuuucuuuacauuaugcuuggaagacuauggcuaugguucuaaguauuguuagucuguugccauugugcuugucaacaacuagccagaaaacgaccuggcuuccugucuuguuggggucauuagggugcaaaccuuugacuauguuccuaaucgccgaaaauaagauuugggguaggaaaucauggccauuaaacgaaggcaucauggcaguuggaauagugucaauacuacucucuucacuauuaaaaaacgauguaccauuagccgggccacucauagcgggagguaugcuaauagccuguuauguaauuagcggcaguagugcugaucuuucacucgaaaaagcagccgaaguaaguugggaggaagaggcagaacauucaggagcaucacacaacauuuuaguagagguucaagaugacggaacaaugaaaauuaaagacgaggagcgugaugauacucugacaauacuguuaaaagcuacacucuuagcuguaaguggaguuuacccauuaaguauaccagcgaccuuauucuuaugguacuuuuggcaaaaaaagaaacaaagaucagguguacugugggacacacccuccccaccugaagucgaacgagcuguuuuagaugauggaauauacagaauaaugcaaaggggauuacuagguaggucgcagguagguguuggaguuuuucaagagaauguguuccacacuauguggcaugucacacgcggagcaguccugauguaccaaggaaagagacuugaaccaaguugggcaucugucaaaaaagaccucauaucauacgguggaggcuggagauuacagggcucauggaacaccggggaagagguacaggucauagcuguagaaccagggaaaaacccaaaaaacguccagacugcgccgggcacauuuaagaccccagaaggagaaguaggugcaauagcgcuagauuuuaaaccggggacuagugguucaccgauaguaaaucgugaggggaaaaucgugggacuguauggaaaugggguagugacuacuaguggaacauauguuucagcgauagcacaagcuaaagcaagccaagaagguccacuaccggaaauagaagaugaaguauucagaaagagaaacuuaacuauuauggauuuacacccagggagcggcaaaacgagaagauaccuaccagccauagugcgagaagcaauuaaaagaaaauuacguacuuuaauuuuggcuccuacucgaguaguugcuucugaaauggccgaggcccuaaaaggaaugccaauccgcuaccaaacgacugcaguaaagucugagcauacagguaaagagauaguggacuuaaugugccaugcaacguuuacaaugcgacuuuuauccccggugcguguuccaaacuacaacaugauuauuauggaugaagcucauuuuacagauccuucuucuauugcugcuagaggguauaucucgacccgaguagguaugggggaagcggcggccauauucaugacugccacuccuccagggucuguugaagcauucccucaaaguaaugcaguaauacaggacgaagaacgagauauaccagagagaucuuggaauaguggauaugaauggauuacggauuuucccggcaaaacugucugguucguacccaguauaaaaagcggaaaugauauugccaacugccuucggaaaaacgguaaaaggguuauucaauuaucacgcaaaaccuuugauacugaauaccagaagacgaaaaauaaugauugggauuacgugguaacgacagauauaucugaaaugggggcuaauuuccgagccgaccgaguuauagacccacggagauguuugaaaccugucauacuaaaagauggccaagaaagaguuauucuagcuggaccaaugccuguaacaguagcaagugcggcucaaaggcgggggagaauaggcagaaaccauaauaaagaaggcgaccaauauaucuacaugggccagccuuuaaacaaugaugaggaucaugcccauuggacagaagcaaaaaugcuuuuagacaacaucaacacaccggaaggaauaauuccugccuuguucgaaccugaacgagagaaaucugcagcuauagauggagaauauaggcuacguggugaggcacgaaaaacuuucguggaauuaaugagacgaggagauuuaccgguaugguugucuuacaagguagcuucugaaggcuuccaauauagugauaggcguuggugcuucgauggagaaaggaacaaccaaguccuagaagaaaauauggauguagaaauauggacgaaggaaggggaacgcaagaaacucaggccucgguggcuagaugcaagaacauauagugauccucucgccuugcgcgaauuuaaagaauuugcagcaggucgacguaguguuucaggcgauuuaauuuuggagauugguaaauugccgcagcauuuaacccaaaaagcgcaaaaugcuuuggauaaucuuguuauguugcacaauucugaacaggguggaagagcguauaggcacgcuauggaggaguuaccggauacaauugaaacauugaugcuacuugcgcuuauugccguauuaacaggcggcguuacauuauucuuccuaagcggaagaggauugggcaagacaucgaucgguuuauuauguguaauggcuagcagugcucuauuauggauggcaucuguagaaccccacuggauagcggcaucaauaauuuuagaauuuuuccucauggugcuauugauacccgagcccgauagacaaaggacaccccaagauaaccaguuagcauacgugguuaucggguuacuuuuuaugauucucacuguugccgccaaugagauggguuugcuagaaacaaccaaaaaagacuugggaauuggacauguggcaguagaaaaccaucaccacgcaacuaugcuagauguagauuuacauccugccucagcauggacucucuaugcagucgccaccaccauuauaacgccuaugaugagacauacgauagagaauacgacagccaauauaucacuaacugccauagcaaaucaggcagcaauauuaaugggguuggacaaaggauggccaauauccaaaauggauauugguguuccucuauuagcccuuggcuguuauucacaaguuaauccgcuuacccuaacugcagcaguauuaaugcuaguggcucauuacgcuauaauugggccugguuugcaagcuaaagcaacacgcgaagcacagaaaagaacugcagcugguaucaugaaaaacccaaccguugacgguauagucgcaauagaucuggaucccguagucuaugacgcaaaauuugaaaaacagcucggacaaauuaugcuacuuauacuuugcaccagucaaauacuucuaaugaggacaacuugggcguugugcgaaucaauuacucucgccacaggcccgcuaaccacccuaugggagggguccccagguaaauuuuggaauacuacaauagcagugucuauggcaaauauuuuucgaggaucuuauuuagccggagccgggcuugcauucucguugaugaaaucauuaggggguggaaggagaggcacaggggcacaaggagaaacacuaggcgaaaaguggaaaagacaacuaaaucaauuaaguaaaagugaguuuaacaccuacaagagaagcgggauaauggaaguagaucguucagaagcaaaagaaggauuaaaaagaggugagacaacacgucaugccguaaguaggggaacugcuaaacuccgcugguuuguagagagaaaucuaguuaaaccagaagguaaaguaauugaucucgguuguggaagaggaggguggucauauuauugcgcugguuugaaaaaaguaacggaaguuaaaggauauacaaagggugggcccggccaugaagaaccaaucccaauggcgacguauggcuggaaucuaguaaaacuacauucugggaaggauguuuucuuuauacccccagagaaaugugauacucucuuaugugauauuggugaaaguucgccgaauccuacuauagaggaagguaggacccuaagagugcuuaaaaugguggagcccuggcuaagagguaaucaauucuguauaaaaauuuugaauccguauaugcccuccguuguggagacucucgagcaaaugcagcgcaaacauggagguaugcugguuagaaacccguuaucgcgcaacucuacacacgaaauguacuggguaucauguggaaccgguaacaucgugucggccguaaacaugaccaguaggaugcuacugaacagauuuacgauggcgcauaggaaaccuacauaugaacgagauguagauuugggagcuggaacuaggcauguggcuguagaaccugaagucgcuaacuuggacauuauaggccaaagaauagaaaauauaaaacaugagcauaagucgacguggcauuacgaugaggauaacccauacaaaacaugggcuuaccacggaucuuacgaagucaaaccuucggguucugcuucuucgaugguaaauggaguaguuaaauuacugacaaaaccaugggacguaauaccaauggugacccaaauagcaaugaccgacaccacaccuuuuggacaacaacgaguauucaaagaaaaaguugacaccagaacgcccaaagcuaaacaaggaacugcacaaauuauggaaguuacagcacgaugguuguggggguuucuaagcaggaauaaaaaaccuagaauauguacaagggaagaguucaccagaaagguccguucuaacgcagcaauaggggcaguauuuguggaugaaaaucaauggaauucggcgaaagaagccguggaagacgaaagauucugggacuugguccaccgagaacgugaauuacacaaacaagggaagugugcgaccugugucuacaacaugauggguaagagggaaaagaaauuaggcgaauuugggaaggcaaaggggucucgagcuauaugguauaugugguuaggagcgcgguuucuugaguuugaagcuuuggguuuuaugaaugaagaucauugguuuagucgagaaaauucuuuaagugguguugaaggugaaggauugcauaagcuaggcuauauuuugagagauauaagcaaaauacccgguggaaacauguaugccgacgacaccgccggcugggauacucgaauuacagaagaugauuuaaggaacgaagcgaaaaucacagacauuauggaaccagaacaugcauuguuagcaacuaguaucuucaaauugacguaucaaaauaaaguaguccgagugcaacggcccgcaaagaacgguacaguuauggacguuauaagcagaagagaccaacggggaucaggccaaguaggcacguauggacugaauacuuuuacaaauauggaagcccaguuaauaaggcaaauggaaagugaagguaucuuuucaccuuccgaacucgaaacuccaaauuuggccgaacgcguauuggauuggcuagaaaaguacggugucgaaagacuaaaaagaauggcaauaucgggagaugacuguguaguaaaacccauagaugauagauucgccacagcauuaacugcucuaaaugauauggggaaaguacggaaagauauaccacaaugggaaccuucaaaggguuggaaugauuggcaacagguuccuuuuuguagccaucacuuucaucaauuaauaaugaaagacgguagagaaauuguugucccaugcaggaaucaggacgaauuaguuggacgagcuagaguuucacaaggugcggguuggucacuaagagagacggcgugcuuaggcaaaagcuaugcacaaauguggcaacucauguacuuccauagacgcgaucuacgauuggcugccaaugcaaucuguucagcaguacccgucgauuggguacccacgagcagaacuacguggucuauccaugcccaccaucaauggaugacuacagaagauaugcucucgguuuggaauaggguauggauagaggaaaacccauggauggaagacaaaacacacauuuccucgugggaggaugucccauaucucggcaaaagagaagaucaguggugugguucauugauaggucugacagcuagggcgacuugggccacuaacauacaaguagcaauaaaucaaguaagaaggcuuauaggaaaugaaaauuaucuagauuauaugaccuccaugaagcgcuuuaaaaaugaauccgauccagaaggcgcuuuaugguaa

SEQ ID NO: 21190 - RNA, 9879 nt, Artificial Sequence
  derived and/or modified CDS sequence (opt6) from DENV-1__FJ639679__SS-prME
ucaguaaccauguugcucaugcuaaugccuacugcguuagccuuccaucucacaacacgagguggagaaccgcacaugauaguuucgaaacaagaaagagguaagaguuuacuuuuuaaaaccagcgcuggugugaauaugugcacacugauugcaauggaucugggagaauugugugaagauacuaugacguauaagugcccacggauuacagaagcggaaccggaugauguagauugcugguguaaugccacagacacgugggugacuuaugguacgugcucacaaacuggcgaacacagaagggacaaaaggagugucgcacucgcaccucacguuggucuaggcuuagaaacaagaacugaaaccuggaugucgagugaaggagcauggaaacaaauacaacgaguagaaaccugggcauuaagacauccuggguuuaccguuaucgcauuauucuuagcacaugcaauaggcaccaguauaacacaaaagggaauaaucuuuauacuucucauguuggucacuccuucgauggcuaugcgcuguguuggaauagggucaagagauuuuguugaagguuuaucaggggccaccuggguggacguaguucuugaacaugguagcugcgucacaaccauggcuaaagacaaaccaacccuagauauagaauuacuuaaaacggaaguuacaaauccugcaauauuacgaaaguuguguauugaggcaaaaauaucuaauaccacgacagauucgagauguccaacccaaggcgaagcuacccucguugaggaacaagacgcaaacuucguauguaggcggacuuuuguggauagagguugggguaauggcugcgggcuuuuugguaaagguuccuuaaucaccugugcaaaguucaaaugcguaacuaaacuagaaggcaaaauaguucaauaugagaacuuaaaauacucaguaauaguuacuguucauacaggugaucaacaucagguugggaaugaaaguacugaacauggaacaacggccaccauuacgccucaagcaccuacuacggaaauccaguugacagacuacggggcuuugacuuuagauuguucgccaagaacaggacuugacuucaaugaaaugguguuauuaacuaugaaagagaaaaguuggcuuguacauaagcagugguuuuuggaccucccccuuccguggacguccggcgcauccacaucgcaggaaacauggaauaggcaagaccuauuaguaacguuuaaaaccgcgcacgcgaagaaacaagaaguuguaguauuagguucgcaagaaggugcaaugcauacugcacuuacuggggcgacagaaauucaaaccaguggaacaacaacaaucuucgcgggccaccuuaaaugucgauuaaaaauggauaaauuaacauugaaaggaaugaguuaugucaugugcacagguuccuucaaauuagaaaaggaagucgcagaaacucaacaugguacuguccuaguacagauuaaauacgaaggaacagaugcaccuuguaaaaucccauucaguacucaagaugagaaaggaguuacccaaaacggccgcuuaauaacagcaaauccgauaguuacggauaaagaaaagccaguuaauauagaagcugaaccaccauuuggcgagucauauauaguaauaggcgcaggcgaaaaggcgcuaaaacuaaguugguucaagaaaggaucuucaauagggaaaauguuugaagcuacagcaaggggugcucguagaauggccauuuuaggagauacagcuugggacuuugggucgaucggagggguauucaccucaguaggaaaacuugugcaccaaauauuugguaccgcauauggaguauuauuuucuggcguaucuuggacuaugaaaaucgguaucgggguccucuuaacgugguugggauuaaacaguaggucuacgucucuuucuaugaccugcaucgcuguaggucuaguuacccuguauuugggaguaaugguccaagcagacagcggaugcguuauaaauuggaaagguagagaacuuaaaugcgguaguggaaucuuuguaacaaaugaaguacacacuuggacugaacaauauaaguuccaagcggauucuccaaaacgauugucagcagcgauaggaaaagccugggaagaaggaguaugcgguauaaggucugcgacacgcuuagaaaauauuauguggaagcaaauuucuaaugaacucaaucauauacuguuagaaaacgauaugaaauucacaguaguaguuggugacgucgcaggaaucuuagcacagggcaagaaaaugaucagaccccaacccauggaauacaaauauucguggaaaucguggggcaaagcaaaaauuauaggugcagacguucaaaauaccacauuuaucauugauggcccuaauacaccggaguguccugaugaccaaagggcauggaauauuugggaaguagaagacuauggauuugguauauuuacuacaaacaucuggcuaaagcuaagagacucauacacgcaagugugugaccauagauugaugucugcggcuauaaaagacucaaaggcuguccaugcggacaugggauauuggaucgaaucggagaaaaaugaaacuuggaaguuggcaagagcaucuuuuaucgagguuaaaaccuguauauggccuaaaucgcauacauuauggaguaacgguguauuggaaucugaaaugaucauaccgaagauuuacggagggccaaucucccaacauaacuauagaccugguuacuuuacacaaacagcagguccauggcacuuaggcaaauuagaacuagauuucgaucuaugugaaggaacaacaguagugguugacgagcauugcggcaauagaggaccaucucuuaggaccacgaccguuacugguaaaauaauacaugaaugguguuguagaaguugcacccuuccacccuuacgauucagaggagaagacgguugcugguacggaauggaaauuagacccgucaaagagaaagaggaaaaccugguaaaaagcauggugucugcgggcaguggagaaguagauaguuucuccuugggccuacucugcauaucgauaaugauagaagaaguaaugcgaaguagauggucacgaaaaauguuaaugaccggaacuuuagccguauuucucuuauuaauuaugggccaacucacauggaaugaccucaucagacuauguauuaugguaggagccaacgcaucagauaggaugggaaugggaacgacauauuuagcucuaauggcaacauucaaaaugcgacccauguuugcagucggccuacuauuucgaagacugacaucacgagagguguuacucuuaaccauuggacuaucgcugguggcaucaguggagcuaccaaauucauuagaggagcugggugauggauuagcgaugggcauuaugaucuuaaaacuauugacugauuuccaaagucaccaauuaugggcuacauuguuaucccuaacuuuuauaaagacuaccuucagccuucauuaugcauggaagacgauggcaaugguauuauccauaguuucgcuauucccacuuuguuuauccacuaccagucaaaagacaacuugguuaccuguucugcuaggaucacucggguguaaaccccuuaccauguuucuuauagcagaaaacaagauauggggcagacguucauggccacucaacgagggcaucauggcaguagggauagucucuauccuguuaucaucguuacugaaaaaugaugugccauuggcgggaccgcuaauagcgggagggauguuaauugcauguuauguaaucuccgguucauccgcagaccuuucuuuggaaaaggcugcagaaguuucgugggaagaagaagcugagcauucaggugcaucacacaauauacuuguagaaguccaagacgauggaacaaugaagaucaaggaugaagaacgggaugauacccucacuauuuuacuaaaagcuacuuuacucgcuguaucagguguguauccgcugaguauaccagcgacacuauucguuugguauuuuuggcagaaaaagaaacagagaucuggagugcuuugggauaccccaucuccgccagagguggaacgagcgguccuugaugaugggaucuauagaauuaugcagcggggauuauuaggacgaagucagguagggguuggcguuuuccaggagaauguauuccauacgauguggcauguaacacgaggagcuguacucauguaucaaggaaaaagauuagaaccaucaugggcaagugugaagaaagaucuaauaagcuaugggggaggauggcgccuucagggaucguggaauacaggcgaagaaguccaaguaauugccguggaaccuggcaaaaaucccaaaaauguacaaacggcccccggaacuuuuaagacgccagaaggugaaguaggugcaaucgcgcuugauuucaagccgggaacaaguggguccccuauaguuaauagagaaggaaaaauaguagguuuauacggaaaugguguaguuacgacuucagguacauacgugucagcaauugcgcaggcaaaggcuagccaagaaggcccacuacccgagauagaagacgaaguauuucgaaaacguaaccucaccauuauggaucugcacccuggaucggguaaaaccagacgguauuuaccagcuauuguucgugaagccauaaaacgcaagcuaagaacuuugauauuagcucccacaagggugguugcaucagagauggcagaagcgcuaaaggggaugccaauaagauaccaaacgacagcuguaaagucagaacacaccgggaaagagauuguagauuugaugugccacgcgacguuuaccaugcgccuacuuucgccgguaagagucccuaauuacaacaugauuauaauggacgaagcacauuucaccgauccgagcagcaucgcugccagaggauauaucagcacaagaguagggaugggagaagccgcugcuauuuucaugaccgcaacuccaccagguagcguugaagcguuuccccaauccaaugcaguuauacaagacgaggaaagggauauuccugagcgauccuggaacucugguuacgaauggauaacggauuucccagguaagacgguaugguucguaccaagcauuaaaucaggaaaugauauugccaauugucuacgcaaaaacgguaaacgaguuauucaauugagucgcaagacuuucgauacagaauaucagaaaacgaaaaauaacgauugggauuauguagucacaaccgacauaucagagaugggggcuaacuucagagcagauaggguaaucgacccgaggaggugccucaagccgguuauacuaaaagacggaccagaaagaguuauacucgcuggcccaaugccaguuaccguagcaucagcagcucagcgaaggggcagaauuggucgaaaucauaauaaagaaggcgaucaauauaucuacaugggccaaccgcuuaacaacgacgaggaucaugcgcauuggacagaagccaagauguuacuagauaacauaaauacuccagaaggcauuauaccagcucuauuugaaccagaacgagagaaaagugcagccauugauggagaauaccgccuaagaggugaagccagaaaaaccuuuguugaauuaaugcggagaggagacuugccuguaugguuaaguuacaaaguugcaagcgagggguuccaauacagcgacaggaggugguguuucgauggugaaaggaacaaucaagugcucgaagaaaacauggaugucgagauauggacaaaagagggagaaagaaagaaauuacgaccaagaugguuagacgcacgcacuuauucagauccauuagcgcuccgagaguucaaagaauuugcagccgggagacguucagucucaggcgauuuaauacuugaaauuggaaaacuaccccaacaccucacacagagagcacaaaaugcccucgacaauuuaguuauguugcauaacagcgagcagggcggacgagcauauagacacgcuauggaagaauuacccgauacuauugaaacacugaugcuuuuagcccuaauugcaguguuaacaggugggguaacucuauuuuucuuaucgggccguggucuaggaaagacaagcaucgguuuauuauguguuauggccagcaguguauuacuauggauggcaucaguagaaccccauuggauugcagcaaguauaauauuggaguuuuuccuuaugguucuuuuaauaccagagccagacagacaaagaacgccacaggacaaucaauuagccuacguuguuauuggccuguuauuuaugauacuaacaguugcagcuaaugaaauggguuuguuagaaacuacuaagaaagacuuggguauaggacauguggcuguugggaaccaccaccaugcagcaauguuggacguagaucuccauccggcaagcgcuuggacacuauaugcuguagcgacaacaauuauuacuccaaugaugcggcauacaaucgagaacacaacugcaaacauuucucuaacagcaauugcuaaccaagcugcuauuuugauggguuuggacaaaggcuggccaaucagcaaaauggauauaggcguuccucuuuuagccuuagguugcuauucacaagucaauccacugacguuaacggcugcaguuuugaugcugguugcacauuacgcaaucauaggaccuggucuucaagcaaaagcaacuagagaagcacagaaaaggaccgcagcggggauaaugaaaaacccuaccguggauggaauagucgccauugaucucgauccaguaguauaugaugcuaaauuugaaaaacaguuagggcaaaucauguugcuuauacuauguacaucacagauuuuacuaaugaggacgacaugggcuuugugugagucgauuacacuagcuacaggaccacuuacaacuuuaugggaagggucaccagguaaauuuuggaacacaacaauagcuguaucuauggccaauauuuuccgagguaguuaucuugccggagcuggauuagccuuuucauugaugaaauccuuagguggagggcgacgagggacaggagcccagggggaaaccuuaggagaaaaauggaaaaggcaacuuaaccaauuauccaaaagugaguucaauacuuauaaacgguccgguaucauggagguugaucgaagugaggcaaaggaaggucuaaaaagaggagaaacaacuaaacaugcaguaucacgaggcacugcaaaauuacggugguucguugaacgaaaccuugugaagccagaaggcaaagugaucgauuuaggauguggaaggggaggauggucauauuacugugccggguuaaagaaaguaaccgaaguaaaaggauacacaaagggugggccuggccaugaagaaccaauuccuauggcuacauacggauggaaccuaguuaaauuacauuccggaaaagacguuuucuuuauaccuccagaaaaaugugauacguuauugugcgacaucggagaaucuucaccgaauccuacaaucgaagaaggaagaacuuuaagaguacuuaaaaugguagaaccauggcuaagaggaaaucaauuuuguauuaaaauauuaaauccuuauaugccgucaguaguagagacccucgagcaaaugcaaaggaaacacgguggcaugcugguaaggaauccacuaucuaggaauagcacucaugaaauguacugggugagcuguggaacagguaauauaguaagcgccguuaauaugacuagcaggaugcuucuaaaccgguuuaccauggcgcaucggaagccaacauacgaaagggacguagaucucggugcagguacaagacauguugcaguagaaccggaaguagcgaaccucgacaucauagggcaacgaaucgagaauauaaagcaugagcacaaaucaacauggcauuaugacgaagauaaccccuauaaaacaugggcuuaucauggaagcuacgaagugaaaccuuccgguagugccaguucaauggucaacgguguaguaaaacuauuaacuaaacccugggaugucauacccaugguuacacaaauagcaaugacagacacaacuccguuuggacaacagcguguguuuaaagagaaaguagauacacgaacuccuaaagcuaagcgaggaaccgcacaaauaauggaaguaacggccaaauggcuuuggggauuuuuaaguagaaauaagaaacccagaauauguacacgugaggaauuuacaagaaaaguaagaucaaaugcagcgauuggagccguuuucgucgaugaaaaccaguggaacucagccaaagaagcuguugaagacgaaagauuuugggaccuuguacacagagaacgagagcuucacaagcaaggaaaaugugcuacgugugucuacaauaugauggggaagcgagagaagaaauuaggagaguucgguaaagccaaaggaucaagagcaauaugguauauguggcuuggugcaagguuucuggaguuugaagcauuagguuuuaugaaugaggaccauugguuuaguagagaaaauuccuuaaguggaguagaaggagaaggccuccauaagcuaggauacauauuaagggacauaagcaaaauaccaggugguaauauguacgcggaugauacagccgguugggauaccaggauaaccgaagaugaccuucagaaugaagcuagaauuacagauauaauggaaccggaacaugcgcugcuagccaaaagcauauuuaaacuuacauaucaaaauaaaguagugcguguucaaaggccagcaaagaacgguacuguaauggacgugauuagcagaagggaucaaagaggcagcggucaggucggcacuuacggacugaauacauuuaccaauauggaggcucaacuaauccggcaaauggaaucagaagggauauuuagcccaucggaacucgagacuccaaauuuagccgcucguguauuggauuggcuagagaaguauggaguggaaagguuaaaaagaauggcuauuaguggagacgauugcguagucaagcccauugacgacagguuugccacugcacuaacugcucugaacgauaugggaaaaguaagaaaagauauaccgcaaugggaaccaucaaaaggguggaacgacuggcaacagguaccuuuuuguagucaucacuuucaccaauugauaaugaaggacggucgcgaaauaguaguaccaugccgaaaccaggaugaacucguagguagagcaagaguaagucaaggggcuggauggucuuuaagagagacugcaugccuaggaaaaucauaugcucagauguggcaacuuauguauuuucaucguagagaucuacgacucgcugcuaaugccaucugcagugcaguaccaguagauuggauccccacuucacggacaacguggagcauacaugcacaccaucaguggaugacaaccgaagauaugcugucuguauggaauaggguuuggaucgaagaaaaucccuggauggaggacaagacgcacauuucgaguuggggagauguuccguauuuaggaaaacgagaagaccaguggugugguuccuuaauagggcuaacugcuagggcaacaugggcgaccaacauccaggucgcaauaaaucaaguuagaaggcuaaucggaaaugaaaauuaucuugauuauaugacaaguaugaaaagauuuaagaacgaaagcgauccagagggcgcguuaugguaa

SEQ ID NO: 21191 - RNA, 9879 nt, Artificial Sequence
  derived and/or modified CDS sequence (opt6) from DENV-1__FJ850069__SS-prME
aguguaaccauguuguugaugcuaaugccuacugcguuggcauuucaccuuacgacaagagggggugaaccucacaugauagucggcaaacaagaaagaggaaaaucgcucuuauucaaaacaucugccgggguaaacaugugcaccuuaauugcaauggaucuaggugaauuaugugaagauacaaugacauauaaaugucccagaauaacggaaguagaacccgaugacgucgauugcuggugcaauacgacugauacuugggugaccuacggcacaugcagccaaacgggagaacaucgccgcgauaaaaggagcguagcacuggcaccccaugugggacuaggucuagaaacaagagcugaaacuuggaugucaucagaaggcgcuuggaaacaaauucaacggguugaaaccugggcccuaaggcaccccgguuuuacgguaauugcacuuuuucuagcucacguuauuggcaccagcaucacgcaaaaaggcauuauauuuauacuucuaauguuaguaaccccaaguauggcaaugcgcugugucggaauagguucacgcgacuuuguagaggguuuaucaggggcgacuuggguugaugugguguuagaacacggaucaugcgucacaacgauggcaaaagacaaacccacccuggauauagaacuguuaaaaacggaaguuacuaauccagcaguacuucgcaaacuaugcauagaagcgaaaauuagcaacaccacaacggauagucgauguccaacgcaaggggaggccacauugguggaagaacaagaugccaauuucguauguagaaggacguuuguggauaggggauggggcaacggaugcggacuuuucgggaaaggcuccuugaucacuugcgcuaaauucaaaugcgucacaaaacucgaagguaaaauuguccaauacgaaaaccuuaaauauuccgucauuguaacaguccauacuggagaccagcaccaagugggaaacgaaucaacagaacaugggacuacagccaccauaacaccccaagcuccaacgucggagauacagcucacggauuauggagcucucacacuagauuguucgccaagaaccggacucgacuucaaugagauggugcuauuaaccaugaaagagaaaaguuggcuaguacacaaacaaugguuucuagaccucccacuuccuuggacaucaggagccaguacaucacaagagacguggaauagacaagaucucuuagugacauucaaaacagcccaugcuaagaaacaggagguaguaguacugggaucacaagaaggugcaaugcauacagcacuaacgggcgcaacagagauacaaacaucaggaacgacaacgauauucgcaggacaccucaaguguagguuaaaaauggauaaguuaacacucaaggguaugaguuauguuauguguacuggaaguuucaaauuagaaaaggaaguggcagagacacaacacggaaccguuuuaguacaaauuaaauaugagggaaccgaugccccaugcaagauaccguuuucaacucaagaugaaaaaggugugacacagaaugggcgcuugauaacugcaaacccuauagucacggauaaagagaagccugugaauauugaggcugaaccucccuucggugaaagcuauauaguuaucggggcaggagaaaaggcacuaaaacuaaguugguuuaagaaaggauccucaauuggaaaaauguuugaagcgaccgcccggggcgcgagaaggauggcaauacuaggagauaccgcuugggauuuuggaucaauagggggaguguuuacaucuguaggaaagcuaguucaucaaauauuuggaacagcuuacgguguauuauucuccggaguaucauggacaaugaagauaggcauuggaguucuucuaaccuggcuaggacuuaauucuaggaguacgaguuuaucaaugacauguauagccguugggcuggucacacuauauuugggaguaaugguacaagccgauuccggaugugugauaaacuggaaagggagagagcuaaaaugcggauccggaauauuugugacgaaugaaguucauacguggacagagcaguauaaauuucaggccgauucacccaaacgacuuucugccgcaauugggaaggcuugggaagaggguguaugugguauccguagugcaacacgacuagaaaauauaauguggcgucaaauaagcaacgaguugaaucacauuuugcuagaaaacgacaugaaauuuacuguaguuguuggagacguaguggggauauuggcacagggaaagaaaaugauaagaccacaaccuauggaacauaaauacaguuggaaaaguugggguaaagccaaaaucaucggugcggauguucaaaauacaacauuuauaaucgauggucccaacacuccagaauguccagaugaucagagagcauggaauauaugggagguugaagacuauggauuuggaauauuuacgacgaauauauggcugaaauuaagggauucuuauacucaaguaugugaucacagacuaaugagugccgccauaaaggacaguaaagcaguacacgccgacaugggauauuggauugaaucggagaagaacgaaacauggaagcucgcuagagcaucguucauugagguuaagacauguauauggcccaaaagccacacguuauggaguaaugguguccucgaaagugagaugauaauacccaaaauauauggcggcccaauuucucagcauaauuaccguccuggauacuuuacccaaacagcaggaccauggcauuuagggaaguuggaacucgauuucgaucuuugugaagguacaacuguagucgucgaugaacacugugguaacagaggaccuagucuacguaccacaacagugacagguaaaauuauucaugaaugguguugucgaucuuguacguuaccaccuuuaagauucaaaggugaagacgguuguugguauggcauggagaucaggccgguaaaagagaaagaagaaaaucuggucaaaaguauggugagugcuggaaguggggaaguggacucuuuuucccuaggccuguuguguauauccauaaugaucgaagagguuaugagaucaagaugguccagaaaaaugcuaaugacagggacuuuagcuguguucuuucuauuaauaauggggcagcuaacauggaaugauuuaaucagacuguguaucauggugggcgcuaacgcaucugaccgcaugggaauggguacgacuuaucuagcgcuaauggccacauuuaagaugcggcccauguucgcaguaggguuauuauuucggagauugacaucaagagaaguauuguuauuaacaauagggcuaucuuuaguugcguccguagaguuaccuaacucguuagaagaauuaggagauggauuagcuauggguauuaugauauugaaauuacucacugauuuucaaaguuaccaacucugggugacacuauuaucccuaacuuuuauuaagacaacuuuuucgcuucauuaugcguggaaaacgauggcuaugguccuaucuauagucucucuguuacccuuguguuuaaguaccacaucucagaaaacaaccuggcuuccaguacucuuggggucacuuggauguaaaccacuuacgauguucuucauagccgaaaauaaaauauggggacgcaaaucuuggccacugaacgagggaauuauggccguagggaucgucagcaucuugcucagcagucuacugaaaaacgacguuccacuagcugguccacucauagccggugguauguuaaucgcuugcuacguaauaagugggaguagugcagaucuaucacucgagaaggcagcugagguaucgugggaagaggaagcugagcacucuggggcaucacauaauauccuaguagagguucaggaugacggaacaaugaaaauaaaagacgaagagagagacgacacuuugacaauauuguuaaaagcaacuuuacuagcgguaagcggaguauauccacuaucuauaccggcaacauuauuugugugguacuuuuggcagaagaagaaacaaagaagcggcguccuaugggauacaccaucgccuccagagguagaacgagcgguauuagacgacggcauuuaucguauaaugcaaagaggcuuguugggaagaucucaaguggggguaggaguuuuccaggaaaacguauuccacacgauguggcauguaacucguggugccguucuaauguaucaaggaaaacguuuggagccaucgugggcaagcgucaaaaaggaccucaucucauauggaggaggauggagguuacaggguucguggaauaccggagaggaagugcaaguuauagcgguagaaccugguaaaaaccccaaaaacguccaaacagcaccagguacuuucaagacuccagaaggcgagguuggagcaauagcguuagacuucaaaccagggacauccggaucgccaaucguaaacagagaaggaaagauaguaggauuauacgggaauggggugguuacaacaucaggaacguacguaucggcaaucgcgcaagcaaaggcuucucaagaaggcccucuuccagaaauugaggaugaaguuuuuaggaaacgcaauuuaacuauaauggauuuacauccgggcucaggcaaaaccagaagguacuuaccggccauuguacgugaggcgaucaagagaaaacuuagaacuuuaauccuugcaccuacuaggguggucgcgucggaaauggccgaggcuuuaaaggggaugccuauacguuaucagacaacggccguuaagucggaacauacuggaagggaaauaguggaucuuaugugccacgcgacuuuuacuaugcgauugcuuucaccgguacgaguaccgaacuauaacaugauaauaauggaugaggcacauuuuacagauccauccucaauagcagccagaggauauauuagcacgcgagucgguaugggggaagcagcagcaauuuucaugacggcuacgccaccaggaucgguagaagcauucccacaauccaacgcuguaauccaggacgaggaaagggacauaccagaaagaaguuggaacagcgguuacgaauggauaacagacuuucccgggaaaacggucugguuuguuccaucuaucaagagugguaaugacauugcaaauugucucaggaaaaacggaaagcgaguaauacaauugucgagaaaaacguuugacacugaauaccagaaaaccaaaaauaaugacugggacuauguagucacaaccgauauaucugaaaugggagcaaauuuccgagcggaucgcguuauugacccaagacggugccuuaaacccguuauuuugaaagauggaccagaacggguaauauuagcaggcccuaugccagugacaguugccagugccgcgcaacgcagaggcaggauaggacguaaucacaauaaagagggcgaccaauauauuuauaugggacagccacuaaauaacgaugaagaucacgcccauuggacagaagccaaaauguugcuagauaacauuaauacaccggagggaauaauaccggcucuauuugaaccagaacgagaaaagagugcugcgauugauggagaauaucgauugagaggagaagcuaggaaaacauucguggaacuaaugagaaggggagaccuuccggugugguuauccuacaagguugcaagugaaggauuccaauauagugacaggcgaugguguuuugacggagagcgaaauaaucaaguucuagaagagaauauggauguagaaauuuggacaaaggaaggagaaaggaagaaacuacgaccgagaugguuagaugccagaacauauagugauccccuagcccuucgugaauuuaaagaguuugcugcaggaagaagaagcaucuccggggaccuaauauuggagauagguaaauuaccucaacaucuaacucaacgugcgcaaaacgcauuagauaacuugguaauguuacauaauucagaacaaggcgguagagcauauagacaugcuauggaggaauuaccagauacuauugaaacuuuaaugcuuuuagcacuuauugcaguauuaacaggcggugucacacuauucuuccuuagcggacgugggcuagguaaaacaucaauagguuuauuauguguaauggcgagcagugcccuguuauggauggcaucaguugaaccucacuggauugcugcaucuauaauccuagaguucuuccuuauggucuuauuaauacccgaacccgauagacagagaacaccgcaagacaaucaacuugcauacgugguaauaggucucuuauucaugauuuuaacaguggcagcuaaugaaauggguuuauuagaaacgacuaagaaagaucucggaauagggcauguggcuguagaaaaucaucaucacgcgaccauguuggacguagauuuacaucccgcaucagccuggacucuuuacgcugucgcaacuacuauuauaacaccgaugaugagacacacaauagagaauacuacagcuaauauaaguuuaacagcaauagcaaaccaggcagcaauauuaaugggccuagauaaaggauggccaauaaguaaaauggauauagguguacccuuauuagcucucggauguuacagccaagucaauccacugaccuugacugcugcgguguugauguuaguagcacacuacgcaaucauagguccuggucuacaagcaaaagccacaagagaggcacagaagcgcacagcagcugggaucaugaaaaauccaacgguagacggaauuguugcaauagacuuggacccagugguauaugaugcgaaguuugaaaagcaacugggacaaaucaugcuucugauucuaugcacuucacaaauacuccucaugcgaaccacgugggcauuaugcgaaucuaucacccuagcaacugggccguugacaacauuaugggagggaaguccgggaaaguucuggaauacaacaaucgccgugucgauggcuaauauauuccguggaaguuaccucgcuggcgcagguuuagccuuuucauugaugaaaagucucggaggaggacgucgugguacgggagcacaaggcgagacacuaggugaaaaguggaaaaggcaacuaaaucaacugucaaaaagcgaauuuaauacguauaaaagguccggcauacucgagguggaucgaucugaagcuaaagaagggcuaagacgaggagaaacaacaaaacaugccguuucacguggaacagcaaagcuaaggugguuuguagaacgcaauuugguaaaaccagaagggaaaguuauagaucuugguugcgggcguggcgguuggucauacuacugugcugguuugaagaaagugacagaaguaaaaggguauacaaaggguggccccggacaugaagaaccaauuccaauggccaccuauggauggaauuuagucaaguugcacagcgguaaagacguauucuuuauaccaccagagaagugcgacacccuauuaugugauauuggggaaucauccccuaaccccacaauugaagaaggccgaacguuacgaguccuaaaaaugguagaaccguggcuuagagguaaucaauuuugcaucaagauucuaaacccuuauaugccaucggucguagaaacacuggaacagaugcaaagaaaacaugguggaauguuaguacgaaaucccuuaucacgaaacuccacacacgaaauguacugggucucaugcggaacaggaaauauagugucggcuguaaauaugacaucucgaauguuacucaaccgguuuacaauggcccaccgcaaaccaacguacgaacgagauguugaucuuggugcgggcaccaggcacguggccguagaaccagaaguagcaaauuuagacauuauuggacagcguauugaaaauaucaaacacgaacauaaaaguacauggcacuacgacgaagauaauccguauaaaaccugggcuuaucaugguucauaugaaguaaaacccagugguagcgcaaguucuauggugaaugguguagugaaacuacuuacgaaacccugggaugucauacccauggugacacaaaucgcuaugacagacacaacaccauuuggccaacaaaggguauucaaggaaaaaguugacacgagaacaccgaaagcaaaaagagggaccgcucagauaauggagguuacggcaggauggcuaugggguuuucugucaagaaauaagaaaccacguaucuguacuagagaagaauuuacgagaaaaguuagaaguaacgcagcaauuggugcagucuucguggaugaaaaccaauggaacuccgccaaagaagcagucgaagaugagagauuuugggaccucgugcaucgugaaagggaauuacauaaacaggggaaaugcgcaacuuguguauacaacaugaugggcaagagagagaagaaacuuggagaauuugguaaagcaaaagggucccgugcaauaugguacauguggcugggagcaagauuucucgaguucgaggcuuugggguuuaugaacgaggaucauugguuuagccgggaaaauucauuaagcgguguggaaggcgaaggauuacacaaacuuggcuacauacugcgugauauuuccaagauuccaggagguaauauguacgcagaugacacggcuggaugggauacacgaauaacugaagacgacuuacaaaaugaagcuaaaauaacggauaucauggaacccgagcacgcacuauuagccacaagcauauuuaaauuaacauaccaaaauaaaguggucaggguacagaggccagcgaaaaauggaacagugauggacgucauaagcagaagagaucaaaggggaaguggacaaguaggcacuuauggauugaacacauuuacgaacauggaagcccaacucauccgacaaauggaaagcgaagguauauuuaguccgucagaguuagaaacucccaaucuagcagagcgagugcuggacugguuagaaaaauauggcguagaaagauuaaaaaggauggcaauauccggugaugacugcguaguaaagcccauagaugaucgauuugcuacggcgcugacagcauuaaacgacaugggcaagguucgcaaagauauaccacaaugggaaccuaguaaaggguggaacgacuggcagcaaguuccauucuguagucaccacuuucaucaauugauaaugaaagacggucgagaaauaguuguaccaugcagaaaucaagaugaauuagugggcagggccagaguuucucagggagcaggcuggucacuaagagagacugcuugcuuaggcaagucauacgcgcagauguggcaguuaauguacuuccacaggcgugaucuuagacuugcagcuaaugccauuugcucggcgguaccggucgacuggguaccaacuucaagaacuacauggucaauacacgcacaucaucaauggaugaccaccgaagauaugcugucgguguggaaucgaguuuggauagaagaaaauccuuggauggaagacaaaacacauauauccucaugggaggacguccccuaucuagggaaaagagaagaccaaugguguggaagucuaauugguuuaacggcacgggccacaugggcaacaaacauacaaguugcaauaaaccaaguacggaggcugauagggaaugaaaauuauuuagauuauaugacgucuaugaaacguuuuaagaaugaaucagacacagaaggagcucuuugguga

SEQ ID NO: 21192 - RNA, 9879 nt, Artificial Sequence
  derived and/or modified CDS sequence (opt6) from DENV-1__FJ639680__SS-prME
ucaguaacuaugcuuuugauguuaaugccgacugcuuuagcauuccaucucacuacgcggggaggugaaccacacaugauaguuucuaaacaagaaagaggaaaaucguugcuuuuuaaaacuuccgcaggaguaaacauguguacucuaauagcaauggauuugggcgaacuuugugaagauacuaugacuuacaaaugcccgcguauuaccgaagcagaacccgaugauguagauugcugguguaacgcgacggacacauggguaaccuauggcacguguucccaaacgggggaacaucguagagauaaaagauccguggccuuagcuccacauguuggacuugggcuagaaaccagaacugagacguggauguccucggagggcgcuuggaaacaaauacaaaggguagaaaccugggcucuacgacacccuggauuuacaguaauugcauuauuuuuagcgcaugcuauuggcacaucaaucacccaaaaagguauaauuuuuauccugcucaugcuuguaacucccucaauggcuaugagaugugucggcauugguucuagggacuucguugaaggccuaucuggcgcaacguggguagacgugguccuagaacacgguucguguguaacaacaauggcuaaagauaaaccgacucuagacauugaacuauuaaaaacggaaguaaccaaucccgccguucuaagaaaacuuuguauugaggcaaaaauauccaacacaacuacggauucaagguguccuacacagggagaggcaacucuaguagaggagcaagacgcuaacuuugucugcaggagaacauuuguagacagaggaugggguaaugguugcggauuauuuggaaaaggaucccucauaacaugugccaaauuuaaauguguuacuaaacuagaagggaaaaucguucaauacgaaaaccuaaaauacagcguuauuguaacagugcauaccggugaucaacaccaagugggaaacgaaaguacugagcauggaacuacggcuacaauaacgccccaagccccgaccacugaaauucaacuaaccgacuacggagcccuuacauuagacuguagcccuagaacaggacucgacuucaacgagauggugcuguugacuaugaaggaaaaaucaugguuagugcacaagcaaugguuuuuggaucuaccauuaccguggacuucuggugcgucaacuucucaagaaacuuggaauaggcaagaucugcuggucacauuuaaaacagcucaugccaagaaacaagaaguuguuguacuagggucccaagaaggagcgaugcacacggcgcucacgggugccacagagauacaaacaaguggaaccacaacgaucuucgcaggucacuugaagugcagauuaaagauggauaaacuaacucugaaaggcaugucuuaugugauguguacaggauccuucaaguuggaaaaggaaguugcagagacucaacauggaaccgucuuaguacaaaucaaauaugagggaacugacgcucccuguaaaauuccauucaguacucaagaugaaaaaggcguuacacaaaacggacgauuaaucacagcaaaccccauugugacggauaaggaaaagccaguaaacaucgaagcagaaccgcccuuuggugagagcuauauaguaauaggugcgggcgagaaggcauugaagcuaucuugguuuaaaaaggguaguucuauugggaaaauguuugaagcuacggccagaggcgcgcgucgcauggcuauacuaggagauacggcuugggauuucgguuccauaggagggguauuuacaucaguggggaaauuggugcaucaaauauucgggacagcuuauggaguccuguucuccggcgucucauggaccaugaagaucgguauaggagugcugcucacauggcucggauugaacucaagaaguacaucacugucaaugacuuguaucgcagugggccuuguuacacuauaucuagggguuauggugcaggcggauucugggugcguuauuaacuggaaaggccgugaacuaaagugcgguagugguauuuuugugacgaaugagguccauacauggaccgaacaguacaaauuucaagcugacucgccuaaaagacugucagccgcaauaggaaaggcuugggaagagggaguuugcgggauacguagugccacgagguuggaaaacauaauguggaaacagauaucgaacgaauuaaaccauaucuuauuggaaaacgacaugaaguugacugucguaguuggugaugucgcgggcauacucgcacaagguaaaaagaugauuagaccgcagccaauggaauauaaauauucuuggaagucauggggaaaagcuaaaauaaucggagcugacgcacagaacacuacguucaucaucgaugguccaaacacaccugaauguccagaugaccaaagagcuuggaauauaugggaaguagaggauuauggauuuggaauuuuuaccacuaacauuuggcugaaacuaagagacucuuacacucagguuugcgaucaccgguuaaugucagcagccaucaaggauucaaaagcaguccaugcugauaugggguauuggauagaaagugaaaagaaugaaacguggaagcuggccagggcaaguuuuauugaaguaaaaacaugcauauggccuaaaucccauacccucuggaguaauggagugcucgaaucagaaaugauuauaccgaaaauauacggcgggccgauuucacaacacaauuacagaccagguuacuuuacucaaacugcuggccccuggcacuuaggcaaacucgaacuugauuucgaucuuugcgaagguacaacuguggucguugacgaacacugcggcaaucggggaccgucuuuaagaacgacuacuguuacgggcaagauaauucacgaaugguguuguagaucauguacacuaccaccauuaagguuuagaggagaggauggauguugguacggaauggaaauccgaccugucaaagaaaaggaagagaacuuaguaaagagcauggucucugcagggucuggcgagguagacucauucagcuuaggccuucuauguaucaguauaaugauagaagaaguaaugaggucucgcuggucgaggaaaaugcuaaugaccggcacucuagccguauuuuucuuacuaauaauggggcaauugacauggaaugaccuuaucagacuuugcauaaugguuggcgccaaugcaucugaucgcaugggcaugggaacaacauaccuugcuuugauggcgacauuuaaaaugagaccaauguucgcaguaggccuacuauuucgacgguuaacaagucgagaaguacuauuacuaacgauaggacucagccugguugcaucaguagaacuaccuaacucccuggaagaacuuggagaugguuuggcaaugggaauaaugauuuugaaauuguuaacagacuuucagagccaucaauugugggcaacucuacuaucccuaacauuuaucaaaacuacauuuucacuccauuaugcauggaaaacgauggcuauggucuuaucuauaguuaguuuauuuccauuaugucuauccaccacuucacaaaagacaacauggcuuccaguauugcuggguucauuggguugcaaaccucuuacaauguuuuugauagcagagaacaaaauuugggggagaaaaagcuggccucuuaacgaagguauaauggcgguuggcaucguauccauacuuuuaucuaguuuacuaaagaaugauguuccacucgcugggccauuaauagcuggugguaugcuaauagcaugcuacguaauuuccgguucaucugcagacuuaucauuagaaaaagcagcagagguaagcugggaggaagaagcggaacacucgggagcgagccauaacauauuaguagaaguacaagacgauggaacuaugaaaauaaaagaugaggaaagagaugacaccuuaacaauacuccucaaggcuacuuugcuagccguuucuggaguauauccauuaucaaucccugccacguuauuugugugguacuuuuggcagaagaagaaacaacgaucgggcguacuaugggauacucccagcccuccagaaguugaaagagcuguauuagaugauggaauauacagaauaaugcaaagaggauuauuggggagaagucaaguaggaguuggaguauuucaagagaauguguuccauacaauguggcauguuacgagaggugccguacuuauguaccaagguaaaaggcuagagccaagcugggcaagugucaagaaagacuugauaagcuacggaggaggcuggcgacuccaaggaucuuggaauacuggcgaagaagugcaagugauugccguugaaccuggcaaaaauccgaaaaauguccagacagcaccaggaacauuuaagacacccgaaggggaagugggggcaauagcgcuggauuuuaagcccgguacaagcggaucaccaauuguaaauagagaaggcaaaaucguaggucuuuauggaaacgggguaguaacuacaagcggaacauauguguccgcaauagcgcaagcaaaggcaucucaggaagggccauugccggaaauagaagaugagguauucaggaagcgaaacuuaaccauuauggacuuacauccggguucaggaaaaacaagacguuacuugccugcgauagugagggaggcuauaaagcguaagcuacgcacacuaauacuugcuccaacuaggguaguugccucugagauggccgaagcauuaaaaggaaugccgauaagauaccaaacaacagcgguuaaaucugaacacacaggcaaggaaauaguagaccuaaugugucacgcgacuuuuacaaugcgcuuacuuaguccaguucgaguaccaaauuauaauaugaucauaauggacgaagcacauuuuacugauccuucauccauagcagcccgaggauauauuucaaccagaguuggaaugggagaagcagcagcaauauuuaugacggcgaccccuccuggauccguugaggcuuuuccacaaucaaacgcagugauucaagaugaagaacgugacauaccagaaagaucuuggaacucuggauaugaguggauaacugacuucccgggaaaaaccgucugguuugugccaucaauuaaaucgggcaaugacauagcaaacugcuuaaggaaaaaugguaaaagaguaauucaacuaucgaggaaaacauucgacacggaguaccagaaaacgaagaacaaugauugggauuacguaguuacaacagauauauccgagaugggggccaacuucagagcagauagggucaucgauccaagaagguguuugaaaccaguuauauugaaggacggcccugaacguguuauucuagcgggaccaaugccuguuacgguugcgucagccgcgcagaggcgugggaggauaggucgaaaucauaacaaagagggagaucaauauauauacauggggcagccucuaaauaaugaugaagaccaugcccauuggacagaggcuaaaaugcuauuggacaacauaaauacaccugaaggcauaauuccggccuuauucgagccagaaagggagaaaucggcagcgauagacggugaguaucgguugcguggagaggcacgcaaaacuuucguagaauugaugagacgcggagaucuaccaguaugguugagcuauaagguugcuucugaagguuuccaauauucagaccgacguuggugcuuugauggagaaagaaauaaccagguuuuggaagaaaacauggacguggaaaucuggaccaaggaaggugaaaggaagaaauuaagaccgcguugguuagaugcaaggacauauuccgacccuuuagcccucagagaguuuaaggaauuugcagcaggaagaaggaguguuuccggagaucuaauccucgaaauagggaaacuuccccaacauuugacacagcgugcgcaaaaugccuuagacaaucuagucaugcuacauaauagcgagcaaggagggcgugccuauaggcaugccauggaagaacucccggacacuauugaaacucucauguuacuagcauuaauagcuguucugacuggaggaguaacacuguuuuuccugagcggacguggucuggguaagacuucaauaggacuuuuaugcguuauggcaucaucagugcuucuguggauggccucuguugaaccucauuggauagcagcuucaauuauacuagaauuuuuccuaaugguacugcuaauacccgaaccagauagacagaggacaccgcaggauaaucaguuagcauaugucgugauuggauuacuauuuaugauauuaacagucgcagcaaacgaaaugggucuauuagaaacaacuaagaaagaucucggaauuggacacguagcaguagaaaaucauaaucacgcagcuauguuagacguugaucuucacccagcauccgccuggaccuuguacgcugucgcaacgacuauaauuacaccaaugaugaggcacacuauugaaaacaccacagcuaacauaagucucaccgcgauagcaaaucaggcagccauacuaauggggcucgacaaaggcuggccaaucaguaaaauggacaucggugugccccugcuggcacuuggauguuauucucagguuaauccguuaacccucaccgcagcgguauuaauguuaguugcccauuacgcaauuaucggaccuggucuucaagcaaaagcuacucgugaagcgcaaaaacguacagcagcgggaauaaugaaaaauccaacaguagauggaauaguagcaaucgaucuagacccaguuguauacgaugcaaaguuugaaaagcaacuggggcaaaucauguuacucauauuauguacaagucaaauauuauugaugagaacaacaugggcauuaugcgagagcaucaccuuagcaacugguccucuaacaaccuuaugggaagguucuccaggcaaauucuggaauacaacaauugcaguguccauggcuaacaucuuucguggaucguaccuagcgggagcaggauuagcuuucucuuugaugaagucacuaggaggagguagacgugguacaggugcgcaaggagaaacccugggcgagaaauggaagcgucaacucaaucaacuaagcaaaagugaguuuaauacguauaaacgaucaggcaucauggagguagaucggagcgaagcuaaagaaggccuaaaaaggggugaaacaacuaaacacgcaguaagucgggguacugcgaaguugcguugguucgucgaaagaaauuuaguuaaaccagagggaaaagucauugacuuggggugcggccgaggcgguugguccuauuauugugccggauuaaagaaaguuacugagguaaaaggauacacaaaaggugggccgggucaugaagaaccaauuccaauggcaacauacggauggaaucugguaaaauugcauuccgguaaagaugucuucuucauaccaccugagaaaugugacacauuauuaugcgauauaggagaauccaguccaaaucccacaaucgaagaggguagaacgcugagaguauuaaagaugguagaacccugguuacgaggaaaucaauuuugcauaaaaauuuuaaacccauacaugccuuccguaguugaaacuuuagagcaaaugcaacggaagcacggaggaaugcuuguacgaaacccuuugagccgaaauucaacucaugaaauguauugggugucgugcgggacuggaaauauuguuagcgcgguuaacaugaccuccagaaugcuacuaaacagguucacuauggcccaucguaaacccacauacgaaagagaugucgaccuuggaacaggaacacgacaugucgcagucgagccagaagucgccaauuuagauauaauaggccaaagaauagaaaauauaaaacaugaacauaaaaguacuuggcauuacgaugaggacaauccguacaaaacaugggcauaucacgguagcuacgagguuaaaccuucaggaucagcuucgagcaugguaaauggcguuguaaaacuccugacaaaaccgugggacgucauaccuauggugacacagauagcgaugacggacacuacgccauuuggccaacaaaggguauuuaaagaaaaggucgacacccgaacuccaaaagcaaaaagaggaaccgcucaaauaauggaagucacggcaagguggcugugggguuuccucagucgaaacaagaaaccaagaauuuguacacgugaagaguucacgagaaaaguaagguccaaugcagcaauaggagcuguguucguagaugaaaaucaauggaauagugcuaaagaagccguggaagacgaaagauuuugggauuuaguacaccgagaaagggaacuucauaaacagggaaagugugcuacaugcguuuauaacaugaugggaaaaagggagaagaaauugggugaauuuggcaaagccaaaggaucgagggcgauaugguauauguggcucggcgccagauuuuuggaauuugaggcacugggcuuuaugaacgaagaucacugguuuucucgagaaaacucucuuucggguguagaaggcgaagggcuacauaaauuaggauauauauugagagauauaucuaaaauaccuggagguaauauguaugcugaugauacagcaggaugggauacuagaauuacagaggaugaccugcagaaugaagcuaagauaacugauauuauggaaccagagcaugcguuacuugcuaaagcaauauucaaauugaccuaccaaaacaaaguuguaagaguccaaagacccgccaaaaacggcacuguaauggacgucauuagccgaagggaucaacgggguucaggccaagucgguacuuacgggcuaaacacguuuacaaacauggaagcccaauugauucgacaaauggaaucugaggguauauuuucaccauccgaacuugaaacaccaaacuuagcagaaagagcacuugauugguuagagaaguauggagucgaaagguuaaaaagaauggcaaucucaggagaugacuguguaguaaagccaauagaugauagauuugcuacagcuuuaacggccuuaaacgauauggguaaaguacgcaaagauauaccacaaugggagccaucaaaggguuggaaugacuggcagcagguuccguucuguucacaccauuuucaucaauuaauaaugaaagaugggcgugaaauagucgucccaugcagaaaucaagacgagcuuguaggcagagcaagaguaagucaaggugcgggcuggagucugagagaaaccgccugucuugggaaaagcuaugcccaaauguggcaacuuauguauuuccaucgaagagaccuaagguuagcagcaaaugcgauaugcucggccguaccaguugacuggguaccuacaucacgaacgacauggagcauacaugcacaucaucaauggaugacaacugaagacauguuaaguguuuggaacagaguauggauagaagaaaauccauggauggaagauaaaacacacauaagcuccugggaagaugucccuuaucuagguaagagggaagaucaaugguguggaucucuaauugggcuaacagcgagagcaacuugggcaacaaauauacaagucgcuauaaaccaggugagaagacuuaucggaaacgaaaauuaccuagauuauaugaccagcaugaaacgauucaaaaaugaaucugacccagaaggagcacuuugguga

SEQ ID NO: 21193 - RNA, 9879 nt, Artificial Sequence
  derived and/or modified CDS sequence (opt6) from DENV-1__FJ639682__SS-prME
ucagugacaauguuacuaaugcuaaugccaacagcacuggcuuuccaucugacaacacgaggaggggaaccacacaugauagucagcaaacaagaaagggggaaaucuuuguuauuuaaaacgucagcaggagugaauaugugcacacuaauagcaauggauuuaggcgaauuaugcgaagauacaaugacuuauaaauguccaagaauaacggaagcagaacccgaugaugucgacuguuggugcaacgcgacugauacauggguuacauaugguacuugcagucaaacgggggaacauagaagagacaaaaggagcgucgcgcuagcaccacauguuggacuaggauuagaaacaagaacugaaacauggauguccuccgaaggagccuggaaacaaauacagaggguagaaacaugggcacuaagacauccaggauucacgguaauugcuuuauuccuggcgcaugccaucgggaccaguauaacucaaaaaggaaucauauuuauauuacuaaugcucgugacucccucaauggcgaugaggugcguaggaauugggagcagagauuuuguugaaggacuaagcggcgcgacguggguugauguaguccucgaacaugggaguugugucacgaccauggcaaaagauaaaccaacacuagauaucgaacuuuugaaaacagaaguaacaaauccagcaguucucaggaaacucuguaucgaagcaaaaauuaguaauacuaccacugacucccgaugcccaacucaaggagaagcgacccuaguugaagaacaagacgcuaauuucguuugucgaaggacauuuguggaucgugggugggguaacggaugcggauuauuuggaaaagggagcuuaauaaccugcgcuaaauucaaguguguaacaaaacuugaaggaaaaauuguccaauacgaaaaccuaaaguacaguguaauuguaacggugcacacaggagaucaacaucagguaggaaacgaaucaacggaacacggaaccacagcgacuaucacaccgcaagcaccaaccaccgaaauacaacucacagacuauggagcuuuaacacuagauuguucccccagaacuggacuugacuucaaugaaaugguacuacuaacgaugaaagaaaaaucguggcuggugcauaagcaaugguuuuuggaccuaccgcuaccguggacaagcggagcaucuacaucucaggaaacuuggaaucgacaagauuuauugguuacuuuuaaaaccgcucaugcaaagaagcaggaagucguuguacuagggucacaagaaggugcaaugcauacugccuuaacgggcgcuacagagauacaaaccaguggaacaacuacaauauuugcaggucaucuaaaaugucgcuugaaaauggauaaauugacacugaaggguaugaguuauguaaugugcacugguuccuuuaaauuagagaaggaagucgccgaaacucagcaugguacaguauugguccaaauaaaguaugaggguacagaugcacccuguaaaauaccauuuucaacucaagaugagaaagggguaacgcaaaaugguagguugauaacugccaacccaauugugaccgacaaagaaaaaccagucaacauugaagccgaaccaccauuuggugaaucuuauaucguaauaggugccggcgagaaaacauuaaaacuuucaugguuuaagaaagguucgagcauaggaaaaauguucgaagccacagccagaggagcaaggagaauggccauuuugggcgauaccgcuugggacuuuggcucaauaggcggggucuucacaucuguaggaaaauuaguacaucaaauauuuggcacggcauauggaguccuauucucaggaguaucauggacuaugaagauugggaucggcgugcuuuugacguggcuaggucuaaacucucgaucaaccagcuuaucuaugacauguauagcaguagguuuagucacauuauaccuaggaguaaugguccaggcagauucaggauguguuauaaacuggaaaggcagagaauuaaaaugcgggucgggaaucuuugugacuaacgaaguucauacauggaccgaacaauauaaauuucaagccgacucgccuaaaagacuuucggcagcaaucgguaaggcuugggaagagggaguguguggaauuagaagcgcaacaagacucgaaaauauaauguggaaacaaauuaguaacgaguuaaaccacauauuauuagagaacgacaugaaacucacaguagucguuggagauguagcugggauucuugcucaaggcaagaaaaugauacguccccaaccaauggaauauaaauauagcuggaaaucauggggaaaagcaaaaauuauaggcgcagacgcucagaauaccacuuucauaaucgacggaccaaauacaccugaauguccggaugaucaaagagcauggaauauaugggaaguagaagacuauggguucggaauauucacuacuaacauuuggcucaaacuucgugacuccuauacacaaguaugugaucaucgauuaauguccgccgcaauuaaggauaguaaagcuguccacgcagauaugggauauuggauagaaagugagaaaaaugaaaccuggaaauuggcgagagcuucuuuuauagagguaaagacauguaucuggcccaagucucauacucuauggagcaaugggguccuagaaagugaaaugaucauccccaaaauuuaugggggaccaauuucacaacauaauuauaggccaggauauuucacacagacagcgggucccuggcaccuaggaaaauuagaacuggacuucgacuuaugugaaggcacaacuguaguaguagacgaacacugcggaaauagagguccaaguuuacguacuacaacagucacuggaaaaauuauacacgaauggugcugccgaucuugcacauuaccuccucuacguuuuagaggggaggauggauguugguauggaauggagauacgaccaguaaaagaaaaggaggaaaauuuagugaaauccaugguaagcgcgggaaguggagagguagacaguuuuagucuuggauugcugugcaucucaauuaugauagaagaggucaugagaucacguuggagcagaaaaaugcuaaugacugggacauuagcuguauucuuucugcuaaucaugggucaacuaacauggaacgaccugauacguuuauguauaaugguaggugcaaacgcgucagacagaaugggaauggggacaacguauuuggcauugauggccacauuuaagaugagaccgauguuugcggucggucuucuguuucgaagacucacaaguagggaaguauugcuucugacaaucggcuuaaguuuaguggcaaguguagaauuaccaaauucucucgaggaauuaggugacggccuagcaaugggaauaaugauacuaaaacucuuaacagacuuccagagucaccaacugugggccacacuauuaagucuaacauucauaaagaccacuuucucccuacauuaugcauggaaaacaauggcaaugguauugaguauagugagccuauucccccucugucucucaacaacuucucagaagaccaccuggcuaccggugcucuuaggaucuuugggaugcaaaccccuaacaauguuccucauugcugaaaauaaaaucugggggaggaaaucguggccauugaaugaagguauaauggcaguagguauagugucaaucuuauuaucaucauuguuaaagaacgaugugccuuuagcugguccacuaauugcuggugguaugcuuauagcauguuaugucuuaaguggaucaucagcagaucucucacuugagaaagccgcugagguaucgugggaagaagaagcugagcauucuggugcaagccacaauauauuaguagaagugcaggacgaugguacaaugaaaaucaaagacgaggagagagacgacacacuaacaauucuuuuaaaagcaacacuguuggcagucaguggaguguauccauuguccauuccggcaacauuauuuguuugguauuuuuggcaaaagaagaaacaaagaucagggguacuuugggacacaccaucgccuccugaaguggagcgggcugucuuagaugaugggauauaucgcaucaugcaacgaggacuucuaggcaggucucaaguaggaguaggaguauuccaagaaaauguauuccacacaauguggcaugugacucgaggggcaguuuugauguaccagggcaaaagguuagaaccgagcugggcgucaguaaagaaggaucuaauaucauauggaggcgguuggcgcuuacaaggaagcuggaauacgggagaagaaguccagguuauugcaguagagcccggcaagaacccgaagaauguacaaacugcuccagguacguucaaaacaccagaaggugaggucggagccauagccuuggauuuuaagccaggaacuucgggaucucccauuguuaaucgggaggguaagaucguugggcuauaugguaacgggguaguaacaacaucgggaacguacguuucagccauugcacaagcuaaggcuucgcaagaagguccauuaccagagauugaagaugaaguauuucggaaacgaaaccucaccauuauggaucuucauccgggcaguggaaaaacucgaagauacuuaccugcuauagucagagaggcaauuaaaagaaaacuaagaacauugauacuugcuccaacgcggguaguagcaagcgaaauggcagaagcguuaaaggguauaccgauaagauaccaaacgacugcugugaaaagcgaacacacugguaaagagauaguagaccuaaugugucacgcuaccuuuacuaugagacuccuaagucccguucgagucccaaauuauaauaugauuauaauggacgaagcacauuucacagauccaaguaguauugccgcaaggggauauauaucuacgagaguuggaaugggcgaggcagcugcuauuuuuaugacagcaacgccaccuggaucugucgaggccuucccccaaagcaacgcaguaauacaggacgaggaaagagauauacccgaacgaaguuggaacucuggcuaugaguggauaacagauuucccaggaaaaacugugugguucgucccaucuauaaaaagcggaaaugacauagcuaauugucuucgcaaaaacgguaaacgagucauacaauuaagucggaagacauuugauacggaauaccaaaagacgaaaaauaacgacugggauuauguggugacaacagauauuucggaaaugggugcuaauuuucgugcggaucgaguuaucgaccccagacgcugccugaaaccaguuauucuaaaagacggaccagaacgaguuauacuggcaggacccaugccugucacuguggcuucggcugcacagcgacgaggacgaauuggaagaaaccacaacaaagagggggaucaauacauauauaugggccaaccauuaaacaacgaugaagaccaugcacauuggacggaagccaaaauguuacuggauaacauuaacacaccugaaggaauaaucccggcccuuuuugagccggaaagagaaaaaucugccgcgaucgacggggaauaccgccuaagaggagaagcuagaaagacauuuguggaacuaaugaggcguggcgacuugccagugugguuaaguuacaaaguagcuuccgaaggauuucaauauagugauagaagauggugcuucgauggugagcgcaauaaucaagugcuugaagagaauauggacguugagauauggaccaaggaaggagaacguaaaaaguuaagacccagaugguuagacgccagaacguauucagauccacuugcacuccgcgaguuuaaagaauuugcagcugguagacgaucaguaucaggagauuuaauucucgagauaggaaaacuaccucaacauuugacucagagggcccagaacgcucuggauaaucuaguuaugcuccacaauagugaacagggaggcagggcuuaucgucaugcaauggaggagcuaccugacacgauagaaacauuaauguuacuagcacuaauugcuguauuaacaggagguguuacacuauuuuucuuauccgguagagggcuggggaagacgaguaucggacuucucugugucauggcgucaucuguacuauuauggauggcaucaguggagccacacuggauagccgccaguaucauuuuagaguucuuccuaaugguacuucuaauucccgaaccugauagacagaggacaccacaagauaaucagcuagcuuauguagugauugguuuauuauuuaugauacugaccguugcggcuaaugaaaugggauuauuagagacuacuaagaaagaucuaggcauuggacauguugcaguugaaaaucaccaccaugcggcaaugcuagacguagacuugcauccagcaucagccuggacacuguacgcuguagccacuacaauaauuacgccuaugaugaggcauacgauagagaacacuacagcaaauauuucucuuacagcaauagcaaaccaggcagcaauuuuaaugggccucgauaaaggauggccuauuucuaagauggauauaggggucccauuacucgcacuuggcugcuacucccaaguaaacccauuaacucuuacagcggccguauuaaugcucguugcccauuaugccaucauuggcccgggauugcaagccaaagcaacaagggaagcacagaaaaggacugcugccgggauaaugaaaaaccccacgguggauggaauaguagccauagaucuugauccaguagucuaugaugcaaaauuugaaaaacaacuugggcaaauaauguuguugauacuuugcacaucccaaaucuuauuaaugagaacuacaugggcuuuaugcgaaucaaucacauuagcuacuggaccccuuacaacuuuaugggaaggaucaccuggaaaguuuuggaacacaacaauagcaguauccauggcaaauauauuccgugguuccuaucucgcaggggcaggucuagccuuuucucuaaugaaaucacuaggagggggacgaagaggaacgggugcacaaggagaaacucugggggagaaauggaaacgacagcuaaaccaauuaucaaaaucagaguuuaauacauauaaacgaucagguauaauggaaguugaucgaucugaagcaaaggaaggauuaaaacgaggggaaacgacgaaacacgcuguuagcaggggcacggcaaaacuuagaugguuuguagagagaaaucuaguaaaaccugaagguaaagucauagaccuggggugcggaagaggagguuggaguuauuacugcgcagggcuuaagaaagucaccgaaguaaaagguuacacgaaaggugguccuggccaugaagaaccgauaccuauggccacguauggcuggaauuugguuaaauuacacaguggaaaagauguauucuucaucccaccagaaaaaugcgacacucugcucugugacaucggugaaucuucuccaaauccaacaauagaagaagggcguacgcuuagaguucuuaaaauggucgaaccgugguuacgcggaaaucaauucuguauuaaaauacuuaaucccuauaugccgagcguuguugaaacacuggagcagaugcaacggaaacauggagggaugcuuguuagaaacccguuaucuagaaauucuacgcaugaaauguauugggucagcugcgggacugguaauauuguuucagcggucaauaugacaucucgaauguuacucaaucgcuuuaccauggcgcacagaaagccuacguacgaaagagaugucgacuuagguacaggaacaagacauguugccguugagccggaaguggcgaacuuagauauuaucggacaacgaauugaaaacaucaagcacgagcauaaaaguaccuggcacuacgaugaagacaaucccuacaaaacuugggcauaucauggguccuacgaaguaaaacccucagggagugccucaaguauggugaauggaguggucaaauuauuaacuaaaccgugggacguaauacccaugguaacacaaauagcaaugacggacacuacucccuuuggacaacagcgaguuuuuaaagagaaaguugauacccguacaccaaaagccaaacggggcacagcgcagauuauggaaguaacggcaaggugguuguggggauuuuuaucuagaaauaaaaagccgcgaauuuguacucgagaagaguucacacguaagguuagaagcaaugcggccauuggggcuguauuugucgaugagaaucaguggaacucagcuaaagaggcaguggaagacgaaagauucugggaucuggugcaccgugaaagggaacuucauaaacaaggaaaaugugccacauguguauauaauaugaugggaaagagagaaaagaaguuaggagaguucggcaaagcaaagggaucgagagcuauuugguacaugugguuaggcgcccgauuucucgaguucgaggcguuaggauuuaugaaugaggaucauugguucagucgagagaauaguuuaagugguguggaaggagaaggcuuacauaaacuuggauauauauugcgagacauaagcaagauaccgggaggaaacauguaugcagaugauacagcuggcugggacacccgaaucaccgaagacgaucuucaaaaugaggccaaaauuacggacaucauggaaccugaacacgccuuguuagcaaaagcaaucuucaaacugaccuaucaaaauaaagucguaagaguacaacgcccggccaaaaauggaacaguaauggauguuaucucgagacgugaucaaagaggaucugggcagguaggcacuuacggauuaaacacguuuacaaauauggaggcacaauuaauacgacaaauggaaucugaaggaauuuuuagcccuagugaauuagaaacaccuaaucuggcagaaagagcuuuggauuggcucgagaaauacggugucgaaagacugaaacgaauggccaucaguggcgacgacugcguggugaagcccaucgacgaucguuuugcuacagcccuuacagcacugaacgauaugggcaaagugcguaaagauauaccacaaugggaaccaucaaaagguuggaacgacuggcagcaagucccauuuuguucccaccauuuccaccaacuuauuaugaaagacgguagagagauaguaguaccaugcagaaaucaagacgaauugguuggcagagcgaggguaagccaaggggcuggguggagccucagggagacagcuugccuaggaaaaagcuaugcacagauguggcaauuaauguacuuucaucgaagagauuuaagacucgcggcaaacgccauuugcuccgcugucccagucgacugggucccuaccagucgaacuaccuggucuauacacgcgcaucaucaguggaugacuacagaagacaugcuaucaguuuggaacagaguauggauugaagaaaacccauggauggaagauaaaacacacauaucaucuugggaagauguaccuuaccuuggcaagagagaagaucaauggugcggaucacuuauugguuuaacagcacgggcgacuugggcuacgaauauacaagucgccauaaaucaaguaaggagacuaauaggaaaugagaacuauuuggacuacaugacgucaaugaaacgauucaaaaaugaaagugauccagagggagcccugugguaa

SEQ ID NO: 21194 - RNA, 9879 nt, Artificial Sequence
  derived and/or modified CDS sequence (opt6) from DENV-1__JQ287664__SS-prME
ucugugacuauguuacuaaugcuuaugccuacggcuuuggcauuccauuuaacaacuagagggggagaaccacauaugauugugagcaaacaagaacguggaaaaucauuauuauuuaaaaccagugcaggaguuaauauguguacccuaaucgcaauggacuuaggugaacuuugcgaagacacaaugacguacaaauguccgaggauaaccgagguagaaccagaugacguagacuguugguguaacaccacagauacauggguuacauaugguacauguagccaaacgggagagcaucggagagacaaacgaucaguugcauuggccccacacguuggguuaggccuagaaacacgugccgaaaccuggaugucauccgagggagcguggaaacaaauccaacgaguugaaacuugggcucuuaggcacccaggauucacaguaauagcccuauucuuagcucacguaauagggacaucuaucacacagaaaggaauaaucuucauucuuuuaaugcugguuacuccaucuauggcaaugagaugcgucggaauaggaucacgagacuuuguugagggcuuaaguggugccacauggguagaugucguauuggaacauggcucauguguuacuacaauggcaaaagauaaaccaacauuggauaucgaguuguuaaaaaccgaagucacgaauccagccguucuacgaaaauuauguaucgaagcaaaaauaagcaauacaacuacagacucuagaugcccaacucaaggagaggcuacauuaguagaagaacaagacgcaaauuucguuugucgaaggacauucgucgaccguggcugggguaacggaugugguuuauuuggcaaaggcucauuaauaacuugugcgaaauucaaaugcguuacaaaauuagaaggcaaaaucgugcaguacgagaaucugaaauacaguguaauaguaacuguacacacuggcgaucagcaucagguaggaaaugaaaguaccgagcaugguaccacggcaacaauaaccccucaggcacccacgagugaaauacaacuuacagauuacggagcgcugacacuagacuguagccccagaacuggacuagauuucaaugagaugguguuacuaaccaugaaagagaaaucauggcugguucauaaacaaugguucuuggauuugccucuacccuggacuucaggagccucaacaagucaagaaacuuggaauaggcaagacuuacuugugacauuuaaaacugcccacgcgaagaaacaggagguuguaguucuagguagucaagaaggugccaugcauacggcguuaacaggcgcaacagaaauucaaacaucuggcacaacaacuaucuucgcgggacauuuaaaaugcagacuaaagauggacaaauuaacacuaaaagguaugaguuauguaauguguacgggaaguuucaaauuagaaaaggaaguugccgaaacucagcauggaacaguuuuagugcagauaaaguaugaagguacggaugcuccaugcaagaucccuuucuccacucaagacgaaaaagggguaacucaaaaugggagacuaaucacugcuaauccuauuguaaccgacaaggaaaagccaguuaacauugaagcggaaccuccauucggagaaucguauauagucauaggugccggugaaaaggccuuaaaauuguccugguuuaaaaagggcagcaguauaggcaagauguucgaggcuaccgcccgaggugcuaggaggauggccauauugggagauacagccugggacuucgggagcauaggagggguauucacaucuguagggaagcuagugcaucaaaucuuugggacagcuuaugguguucuguucucagguguuagcuggacaaugaaaauaggaaucggaguacuguuaacaugguugggauuaaauucacgcuccacgucucuuaguaugacaugcauagcgguagggcuaguaacccuguacuugggaguaaugguacaggcagacuccggaugugucauaaacuggaaggggcgugagcuaaaauguggaaguggaauauuuguuaccaacgaaguacauacuuggacagaacaguauaaauuccaagccgacucaccgaagagacuaagcgcagcuaucggaaaagcgugggaagaaggaguaugcggaauacgaagcgcuacgaggcucgaaaauauaauguggagacaaauaucgaaugaacuaaaccauauauugcucgaaaaugacaugaaauucacuguuguaguuggcgauguagugggaauacuugcacaaggaaagaaaaugauaagaccucaaccaauggaacacaaauauucauggaaaaguuggggcaaagcaaaaauaauaggcgcagauguacagaacacuaccuuuaucauugacggaccaaacacaccugaaugcccagaugaccaacgagcuuggaauauuugggaaguagaggacuauggauuugggauuuucacgacaaauauuuggcuaaaacuucgagacucuuacacacaaguaugugaccauagacuaaugucugccgcaauaaaagauaguaaggcuguacacgcggauaugggcuauuggauagaaucagagaaaaaugaaacuuggaagcuggcaagagcaucauuuaucgaagucaaaacauguaucuggccuaaaagccacacauuauggagcaaugguguccuugagagugagaugaucauuccuaaaauauauggcggacccauuucccaacauaauuaucgcccgggauacuucacucaaacagcgggcccauggcaucuuggaaaguuagagcuugacuucgaucuuugugaggggacaacgguugugguagaugagcauugugggaacagaggccccucacucagaacaaccacaguaacugguaagauuauacacgaaugguguuguagauccuguacacuuccaccccuuagguucaaaggcgaagacggcuguugguaugguauggaaauaagaccggugaaagagaaagaagaaaaccuaguaaaaucuaugguaucugccggcuccggcgaaguagacagcuuuucuuugggacuacuauguauuucuauaaugauagaggaggucaugagaucaagauggaguagaaaaauguuaaugacaggcacacuggcaguuuucuuucuuuuaauaaugggucagcuuacuuggaacgauuugauaagacuaugcauaaugguaggagcaaacgcaagcgaucgaaugggaaugggcacaacauaucuagcacugauggcgacauuuaaaaugcgaccaauguuugcaguuggacuccuauuccgacgguugacaucgagagagguccuccuucuuacgauaggucucagcuuaguugcgucuguagagcuaccaaacucauuagaagaauuaggagauggguuggcgauggggauaaugauacuaaaauuacuaacugauuuucaaucauaucaguuaugggcgacguuguuaucucuaacauucauaaaaacuacguuuagccugcacuacgccuggaagacuauggcuaugguuuuguccauuguaucacuacuaccccuaugccuaaguacuacgagucagaaaacaacaugguuaccaguauuauuaggaucccuagguuguaaaccucuuacaauguucuuuauagccgagaacaagaucuggggccggaagaguuggccccuaaaugaagggaucauggcaguaggcauaguuagcauacugcuuaguagccuccuaaagaaugauguaccucucgcagggccccugaucgccggagguauguuaaucgccuguuacgugauuucugggucauccgcugaucucagcuuagaaaaagccgcagaagucaguugggaagaggaagccgagcauuccggcgccagucauaauauuuuaguggaaguucaagaugacgguacaaugaagauuaaggaugaagaacgugaugauacauuaacaauucuauuaaaagcgacucuacucgcugucucuggaguuuauccgcuaucgauucccgcaacccuuuuugugugguauuuuuggcaaaagaagaaacaaagaucaggaguccuuugggauaccccuaguccuccagaaguugaaagagcaguauuggaugaugguauauacagaauuaugcagcgagguuuauuaggaagaucgcaaguaggaguggggguuuuucaagaaaauguauuccauacgauguggcaugucacucgaggugcaguccuaauguaucaagguaaacgccuagaaccaucaugggcuucuguuaagaaagacuuaauaucguacgggggcggauggagauugcaagguucuuggaacacgggagaagaaguacagguaauagcaguagaaccagguaaaaaccccaaaaauguccaaacagcacccgguacguuuaagacaccggaaggugaaguaggugccaucgcacuggauuuuaaaccaggaacauccggcucgccaauaguaaauagagaaggaaagauuguuggacucuacgguaauggugugguuacaacauccggaacguacgucagugcaauagcacaggcaaaggcuagucaggagggaccccuacccgagaucgaagacgagguauuuagaaagagaaaccuaacgauaauggaccuccacccagguucagguaagacacggaaguauuugccagcaauagugcgugaggcuaucaaaagaaagcuaaggaccuugauucuggcgccaacacguguaguggcaagugagauggcggaagccuuaaagggaaugccuauaagauaucagacaacugcuguaaaaucagaacacacggguagagaaauaguagaccucaugugccacgccacguucaccaugcgccuacuaagcccagucaggguaccgaacuauaacaugauaaucauggaugaggcgcacuuuacugauccgucuaguauagcagcuagaggauacauaucuacgaggguuggaaugggugaagcggcugcuauauucaugaccgcaacuccuccggggaguguugaagcauucccccaaagcaaugcagugauucaagaugaagaaagagacauuccugagaggucauggaacucaggcuaugaauggauaaccgauuuuccuggaaaaacuguaugguucguuccaucuauaaaauccggaaacgacauugcuaacugucugaggaaaaaugguaaacgcguaauacagcugucucgaaaaacauuugauacggaauaccaaaagaccaagaacaacgauugggacuacguugucacaacagacauuagugaaaugggcgccaacuucagagcagacagagucaucgauccacgcagaugucuuaaaccagucauuuuaaaggauggaccugaaagaguaauucuagcaggaccaaugcccguuaccguagcaucagccgcccaaagacgaggaagaauaggacgaaaucacaauaaagaaggcgaucaauauauuuacauggggcaaccucugaauaacgacgaagaccaugcacacuggaccgaggccaaaaugcugcuagauaauauuaauacuccugaaggcauaaucccugcgcuauuugaaccugaacgagaaaaaucugcugcaauagauggagaauaccgacucagaggagaagcaagaaaaacauuugucgaauuaaugcgacggggugaucuaccaguuuggcugucguacaagguggcuucggaagguuuccaguauagugacagacgcuggugcuuugauggugaaagaaacaaucaaguguuagaagaaaacauggacguggagauauggacuaaggaaggugagcggaagaaauuaagaccucggugguuggaugcaaggacuuacagcgauccgcuagcguuacgggaguucaaggaguucgccgcagggagaagaucaauaucgggcgauuuaauuuuagaaauagguaaacucccucaacaucuuacacagagggcacagaacgcauuagacaaccuuguuaugcuacauaacucugagcaaggagguagggcuuacaggcaugcaauggaagaauuaccagacacuauagaaacacuuauguuauuagcccuuauagcgguccugacuggaggagugacauuauucuucuuaucaggucguggauuagggaaaacaagcaucggccuucuaugugucauggcuucuagcgcauuacuauggauggcaucaguggaaccacacuggauagccgcuucaaucaucuuagaauuuuuccuaaugguuuuacucauucccgagcccgauagacagaggacaccacaggacaaucaauuggcauauguugucauuggucuacuauuuaugauauuaacgguagcagcuaaugagauggggcugcuggagacuacuaagaaagacuuagguauaggacacguagcaguggaaaaucaccaucaugcgacaauguuggauguggaucuucacccugccucagcuuggacuuuauaugcuguagcuacuacuauaauaacaccaaugaugaggcauacuauugaaaacacaacagccaacauuucacuuaccgcaauugcaaaucaagcggccauacugauggguuuagauaaagguuggccaauaaguaaaauggacauuggcgugcccuugcuugccuuaggcugcuauucucaaguuaacccguuaacauuaacagcugcagugcuaaugcucgucgcccacuaugccauaauaggucccgggcuacaagcgaaggcaacacgagaagcccaaaaacggacagcugcagguaucaugaaaaauccuacaguagacggcaucguagcaauugauuuagauccaguuguuuacgacgcaaaauuugaaaaacaauugggacaaaucauguuacucauucuaugcacuucacaaauucuauuaaugcgcacaacaugggcacucugugaaaguaucacgcuugcgaccggaccgcugacuacacuaugggaaggaaguccaggaaaauuuuggaacacuacaauagcugugucgauggcaaacaucuuccgaggaucauacuuagcuggugcaggccuugcuuucucacugaugaaaucacuaggagguggcaggagagguacaggugcccaaggcgaaacauuaggagagaaauggaaacgacaauuaaaucaguuaucaaaaagugaauuuaauacuuacaaaagaagugguauucuugaagucgauagaagcgaagccaaagaaggauuacggcggggagaaacuacaaaacacgcgguaucucgugguacagcuaaacuccgaugguucguagaaaggaaccuugucaaaccagaaggaaaaguaauagauuuggguugcgggagaggggguugguccuacuacugugcaggccuaaagaaaguaacugaaguaaaagguuauacaaaaggcggacccggacacgaggagcccauaccgauggcaacuuacgguuggaaucucguuaaacuucacucaggcaaagauguuuucuuuauaccgccugagaagugugacacgcuauuaugugacauaggugagaguucgccgaaucccacuauagaggaagguagaacauugcguguacucaaaaugguugaaccuugguuacgugguaaccaauuuuguauuaaaauuuuaaacccauauaugccaucuguaguagaaacucuagaacaaaugcaacgaaaacacggagguaugcucguacgcaauccacuauccagaaauagcacgcaugaaauguauuggguuucauguggaacuggaaacauaguauccgcaguaaacaugacauccaggaugcugcuaaauagguucaccauggcacaccgaaagccaaccuaugagcgagacguugauuuaggagcgggaacaagacacguugcgguagaaccugagguagccaaccuggauaucauaggucaacggauugaaaacauaaagcaugaacacaaaucaacauggcauuaugacgaagacaauccuuauaaaacaugggcauaucaugguuccuaugaagucaaaccuaguggcagugcuucaucaauggugaauggugugguuaaauuauuaacaaaaccaugggacguuauucccauggugacgcaaaucgcaaugacagauacgacaccguuuggccaacagcgaguauucaaagaaaagguagauacacgaacgccaaaagcgaaacguggaaccgcgcaaauaauggagguuacggcuaggugguuauggggauuccucucuagaaauaagaaaccacguaucuguacaagagaagaauuuacacggaaaguaagaaguaaugcagcuauuggagcuguauuuguagaugaaaaccaauggaacagugcaaaggaagcuguagaagacgaaagauuuugggaccuaguacacagagaaagggaacuacacaaacaagggaaaugcgcuacaugcguauauaacaugauggguaaaagagagaagaaauuaggagaauuuggcaaagccaaggguucaagggcaauuugguacaugugguuaggugcccgauuccuagaauuugaagcacugggauucaugaaugaagaucauugguuuaguagagaaaacucucuaagcgguguagaaggagaaggccugcacaaauuaggguauauccuacgugauauuucaaagauacccgggggcaacauguaugccgacgacacagcagguugggauacuaggauaacugaagacgaucuacaaaaugaggcuaaaauaacagauaucauggaaccagaacaugcguuauuagccacuagcauauuuaagcuaacuuaccagaacaaaguugucagaguucaaagaccagccaaaaauggcaccguaauggauguuaucucaaggagagaucagagaggaagcggacagguuggcacauacgggcuuaauacguucacaaacauggaagcucagcuaaucagacaaauggaaucggaaggcauuuucucacccuccgaauuagaaacaccgaauuuagccgaaagggugcuugacugguuagagaaauacggaguagaacguuugaaacguauggccauaagcggggaugacuguguaguuaaacccauagaugaucgauucgcaacagcacugacugcucuaaacgacaugggcaaaguaagaaaagauauuccccaaugggaacccaguaaaggauggaaugauuggcaacagguaccuuuuugcagccaccauuuccaccaauuaaucaugaaagauggacgagaaauugugguaccaugcagaaaucaggaugaacuuguaggacgggcucguguuucacagggcgcaggcuggucacucagagagacagcuugucuagggaaaagcuacgcucaaauguggcaauuaauguauuuucauaggcgugacuuaagacucgccgccaacgcaauauguucugcaguuccuuucgauugggucccuacuagccguacuacguggaguauacacgcacaucaucaauggaugacaacagaagacauguuaagcgucuggaaccgcguguggauugaagaaaacccauggauggaagauaaaacacauauaucaaguugggaagacguaccauacuuaggaaagcgugaggaucaaugguguggcagcuuaauuggguuaaccgcucgagcaacaugggccacaaauauacagguagcaaucaaccaggugagaagacuuaucgguaaugaaaacuaucuagauuauaugacaagcaugaaaagauucaaaaacgaaagcgauacugaaggagcauuaugguaa

SEQ ID NO: 21195 - RNA, 9879 nt, Artificial Sequence
  derived and/or modified CDS sequence (opt6) from DENV-1__FJ639683__SS-prME
ucaguuacaaugcugcuuauguuaaugccaacugcacuggcauuucaucuaacaacuagaggaggagagccucauaugauuguaucaaaacaagaacgugggaaauccuuacuuuuuaaaaccagugcuggaguaaauauguguaccuuaauugccauggaucuuggagaauuaugugaagauacaaugacuuauaaauguccuaggauaacugaagccgaaccggaugacguugauugcugguguaaugcaacagacacaugggugacauaugguacuuguucacaaacuggggaacaccguagagauaaaagaucuguggcgcucgcuccucauguaggacuaggacuggagacaagaacagagaccuggaugaguucagaaggugcuuggaaacaaauacaaagagucgaaacaugggcacuaagacacccaggauucacgguaauagcauuauuuuuagcucaugcaauagggacuagcauuacacaaaaaggcauaaucuuuauauuauugaugcuaguaacuccgagcauggcuaugcguuguguaggaauaggauccagggacuuuguugaaggccugucaggugccacguggguagaugucguucuggaacauggaaguuguguaaccacuauggcgaaagauaaaccgacgcuagauauugagcuucuuaaaacagagguaaccaauccugccauauugagaaaauuguguauugaggcaaaaaucucaaauacaacgacagacucgagaugccccacgcaaggugaagcaacgcuuguagaggaacaagaugcgaacuuuguaugccgccgcacauuuguagaccgaggauggggaaaugguuguggauuauuuggcaaaggaucacucauaacuugcgcuaaauuuaaaugcguaacgaaacuugaagguaaaauugugcaauaugagaaucuaaaauauagcgucauaguaacugugcacacuggagaucaacaccaaguugggaacgaaaguacugagcauggaacaacugcaacaauaacgccacaagcaccuacuacagaaauccaauuaacagacuacggggccuuaacacuagacuguucaccgaggacagguuuagacuuuaaugaaaugguccuauugaccaugaaggaaaaaucuuggcuaguucacaaacagugguuucuagacuugccguuaccauggaccagcggggcaagcaccucacaagagacauggaacagacaggaucuacugguaacuuuuaaaacagcacacgccaagaaacaagaagucgucguauuggguucccaagaaggagcgaugcauacugcguugacaggagcaacagaaauacaaacaucgggcacaacaacuauauucgcugggcacuuaaaauguagacucaaaauggauaaacucacuuuaaaaggcaugagcuauguaaugugcaccggauccuuuaaauuggaaaaagaagucgcagaaacacagcauggaacaguguuaguacaaauaaaauacgaagguacagacgcaccaugcaaaauaccauucucuacgcaagaugaaaaggguguaacucagaacggccgucuaauuaccgcuaauccuaucguuacugauaaagaaaaaccaguuaauauagaagcugagccuccguuuggcgaauccuauaucguuauaggcgccggugagaaggcauuaaaauuaaguugguuuaagaaaggaaguucaauuggcaaaauguuugaagcgacagcaaggggagcacgacgaauggcgauuuugggugacacagcgugggacuucgggucaauaggagggguuuuuacaaguguagguaaauuggugcaccaaauauuuggaacugcauacggaguauuauucucaggcgucagcuggacuaugaaaauagguauaggaguccuauugacgugguuaggucucaacagcaggaguacgagcuuuaguaugacaugcauugcuguuggacugguaacuuuauaccucggcguaauggugcaagcugauagcgguuguguaauaaacuggaaaggacgagagcuuaaguguggcagcggcauuuuugugacaaaugaaguucauacuuggaccgaacaauauaaguuucaagcugauaguccaaaaagacuauccgcugcgauuggcaaagcaugggaagaaggcguguguggcauaagaucagccacuagacucgagaauauaauguggaagcagauaucaaaugaacugaaucauauacuucuagaaaacgacaugaaauuuacaguaguuguaggagacguagcaggcauacuugcucaaggcaagaaaaugaucaggccgcaaccaauggaauauaaauacucuuggaaaaguugggguaaagcaaaaauuauaggagcagauguacaaaauacuaccuuuauuaucgauggaccgaacacgccagaaugcccugaugaucaacgagccuggaacauaugggaaguagaagauuauggcuucggaauauuuacgacaaauauuuggcuuaaauuaagagacucauauacacaagugugugaccauagacuuaugucagcagcaauaaaagauaguaaggcgguucaugccgauaugggauacuggauagaaucugagaaaaaugaaacuuggaaacuggcaagagccaguuuuauugaaguaaaaacguguauauggccaaaaucucacacacuauggucaaauggaguacuagaaucugagaugauaauaccaaaaauuuauggcggaccaauaucucaacauaauuauaggcccgguuacuucacgcaaacagcaggaccauggcauuuaggaaaauuggagcuugacuuugacuugugugagggaacgacaguaguugucgacgaacauugcgguaaucgcggaccgucauuacgaacaacaacaguuacaggaaagauuauucacgaaugguguuguagaaguugcacccugccgccucuccguuuucguggcgaagaugguuguugguauggcauggaaaucaggccagugaaagaaaaagaggaaaaccuaguaaaaucgcuaguaagugcaggaagcggcgaaguagauucuuuuucauuaggguuacuuugcauuagcauuaugauugaagaaguuaugagaucccguuggucucguaaaauguugaugacagggacauuggcuguauuccugcuuuuaauaaugggccaguuaacuuggaacgaucucauuagauuaugcauuaugguuggagcuaacgcuagcgacaggauggguauggggacgacauaucuggcauuaauggcuacauuuaaaaugcgaccaauguuugcagucggcuuauuguuuagacguuugacaagccgcgaaguauuacuucuaacuauuggcuuaagccugguagcuucaguugagcucccaaacucguuagaagaacucggagacggucuugcaaugggaauaaugauacuaaaacuacuuacugauuuucaaucgcaccaauugugggcuacguuauuaagucucaccuuuauuaaaacuacauucucacuacauuaugcauggaaaaccauggcaauggugcuauccauaguaucguuauuuccauugugccuuucuacuacgucacagaaaacaaccuggcuuccagucuuguugggaucucuuggauguaaaccacuaacaauguuccuaauagcugaaaauaagauauggggucguagaucauggccucuuaaugaagggauuauggcuguagguauagucucuaucuuauuaucuagcuuauuaaagaaugacgucccacucgcugggccauuaauagcggguggaauguuaauagcguguuaugucauuucagguucaucagcagauuuaucgcucgagaaagcggcugaaguuucaugggaagaagaggcagaacauaguggagcaucucacaauauccuaguagagguucaagaugaugggacaaugaaaauaaaagaugaagaaagagacgauacccuaacaauacuucucaaggcgacccucuuagcaguuagcggaguauauccacuaucuauaccugcgaccuuguuugucugguacuucuggcagaagaagaaacagagaucugguguacucugggacacuccuucaccuccagaaguagaacgcgcaguuuuagacgaugggauuuacaggauuaugcaacgaggccugcuuggucgaucucaaguaggaguaggagucuuucaagaaaacgucuuccacacuauguggcauguuacacggggugccgugcugauguaucaaggcaaaagguuagaacccaguugggcaucggucaagaaagacuuaauuucauacggaggcggauggagacuacaagggagcuggaauacaggcgaggagguacaaguaauugccgucgaacccggcaagaaccccaaaaauguacaaacagcaccuggaaccuucaaaacaccugagggugaagugggagcuauagcacucgauuuuaaacccgggacaagugguucgcccauagucaaccgugaaggaaagauugugggacuauaugggaacggugucguaacaacaucaggaacauacgugucagcaauagcacaggcgaaggcuucgcaagaggggccacugccggagaucgaagacgaaguauuuagaaaaaggaaucuuacaaucauggaccuacacccaggaaguggaaagacacgucgauaucuaccggccauuguuagagaagccauaaaacguaagcuaagaacgcucauuuuagcaccaacaagagugguggcaagugaaauggcugaggcccuuaaagguaugccuauucguuaccaaaccacugcaguaaagucugagcauacaggaaaggaaauaguugauuugaugugccacgccacauuuacuaugagacuacuaaguccaguuagagucccaaauuacaacaugauaauaauggaugaagcccacuucaccgauccgucauccauugcggcgagaggauacauuuccacucgaguagguaugggcgaagcggccgcuauauuuaugacggcuacaccucccgguucaguugaggcuuucccucagucaaacgccguuauacaagaugaggaaagagacauaccagaacguaguuggaacucagggcaugaauggauaaccgauuuuccugguaaaacuguaugguuuguaccaucgaucaagaguggaaaugauauugcuaauuguuugagaaagaaugguaaaaggguuauccaauugagccggaaaaccuucgauaccgaguaucagaaaaccaaaaauaaugacugggacuacguaguaacaacggacauaucggagaugggugcaaauuuuagggcagacagaguuaucgacccgaggcgaugucucaagcccgucauucuaaaagaugggcccgaacgcgucauauuggcaggacccaugccaguaacaguugcauccgcagcccaaagaagagguaggauaggacgaaaucauaacaaggaaggcgaucaauacaucuacaugggccaaccacuuaacaaugaugaagaucacgcccauuggacggaggcaaagaugcuacuggauaacaucaauacaccggaaggcauaauucccgcacuguucgagccagagcgagagaaaucagccgcaauugauggcgaauacagacuuaggggcgaagcucgaaaaacuuuugucgagcugaugagaagaggugaucuuccugugugguuaucguauaaaguagccucagaaggcuuucaguauagugacaggagaugguguuucgauggugaaagaaacaaucaaguccuagaagaaaauauggacguagaaauauggacaaaggagggugagaggaagaaacuaagaccacgauggcuggacgcaaggacguauucagauccacuggcucucagagaguucaaagaauuugcagcaggacgaagaaguguuucuggggaccuuauccuagaaauugggaaacuaccgcagcaccuuacgcagagagcucaaaacgcauuagacaacuuagucauguuacauaauucagagcagggagggcgagcauacagacaugcuauggaggaacuacccgauacuaucgaaacccuaauguuacuagcauuaauagcaguauuaacaggaggaguaacgcuauuuuuccuaucaggacggggcuuggggaaaacgaguauuggauuacuuugcgugauggccucgaguguucuccuuuggauggcaucaguagaaccacauuggaucgcugccagcauaauccuugaguucuuuuuaaugguccucuuaauaccagaacccgauagacaaaggacaccucaagacaaucaacuggcguaugucguaauaggacugcucuuuaugauauugacaguugcagcuaaugaaaugggcuugcuggaaacaaccaagaaagacuuaggaauuggccauguagcagucggaaaucaucaucaugcagcgauguuggaugucgaccuccacccggccuccgccuggacacuauacgcuguagcaacgacaauaauaacucccaugaugaggcauacaaucgaaaauaccacagcuaauauaagucuuacugccauugcgaaucaagcggcaauacuuaugggguuagauaaaggauggccaauaucaaaaauggacauaggcguaccacuacuagcauuagguuguuacucccaagucaacccauuaacgcuaacggcugcuguacuuaugcuggucgcccauuacgcaauuauugguccuggccuccaggccaaagcaacgagagaggcgcaaaaacgaacggcagcuggaauaaugaaaaauccgacaguugaugggauagucgcaauagaccuagacccaguaguuuaugaugcgaaauuugaaaaacagcuaggacagauuaugcuacucauccugugcacaagucaaauucuccuuaugcgaacuacuugggcccuuugugaguccaucacacuagcaacaggcccgcuaacaacucuuugggaagguagucccgguaaguuuuggaauaccacaauugcaguaagcauggccaauauauuuagaggcucauaucuggccggugcaggucuagcauucucuuuaaugaaaagccuaggagguggaagaagaggaacaggagcacagggcgagacauuaggugaaaaauggaaaaggcaacuaaaucagcuaucaaaauccgaguucaauacguacaaacgaaguggcauaauggaaguugaucgauccgaggcuaaggaagggcucaaaagaggggaaacuacaaagcaugccguaucaagaggaaccgcuaaacuucgaugguuuguggagcgcaauuuaguaaaaccugaggguaaaguaaucgauuuagguuguggaagaggaggguggucuuauuauugugcaggcuuaaagaaagucacugaaguaaaaggauauacaaaagggggcccaggacaugaagaaccaauuccuauggcuacauauggauggaaucuggugaaacuacacagcggaaaagauguauucuuuguuccaccugaaaaaugugacacucugcuaugugauauuggagaaaguaguccaaacccaacuauagaagaggggcgaacccuucgaguuuuaaaaaugguugaacccugguuacggggaaaucaauuuugcauaaaaauauugaauccauauaugccuucgguaguagagacucuugagcaaaugcaacgcaaacauggaggaaugcucguaagaaauccccuaucaagaaacucaacacaugagauguauuggguaaguugcggaacagguaacaucguuucagcagucaauaugacuucucggaugcuucuaaaucgcuucacgauggcacauaggaaaccgacauacgaaagggacguugacuugggggcaggaacuagacaugucgcugucgagccagaaguagccaaccuggacauuauaggacagagaauagaaaacauuaagcacgaacauaaaaguacuuggcacuacgacgaagauaauccguauaaaacuugggcguaucauggaaguuacgaagucaagccaucaggaucggcauccucuaugguuaauggaguggucaaauuacuaacuaagccgugggaugugauuccuaugguuacacagauagcuaugacagauaccaccccguuuggucagcaaagagucuuuaaagaaaaaguugauacgcgaaccccaaaagcaaagcggggaacagcccaaauaauggaaguuaccgcuaaauggcuuuggggguuucuuucacgaaacaagaaaccccgaauuugcacaagggaagaguuuacucgaaaaguacgaucaaacgcagcaauaggggcggucuuuguagaugaaaaucaauggaacucagcgaaggaggcaguggaggacgaaagauucugggacuuggugcaucgugaacgcgaauuacauaagcaggggaaaugugcuacuuguguauacaacaugauggggaaaagagagaagaaacuaggggaauuuggaaaagcaaagggaagcagggcgauaugguauaugugguuaggcgcaagauuuuuggaauuugaagcguugggauucaugaaugaggaccauugguuuucucgagagaauaguuuaucaggcguagaaggugaaggguuacacaaacuugguuauauacucagagauauaucaaaaauaccuggcgguaacauguacgcugacgauacggcuggaugggacacuagaauuacugaggaugauuuacaaaaugaagccagaaucacagauauaauggaaccugagcaugcuuuguuagcuaagucgauauucaaauuaacguaucagaauaaagugguaagaguccaaaggccugccaaaaaugguacuguaauggacgugauauccagaagggaccaacgaggaagcggacaaguggguacauaugguuuaaauacauuuacgaacauggaagcacagcuaauaagacaaauggaaucggaaggaauauuuucccccuccgaacuagaaacaccaaacuuagcagaaagaguccuagauuggcuggaaaaauaugguguagagaggcuaaaacguauggcuauaucaggcgacgauuguguaguuaaacccaucgacgaucgauuugcgacagcccuuacagcccuuaacgauauggggaaaguaagaaaagacauaccacaaugggaaccuaguaaaggcuggaaugauuggcaacaaguaccguuuuguucacaccauuuccaccaacuaauaaugaaagacggaagagaaauuguaguuccaugucgcaaucaggaugaauuagugggacgugcgaggguaucacaaggagcggguuggagcuuaagagagacagccugucuaggcaagagcuacgcucaaauguggcaguugauguauuuccauaggcgggaucuacgacucgcggccaaugcaauauguucggcgguuccaguugauuggauaccuaccucaaggacaacuuggucaauacaugcgcaucaccaguggaugacaaccgaagauaugcucuccgucuggaauaggguauggaucgaagaaaaucccuggauggaagauaaaacacacauuaguucuuggggcgauguaccuuaucuaggaaagcgugaagaucaaugguguggcaguuuaauagggcugacugcacgcgcuaccugggcaacaaauauucaaguugcaauaaaucaaguaagacgguuaauuggcaacgaaaauuaccuugacuauaugacuucaaugaaacguuuuaagaaugaaagcgauccagagggagcacuuugguga

SEQ ID NO: 21196 - RNA, 9879 nt, Artificial Sequence
  derived and/or modified CDS sequence (opt6) from DENV-1__FJ639684__SS-prME
agugugacgauguuauuaaugcuaaugccuacugcauuagcauuucaucuuacgacaagagggggagaaccccacaugauaguuucaaaacaagaaagaggaaaaagccuacuuuucaaaacgagcgcgggagugaauauguguacgcuaauugccauggauuugggugaguucugugaagauacgaugacauacaaauguccacgaauuucagaagcagaaccugacgacgucgacuguugguguaacgccacagauacuuggguaacauauggaacuuguucacaaacaggagaacauagaagagacaaaagaaguguugcacuagcaccccacguuggacucggccuugagacccgcacagaaacauggaugucuagcgaaggugccuggaaacaaauacaacgaguugaaacgugggcauuacgacacccgggauuuacaguaauugcgcuauuuuuagcacacgcaauaggaacuucgauaacacagaaagguauaauauuuauacuauuaauguuagugacacccagcauggcaaugagaugugucggaauaggaaguagagauuucguagaaggacucucuggcgcaacauggguggauguuguuuuggagcauggaagcugcguuaccacaauggcaaaagacaaaccaacguuagauauugaauuacuuaaaacggaaguaaccaacccugcggucuuacgcaaacuaugcauugaagcgaaaaucaguaacacuacuacugacaguagaugccccacacaaggggaagcuacacugguagaagaacaagacgcaaauuuuguuugcagaagaacauucguagaccgaggaugggggaaugguugcgguuuauuugguaaaggaucuuuaauaacaugugccaaauuuaaaugcgucacaaaacuggagggaaaaaucguccaauacgaaaaucuaaaauacucugucaucguaaccguucauacgggcgaccaacaucaaguggggaacgagaguacugaacauggaacaaccgcaacgauaacaccucaggccccaucaacagaaauacaacuuacagacuacggugccuuaacauuagacugcaguccacgaacaggacuagauuuuaacgagaugguauuguuaacaaugaaagaaaaaucuugguuaguucauaaacaaugguucuuggaccucccucuuccauggacaaguggcgccucuacaucucaagagaccuggaaccgccaagaucuacucguaacuuuuaaaacagcacacgcaaagaagcaagaagucguuguguugggaucucaagaaggugcgaugcacacggcguuaaccggggcaacugagauacaaacgagcggcacuacaacaauauucgcaggacaccuuaaauguagguuaaaaauggauaaacuuacacugaaaggaaugaguuauguaaugugcacugguagcuucaagcucgaaaaagaaguugcagaaacacaacacggaacuguuuugguacaaauaaaauacgaaggaaccgacgcuccaugcaaaauaccauuuucuacucaggacgaaaagggugugacucagaacggaagauuaaucacggcuaaccccaucgucacggacaaagaaaagccaguuaauauagaggcugagccgccauuuggagaaagcuauaucguaauaggugcuggagagaaagcgcuaaagcucucaugguucaaaaaggguaguagcauuggcaaaauguuugaagcaaccgcccggggagcaagaaggauggcaauauugggcgauacagcgugggacuuuggaaguaucgggggaguguuuaccucaguaggaaaacucguucaccaaaucuucgguaccgcauaugggguccuauuuuccggaguuagcuggaccaugaagauagguaucgggguuuugcuuacauggcuaggucuuaacagcagaaguacaucucugucaaugacuuguauagcagugggacucgucacacuuuaucugggagucaugguacaagcugacaguggguguguaauuaauuggaaaggccgugaacuuaaaugcgggucaggcaucuuuguaacgaacgagguucauacuuggacugaacaauauaaguuucaagcggacagcccuaagagauugagcgcagcaauagguaaagcgugggaagaagguguuugcggaauacguuccgcgacaaggcuugaaaauaucauguggaagcaaauuucuaaugaacugaaucacauacuguuggaaaacgauaugaaguucacggucguaguaggugauguugccggaauccuagcacaaggcaaaaagaugauuagaccucaaccaauggaauacaaauauucauggaagaguuggggaaaagcuaagauuauuggagcugacguacaaaauacuaccuuuaucauagacggaccaaauacaccugaaugccccgaugaccaaagagcuuggaacauaugggaagucgaagauuacgguuucgggauuuuuacaacuaacauuuggcuaaagcuaagagacucauauacucaaguaugcgaucacagacuaaugucagcagcaauuaaagauagcaaagcaguucaugccgauaugggcuacuggaucgaauccgagaaaaaugaaacauggaagcuagcgcgagcaucauucauagaaguaaaaacaugcaucuggcccaagagucauacgcuuuggucgaauggcguauuagaaagcgaaaugauaauaccuaaaauauauggcggaccaauaagccaacauaauuauagaccaggauauuuuacccaaacggccgguccguggcaucuaggcaaacuugaauuagacuuugaucuaugcgaaggaaccacaguaguuguggaugaacacugugggaauagaggaccuaguuugcgcacgacuacuguuaccggcaaaauaauacaugaauggugcugucguagcuguacuuuaccaccccucagauucaaaggagaagacggauguugguacggaauggaaauccggccaguaaaagaaaaagaagaaaaucucguaaaaaguaugguaagugccggaucuggagaaguagacucguuuagcuuaggguuacuuugcauaucuauaaugaucgaggaagugaugagaagucgcuggucucgaaagaugcugaugacaggcacauuggccguguuuuucuuguuaaucaugggacaauuaacguggaaugauuugaucagacuaugcauuaugguaggagcaaacgcuagugaucgcauggguaugggaaugacuuaucuagcccuaauggcuacauucaaaaugcgucccauguuugccgugggcuuguuguuuaggcgucuaacuagcagagaaguuuugcuauuaacaauaggacugucccuuguugcuuccguugagcugccuaacuccuuggaagaacuaggagacggucucgcaaugggaauaaugauccuuaaacuauuaacugauuuccaaagucaucaauuaugggcaacuuuauuaagccuaacauuuaucaaaacuacauucagucuccauuaugcauggaaaaccauggccaugguacuuaguauuguaaguuuauucccccuuugucugaguaccacaucgcaaaagaccacaugguugccgguauuguuagguucacuggguuguaagccucuuacuauguuucuuauagcggaaaacaaaauauggggaagaaaaaguuggcccuugaaugaaggaauaauggccguuggcauugugagcauccuccucucaucuuuauuaaagaacgaugucccacuagcaggaccccuaauagcgggcggcauguuaauugcuuguuauguuauaaguggcucaucggcagauuuaucuuuagagaaagcggcagaagugucuugggaagaagaggcugaacacaguggggcuagucauaacauccuuguggaaguccaagacgacggaacaaugaaaauuaaggacgaagagagagaugauaccuuaacaauauuacuaaaagcgacacuauuagcagugagugggguauacccguuaaguauaccagcuacgcuauuuguuugguauuuuuggcagaagaagaaacaacgaagugggguguuaugggacacuccuucuccgccagaaguagaaagagcaguauuagaugauggaauuuaucgaauaaugcaacgaggccuauuaggucguucucaaguaggaguagguguguuccaagagaacguuuuccauacaauguggcauguuacuaggggcgcagucuuaauguaccaaggaaaaagacucgagccaucaugggccucugucaagaaagauuuaauuucauauggaggagguuggaggcuacaagguagcuggaauacaggggaagagguucaagucaucgcaguagagccagguaagaaccccaaaaauguacaaacagcaccuggaacauuuaaaacauccgaaggugaaguaggugcuauagcacuagauuucaagcccggcacaucaggaucaccgauaguaaauagagaaggcaaaauaguaggcuuguauggaaacggaguaguuaccacaaguggaacuuauguuagugcuauugcacaagcaaaagcaagucaagaaggccccuuaccugaaaucgaggaugaaguauucagaaaaagaaauuugacaauaauggaucuacacccagggaguggaaaaacuagacguuaccuaccugcuauaguacgggaagcaauuaaaaggaagcuacguacacuaauuuuagcuccaaccaggguaguugcgucugaaauggccgaagcgcugaaggguaugccuaucagauaccagacaacagcgguuaaaagugaacauacggggaaagaaauaguagauuuaaugugccaugcaacauuuaccaugagauugcuaaguccugugagaguaccuaacuacaauaugauuaucauggaugaagcccauuuuacugauccuagcucaauagcagcgagagguuacaucaguacacguguaggaaugggugaagcugcugcaauauuuaugacggcaacaccaccggggucagucgaggcauuuccacaaagcaacgcaguaauucaagaugaggagagggacauaccggagagaaguuggaacaguggcuaugaauggauuaccgacuucccaggaaaaacuguaugguuuguuccgucaauuaaaucugguaaugacauugcgaacugcuugaggaaaaaugguaagcguguaauccaacuaucaagaaagaccuucgacacugaguaucagaaaacuaaaaacaacgacugggacuauguaguuacuacggacaucucugaaaugggagccaauuuuagggccgauagaguaauagacccgcgacgguguuuaaaaccaguuauauuaaaagauggaccagaaagaguaauucucgcagggccaaugccugucacugucgcgagcgcugcucaaagacggggucgaaucggacgaaaucauaauaaagaaggagaucaauauauauauaugggccaaccacuuaauaaugacgaggaucaugcacauuggacagaagcaaaaaugcuuuuggauaauauuaauacgccagaaggaauaauaccagcauuguuugaaccggagcgagaaaaaucagcggccauagauggugaguauaggcuuaggggagaagcgagaaagaccuucguagaauuaaugcgaaggggugaccuaccuguauggcugaguuauaaaguugcuucagaagguuuccaauauagcgauagaagauggugcuucgacggagaaagaaauaaucaggucuuagaagagaauauggauguugaaaucuggacaaaggaaggugaaaggaagaaauugcgaccaagauggcuugaugcuagaacguacuccgauccucuggcuuuaagggaauuuaaagaauuugccgcagggcgcaggagcguuucaggcgauuugaucuuagaaauagggaagcuaccacaacauuuaacccaaagagcccagaacgcgcuugauaaccuaguuaugcuacauaauucagaacaagguggccgggccuaucgucacgcaauggaagaauugccggacacuauagaaacacuaaugcuacuugcccugaucgcgguucuuaccgguggugucacauuguucuuccuuucuggaagaggucuaggaaagacaucgauuggacuauuauguguaauggcuucaucaguacuacuuuggauggcgucagucgagccacacuggauugcugcaagcauaauccuagaauuuuucuugauggugcuucuaauuccggaaccugaucgccaacggacaccucaagauaaccagcuagcauacguaguuauagggcuucuuuuuaugauuuugacgguggcagcaaacgagauggguuuauuagaaacuacaaagaaagaccuaggcauaggccacguggccguugaaaaucaucaucaugcagcuaugcuagauguagaucuucacccugcgucugccuggacacuguacgcuguugcaacgacaauaaucacuccaaugaugagacauaccauagaaaauaccacggcgaacauaucucugaccgcaauugcuaaucaagcggcuauuuuaaugggguuagacaagggauggcccauuucgaagauggauauagguguuccacuacuagcacuagggugcuauucccaagugaauccuuugacauuaacagcagccguauuaauguuaguagcacauuacgcaauuauaggaccaggacuacaagcuaaagcuacgcgugaagcacaaaagagaacggcggcugggauuaugaaaaauccuacaguggacggaaucguugcuaucgaucuggacccaguaguguacgaugcaaaauucgaaaaacaauugggacagauaaugcuauuaauauuauguacaagucagauacuucuuaugagaacaacuugggcucuuugugaaagcauuacacuugcaacgggacccuuaacaaccuugugggaagguuccccaggaaaauucuggaauacaacaauugcagugucaauggcaaauauuuuuagagguagcuacuuagccggugcggggcuggcguucucucuaaugaaaucacucggugggggaagacgugguacuggagcucagggagaaacucucggcgaaaaauggaaaagacagcuuaaccaacuuagcaaaucggaauuuaauacauauaagcguagcggaauuauggaaguagauagaucagaagcgaaggaaggcuugaaacgcggagaaacgaccaaacaugcggucucaagggggacagcgaaauuaaggugguuuguagaaaggaauuugguaaagccagaagggaaaguaauugacuuggguuguggucgugguggcuggaguuauuacugcgcuggacugaagaagguaacagaagucaaaggguacacuaaagguggcccaggacacgaagaaccaauaccaauggcaacauauggauggaacuuaguuaaacuccauucugggaaagacguauucuucguuccacccgagaaaugcgauacacuccuaugcgauauaggggaaaguagcccaaauccaacaauugaggagggcagaacauugcguguucuaaaaauggucgaacccuggcuuagagguaaccaauuuugcauuaaaauacucaauccauacaugccaucagugguagaaacucuugaacaaaugcagagaaagcauggcgguauguugguaagaaauccauuaagccggaacuccacacacgaaauguauuggguuaguugugguacggguaacauuguuagugcaguuaauaugacgucacgaaugcuguugaauagauuuacaauggcacauagaaaaccaacguaugaaagggacguagauuuaggagcagggacgagacacguugcgguagagccagaaguagcaaauuuggacauaauaggucaacgaauagaaaacaucaagcacgagcacaagagcacuuggcauuacgaugaagacaacccauacaaaacaugggcauaucauggauccuacgaaguaaagccguccggcucugcaagcaguaugguaaacggagucguuaaauugcuuacgaagccaugggacgugaucccaauggucacacaaauugcaaugaccgauaccacuccuuucggucagcaaaggguauuuaaagaaaaagucgacacaagaacacccaaagcaaaaagagguacugcacaaauaauggaggucacugcaaaauggcuauggggauuccuaucacgaaauaagaaaccaagaauuugcacuagagaagaguucacaagaaagguaagaucuaaugcagccauaggagcuguauucguggaugagaaucaauggaacucugcuaaagaagccguugaggacgaaagauuuugggaucuaguccacagggaacgugaauuacauaaacaagggaaaugugcaacguguguuuauaauaugaugggaaaaagagagaaaaagcucggggaguucggaaaagcgaagggcucuagggccauuugguauauguggcucggcgcgcgauucuuagaauuugaggcuuuaggguuuaugaaugaagaucauugguucucacgggaaaacucuuugucuggcguggaaggugagggccuacacaaguuagguuauauacucagagacauaaguaaaauaucuggagggaauauguacgcugacgauacggcgggaugggauacccgcaucacagaagacgauuuacaaaaugaagccaaaauaaccgacauaauggagccggagcacgcuuuacuugccaaguccaucuucaaacugacuuaccagaauaaaguuguucgugugcaaaggccagcuaaaaauggcacaguuauggauguuauuucuaggagggaucaacgaggaucaggacaagugggcacuuacggguuaaauacguuuacaaacauggaagcccagcucauuagacagauggagucggaggggauauucagucccucugaauuagaaacaccaaacuuagcagaacgugcucuagauugguuagagaagcauggaguugagagacugaaaaggauggcgauuucgggagacgauugcguaguaaagccaauagacgaucgguucgcuacggcacuuacugcccuaaacgauaugggaaaggugagaaaagacauuccacaaugggaaccgucgaagggauggaaugacuggcagcaagucccauucuguucgcaccacuuccaucaauuaauaaugaaagacggcagagagauuguuguaccaugccgaaaucaagaugaguuaguuggcagggcccgaguuucccaaggagcaggauggucucuuagggagacugccuguuuggggaaaaguuaugcucaaauguggcaacucauguauuuucaucgucgugaucuuagguuagcagccaaugcgauuuguucagcuguuccaguggauugggucccaacaaguagaacuacuuggucuauacaugcucaucaucaauggaugacgacagaagauaugcuuaguguuuggaauagaguauggauagaagaaaauccuuggauggaagacaaaacacacauaagcaguugggaagacguaccuuacuuaggaaaacgcgaagaucaauggugugguucucuuauagggcuaacggccagagcuacaugggcuacuaauauacaggucgcaauaaaucagguccgcaggcuaauugguaaugaaaacuauuuagacuacaugacaaguaugaaacgauuuaaaaaugagucagucccagaaggagcucuaugguag

SEQ ID NO: 21197 - RNA, 9879 nt, Artificial Sequence
  derived and/or modified CDS sequence (opt6) from DENV-1__FJ639685__SS-prME
ucugugacaauguuacucaugcuaaugccaacagcacuagcuuuucaccuaacgacucgagggggagagccacacaugauaguaucuaaacaagagagggguaaaucauuguuauuuaaaacgucugcgggaguaaauaugugcacacuaaucgcaauggacuuaggggaauuaugugaagacacaaugacuuacaaaugcccuaggauaacugaggccgaaccagaugacguugacugcugguguaaugccacagauacuugggucaccuacggaacaugcagucaaacaggugaacaucguagggacaaacgaaguguagcacuugcaccucauguagggcugggauuagagacacguacagaaacuuggaugaguucagaaggggcauggaaacaaauccaaaggguggaaacaugggcgcuaagacauccaggauucacuguaauagcucucuuucuugcgcaugcgauuggaacuucgauuacucaaaaagguauaauauucauacuccuuaugcuagugacucccaguauggccaugcgcuguguuggaauagggucgagagacuucguagaaggacuuagcggcgcgacauggguugauguuguacucgaacacgguucaugcgucacgacaauggcaaaagacaaaccaacgcuugacauugaacuauuaaaaaccgaaguaacaaacccagcuauacuuagaaaacuuuguauagaagcuaaaauauccaauacaacgacagacaguagaugucccacucaaggcgaagcuacacucgucgaggaacaagaugcaaacuucguaugucgacgcacuuucguagaucgagguugggggaacggauguggacuauucggcaaagggucccuaauuaccugcgccaaauuuaaauguguaacuaaacuggaagguaaaauaguccaguaugaaaaccucaaauacagugucauagucacaguacacacaggagaccaacaccaagugggaaaugaaucgacagaacauggaacuacugcaaccauuacuccccaagccccaacuacugaaauacaguuaacugauuauggggcucuaacauuagacugcaguccgaggacagguuuggauuuuaacgaaaugguauuacugacgaugaaagagaaguccugguuaguucauaaacagugguucuuggaccuuccacucccauggaccaguggggccaguacaagccaggagaccuggaaucgacaggaucuucuaguaacuuuuaaaacugcacaugcgaagaaacaggaaguuguaguuuuagggagucaggaaggagcgaugcauacagcguuaaccggugccacagaaauucagacgaguggaacaacaacaauauuugcaggucauuugaaaugucguuuaaagauggauaaauugacucuuaaaggcaugucuuauguaaugugcacagguucuuuuaaacuggaaaaagaaguggcagaaacacaacauggaaccgucuuaguacaaauuaaguacgaaggaacagaugcuccuugcaagauaccauucucgacacaagaugaaaaagguguuacucaaaauggaagguuaaucaccgcaaauccuauaguuacagacaaggaaaaaccagucaacauugaagccgaaccaccauucggggaauccuacaucguaauuggggcaggcgagaaagcguuaaaacuuucaugguuuaagaaaggaagcaguaucggaaaaauguuugaagcuacggcuaggggagcgagaagaauggcgauacuaggagacacagcaugggauuuugguucuauaggaggaguuuucacaucugucggcaaacuuguacaccaaauuuucgggacugcguauggaguacuauuuaguggcgucaguuggacuaugaagauaggaauaggcgugcuauuaacauggcucgggcucaauucccggucgacaucauucaguaugacuuguauagccgugggucuagugacucuguaccucggaguaaugguacaggcagauucaggaugugugauuaacuggaagggaagagaguuaaagugcgguuccggaauuuuuguaacaaacgaaguccauacauggacagaacaauacaaauuccaagcagauucaccaaaacggcugucggccgcaauuggaaaagccugggaagagggaguaugcggaauacgauccgcaacgagacucgaaaauauaauguggaaacaaauaucaaacgagcucaaucauauuuuguuagagaaugauaugaaauuuaccguagugguaggagacguugccgguauauuagcacaggguaagaaaaugaucaggccucaaccaauggaauacaaguauaguuggaaaagcuggggaaaagcgaaaauuaucggggcagauguucaaaacacaaccuucauuauagauggcccaaacacaccugaaugccccgacgaucagcgagccuggaacauaugggagguagaagacuauggcuucggcauauucacuacuaauauuugguuaaaacuaagagauucauauacacaaguuugcgaucauagguugaugagugcagccauuaaagauaguaaagcaguacacgcugacaugggguauuggaucgaaucggagaaaaaugagacuuggaaauuggcaagagcuucguuuaucgaaguaaagacuuguauauggcccaaaucucauacauuauggucuaaugguguccuugaaucugaaaugaucauucccaaaaucuaugggggucccaucagucaacauaauuauagaccagguuauuuuacacaaacagcuggucccuggcaucuaggaaaguuagaacuagauuuugacuuaugugaagguacuacuguuguuguagacgaacauuguggcaauagagggccuucgcuucggacaacaaccguaacagguaaaauaauucaugaauggugcugucgauccuguacacuaccgccuuuaagauuccgcggggaagaugggugcugguaugggauggaaaucaggccaguuaaagaaaaagaagaaaaucuugugaagucaaugguuagugccggaucaggugagguugauucauuuucacuuggauuacuuuguaucagcauaaugauagaagaagucaugaggagucguuggucgcgaaaaauguuaaugacugggacccuagcgguguuccuucugcucauuaugggucagcuuacauggaaugaccuaauucgauuauguaucaugguaggagcuaaugcaucagauagaaugggaauggguacaacuuauuuagcccuuauggcaacuuuuaaaaugcguccaauguuugcaguaggacuucuuuuccgaagauuaaccucgagagaagugcuauugcucacgauuggucucucucuagucgccucaguagaacuaccaaacagucuugaagaauuaggcgauggacuagcaaugggaauuaugauacugaaauuauuaacugacuuucagucccaccagcuaugggcaacucuauuaucacuuaccuuuauuaagaccacauucagucuccacuacgcguggaaaacaauggcgaugguacuguccauagucagcuuauuuccauuguguuugucuacaacuucacaaaagacuacuugguuaccgguauuauuaggcucacuuggauguaaaccccuaacaauguuucucauagcagaaaacaaaauauggggaaggagaucuuggccauugaacgagggaaucauggcgguuggaauugugagcauacuguugucaucucuauuaaagaacgacguuccgcucgcuggaccacuuauagcaggcgggaugcuaauagccugcuauguaaucucaggaucgucagcagaccuaagucucgagaaagcugccgagguaagcugggaagaagaagcggaacauaguggggcuucacacaauauauuaguggagguucaggacgacggaacaaugaaaauaaaggacgaagaacgugaugauacauuaacaauuuuauugaaggccacucuauuagcgguuagcggaguguaccccuuaucaauacccgcaacacuauuuguuugguauuucuggcagaagaagaaacagcgaucaggaguucugugggauacgcccaguccgccugagguagaacgcgcuguacuggacgacgggauauaucgaauuaugcaacgggguuuauuaggaaggagucaaguuggaguggguguauuccaagaaaauguuuuccacacaauguggcacgucacuagaggagcaguccuaauguaucaagguaagcgucuagagccgucaugggcuagugucaagaaagacuuaauaagcuauggagguggguggcgauuacaaggaucuuggaauaccggcgaagaaguacaagucauagcuguagaacccggcaaaaaucccaaaaauguacagacagccccagggacguucaaaacuccugaaggugaaguuggggccauagcauuagauuucaaaccuggaacgucagguuccccuauuguaaaucgagaaggaaaaauagucggauuauacgguaacggcguagucacaacuuccggaacguacguuagugcgauugcacaggcuaaagcgagccaagaaggucccuugccagaaauagaggacgagguguucaggaaacgcaauuuaacuaucauggaccuccacccagguaguggaaaaacgcgaagauauuuaccagcgauaguacgagaagcaaucaaaagaaaacuacggacacuuauauuagccccaaccagaguagucgcuucugagauggcugaagcauuaaaggguaugccuauacguuaucaaacuacagccgugaaauccgagcacacugguaaagagaucguugauuuaaugugucaugcaacguuuacaaugagacuauugucaccgguaagagugccaaacuauaacaugauaauaauggacgaagcgcauuuuacugauccuucuaguauagccgcacguggauauauauccacuagaguaggcaugggugaagcagcggcuauauuuaugacggcaaccccaccaggaagcguagaagcauucccacagucgaaugccguaauucaagacgaagaacgagauaucccggagaggaguuggaacucaggauaugaguggauaaccgacuuucccggaaaaacugucugguucguaccgucuauaaaaucaggcaaugauaucgcaaacugccuacgcaagaacgggaaaaggguuauacaacuuaguagaaaaacuuuugacaccgaauaccagaaaaccaaaaacaacgacugggacuacguaguaacuacagauauuucagaaaugggagcuaauuuucgugcagauagaguuauugauccucguaggugucuuaagccaguaauccugaaagacggccccgaaagggugauauuagcaggucccaugccuguuacugucgcgucagccgcucaaaggagaggaaggauuggaagaaaucauaacaaagaaggcgaucaauauauauauaugggacagccgcucaacaaugacgaagaucacgcgcauuggacggaagcgaaaaugcuucuugauaacaucaauacuccugaaggaauuauuccugcucuauucgagccagagagggaaaaauccgccgcuauagacggagaauaucgccuucggggagaagcaagaaaaacuuuuguagaauuaaugagaagaggggaucucccaguauggcuaucguauaaaguggccucagagggauuccaauauucagacagaagauggugcuucgacggcgagagaaacaaccagguucuggaggaaaacauggauguggaaauauggacuaaagaaggggagagaaagaaauuacggccgaggugguuagacgcccgaaccuacucagaucccuuggcuuuacgugaguucaaagaguucgccgcaggccgccguucagugaguggagaccuaauucuagagauugggaaacuuccacagcauuuaacacagcgugcccaaaaugcauuagauaauuuaguaauguugcacaauagugaacaagguggccgggcauaucgacacgcgauggaagaauuaccagauacaaucgaaaccuuaaugcuucucgcguuaaucgcaguacugacgggaggugucacuuuguucuuucuaucugguaggggauuaggaaaaacuucaauuggacugcucugcguuauggcgucaagcguucuuuuauggauggcgucaguagaaccacauuggauugcugccagcauaauauuggaguucuuucuaaugguucuauuaauaccggaacccgauagacaaagaacaccucaagacaaucaauuagccuacguuguaauaggacuacuguucaugauucugaccguugcagcaaacgaaaugggguugcuggaaacuaccaagaaagaucuaggaauuggucauguggcugccggcaaucaucaccaugcggcaauguuggacguugacuuacauccugcgucagcauggacgcuuuaugcaguugcuacuacuaucauuacgccgaugaugagacacacaaucgaaaauaccacugcuaacaucagcuuaacugcaaucgcgaaucaagcggccauacuaaugggucuugacaaagguuggccuauaaguaaaauggauauuggcguaccucuccucgcacucgggugcuauagucaaguuaauccguugacucuaacugccgcaguucuuauguuaguugcgcauuacgcgauuauugggccaggucuacaagcgaaagccacgcgagaagcccagaaaagaacagcugcggguauaaugaagaacccgacaguagauggaauuguggcaauagauuuagauccaguaguauaugacgcuaaauucgaaaaacagcuaggccaaaucauguuauuaauacuaugcacaagccaaauuuuauuaaugagaacuaccugggccuuaugugaaaguauuacauuagcaacaggcccccuaacaaccuuaugggaggggagcccaggaaaguucuggaacacuacuaucgcugugucaauggcgaauaucuuucgggggucguaccuagccggugccggucuagccuuuagcgucaugaaauccuuagguggaggucgucgaggaacgggagcucaaggagagacucuaggggaaaaguggaaaagacaauugaaucaauuaucaaagagugaauuuaauacauacaaaaggucagguaucauggaagucgauaggucagaggcuaaagaaggacuuaagagaggagaaacaacuaaacaugcaguuaguagaggaacagcgaagcugagaugguucguugaaagaaacuuaguuaaaccagaaggcaaagugauugacuuaggaugcggacgcggaggauggucauauuauugugcaggacuuaagaaaguaacagagguuaaaggauauacaaaagguggaccaggccaugaagaaccgauuccgauggcuacauauggauggaauuuagucaaauuacacuccggcaaagaugucuucuucguaccacccgaaaagugugauacucuucuaugugauauaggcgaaaguuccccaaacccgaccauugaagaagguaggacgcuuagaguuuuaaaaaugguugaaccaugguugcgggguaaucaauuuuguaucaaaauacucaacccauauaugccaucugugguggagacucucgagcaaaugcagcgaaaacacggagguauguuaguaagaaauccacugagccgcaauuccacacaugaaauguacuggguuuccugugguacagguaauauuguaagugcuguaaacaugacaucacgaaugcuguuaaaucgcuuuacuauggcucauagaaaacccacauacgaaagagauguagauuugggagcaggaacucgacacguagcaguagaacccgaaguggcuaaucuagauauaauaggucaacgaauugaaaacauaaagcacgaacauaaaaguacguggcauuaugaugaagauaacccauauaaaacaugggcauaucacgguucauaugaggugaaaccgagcggcucugccaguaguaugguaaauggugucgucaaguuauuaacuaaaccaugggaugugauucccaugguaacacaaauagcuaugacugauacuaccccuuucggucaacaacguguguuuaaagaaaaagucgauacacgaaccccuaaagcgaaacgaggcaccgcccaaauaauggaggucacugccaaauggcuauggggguuccuaaguagaaauaaaaagccacgaauaugcacucgagaggaguucacucgcaaaguaagaucaaaugcugcaauuggagcuguauuuguggacgaaaaucaauggaacucggcuaaagaggcaguagaagaugaaagguucugggauuuaguacacagagaaagggaacuccauaaacaagguaaaugugcuacuugcguauacaauaugaugggaaaaagagagaagaaauuaggagaauuuggaaaagcuaaagggucgagagcaauaugguacauguggcuaggagcacgcuuuuuggaauuugaagcgcuugguuuuaugaacgaagaccauugguuuuccagagaaaacucacuuuccggaguggagggugaagggcuucauaagcuagguuauauacuucgugauauauccaaaauaccugggggaaacauguaugcggaugacacagcagguugggauacuagaauaaccgaagaugaccuucaaaacgaggcucguauuacagauauaauggagcccgaacaugcccuucuggcgaaauccauauucaagcuaacauaccagaacaaagugguucggguucaaaggccugcaaagaacgggaccguaauggacguaauuagccgcagagaucaaagaggaagcggacaggucggcacauacggucuaaauaccuuuacaaauauggaagcccagcugauaagacagauggaaucugaagggauuuuuagccccucugaauuagaaacgccaauuuuagccgaacgaguauuagauuggcucgaaaaauacggcguagagcgauugaagcgaauggccauuucaggugaugauugcguaguuaaaccuauugacgaucgauuugcaacagccuuaacggcauuaaacgauaugggaaaaguacgaaaggacauaccccaaugggaacccaguaaaggauggaacgauuggcaacagguuccauuuuguucucaccauuuccaccaacugauaaugaaagauggucgugaaauaguaguaccuugucguaaucaagaugaacuuguugggcgagcaagggugucacagggggccggauggucccucagagaaacagcguguuuggggaaaucauacgcccagauguggcaauugauguacuuucaucgacgugaucuucgauuagcagcuaaugccauauguucugccgucccaguugacuggauaccuaccagccgaacaaccuggagcauccaugcacaucaccaauggaugacgaccgaagauaugcuaucaguauggaacagaguauggauagaggaaaauccuuggauggaggauaagacucacauaucaagcuggggugauguaccuuaccuaggcaagagagaagaucaauggugcggaagucuaauaggacuaaccgcccgagcuacaugggccacaaacauacaagucgcaauuaaucagguuaggagauuaauagggaaugagaauuaccuagauuauaugacuucuaugaagagguucaaaaaugaaucagaccccgaaggugcguuaugguaa

SEQ ID NO: 21198 - RNA, 9879 nt, Artificial Sequence
  derived and/or modified CDS sequence (opt6) from DENV-1__FJ639686__SS-prME
aguguuaccaugcuucuaaugcuaaugccaaccgcucuggccuuucaucuuacgacuagagggggcgaaccucauaugauugugucaaaacaagaacggggaaaauccuugcuauuuaaaacuucagcuggaguaaauauguguacucuaaucgcgauggaucuaggugaauuaugcgaagauacgaugaccuauaaauguccccgaauaacugaagcugaaccagaugauguugacugcuggugcaaugcaacggauacuuggguuacuuauggcacaugcucgcaaacaggagagcauaggcgugacaaacgcaguguagccuuagcuccgcauguaggucuagggcucgaaacaagaacggaaacuuggaugucgucugaaggagcauggaaacaaauucaaaggguagaaacuugggcauugcgacauccaggauucacagugaucgcauuauucuuagcccacgcgauagguacguccauaacucaaaagggaaucauauuuauuuuacucaugcuaguaacaccaaguauggcaaugcgaugcguuggaauagguucaagagacuuugucgaaggacuaucuggagcgacuuggguugauguaguccucgaacauggcaguugcguaacuacaauggcaaaagauaaaccuacucuugacauugaauuguuaaaaacggaagugacuaauccagcuauucuucgaaaacuguguauugaagcaaagauuaguaauaccacaacugacucccguuguccgacacaaggcgaggcaacauuaguagaagaacaagaugcaaauuuuguauguagaagaacauuugucgauagagguugggggaacggauguggucuauucggaaaagguucauugauaacgugugcuaaauucaagugcguaacaaaauuggaaggaaagauaguucaauacgagaacuuaaaauacucaguaauaguuacuguccauacuggagaucaacaucaagugggcaaugaaaguacugaacacgggacaacagcuacaaucacaccucaagcuccaacuacagaaauacaacuuacugacuauggagcccucacgcuggauuguucgccacggacaggccucgacuuuaacgaaaugguguugcuuacuaugaaggaaaaaucuugguugguccauaaacagugguuccuagacuuaccgcugccuuggacuuccggggccaguacaucacaggaaacuuggaauagacaagaccuauuaguaacuuucaaaacggcucaugcuaagaaacaggaggucgugguauuaggcucgcaagaaggggcaaugcauacagccuugacuggagccacagaaauacaaacaucggggaccacgacgauauuugccgggcaucuaaaaugcagacugaagauggauaaauugaccuuaaaggguaugucauacguuauguguacugggucuuucaaacuagaaaaggagguagcagaaacacaacauggaacugucuuaguucagaucagguaugagggaacggaugcaccaugcaaaaucccauucuccacucaagaugaaagaggggucacucagaacgguagauugauaacugccaauccgauaguuacugacaaggaaaagccuguuaauaucgaagcagaaccacccuucggagaguccuauauuguuauaggugcuggggagaaagcgcuaaaauuaagcugguucaaaaagggaucuaguaucgggaaaauguuugaagcaacagcucguggagcgaggagaauggccauacuaggagauacagcuugggauuucggaucaauuggagguguuuuuacaucaguaggaaaauuaguacaccagauauucgguaccgcuuaugguguacuauuuuccgguguaucuuggacaaugaaaauaggaauaggcgugcuauuaaccuggcucggauuaaauucgagaucgacaucuuuuucaaugacuugcauagccguugggcucguaacacuauaucuaggaguaauggugcaagcugauucuggcugcguaauaaacuggaaagguagagaacugaaauguggaucaggaauuuuuguuacaaacgaaguacacacauggacggagcaauauaaauuucaagcugauagcccaaaaagauuauccgcagcaauaggcaaagcaugggaagaaggaguaugugguauucgaagcgcaacccguuuggaaaauaucauguggaaacagauauccaaugaauuaaaucauauucucuuagagaaugauaugaaauucacuguugucguaggagauguagcaggcauacuugcccaagggaagaagaugaucagaccacaaccaauggaauacaaauacucguggcgaucaugggguaaagcaaagauaauaggagcagacguacagaacacgacuuucauuaucgacggaccgaacacaccagaauguccggacgaucaaagagcuuggaauaucugggaggucgaggacuauggguucgggauauucacuacuaacauauggcugaaguuaagggauucauacacucaaguuugugaucaccguuuaauguccgcugccauuaaagacagcaaagcaguucaugccgauaugggguacuggauugaguccgagaaaaaugaaacauggaaacuugcacgggcuagcuuuauagagguuaaaacaugcauauggccaaaaucgcacacacuauggucaaacgguguacuagaaucagaaaugauaaucccaaaaauuuaugguggcccaauuucccagcauaauuaucguccaggcuacuucacucaaacugcaggccccuggcaucuaggaaaacuagaacuggacuucgauuuaugcgaaggaacgacaguaguuguagacgaacauugcggaaacagaggaccuagucucagaaccacaacagugacugggaaaauaauccaugaaugguguugucgcucuuguacucuucccccucugcgcuuuagaggugaagaugguugcugguaugggauggaaauaagaccgguaaaggaaaaagaagaaaacuuaguaaagagcauggugucugcaggcagcggagaaguagauagcuucuccuuaggauugcuauguauuucgauuaugaucgaggaggucaugcgcucuagguggucgcgaaagauguuaaugacagguacuuuggcagucuuccuacuccuaaucaugggccaauuaacauggaaugaucugaucagguuauguauaaugguaggagccaaugcgagugaucggaugggaauggggacgacauacuuagcuuuaauggcaacauucaaaaugcgacccauguuugcagugggauuacuauuuagaagauuaaccucuagggaaguguuacuacuaacaauuggccuuagccuaguggcgucgguagagcuucccaacucucucgaagaacuaggugauggucuugcgaugggaauuaugauucugaaguuauuaacggacuuccaaucacaucaguuaugggccacccuacugucgcuaacguuuauaaagacuacuuuuucacuacauuacgcauggaaaacuauggcuaugguucuaucaauaguuucccucuucccauuguguuuaucuacuacaagccagaaaacaacgugguuaccuguccuauuggggagucucggcuguaaaccguuaaccauguucuuaaucgcagaaaauaaaaucuggggaaggaggucuuggcccuugaacgaagggauuauggcaguuggaauugugagcauccuacucucaucucuucugaagaacgacguuccacucgcaggaccucuuauagcuggaggaauguuaaucgcuuguuauguaauaagcggcucaucugccgauuuaagccuugaaaaagccgcggaagugagcugggaggaagaggcugaacacucuggcgcuagccauaauauauugguugagguucaagacgauggaacgaugaaaauuaaggacgaagaaagagaugauacacuuacuauuuuacuaaaagcuacacuuuuagccguaucaggaguuuaccccuuauccauuccagccacguuguuuguaugguacuucuggcagaagaagaaacaaagaaguggugucuuaugggauacuccuucaccaccugaaguagaacgcgcgguccuggacgacggcaucuauaggauaaugcaacguggucuccuaggaagaagucagguaggaguagguguguuucaagaaaauguguuccauacuauguggcacguaacgcggggagcaguucuuauguaccaaggaaagcgucucgaaccaucaugggccagugucaaaaaggacuuaauuucguacggaggugguuggcguuugcaagguuccuggaacacaggcgaagaagugcaaguuauagcaguagaaccaggcaaaaauccgaagaacguucagaccgcaccaggaacauucaaaacucccgaaggcgaaguaggagcgauugcacuagauuuuaaaccaggaacaaguggaucuccaauugucaaucgggaaggcaagauaguaggucuuuacggaaauggugugguaacaacaagcgggacuuacgugucggcaaucgcucaggccaaagcaucacaagagggacccuuaccagagaucgaagaugaaguauuuagaaagagaaaucuuaccauaauggauuuacacccuggaucggggaaaacuagaagauauuuaccagcgauaguaagagaagccaucaaacgaaaacuacgaacguugauuuuagcaccgaccagaguaguagcaagugagauggccgaagcacucaaagguaugccaauacguuaucagacgacugcaguuaaaucagaacauaccggaaaagagauugucgacuuaaugugucacgcaacuuuuacaaugcguuuauuaucuccuguacgaguaccgaauuacaacaugauuauuauggaugaggcacauuucacugacccaucuucuauagcagcuagaggauacauaucaacgaggguuggaaugggggaagcugcagccauauucaugacggcuacucccccaggaucaguugaagcauuuccccaaucaaaugcagucauacaagaugaagaaagggauauaccagaaagaucguggaacucaggcuaugaguggauaacagauuuuccuggcaagacaguaugguuuguaccauccauaaaaaguggaaaugacaucgcuaacugucuaaggaaaaaugggaagcgugucauacaacuaucaagaaagacguuugacacagaguaucagaaaaccaagaacaaugauugggauuauguuguuacaacugacaucucagaaaugggagcgaacuuccgagcagaucggguaauugacccaagacggugucucaaaccaguaauccuaaaagauggaccugaaagaguaauacuagcagggccgaugccaguaacgguagcuucagccgcacaacgucguggaagaauagguaggaaucacaacaaagaaggagaccaauauauauauaugggccaaccucuuaacaaugaugaagaccaugcccauuggaccgaagcuaaaauguuacuagauaacauaaauacaccagaagguauaauucccgcacuauuugaaccagagcgugagaaaucugcagcuauugacggagaguacagacuucgaggagaggcuaggaagacauucguugaacuuaugaggcgaggugauuuaccaguuugguuaagcuauaaagucgcaagcgaaggauuucaauacucugaucgacggugguguuuugacggagagagaaacaaucagguccuugaggaaaauauggacguagaaauuuggacaaaagaaggagagaggaaaaagcugcgaccaagauggcuggaugcgagaacuuacucagauccauuggcacuuagagaauuuaaggaguuugcagccggaagacgaucaguaucgggugauuuaauucucgaaauuggaaaacugccccaacaccuuacucaacgagcccagaaugcguuagacaaccuaguaaugcuccauaauagcgagcaaggaggacgagcuuauagacaugcaauggaagaauuaccggauaccauagaaacccuaauguugcuagcccuaauagcaguauuaacaggcggagucaccuuauucuuucuuuccggcaggggauuaggaaagacaaguauuggacuacuauguguaauggcuucuucaguauuauuauggauggccaguguggaaccucacuggaucgcagcaucgauuauauuagaguucuuucuuauggugcuauuaauaccagaaccugauagacaacguacaccgcaagauaaucaacuagccuacgugguuauagguuuauuauuuaugauacuuaccgucgcggcaaaugaaaugggguuacuugaaacaacuaaaaaggaccucgguauaggucacguugcaguuggaaaucaucaccaugcagcaaugcuugacgucgauuuacacccagcuagcgcguggacuuuauaugcaguggcgacuacaauuauuacgcccaugaugagacauacgauagaaaauacuacugcgaauauaucacuaacugccauagcgaaucaagcagcgauauuaauggguuuagacaaaggauggccuauuucaaaaauggacauugguguuccacuccuugcuuugggaugcuauucgcaaguaaacccacuaaccuuaaccgcugccguacugaugcuagucgcacacuaugccauaauaggcccgggauuacaggcaaaagcgacacgugaagcacagaaaaggacagcggcugguauuaugaagaacccuacaguugaugguauaguagcuaucgaccucgacccaguuguauaugaugcuaaauuugagaaacaauuagggcaaauaauguuacuaauacucugcacgagccaaauacuacuaaugaggacgacuugggcauuaugugaaaguaucacuuuggcaacaggcccccuaacuacauuaugggaaggaaguccggguaaauucuggaacacaacgauagcagucaguauggcuaauauauucagagggucguauuuagcaggcgcagguuuagcuuucagccuaaugaaaucucuuggcggagguagacgagguaccggugcacaaggggaaacacuuggagagaaauggaaaagacaacuuaaucaacuaucaaagagcgaauuuaacacuuauaaacgaagugguauaauggagguagauagaagugaagcgaaggagggacucaagagaggugaaauuacgaagcaugcaguuucccgaggaacugcaaaacugagaugguuuguugaaagaaaucugguuaaaccugagggaaaaguuauagaucuaggauguggcaggggaggauggaguuacuacugcgcuggucuuaaaaagguuacagaagugaaaggauauacaaaaggggguccuggccacgaggaacccauaccuauggcaacuuacggguggaaucuaguaaaacuucacuccgguaaggacguauucuuuguuccgccugaaaaaugugacacgcuuuuaugugacauaggagagaguuccccaaauccuaccaucgaagagggucgcacacuucguguccugaaaauggucgaaccaugguuaagagggaaccaauuuuguauaaaaauauuaaauccauauaugccaaguguuguugaaacuuuagaacaaaugcaaaggaaacacggugguauguuaguuagaaauccauuauccagaaauagcacacacgaaauguauuggguuaguugcggcacagguaauauuguaucugcaguaaacaugacaagcaggaugcucuugaacagguucaccauggcacauagaaagccuacuuacgaaagagauguagaccuuggagcuggaacacgucacguagccgucgaacccgagguagcaaaccuagauauuauaggacaacgaauagaaaacauuaagcaugaacauaagucuacauggcauuacgaugaggauaacccguacaaaaccugggcuuaccacggcaguuaugagguaaaaccaucaggauccgcuaguagcauggucaauggaguaguuaaauuauuaaccaaacccugggacguaauaccuaugguaacacagauagcaaugacugacaccacgccuuuuggacaacaacgcguauucaaagaaaagguagauacacguacuccaaaagcgaaacgggguacggcccagaucauggaaguaacggcaaaauggcuguggggcuuuuuauccagaaacaaaaagcccaggauauguacgagagaagaguucacacguaaaguaaggaguaaugcagcaauuggagcaguauuuguugaugaaaaucaauggaacuccgcgaaggaggccgucgaagacgaaagguuuugggaucugguccauagagagcgagaacuacacaaacagggaaaaugugcaacauguguauauaacaugauggguaaacgugagaagaaacuaggagaauuuggaaaagcuaaagggucuagagcaauaugguauaugugguuaggagcucgauuuuuagaauuugaagccuuagguuucaugaacgaggaccauugguucucuagggaaaauucacuaucaggugucgagggcgagggguuacauaaacuaggguacauccuacgagacauuucuaaaauuccuggugguaacauguaugcggaugauacggcagggugggacacacgaaucaccgaagaugauuuacaaaacgaggccaggauuacagacauuauggagccagaacacgcgcugcuagccaaauccauauuuaaauugacuuaccagaauaagguuguccgcguacaaagaccagccaagaacggcacaguuauggacguaaucucacgacgagaucaaagaggaucaggucaaguuggaacuuauggacugaauacauucaccaacauggaggcucaauuaauuagacaaauggaguccgaagguauuuucucgccaagugaacuggaaacuccaaacuuagccgagagaguuuuagacuggcuugaaaaauaugguguagaaaggcugaaacgcauggcaaucucaggcgaugauuguguaguuaaacccauagaugauagguuugcgacagcgcuuacagcccuaaaugauaugggaaaaguacgcaaagauauaccccaaugggaacccucaaaaggguggaacgacuggcaacagguaccuuucuguucgcaccacuuucaucaauuaauuaugaaagacggaagggaaauugucguaccauguagaaaucaagacgaauuaguaggacgcgcaaggguaucucaaggggcuggguggagcuuaagagaaacagcgugucuggguaagagcuaugcucaaauguggcaacuuauguacuuucaucggagagaucuucgacuugcagcgaacgcgauuuguuccgcaguucccguagacuggauuccaacaagucguacaacauggucgauccaugcucaccaucaauggaugaccaccgaggacauguuaagcguauggaaccguguauggauugaggaaaaucccuggauggaagauaaaacucacauaaguagcuggggagaugugccauauuuaggaaaaagagaagaucaauggugugggucuuuaauuggauugacugcacgcgcuacuugggcgacaaauauucaaguugcaauuaaccaggugaggagacuuauaggaaaugaaaauuaucucgauuacaugacaaguaugaaaagguucaaaaacgagagugacccggaaggugcacuaugguaa

SEQ ID NO: 21199 - RNA, 9879 nt, Artificial Sequence
  derived and/or modified CDS sequence (opt6) from DENV-1__FJ639687__SS-prME
aguguuacuauguuacugauguuaaugccaaccgcacuugccuuucauuuaaccacacgcggaggugagccacacaugaucguaucuaaacaagagcgaggaaaaucuuuacuguuuaaaacaagugcugguguaaauaugugcacguuaauagcuauggaucuaggugaguuuugcgaagacacaaugacuuacaaauguccccgcauaagcgaagcggagccggaugauguagauuguuggugcaaugcaacugacacaugggugacauacggaacauguagccaaacaggcgaacaucgcagagauaaaagaucuguagccuuagcuccucacguuggacuaggucucgaaacucgaaccgaaaccuggaugucguccgaaggugcguggaaacaaauacaaagaguugaaacaugggcccuuagacauccagguuuuacugucaucgcuuuauuuuuagcgcacgcgaucggaacauccauuacacaaaagggaaucauuuucauauuacucaugcucguuacucccucaauggcuaugaggugcguuggaauuggaaguagagauuuuguagaaggacuaucgggagcaacuuggguggaugucguucuugaacacgggucaugugucacaacgauggcaaaggauaagccuacucucgacauugaguuauuaaagacugaagucacuaaucccgcugugcuacggaaacuauguauagaagcuaaaaucucaaauacuacaacugacucaagauguccaacacagggugaagcuacgcuaguagaagaacaagaugcaaacuuugucugccgaagaaccuuuguagaucgaggguggggaaauggaugcgguuuauucgggaaagguucgcucauaacuugcgcuaaauucaaaugugucacuaaacuagaaggaaagauaguccaguaugaaaaucuaaaguauucggucauuguuaccguacauacuggcgaucaacaucaagucgguaacgaaaguacggagcaugguacuacugcuacaauuacuccacaagcuccaucaacagaaauacaauugacugauuacggagcacugacgcuagacugcaguccaagaacaggucuugauuuuaacgagaugguuuuauugacaaugaaagaaaaaucaugguuaguucauaagcagugguuccuagaccuaccauuacccuggacaagcggcgcuucaacaucucaagaaacuuggaauagacaagaccuuuugguaaccuucaaaacugcucaugcgaagaaacaagagguaguuguccuagggucucaagaaggugcaaugcacacagcuuuaaccggugcaaccgagauccaaaccucagguacuacuacgauauucgccggucaucuaaaaugcagacuaaagauggacaaguuaacccuaaaaggaaugucauauguaaugugcacagggucuuucaagcuggaaaaggagguagcugagacacaacacggaacuguccucguccaaauuaaguaugaaggcacagaugcaccuugcaagauaccguucuccacucaagacgaaaaaggcgucacacagaaugguagacuuauuacagcgaauccgauagucacggacaaagaaaaaccagucaauauagaagcagaaccaccguuuggugaaucauauauagucauaggcgccggggaaaaagcauuaaaguuaucgugguuuaagaaaggaucuuccauaggcaagauguucgaagcuacagcuagaggagcgagaagaauggcgauccucggugacaccgcuugggauuucggaagcaucggaggaguauuuacgagcguaggaaaauuaguacaccaaauuuuuggaacugcauauggcguccuauucucaggaguauccuggacgaugaaaauaggcauaggaguucuucuuacaugguuaggccuuaacucacguucaacaaguuuaagcaugaccugcauugcugucgggcugguuacauuguaccuaggagucaugguacaagcugauucaggcugugugaucaauuggaaaggccgagaacuuaaaugugggucagguauauuuguaacaaacgagguucacaccuggacagaacaauacaaauuccaagcggacaguccaaaaagacuaagcgccgcuauagguaaagcaugggaagaaggaguuuguggcauaagauccgcaacccgauuggagaauauuauguggaaacagauaucaaaugaacucaaucacauacuacuugaaaacgacaugaaauucaccguggugguaggugauguugccggcauacuagcgcagggcaagaaaaugauaagaccacaaccgauggaguacaaauauucauggaaaaguugggggaaggcaaagauuauaggagcagaugugcaaaauacuacuuucauaaucgacgggccuaauacaccagaaugucccgaugaucaaagagcauggaacauaugggagguggaagauuauggguuugggaucuuuacgacgaacauaugguuaaaauugagagacucguauacacaaguaugugaucaucgucucaugucugcggcaauuaaagacaguaaagcaguacaugcugacaugggauauuggauagaaucugagaaaaacgagacguggaaacuugcacgugccucuuuuauagaaguaaaaacuuguauauggccaaaaucacacacacuauggagcaauggcgucuuggaaucagaaaugaucauaccuaaaauauauggcgguccgauaagucaacauaauuauaggccuggguauuuuacucaaacugccggucccuggcauuuaggaaaacucgaacuugacuuugauuuaugcgagggcacaacgguugucgucgaugaacacugugguaauagggguccuucauuacgcacaacgacaguuaccgguaaaauaauacacgaaugguguuguagaaguugcaccuuaccaccccuaagauucaaaggagaagacggauguugguacggcauggaaauacgaccaguuaaggaaaaagaggaaaacuuaguuaaaucuaugguaucagcagguaguggagaagucgauucuuuuucccuaggacuauuauguauaagcauuaugaucgaagaggucaugaggucgagguggucuagaaaaaugcuuaugaccgguacauuggcaguguuuuucuuacuuauuaugggacaguugaccuggaaugaucugauaagacuuuguauaaugguaggcgcgaaugcuucagacagaauggguauggguaugacauaccuagcacuaauggccaccuuuaaaaugaggcccauguuugcagugggucuacucuuucgcagauugacaucacgcgagguacuguugcucacaaucgggcuuucauuaguggcuaguguagaacucccaaauaguuuagaagaguuaggagaugggcuagcaauggguauaaugauucuuaaacucuuaacagacuuucaaagucaucagcuuugggccacauugcuuagcuugacuuucauuaagacgacauuuucccugcauuaugccuggaaaacgauggcgaugguccuuagcauuguaagccuauuuccauuaugccuuaguaccacgagccagaaaacgacuuggcuacccgugcuauuagggucauugggauguaaaccacuaacuauguuuuugaucgcagaaaauaaaauauggggacggaagaguuggccuuuaaacgaagguaucauggcugugggaauaguauccauauuacugagcagccucuugaaaaacgaugucccacuagcaggaccucugauagccggaggaaugcugaucgcaugcuacguaauaucaggaucaagugcggaucuaucacuagagaaggcagccgaagugagcugggaagaagaagcagaacacaguggagcuucacauaacauccuaguagaagugcaagacgacgguacaaugaagauaaaggacgaagaacgggaugacacacucacuauauuauugaaagcgacauuacuugcaguaaguggugucuauccauugagcauuccugcuacacuguuuguuugguacuuuuggcagaaaaagaaacaaagaagcgguguucuaugggacacaccaaguccgccugaagucgaaagggcuguguuagacgaugguauauacaggauuaugcaacggggacuucucggaagaucacaagugggagugggaguguuucaagaaaacguauuucacacuauguggcacguuacccgaggagcuguauuaauguaucaaggcaaacgacuagaaccaucaugggcaaguguaaagaaagaccuuauauccuauggugguggcuggcgucuacagggaucauggaauacuggcgaagagguucaaguaauugcuguggaaccagggaaaaaccccaaaaacguacaaaccgcuccaggaacguucaagacuucggaaggugaaguuggcgcuauugcucuggauuucaaaccagguacaucgggaucuccgauaguaaaucgcgaaggcaaaauagucggacuauacgguaacggugucguuacaacaucaggcacuuacguaucagcuauugcgcaagccaaagccucgcaagaggguccauugccggaaauagaggaugaggucuuuagaaaaagaaaucugaccauaauggauuuacauccaggcucggguaagacacgccguuaccuaccggcgauuguucgcgaggcaauaaagagaaaauuaaggacauugauauuagcaccgaccagaguuguugcaagugagauggcggaggcucucaaaggaaugcccauaagauaucaaacaacagccguaaaaagcgaacauacaggaaaggaaaucgucgaccugaugugccacgcuacauucacgaugcgacuuuuaucgcccguacgagucccaaauuauaacaugaucaucauggacgaagcucacuuuacagauccaagcaguauugcagcucggggguacauuuccacaagaguaggaaugggugaagcagcugcuauauuuaugacugcaacuccaccuggaagugccgaggcguuuccucaaaguaacgcagucauccaagacgaagaacgugauauaccagaacgcuccuggaacucaggauaugaauggaucacagauuuucccgggaaaacggucugguuuguaccaaguaucaaaucaggaaaugacauugcaaauuguuuaagaaagaauggaaaaagaguuauacaacugucacguaagaccuuugacacagaauaccaaaagacgaaaaauaaugauugggacuacguuguuacgacagacaucucugagaugggagcaaacuucagagcggauagggugaucgauccucguagaugccuaaagccagucauuuugaaagacgggccagaacgaguaaucuuagcgggaccaaugccagucacagucgcuagugccgcacaaagaagaggucguaucgggcggaaccauaauaaagagggagaucaauauauauauaugggccaaccuuuaaacaacgacgaagaucacgcucauuggacagaggcuaagaugcuacuggauaauauuaauacaccagaaggaauuauaccggcacuauucgaacccgagagagagaaaagugcagcgaucgacggagaauauagacuacguggagaagcaaggaaaacauucguagaacuaaugagacgcggggaucuccccgugugguuaaguuauaagguagcuagugagggauuucaauacagugacagaagguggugcuuugauggagagaggaacaaccaaguucuugaggaaaacauggauguugagauauggacgaaggaaggcgaaagaaagaaauuacgaccuagguggcuggaugcaaggacuuauagugacccacuagcuuuaagagaauuuaaagaguuugcagccggacgccgaaguguaucaggagacuugauuuuagagauaggaaaacuaccucaacaccuaacccaaagagcacaaaacgcauuagacaacuuaguaaugcuucauaacucggaacaaggugggagagcuuacagacacgcaauggaggaauuaccagacacaaucgaaacuuuaauguuacuugcccugauugcugugcuaacgggaggagugacauuguucuuucuaucggguaggggucucggaaaaacaagcauaggacuacuuuguguaauggcuaguaguguacuucuauggauggccaguguagagccccauuggauugcagcaucaauuauauuagaguucuuucuaaugguucuuuugauaccagaaccugaccgacaacgaacaccccaagauaaucaauuagcguacguggucaucggacuacucuucaugaucuuaaccguugcagcgaaugaaaugggccuucuagaaacuacgaagaaagacuuaggaauuggccacguagcagucgaaaaccaucaucaugccgcgauguuagacguugaucuccauccugcaagcgcauggacauuauacgcuguagcaacaacaauuauuacuccaaugaugaggcauacaauagagaauacgacagccaacauuagccuaacggcaauugccaaccaagcagccaucuugaugggacuagauaagggguggccuauaucaaaaauggacauaggagugccuuuacuggcuuuaggaugcuauagucaggugaaucccuuaaccuuaacagcagcugugcuaaugcuuguugcucauuaugccauaauagguccuggauuacaagcgaaagcuacucgugaagcccaaaaacgaacggcagcuggcauaaugaaaaaucccacgguagauggaauugucgcgauagauuuagacccagucguguacgacgcaaaauuugaaaaacaguuaggacaaauuauguuauuaaucuugugcacuucacaaauccucuugaugagaacaaccugggcccuaugugagucaauaacacuggccacggguccuuuaacaaccuuaugggaagguaguccugguaaauuuuggaacacaacaauugcugugucgauggcaaauauauuuagagguagcuaccuggcuggagcggguuuagcguucagcuuaaugaagucacuggguggcggccgacgcggaacuggugcacaaggugagacauuaggggaaaaauggaagaggcaauuaaaucaauugucaaaaucggaguuuaauacauauaagcgaucaggcauaauggaagucgacaggagcgaagcuaaggagggucuaaaaagaggggaaacaacaaaacacgcagugagucgaggaaccgcgaagcuacguugguuuguagagcgaaaccucgugaagccugaggggaaaguuauagaccuaggcugcggcagagguggauggucuuauuacugugcaggucuuaaaaagguaacagaaguaaaagguuauacuaagggcggaccaggucaugaggaacccaucccaauggcaaccuacggauggaacuuagucaaauuacacucaggcaaagauguauucuuuguaccuccagagaaaugugauacgcuacuuugugauauaggugaaaguaguccuaacccuacgauagaagaaggaaggacacugagaguccuuaaaaugguagaaccuugguuaaggggaaaccaauuuuguauuaaaauucucaacccauacaugccuucaguaguugagacacuugagcaaaugcaaagaaaacacggagguaugcuagucagaaacccauuaagucgaaauagcacacacgagauguauuggguuaguugcggcacaggaaacauugucagugcaguaaauaugacaucaagaaugcuauuaaauagauuuacuauggcucauagaaaaccaacauacgaacgcgacguagaccuaggcgccgggacucgacauguggccguagaaccagagguugccaaccuggauauaauuggccagcgaaucgaaaacauaaagcaugaacauaagaguacauggcacuaugacgaagacaacccuuacaagacuugggcguaucauggguccuaugagguaaagccaucaggaagugcaaguagcaugguuaacggaguaguaaaacuuuuaacaaaaccuugggauguaauaccgaugguaacacagauugcgaugacggacaccacaccauucgggcaacaacgaguuuuuaaggaaaagguugauacucguacaccgaaagcuaaacguggcacugcgcaaauuauggaaguaaccgccaaaugguuaugggguuuccugucacggaacaagaaacccagaauuuguaccagggaagaguucacuagaaaaguacguuccaacgcagcuauuggggcaguuuucguugaugaaaaucaauggaacucggcaaaagaagccguagaagaugaacgauucugggaccucguccaccgcgaacgugaacuucacaaacaagggaaaugugcuacauguguuuacaauaugaugggaaaaagggagaagaaauuaggggaauuuggaaaagcaaagggcucuagagcgauuugguauaugugguuaggagcgagauuucuggaauuugaggccuuagguuuuaugaacgaagaccacugguucucgcgagagaacagccuaucaggaguugaaggagaagguuuacauaaacucggauacaucuuacgagauauauccaaaauaucaggaggcaacauguaugcugacgacacugcagggugggauacaaggauaacggaagaugaucuacaaaacgaagccaagauuaccgacauaauggagccugaacaugcauuauuagcgaagucuauauuuaaauuaacauaccaaaauaagguaguaaggguacaaagaccggcgaaaaacggaacgguaauggacguuauaucgagaagagaucaacgcggaagcggacaagucggaacauauggacuaaauacauucacaaauauggaagcgcagcuaauaagacaaauggaaucugaagguauuuuuaguccgagugaauuagaaaccccaaaucuagcagaaagagcauuagauuggcuugaaaaacaugguguagaaagauuaaaaagaauggcuauuaguggcgaugauuguguugugaagccaauagacgaucgauucgcgacggcguuaaccgcauugaaugauaugggaaaagugagaaaggacauuccccagugggaacccaguaaaggguggaacgauuggcaacaaguaccguucuguucccaucauuuucaccaauuaauaaugaaagaugggcgugaaauaguagucccaugucggaaucaagaugaacuuguagguagggcgcgagucucacaaggcgcagguugguccuuaaaagaaacugcaugucuggguaaguccuaugcucagauguggcaauuaauguacuuccaccgacgcgauuuacggcuagcugcuaaugcaauauguucagcaguaccgguagauuggguuccaacaagucgcacaacguggucgauacacgcacaucaucaauggaugacaacugaagacaugcuaucaguauggaaucgcguauggauagaagaaaaucccuggauggaagauaaaacucacauuuccucgugggaagacgugccauaucuugggaagagagaagaucaaugguguggaaguuuaauaggacuaacagcacgagcgaccugggcaacuaauauacaaguagcuauaaaucaaguuagacgacuuauuggcaacgaaaacuacuuagacuauaugacaaguaugaaaagauucaagaacgaaagcgauccagaaggugcuuugugguaa

SEQ ID NO: 21200 - RNA, 9879 nt, Artificial Sequence
  derived and/or modified CDS sequence (opt6) from DENV-1__FJ639688__SS-prME
ucagugacuauguuacugauguuaaugccaacggcauuagcauuucacuuaacaacucgagguggggaaccucauaugauuguauccaaacaagaacgcgguaagagcuugcucuuuaaaacuuccgcugggguaaauauguguacccucauugcuauggauuugggagagcucugcgaggacacaaugacauacaaaugcccuagaauaacggaagcagaaccagacgacgucgacuguuggugcaacgcaacagacacuuggguaacuuauggaacauguucacaaacgggggagcauagaagagauaaaagaagcguggcacuagccccacauguaggauuaggguuggagacucgaacggagacuuggaugucaagugaaggcgcguggaaacagauacaaagaguugaaacgugggccuuaagacauccaggcuucaccgugauagcauuauuccuagcacaugcuauaggaacaucgaucacucagaaaggcauaaucuuuauccuucuaauguuaguuacuccuucaauggcaaugcggugcguagggauugggucaagagauuuuguugaaggacugucaggcgcaacauggguagauguuguacuagaacauggcucuugcgugacaaccauggcaaaagauaaaccaacucuugauauagaauuauuaaaaacagaagucacaaacccugcaguacuccgcaaauuaugcauugaagcgaaaauauccaacacuacaacugacaguagauguccuacacaaggagaggcaacacuuguagaagaacaagaugcuaacuucguaugccgaagaaccuucguagaucgagguugggguaaugguugugguuuauuuggaaaaggaucauuaauuacuugcgcuaaauuuaaauguguuaccaaauuagagggaaaaauaguucaguacgagaauuuaaaauacucuguaaucgucaccguucauacaggggaucaacaucaaguugggaaugaaucaacagaacauggaaccaccgcaacuauuacaccacaggccccaaccacagagauccaauuaacagauuauggggcacuaacuuuggacugcaguccacggaccggcuuagacuucaaugaaaugguacuguugaccaugaaagaaaaauccugguuggugcauaaacaaugguuucucgacuuaccauuacccuggacaaguggcgcuucaacaucgcaagagacauggaaccgacaagauuuauuagucacauuuaagacagcucaugccaagaaacaagaggugguaguccuaggaucacaagaaggggcaaugcacacugcccuuacuggagcaacggaaauucaaacuucuggaacgacgacgauuuucgccggacaucuaaaaugucgucucaaaauggacaaauuaacuuuaaaaggaaugucauacguaauguguaccgguagcuuuaaacucgagaaggaagucgcagagacacaacacgguacggucuuaguucaaauaaaauacgaaggcacagacgcacccuguaaaauuccauuuagcacccaagaugaaaaaggaguaacacaaaacgguagauuaauaacggcuaaucccauaguaacugacaaagaaaaaccggugaauauugaagcagaacccccauuuggcgaaucauauauuguuauaggagcaggagagaaagcauuaaaacuuaguugguucaagaaagggucaagcaucgggaaaauguucgaagcuacugcucguggugcaagaagaauggcuauuuuaggagauacagcaugggacuuugguucaauaggagggguauuuacuucaguaggaaaauuaguacaucaaauuuuuggaaccgcguauggagugcuauuuucaggagugucuuggacaaugaaaaucggcaucggagucuugcuaacguggcuuggucuaaacucucgaucaaccagucugaguaugacgugcauugcagugggauuaguaacacuauaucuaggaguaaugguucaagccgacucagguuguguaauuaauuggaaaggaagggaauuaaaaugugggucaggaauuuucguaacuaaugaaguucacacauggacugaacaauauaaguuucaagccgauucaccuaaaagacucagugccgcaaucgggaaggcgugggaagaagguguguguggcauacgcucagcaacccgacuugaaaauauaauguggaaacaaauuucaaacgagcugaaucauaucuuauuagaaaaugacaugaaauuuacaguuguaguaggugauguugcaggcauauuggcacaaggcaagaaaaugauacgcccucaaccaauggaguacaaauauucguggaaaagcugggggaaggccaagauaauaggagccgacguacaaaauaccacauucauaauagauggacccaauacuccagaauguccugacgaccagagagccuggaacguuugggaagucgaagauuauggauuuggaauauucaccacuaacauuuggcuaaaguuaagagauucuuacacacaaguaugcgaccaucguuuaaugagcgcggcuauuaaagauucaaaagcaguccacgcggacaugggauauuggauugaaucugagaaaaacgagacauggaagcucgccagagcuagcuuuauagaagucaaaacaugcauuuggcccaagagccauacacuauggucaaacggaguacucgaaucugaaaugaucauacccaaaauauacgguggaccuauuagucaacauaauuauagacccgguuauuuuacgcagacagcuggccccuggcauuuagguaaacuugaacuagacuuugauuuaugugaagguacuacaguagucgucgaugaacacugugggaaccgcggaccgagccuccgaacaacaaccguaaccggcaagauaauacaugagugguguuguagguccuguaccuugccuccauugcguuuucggggugaagaugggugcugguaugguauggaaaucaggccaguaaaggagaaagaggagaaccuaguuaaauccaugguaucagcggguucaggugagguagauucguuuucacucgguuuguuaugcaucagcaucaugauagaagaagucaugagaagccgauggagcagaaaaaugcuuaugaccgguacccuggcuguauuuuuccuacucauaauggggcaguuaacauggaaugaucugauaagacuguguauaaugguaggagcaaaugcaucagaccguaugggcaugggaacuaccuaccuggcacuaauggcaacguuuaaaaugcgaccuauguuugcaguaggacuacuuuucaggagacuaacaucucgugaggucuuguuacuaacuauuggauuaagccuaguugcgucgguagaacugccuaccagucucgaagaguuaggggauggacucgccauggguauaaugauacugaagcuccucacggacuuucaaucgcaccaguuaugggcuacacuguuaucauuaacauuuaucaaaacuacuuucucauuacauuaugcauggaaaaccauggcaauggucuugucaauugucucuuuauugccuuugugucucaguacuaccagccagaaaaccaccuggcuaccggugcuucugggcagcuuaggauguaagccguugacaauguucuuaaucgcagagaauaaaauaugggggagaagaucuuggccuuuaaaugagggaauaauggcgguaggaauuguuucaauucuauuaagcucccugcuuaaaaaugacguucccuuggccgguccccugauagcgggugggaugcuuaucgcauguuaugugauuagcggaagcucagcagaucucucauuggaaaaagcagcagaagucuccugggaagaagaagcagaacauucaggagcaucacauaacauccuaguagaaguccaggacgaugggacgaugaaaaucaaagacgaagaacgggaugacaccuuaacuauauuguugaaagccacuuuauuagccguuucaggaguuuaucccuuaucgauacccgcaacuuuauuuguaugguauuucuggcagaagaagaaacaacguucaggaguacuuugggauacaccaaguccgccugagguagagagagcaguucuagacgauggcauauauagaauaaugcaaagaggacuccuaggccgcucucaagucgguguuggaguguuccaagagaauguauuucauacaauguggcacguuacgagaggcgcaguuuuaauguaccaaggaaaacgacuugaaccuagcugggcuagugugaagaaagauuuaaucucguauggaggaggcuggcgacugcagggaucauggaacacuggagaggagguacaaguaauagcaguagaaccaggcaaaaaucccaaaaauguacaaaccgcaccugguacauuuaagacuccugagggggaaguaggggcgauagcauuagauuuuaaaccgggaacuucgggaucucccaucguuaauagagaggguaaaauaguuggacucuauggaaacggcguaguaacgaccuccgggaccuacguuagcgcuauagcacaggcaaaagccagucaagaagguccgcucccagaaaucgaagacgagguuuuuagaaaacgaaaccuuacuauuauggaucuccaucccggaaguggcaagacaagacguuacuuaccugcaauagugagagaggcuauuaaaagaaaauuaagaacauuaauucuagcaccaaccaggguugucgccagcgaaauggcggaggcacucaaggggaugccgauaagauaccagacaacugcaguaaaaagugaacauacaggaaaagaaauaguggaucuuaugugccaugcgacauucaccaugagauuauuaucucccguacgcguaccaaauuauaacaugauaaucauggaugaggcucauuucacagauccaucaucuaucgcugcaaggggauacauuucaacaagagugggaaugggagaagcggccgcaauuuuuaugacagcaacgccgccugguaguguagaggcuuuuccucaaucaaaugcugugauacaggacgaagagagagacauaccagagcgauccuggaauagcgguuaugaguggauaacugauuucccaggaaagacaguuugguucguaccuuccauuaagucggguaaugauaucgcaaacugcuuacguaagaaugggaaaaggguuauacaacucucacguaaaacauuugauacagaauaccagaaaacuaagaauaaugauugggacuacguuguuacuacagauauaucggaaaugggagccaauuuuagagcagaucggguaauugacccuaggcgauguuuaaaaccagugauacuaaaagaugggccugaacgggugauauuagcaggaccaaugcccguaacgguugcaagugcagcucaaagaagaggaagaauagguagaaaucauaacaaagagggagaucaauacauauauaugggacaaccgcucaacaacgacgaagaucacgcacauuggacugaagcgaaaaugcuacuggauaacauuaacacuccugagggaauaauaccugcuuuguuugaaccggagagagaaaaaucagcggcaauugacggagaauaccgccuacggggugaagcaagaaaaacguucguggaacuaaugagaagaggagauuuaccagugugguugucguauaaaguagccucugaaggauuucaauauuccgauaggcgaugguguuuugauggcgaaagaaauaaucaaguccuagaggaaaauauggauguagagauauggacgaaagaaggugaaaggaagaaacuuaggccaagaugguuagaugcgcgcacguauagugauccgcuagcacuccgggaguuuaaagaauuugcagccgguagacgcagcgugaguggagacuuaauucuagaaauugggaaacuuccucaacacuuaacucaacgagcacaaaacgcacuugauaauuuggucauguuacauaauagugaacaagggggacgcgcuuaccgacacgcaauggaggaacuucccgacacgauugaaacucuuaugcuacucgcacugauagcuguucuaacagggggaguaacacucuucuuucuuucggggagaggccuagguaagacuuccauagguuuguugugugugauggccucuucuguauuauuauggauggcuaguguugaaccacacuggaucgccgcauccauuauacucgaauuuuuccuuaugguacuauuaauaccggaaccugauagacagcguacaccccaagacaaucaauuggccuaugugguaauaggacuucuguuuaugauacugacaguagcugcaaacgaaaugggcuuacuggagaccacaaagaaggaucugggaauaggacauguagccgccgaaaaucaucaccacgcugcaauguuggauguagaucuucacccagcuucugcuuggacuuuauaugcaguugcaacuacuauaauaacuccuaugaugagacacacgauagaaaauacaacagcaaauauaucuuuaacugcuauugcgaaucaagcggcaauacuuaugggccuggauaaaggauggccgauuuccaaaauggauauugggguuccauuauuagcauugggauguuauagucaaguaaaucccuugacuuuaaccgcugccguguugaugcucgucgcucauuaugcuauaaucggcccugggcuccaagcuaaagccacaagagaggcgcaaaaacguacugcugccgggauaaugaaaaacccaaccgucgacggcauuguugcuauagaucuagacccaguaguauacgacgcaaaguuugaaaagcaacuugggcaaauuaugcuuuugauacugugcacaagucaaaucuuacuaaugcgaacaacuugggcgcuaugugaaagcauuacgcuugcaacagguccacuuacgacacucugggaaggaagucccggcaaguuuuggaacacuacuaucgccgucuccauggcgaauauuuuucgggguucuuacuuagccggagccggauuagcuuuuuccuugaugaaaucauuaggaggaggacgaagaggcaccggugcucaaggagagacuuuaggcgaaaaauggaaaaggcaacucaaccaacuaagcaaguccgaauuuaauaccuauaaacguucaggcauaauggaagucgauagaagugaagcaaaagagggucuuaaacguggugaaacgacuaagcaugcagucagcagaggaacggcgaaacugaggugguuuguagaacgaaaucuaguaaaacccgaaggaaaagucauugaucuaggaugcgguagaggaggauggaguuacuauugcgcuggauugaaaaagguaacggaaguaaaaggauauacaaaagguggaccgggacaugaagaaccaauucccauggcuacauauggguggaaucuaguuaaacuccacucaggaaaggauguguuuuucauaccaccugagaagugcgacacuuuauuaugcgauauuggagaaucauccccaaaucccaccauugaggaaggaagaacacuuaggguauugaagauggucgaaccguggcuucgcgggaaucaguucuguauuaagauucuuaaccccuauaugccuucaguaguagagacacuugaacaaaugcaacguaagcauggggguauguuagucagaaauccauugagucgaaauucuacucacgaaauguauuggguaucgugcgguaccggcaauauagucagugcagucaauaugaccucaagaaugcuucuaaauagauucacgauggcacacagaaaacccaccuaugaacgcgacguagauuuaggugcuggaacacggcauguugccguagagccagaaguggcaaaccuagauauaauugggcagcgaaucgaaaauaucaaacaugagcauaaaucaacauggcauuaugaugaagacaacccuuauaaaacaugggcuuaccauggaaguuaugaaguuaaaccaaguggaucggcaagcaguaugguaaauggagucgugaaacuacugacuaaaccuugggauguuauuccuauggucacacaaauggcaaugacagauacgacgccauuugggcagcaaagggucuuuaaagaaaagguagauacucguacccccaaggcuaaacguggcaccgcacaaauaauggaagucacagcaaaauggcucuggggcuucuuguccagaaacaaaaagccuagaauauguacgagagaagaauuuacgcguaaaguaagaucaaaugcggcuauaggugcugucuuuguagacgaaaaccaauggaacucugcuaaagaagcaguagaggaugaacgauucugggaccuaguccaccgggaaagggaauuacacaaacaggggaaaugcgcuacauguguguauaauaugaugggaaaacgagagaagaaacugggagaauuuggaaaggcgaaagguucucgggcaauuugguacaugugguuaggcgcaagguuucuugaguucgaagcccucggauuuaugaacgaggaucacugguuuaguagagaaaauucuuuaucugguguugaaggagaaggauuacauaagcuaggguauauacugcgcgauauaagcaaaaucccagguggaaauauguaugcugaugauacagcaggaugggauaccaggauuacugaagacgaccuacaaaaugaggccaggauaacagauauaauggagccagaacaugcucuccuagcaaaaucaaucuucaagcuaacauaccaaaacaaaguagugagaguccaaaggccagccaaaaacgggaccguaauggauguaauaucucggagagaccagcggggcucaggacaaguugguacuuauggauugaacacauucacaaacauggaggcacaauuaauucgucaaauggagucugaaggaaucuuuucacccucagagcuagaaacgcccaauuuggccgaacguguacuggauuggcuagaaaaauacggugucgaacgacuuaaaaggauggccauaucuggugaugauugcguaguuaagccgaucgacgauagauucgcuaccgcucugacggccuuaaacgacauggguaaaguucgcaaagauauaccccaaugggaaccuagcaaaggauggaacgauuggcaacaaguaccguucuguagccaucacuuucaccaauuaauuaugaaagacggaagagaaauaguaguaccuugccgcaaucaagaugaacuggugggccgcgcuaggguuucacaaggggcuggauggucacuccgggaaacugcuugucucgggaaaucauaugcucaaauguggcagcucauguauuuucaccgccgggauuuaagauuagcugcuaaugcaaucuguucugcagugccagucgacuggaucccaacaagucguacgacuuggucgauucaugcacaucaccaauggaugacuacagaggauauguuaaguguauggaauaggguauggaucgaggaaaacccauggauggaagauaaaacccacauaucuucauggggcgacguaccauaccuugguaaaagagaagaccaauggugcgggagucuaaucggcuuaacagcacgugccacuugggcgacaaauauacaaguugccauauaccaaguccgucgacugauuggcaaugagaauuaucucgauuauaugacaaguaugaaacguuuuaaaaacgaaagugacccggagggggccuugugguag

SEQ ID NO: 21201 - RNA, 9879 nt, Artificial Sequence
  derived and/or modified CDS sequence (opt6) from DENV-1__FJ639689__SS-prME
ucagucacaaugcuacuaauguuaaugccaacagcauuagcauuccauuuaacaauuaggggaggggaaccucauaugauaguaagcaaacaagaaagaggaaaaucucugcuuuucaaaacgagcgcuggggugaauaugugcacacuaaucgcaauggauuugggagaacugugugaagacacgaugacuuauaaauguccgaggauuacggaagcagaacccgacgacguggauuguugguguaaugcuacggauacuuggguuacauacggaacaugcucucaaacuggugaacauagaagagauaaaagaaguguugcccuagcaccucauguggguuuagggcuugaaacacgaacugaaacuuggaugagcucugaaggagcauggaaacaaauucaaaggguagaaacuugggccuuacgacaccccggauucaccguuauagcucuuuuucuugcccaugcuauaggcacuucaaucacacaaaaaggaauaauuuuuauccuguuaaugcuuguaacaccaucuauggcgaugagaugugugggaauugggucaagggacuuuguagagggccuuucuggagcgaccuggguugacguagucuuagaacauggaucgugcguaacgacaauggccaaagacaaaccgacuuuagacauagaacuuuugaaaacggagguuacuaauccagcgauucuaagaaaacuaugcauagaagccaaaauuucuaacacaacuaccgauuccagguguccaacgcagggcgaagcuacccuaguagaagaacaggaugccaacuucgugugucggcgcacuuuuguagacagaggaugggguaauggauguggcuuguuuggcaaaggaucccugaucacgugcgccaaauucaaauguguuaccaaacuggaagggaaaauuguacaauacgagaaccucaaauauagugugauaguuacuguccauacaggcgaccaacaucaaguuggaaaugaaucgacggaacacggcacaacggcaacuaucaccccacaagcaccaacgacugaaauacaacucacagauuacggagcauuaacccuagacugcagccccagaacaggacuugacuuuaaugaaaugguacuacuaacaaugaaagaaaaaucuugguuagugcauaaacaaugguuucuagaccuuccucuuccuuggaccucaggagcaagcacgucccaagagacauggaaccgacaagaccuccucguuacauucaaaacugcacaugccaagaaacaagagguuguuguauuaggaucgcaagaaggugcuaugcauacugcacuaacaggggcgacagaaauucaaaccucgggaacgacuacaauauuugcaggccaccuaaaauguagauuaaaaauggacaaauugacacuuaaaggaaugaguuaugugauguguacuggaucguuuaaacucgagaaagaaguugcagaaacucaacacgguacugucuuaguacaaaucaaguacgagggcaccgacgcacccugcaaaauaccuuucucaacucaagaugagaagggugucacacaaaacggaagacugaucacugccaacccaauagugacagacaaagagaagcccguaaauauugaagcagagccaccauucggggagucuuacaucguaaucggagcaggcgagaaggccuugaaauuauccugguucaagaaaggcucuaguauaggaaaaauguucgaggcuacagcucguggagcuaggaggauggcaauauuaggggauacagcgugggacuuugggucaauaggaggaguauuuacuagcguuggaaaacuuguccaucaaauauucggaaccgcguaugggguacuuuucaguggaguauccuggacgaugaaaauagguauaggaguuuugcuaacguggcuaggauugaauagucguucuacaucguucaguaugacaugcauugccguuggcuugguuacgcucuacuuaggaguuaugguacaagcugauucuggcugugugauaaacuggaaaggacgggaacuuaaaugugggucagggauuuuuguuacuaaugaagugcacacauggacagaacaauauaaguuccaggcugacuccccaaagcguuuaucagccgcaauaggcaaggcuugggaagaaggugugugcggaauacguagcgccacacgccuagaaaauaucauguggaaacaaaucuccaaugaauugaaccacauucuuuuagagaacgauaugaaauuuacagucguagucggagauguggcaggaauacuagcacaagggaagaaaaugauacguccucagccuauggaauauaaauauucuuggaggaguugggguaaagccaaaauaauuggagccgacguacagaauacaaccuucaucauagacgggccaaauacaccagaaugcccagaugaucaacgagcguggaauauuugggaaguugaagauuauggauucggaauauuuacaacgaauauauggcuaaaacuaagagauaguuacacacaaguaugcgaucaucgacuaaugagcgccgcgaucaaagacagcaaggccguacaugcagauaugggauauuggaucgagagugagaaaaaugaaacauggaaauuagcucgggcuucuuuuauagaaguaaagacuuguguauggcccaagucccacacguuauggucaaauggaguuuuagagucagaaaugaucauaccuaaaauuuauggaggcccuauaucacagcacaauuauagaccuggauacuucacacagaccgcugguccguggcauuuaggcaaauuggaguuggauuuugauuuaugugaagggacaacugugguggucgaugaacacugcggaaauagaggacccuccuuaagaacuacuacagucacaggaaagaucauccacgaaugguguugcaggucauguaccuuaccaccccuucguuuucguggagaagacggguguugguacggaauggaaauacgaccaguuaaagaaaaggaggaaaaccucguaaagucaaugguuagcgcaggaagcggagaaguagauaguuucucacuuggucuucuauguaucagcauaaugacagaagagguaaugcgguccagauggucucguaagaugcucaugacggguacacucgcgguauucuuauuauugauaaugggacaacuuacuuggaaugaccuuauucgacucuguauuauggucggggcuaacgcuucagauaggaugggaauggguacaacuuaccuggcucuuauggcaacauucaaaaugaggccaauguucgccguuggauuauuauuuagacgacuaaccagucgcgaaguuuuacuccuaacagugggacuaaguuuaguagcgaguguggaauuacccaauucccuggaggaacuaggugacggcuuggcuaugggaauaaugauauuaaaauuacuaacagauuuccaaccucaucaacuaugggcaacccucuuaaguuuaaccuucauuaaaaccacauuuagcuuacauuaugcauggaaaacaauggccaugguguuaaguauaguaucacucuuuccauuaugccuuaguacaacuucacagaaaacuaccugguugccggucuuauuaggcagcuugggguguaaaccacuaaccauguuccuuaucgcagaaaacaaaauauggggaagaaggaguuggccacuuaaugaaggaauaauggcaguagguauaguaagcauauuacugaguucauuacuuaaaaaugacguaccuuuagcuggcccacucauagccggagugaugcucaucgcaugcuacguaauuucugggaguucagcagauuuaucacuugagaaggcagcugaagucucuugggaagaggaagccgaacauagcggagcaagucacaacaucuuaguagagguucaagaugaugguacaaugaagauaaaagaugaagaacgugaugauacgcucaccauuuugcucaaggcaacauugcuugcugugucuggaguuuauccacuuucaauaccggcaacauuauuuguuugguacuucuggcagaagaagaaacaacgaucagggguacucugggauacgccuucacccccagaaguagagcgagcagucuuagaugauggaaucuaccguauaaugcaacggggacuauuaggaagaagccaaguaggaguaggaguauuccaagaaaauguguuccacacuauguggcacguaacucguggugcaguguuaauguaucaaggaaaacgacuugagccgucaugggcuucgguuaagaaagaucuaauaaguuaugggggaggcuggagauugcagggaucuuggaacacaggggaagagguacagguaauugcaguggaaccuggcaagaaccccaaaaauguccaaacugcuccaggaacguucaaaacuccugaaggagaagucggagcuauagcgcuagauuuuaaacccggaacgagugguucaccaaucguaaacagagaaggaaaaauaguaggcuuguacgguaauggugugguuacuacaucaggcacuuauguuucagccauagcacaggcaaaggcuucgcaagaagguccgcucccugaaaucgaagacgagguauucaggaagcgcaaucuuacuauaauggaucugcaucccggaaguggaaaaacccggcgguaucugccagcaauuguaagagaagcuauuaaacgaaaacuccgaaccuuaauuuuagccccaacuagggucguagccuccgagauggcagaagcauuaaagggcaugccaauccgguaucaaacaacugcagucaaguccgaacacaccgguaaggagauaguugaucuaaugugucacgcaacguuuacaaugagauuacuuucaccaguaagaguuccuaauuauaauaugauuaucauggaugaagcacacuucacagauccaucaaguaucgcggcacgagguuacauaucgacacgaguaggaaugggggaagcagccgcgauuuucaugacagccacgccgccaggcucgguagaggcauuuccucagagcaacgcaguuauacaagacgaggaacgagauauaccggaacgcaguuggaauagcgguuacgaguggauuaccgacuuuccaggaaaaaccgucugguuugucccaagcauaaagagugggaaugauauagcuaauugcuuacguaagaauggaaagcgugucauacaauugucucggaaaacguuugauacagaauaccagaaaacuaaaaauaacgauugggauuauguaguuacaacggauaucagugaaaugggugcuaacuuucgagccgaucgcguaaucgauccacgaagaugccuaaaaccaguuauauuaaaagauggacccgaaagaguuauauuagcaggcccuaugccggucacuguagccucagcggcacagcguagagggagaauaggccgaaaucauaauaaagaaggagaucaauauaucuacaugggucaaccauuaaauaaugacgaagaucacgcacauuggacagaagcuaaaauguuguuagauaauauaaauaccccagaaggcaucauuccugcacuauuugaacccgaacgggaaaagucagcggcuauagauggcgaauaucgguuaagaggagaagcuagaaaaacauucguagaacuaaugaggagaggagauuugccuguauggcugucauauaaaguggcaagcgaaggauuucaauacagcgaccguaggugguguuuugacggcgaaagaaauaaucaaguauuagaagaaaauauggauguagaaauauggacaaaagaaggagaacguaagaaacuuaggccgcgaugguuggaugcacgcacauacagcgacccacuagcucucagagaauuuaaagaguucgcugcagguagacguucgguaucuggugaucuaauucuagagauuggaaaauuaccucagcaucuaacucagcgagcacaaaacgcacucgauaaccuaguuauguuacauaacucugaacaagggggacgagcauaucggcacgcuauggaagaauugcccgacacuauagagacccucauguugcucgcacuuaucgcuguucuaacugguggcguaacauuguucuuucuaucugggcggggcuuggggaaaacaaguauagggcugcuuuguguuauggcaucuucaguauuacuuuggauggcuucggucgaaccucauuggauagcugcgagcauaauacuugaguucuucuuaaugguacuccuaauuccagagccagauagacaaagaacuccacaagacaaccaguuggcauauguuguuaucggauuauuauuuaugauacuaacugucgcagccaacgaaaugggucugcuagaaacaaccaagaaagacuuaggcauuggacauguggcgguuggaaaccaccaucacgcggcgauguuagacguugaucuacauccagcgucugcguggacgcuuuaugcgguugcaacaacaauaauaacuccuaugaugagacacacuauagaaaauacuacagcuaauauuucacugacugcuauugcgaaucaagcggcuauacuaaugggguuagauaagggauggccgauuaguaaaauggauauaggaguuccauuguuggcacucgguugcuauucacaaguuaauccguuaacucuaacggcugcuguacuaauguugguugcucacuaugccauaauagguccuggacuccaagcaaaggcuaccagagaagcucaaaaacgcacugccgcaggaauaaugaaaaacccgacuguagacgguaucguagccaucgaccuagacccggucguauaugacgcaaaauuugagaaacaguuaggucaaauaauguuguuaauauuguguaccucucaaauccuuuuaaugagaacuacuugggcacuaugugaaucgauaacacucgccacgggcccauuaacaacguugugggaagguucuccugggaaauuuuggaauacaacgauagcaguaucaauggcaaacauauuuagaggguccuaucuagcaggggcaggauuagcuuucucuuuaaugaaaucacugggaggagguagaagggggacuggggcucaaggugaaacguuaggugagaaauggaagagacaauuaaaccaguugaguaaaagugaguucaauacauauaaaaggagcggcauuauggaaguugaccggucggaggcaaaggaagggcuaaaaagaggagaaauaacgaagcaugccguuagccggggaacugcaaaauuaagaugguuuguugaaaggaauuugguaaaaccagaaggaaaagucauugacuuaggaugcggaagggguggaugguccuacuacugugcugggcucaagaaagucacggaggucaaaggguauacaaaaggugggccaggacacgaagaaccgaucccuauggcaacauauggguggaacuuaguaaagcuccauucuggcaaagauguguucuuugugccgccugaaaaaugugacacguuguuaugugauauaggugaaucaagucccaaucccacuauagaggaaggucguacauuaagaguuuugaagaugguugaaccaugguuaaggggcaaucaauucuguauaaaaauacucaacccguacaugccaagugucguggaaacguuagaacaaaugcaaaggaaacacgggggcauguuaguucgaaauccgcugucccgcaauucaacgcaugaaauguacugggugucuugcggaacaggaaauauaguaagcgcuguuaauaugacuucacguauguuacuaaaucguuuuacaauggcacaucgaaaaccuacuuaugagcgugaugucgacuuaggggccggaacgagacacguagcggucgaaccagagguagcaaacuuggacaucauagggcaacggaucgaaaacauuaaacaugaacauaaaucaacguggcauuaugaugaggacaauccauauaaaacuugggcauaccacgggucuuaugaaguaaaacccucaggaucugcaucaaguaugguuaaugggguagugaaauuacugacaaaaccaugggaugucauacccauggugacacagauugcaaugacggauacgacuccuuuuggccagcaaagggucuucaaggagaaaguggacacacgcacacccaaagcaaaacgcggaacggcccaaauaauggagguuacggcuaaaugguuauggggauucuugagcagaaauaagaaaccucgcauuuguacacgggaagaguucaccagaaaaguacgaucaaaugcagcuauuggggcaguauucguagacgaaaaucaauggaacagcgccaaagaggccguagaggacgagagauuuugggaccucguacauagagaaagagaauugcauaaacaagguaaaugugccacaugugucuacaauaugaugggaaagagagagaagaaauugggagaguucggaaaagcaaaaggcagcagagcaauaugguauauguggcuaggcgcaagauuuuuagaauuugaagccuuaggauuuaugaacgaagaccacugguucucgcgggaaaacucacuaucuggagucgaaggugagggucuucacaaacuaggguauaucuuaagagauauaaguaaaaucccaggagggaauauguaugccgacgacacugcgggaugggacacucgaauaacggaagacgaccuucaaaaugaggcgaggauuacagacauaauggaaccugaacaugcgcuauuggcuaaaucgauauuuaaacuaacauaucaaaauaaaguagucaggguccaaagacccgcuaaaaauggcacugucauggacguaauuucgagacgggaucagcgaggaucaggucaaguaggaacauauggauugaacacguuuacgaauauggaagcccaguuaauuaggcagauggaaucagaaggcauuuuuagcccuagugaacuagaaacaccaaaucuugcagaaagaguacuggacugguuggaaaaguauggcguugaaagguuaaagcgaauggcaauuucuggagaugacugcguaguaaagcccauugacgacagguucgcaacagcucucacagcucuuaaugauauggguaaaguccguaaagauauaccacaaugggaaccaucaaaaggauggaacgauuggcagcagguccccuuuugcagucaccauuuucaucaauuaauaaugaaagacgggagagagauuguuguccccugcagaaaccaagaugagcuaguaggcagagcacgcguuucacaaggggccggguggagucucagagaaaccgcaugccuaggaaaguccuaugcacaaauguggcaauuaauguauuuucacagaagagaccuaaggcuagcggccaacgcgauaugcagugccgucccuguagauuggauuccuacaucuaggacuaccuggucuauacacgcacaucaccaauggaugacaacagaagauauguuaaguguuuggaaucgaguguggauagaggagaauccauggauggaggauaaaacgcauauuucuucuuggggugacgucccauaucuugguaagagggaggaucaauggugcgguucucucauuggacucacagcacgagccaccugggcgacgaauauccaagucgcuauuaaccaaguaagaagguuaauuggaaacgagaauuacuuagacuacaugacaagcaugaagagguuuaaaaacgaaagugauccugaaggggcuuugugguag

SEQ ID NO: 21202 - RNA, 9879 nt, Artificial Sequence
  derived and/or modified CDS sequence (opt6) from DENV-1__FJ639690__SS-prME
ucaguuacaauguuauuaaugcuuaugcccacagcuuuagcauuucauuugacaauuagaggaggggaaccgcacaugauaguuucaaaacaggaaagaggaaaaucacuuuuauuuaaaacgagugcuggaguaaauaugugcacguuaauagcaauggaucuaggugaauuaugugaagacacaaugacauauaaaugccccagaauaacagaagcugaaccugacgaugucgauuguugguguaacgcaacagacacuuggguuaccuaugguacauguucccagauaggagaacaccgccgugauaaacguucggucgcccuagcuccccaugugggacuaggauuagaaacgagaacagaaacauggauguccucggaaggcgcuuggaaacaaauacaacguguggaaacuugggcacuaaggcacccuggauuuacaguuaucgcacuauuuuuagcacaugcaauagguacuucuauaacccaaaaagguaucauauuuaucuuacuaauguuaguaacaccgucaauggcgaugagauguguggggauaggaagucgcgauuuuguugaaggauuaaguggugcuacuuggguugauguuguuuuagaacauggaagcuguguuaccacuauggccaaagacaaacccacauuagacauugaauuauugaaaacugaaguaaccaauccagccauacuaagaaaacucuguauugaagcuaaaauuucaaauacuacuacagacagcagauguccuacucagggagaagcaaccuuaguagaagaacaagacgcuaauuuugucugcagacgcacuuuuguggaucguggcuggggaaacggauguggacuuuuuggaaaagggagucuaauuacuugugccaaauuuaaaugugucacgaaauuagaagggaaaauaguucaauacgaaaacuuaaaauacuccguaauuguaacgguccacaccggggaccaacaucaaguuggaaaugaaagcacagaacaugggacuacagcgacuaucaccccacaagccccaacuacagaaauacaacuaacugauuauggugcauuaacacuagauugcuccccgaggacuggccuugauuucaacgaaaugguguuauuaacuaugaaagaaaaaucguggcugguccauaaacaaugguuuuuggaccuacccuuaccguggacaagcggggcaaguacuucccaagaaaccuggaacaggcaagaucucuuaguaacauuuaaaacggcacacgccaagaaacaggagguuguaguuuugggaucacaggaaggggcgaugcacacagcauugacuggugcuacagaaauccagacuagcggcacuacaacgaucuuugcaggccauuuaaaauguagguugaaaauggacaagcugacucuuaaagguauguccuauguuauguguacaggaucauuuaaguuggaaaaagagguugcagaaacccaacauggaacagucuuagugcaaauaaaguacgaagggaccgacgccccaugcaaaauuccauuuaguacucaagacgaaaaaggaguuacgcaaaauggacgacuaaucacggcaaauccaaucgugacugacaaagagaaaccugucaacauagaagcagaaccgccuuucggggagagcuauaucguuauaggugcuggagaaaaagcgcuaaaguugagcugguucaagaaagggucaucaauuggcaaaauguucgaagcuaccgcacggggagcuaggagaauggcgaucuugggagauacagcuugggauuucggaucaauuggugggguuuucacuucuguuggcaaacuuguccaucaaaucuuuggcacagcauaugguguguuguucucagggguaucauggacaaugaaaauaggaauagguguguuauuaacuugguugggcuuaaauucucgaagcaccucauucaguaugacaugcaucgcagugggccuuguaacccuuuacuugggaguuauggugcaagcagauucagguugcgucauaaauuggaaagggcgcgaauuaaaauguggaagugguauauuuguaacaaacgaaguucauacguggacagaacaauauaaguuucaagccgacucuccaaaacgauuaucugcagcaauuggaaaagccugggaagaaggagucugugguauacgaucagcgacacgacuggaaaacauuauguggaaacaaaucagcaaugaguugaaucauauacuccucgaaaacgauaugaaauuuacaguuguaguuggagaugucgcaggcauacucgcucaaggaaagaaaaugauaagaccgcaaccaauggaguacaaauacucguggcguuccuggggcaaagcuaaaauuauuggugcugacguucagaauacaacauuuauuauagauggaccaaacacccccgaguguccugacgaucagagagcauggaauaucugggaaguugaagauuauggcuucgguaucuucacuacaaacauaugguuaaaauuacgggauucuuacacgcaaguaugcgaucacagacuaaugagcgcagcaaucaaagauaguaaggcuguacaugcagauaugggcuacuggauugagagugagaaaaaugaaacauggaaauuggcaagggcuagcuuuaucgaaguuaaaacuuguguuuggccaaagagucauaccuugugguccaaugguguuuuggaaagcgaaaugauuaucccgaagaucuauggaggaccgauaucacagcauaacuacagaccaggauacuucacacaaaccgcuggcccuuggcaucucgggaagcuggaauuagacuuugaucucugcgaaggcacuaccgucguaguugaugagcacugcggaaaccguggcccaagccuuagaacaacgacuguaacaggaaaaauaauccacgaguggugcugucggaguugcacauugccuccccuacgguuuaggggugaggauggaugcugguacggaauggaaauuagaccuguuaaagaaaaggaagaaaaucugguaaaaucuaugguuagugcuggcucaggagaaguagauaguuucucauuagggcuuuuguguauuaguauaaugacagaagaggucaugagaagccgauggagucgcaaaaugcucaugacuggaacguuagcagucuuuuugcucuuaauuaugggacaauuaacauggaacgaucucauaagacuuugcaucauggugggugccaaugcaagugaccgaaugggcaugggaacaaccuaccuagcuuuaauggccaccuuuaaaaugaggcccauguuugcugucggacuguuguuuagaagguuaacgucuagagaaguauugcuauuaacagucggccuuucauugguagcuucgguugaacuuccaaacagccuugaagaauuaggagacggacuagcaauggguauaaugauucuuaaauugcucacggacuuccagccacaucaacuuugggcaacguuauuaucucucaccuucauaaaaacgacuuuuagucuacauuacgccuggaaaaccauggcaaugguauugucaaucguuagccuuuuccccuuauguuugucaacaacgucgcagaagacaacgugguuaccaguuuuauuaggcagcuuggggugcaaaccucucacuauguuuuuaauagcugagaacaagaucuggggcagaagaaguuggccccuaaaugaaggaaucauggcagucgggauugucucgauacuacugaguagucuauuaaagaacgacguaccucuagcugguccucugauagcaggaggaauguuaauagcuuguuaugugauaucuggaagcucagcagauuuaagccuagaaaaagcagcggagguuucuugggaagaagaagccgagcauaguggagcgagccauaauauuuugguugaaguacaagacgacgguacaaugaaaauaaaagaugaagaaagggaugauacucucacuauucugcuaaaagcuacucuacuagcuguguccggaguuuaucccuuaagcauacccgccacacuauuugucugguacuuuuggcagaagaagaaacagcgaaguggcguucuaugggacacaccaucaccaccggaaguagaacgggccguucuagacgauggcauauacagaauaaugcagagaggccuucuuggccgaagccaagucgguguugguguauuccaggagaauguuuuccauacgauguggcacguuacgagaggggcaguucucauguaucaaggaaaaagguuagaaccaagcugggcaucugucaagaaagacuuaaucucauauggagguggauggagauugcagggaucuuggaauacaggagaagaaguacagguaauugcaguugaaccugguaaaaacccgaaaaauguccagacagcaccgggaaccuucaaaacuccugagggagaaguaggagcaauugcacuagauuuuaaaccagguacaagcggcuccccaauaguaaauagagagggaaaaauagucggcuuguacggaaaugguguagucacuacuucagggacauauguaagugcgaucgcacaagccaaagcgucccaagaagguccccugccagaaauagaagaugaaguauuccggaaacgaaacuuaacaaucauggaucugcaccccgguucaggaaaaaccagacguuauuuaccagcaauaguuagagaagcaauaaaacgaaaauugcgaacucuuauacuugcaccgacucgcguaguagcuagugaaauggcugaagcccugaaaggcaugcccauccgauaucaaacuacagcaguuaagucugaacauacuggaaaagaaaucguugaucuaaugugucaugcaacauuuacaaugagacucuuaucuccagugagagugcccaauuauaauaugauaauuauggaugaagcacauuucacugaccccagcaguauugccgcccgaggguauaucaguacaagaguuggaaugggugaggcagcggcuaucuuuaugacggcaacuccaccaggaucaguagaagcauuuccacagagcaaugcggugauucaagaugaggagcgagauauaccugagagaucuuggaauagcggauaugaauggauaacagacuucccugguaaaacaguuugguucgucccaaguauaaagucuggcaaugauaucgcgaacugucuacgaaagaacgguaaaagaguaauucaacuuucacguaaaacuuuugauaccgaauaccaaaagacgaaaaacaacgacugggacuauguaguuacaacagacauaucagaaaugggcgccaacuuccgagcagauagaguuauugacccaaggagaugccuuaaaccugugauacuaaaagacggaccagaacgagucauacuagcugguccaaugccgguaacgguagcuucagcggcucaaagaagagggagaauaggacguaaucacaacaaagaaggggaucaauauauuuacaugggacagcccuuaaauaacgaugaagaucacgcacacuggacagaagcaaaaaugcuucuugacaacauaaauacaccagaaggcauaauccccgcucuauuugagccugaacgagaaaaaucugcagcuauagacggagaauaucgccuuagaggggaagcucggaaaaccuuuguggaguuaaugcgacguggugaucuaccgguguggcuaaguuacaaaguggcgucggaaggcuuucaauauucggaccgaaggugguguuuugauggugaacgaaacaaucaaguucuugaagaaaacauggauguagaaauauggacaaaagagggugaaagaaagaaacugcguccuagauggcuggaugcgagaacuuacucagauccguuggcacuaagagaguucaaagaguuugcagcuggaagaagaagcguaucaggcgauuuaauacuggagauaggaaaauugccgcaacacuugacacaaagggcacaaaaugcucuugacaaucucgucaugcuacauaauagugagcaaggcggcagagcuuauagacaugcaauggaagaauuaccggauacaauagaaacacucaugcuauuggcccugauagcuguauugaccgguggagucaccuuguucuuuuugaguggaagagggcuggggaagacguccauaggauuguuauguguuauggcauccucaguacuucuguggauggcaucaguagaaccacauuggauagcagcaaguauaauacuagaauuuuuccuaaugguccuauugauaccggaacccgaccgccaaagaacaccucaagauaaucaauuagcuuacguuguaauuggccucuuauuuaugaucuugacaguugcggcuaacgaaaugggucuucucgaaaccacuaagaaagauuuaggaaucggacauguggcuguuggcaaucaucaccacgcagcgaugcuagacguggauuuacacccugcuucagcuuggacauuauacgcgguagcgacaaccauuaucacuccaaugaugagacacaccauagaaaacacaacagcuaauauuucucucacugccauagcuaaucaagcugcaauacuuauggggcucgacaaaggauggccuaucucaaaaauggacauaggaguaccauuacuggcauugggauguuacagccaaguaaauccacuaacuuuaacugccgcuguucuuaugcucguugcacacuaugcaauuaucggcccaggauuacaagcuaaggccaccagggaagcccaaaaacguaccgcugccgguaucaugaaaaauccaaccguagacggaaucgucgcgauagauuuggacccaguaguauaugaugcaaaauuugaaaagcaguuaggucagauaaugcuccugauauuaugcacaucgcaaauuuuacuaaugagaacaacgugggcacuaugugaaucaaucacacuagcaacagguccuuuaacuacauugugggaaggcaguccggggaaguuuuggaauacaaccaucgccguguccauggcuaauauuuuccguggaucguaccucgcuggugcaggauuagcuuuuucgcucaugaagucgcuaggagggggaagacgagguacaggggcacaaggagaaacgcuaggagagaaguggaaacgucaauuaaaucagcuuucaaaaucagaguuuaauacauauaaaaggucaggaauuauggaaguagaccgaagugaggccaaagaaggauugaagagaggagaaauaacaaaacaugcuguaucaagaggaaccgcaaaguuacguugguuuguugaaagaaaucucgugaagcccgaagguaaaguuauagaccugggaugugggcgagguggauggucuuacuauugugcgggucuaaagaaaguuacugaaguaaaaggcuauacgaagggcgguccgggucaugaggagccaauuccaauggcaacuuauggauggaacuuaguaaaguuacauucugguaaagacguauuuuucguuccaccugaaaaaugugacacauuacucugugauaucggugaaaguucgccgaaccccacuauugaggaaggaagaacauugagaguccugaaaaugguagaaccgugguugagaggcaaccaguuuuguauaaagaucuugaacccguacaugccuucugucguagaaaccuuagagcaaaugcaacgcaaacauggagguaugcuuguuaggaauccauuaagucgaaacucaacacacgagauguauuggguuucuuguggaacagggaauauuguuucggcuguuaacaugacaucacgcauguuguugaaccguuuuacgauggcgcauagaaagccuaccuaugaacgugacguagauuuaggagcugguacuagacacguagcuguagagcccgaagucgcaaacuuggacauaauaggacaaagaauugaaaacauaaaacaugaacauaaaaguacuuggcauuacgacgaagacaauccauauaaaacuugggcuuaucaugguucguacgaggucaagccaaguggaagugcguccaguauggugaauggaguaguaaaacugcuaaccaagccuugggaugucaucccuauggucacccaaauugcuaugacggacaccaccccauuuggccaacaaagaguguucaaagaaaagguagauacgagaacacccaaagcuaaaagaggaacugcccaaauaauggaaguuacggcaaaauggcuuuggggcuucuuaaguagaaauaagaaaccgcgaauauguacucgugaagaguucacaagaaaaguucguucuaaugcagcuaucggagcaguauuuguggacgaaaaucaauggaacucagcaaaggaggcaguugaggacgaacgauuuugggaucuaguacauagggaaagagaauuacacaaacagggaaagugcgcuacgugugucuacaacaugaugggaaagcgcgagaagaaauugggcgaguucggaaaggcuaaagggagcagggcuauaugguacaugugguuaggugcacgauuucucgaguucgaggccuuagguuuuaugaaugaggaucauugguucucacgcgaaaacagccuuucuggaguagaaggagagggauuacacaaacuaggauacauucucagagacauuucaaaaauuccugguggcaacauguaugccgacgacacagcagguugggauacaagaauaacugaagaugauuugcaaaaugaagcaaggauuacagauauuauggagccggaacaugcgcuguuagcgaaaaguaucuuuaaauugacuuaucaaaauaaaguaguuagaguucaaagaccugccaaaaauggaacaguaauggaugugauuucacgacgagaucaacgaggaucaggucaagucgggaccuauggccuuaauacauucacuaauauggaggcccaacuuauuagacaaauggaaagugaagguauuuucuccccaucagaacuggaaaccccuaacuuagcugaacgaguauuggacuggcuugaaaaguaugggguggaacggcuuaaaagaauggcgauaaguggcgaugacugcgucguuaagcccauugaugaucguuucgcuaccgcuuuaacugcacucaaugauauggguaagguuaggaaagacauaccacaaugggagcccucaaaagguuggaacgacuggcagcaaguaccauucuguucgcaccauuuucaucaacucauuaugaaagauggccgugagauuguagucccauguagaaaccaggaugagcuagugggacgagcaaggguaagucaaggcgcaggcuggagccuacgugaaacagcguguuugggcaaaucauacgcucagauguggcaauuaauguauuuucauaggagagaucuucgccucgcagcaaaugccaucugcuccgcggugccagucgauuggauaccaacgagccguacaaccugguccauccacgcgcaccaucaauggaugacaacagaagauaugcuuucaguauggaauagaguuuggauugaggaaaaucccuggauggaagacaagacacauauaaguaguuggggugauguaccauaccuuggaaaaagggaagaccaauggugcggaucucuuaucggauugacugcaagagccacuugggcaaccaacauacaaguagccauaaaucaaguuagaagauuaaucgguaaugaaaacuacuuagauuacaugacaagcaugaagagauuuaagaacgaaucugacccagaaggggcacucugguaa

SEQ ID NO: 21203 - RNA, 9879 nt, Artificial Sequence
  derived and/or modified CDS sequence (opt6) from DENV-1__FJ639691__SS-prME
ucuguuacuaugcuccuaauguuaaugccaacagcauuagcauuucaucuuacuacaaggggaggugaaccacauaugauagugagcaaacaagaacgaggaaaaucucuauuguucaaaacaucagcgggaguuaauaugugcacacuuauagcaauggaucuaggugaauuuugugaagauaccaugacauacaaauguccgaggauuucugaagcagaaccugaugaugucgacuguuggugcaaugcuacagauacaugggucacguacgguacguguagucaaacaggugaacauaggagggauaaacggucuguugcacuagcaccucauguuggcuugggguuagaaacaaggacugaaacauggaugucgucagaaggggccuggaagcaaauucaacguguggaaacuugggcuuugcgacaccccggauuuacagugauagccuuguuucuugcacacgcaauugggaccucuauaacacaaaagggaauuaucuuuauccuucugauguuaguaacgccguccauggcgaugcgauguguuggaauagggucaagggacuucguugaaggguugagcggugcaaccuggguggacgucgugcuugaacacggaaguugcgugacaaccauggcuaaagauaaaccuacgcuagacauagaacuacuuaaaacugaagugacaaaucccgcuguguuaagaaaacuuugcaucgaagcaaagauuagcaacacuacaacggauucaagaugccccacucagggagaagcuacacucguugaagaacaagaugcuaacuuugucugcagacgaacuuuuguugauagaggaugggguaauggaugcggucuauucggaaaaggaucauugauuacaugugcaaaauucaaaugcgugacaaaacuugaagggaaaauuguacaguacgaaaacuugaaguauucagucaucguaacagugcauacgggagaccaacaucaagugggaaaugaaucgaccgaacauggaacuacugcuacuauuaccccacaggcgcccucgacagaaauucaauuaacggauuacggagcauugaccuuggauugcagcccccgaaccggacuagauuucaacgaaaugguauuauugacaaugaaggagaaaagcugguuaguccauaaacaaugguuccuagacuuaccauuaccguggacgagcggggcgucgacgucacaggaaacauggaaccgucaagacuuauuaguaacauuuaagacagcgcaugcgaagaaacaggaagucguaguacucggaucucaagaaggagcuaugcacacagccuuaacgggagcuaccgaaauacagaccucaggaacaaccacuauauuugcaggccaccuaaaaugccgacuaaagauggauaaacucacguuaaaagggaugucuuaugucaugugcacgggaucuuuuaaauuagaaaaagaaguugcggaaacucagcacgggacuguucuaguacagauaaaauaugaagggacugaugcgccaugcaaaauuccguuuucaacacaagaugaaaaaggaguaacgcaaaacggacgacugauuacggcuaacccaaucgugacagauaaagaaaagccggugaauauagaagcggagccgccguucggugagaguuacauaguuaucggugcaggggaaaaggcacuuaaacuauccugguuuaagaaaggaucaagcauugggaagauguuugaggcaacagcuagaggcgcaaggcgcauggcaauacugggggauacagcuugggauuucgggucgauuggaggugucuuuacauccguagggaaauuggugcaucaaauuuucggaaccgcauaugguguucuauucaguggagucuccuggacaaugaaaauugggaucggaguuuuacuuacuugguugggucuaaauagccgaucaaccagcuugucaaugacauguaucgcaguagggcucgucaccuuauaucucggagugaugguacaagccgacucgggaugcguaauuaauuggaaaggcagagaguuaaaaugcggcucggguaucuucguuaccaaugaggugcauacauggacugaacaauauaaauuucaagcagauucaccaaagagauuaagugcagcaauaggaaaagcgugggaagaaggugugugcggaauuagaucggccacucgcuuagaaaauauaauguggaagcagauaaguaaugagcuaaaccauaucuuacuagaaaacgacaugaaguucacggucguagugggggacguugccggaauuuuagcgcaaggcaagaaaaugauacguccucagccuauggaauacaaguauaguuggaagucauggggaaaagcgaagauaauuggagcagauguucaaaauacuacauucauuaucgaugggccgaauacaccggagugcccugaugaucaacgggcguggaauaucugggaaguggaagacuaugguuuugggauauucacgacgaauaucugguugaaguuaagagauuccuauacucaagucugugaucauagauugaugagcgcggcaauaaaagacaguaaagcgguacaugcagauaugggauauuggauagaaucugagaaaaaugagacauggaaacuugcgagggccagcuuuauugaaguuaaaacuugcauauggccaaagagucauacacuuugguccaacggcguucuagaauccgagaugaucaucccaaagaucuaugggggacccauaucgcaacauaauuauagacccggauauuuuacucaaacagcaggaccauggcaccuugguaaacuagaacuagauuuugauuuaugugagggaacuacgguaguuguagacgaacacugcgggaauagagggcccagcuuaaggacaacaacaguuacagguaagaucauccaugaaugguguugcagauccugcacguugccgccauugcguuucaaaggagaagaugguuguugguaugguauggaaauacguccaguaaaagaaaaagaagagaacuuaguaaaguccaugguauccgccgguucaggugaggucgauagcuuuucacugggguuacucuguauaucaauaaugauagaagaggugaugaggaguagguggagccgcaaaaugcuaaugacuggcacauuagcuguauucuuuuuauugauaaugggacaacucacauggaaugaucuuauaaggcuuugcauaauggugggcgcgaaugccagugaucguaugggaauggguaugacauaccuagcuuugauggcaacauucaaaaugagaccuauguuugccgucggauuguuguuuaggcgucuuacaucgcgugaaguacuacuccuuacaauaggucuauccuuaguugcgaguguggaauuaccaaacagccuagaagaacuuggagacggcuuagcgauggguauaaugauauuaaaauuguuaacagauuuucaaucauaccaguuaugggcaacauuacuaagucuaacuuuuauaaaaaccacauuuucguuacacuacgcauggaaaacaauggcaaugguccugaguauaguuagucuauuuccucuuugcuuaaguacgacaagucagaaaacaacuuggcuuccaguuuuguuaggaucacuaggaugcaaaccauuaaccauguuuuuaaucgcugaaaacaaaauauggggucggaaaucuuggccgcucaaugaaggaauaauggcaguaggcauaguuuccauucuacucaguagucuacuaaagaaugaugugccauuagcuggaccacuaaucgcuggcggaaugcuaauagcauguuaugucauauccggaaguucugcagacuuaucacuagaaaaagcugcugaaguaucuugggaagaagaagcagaacauaguggggcaagucauaauaucuugguagaaguacaagaugacggcacuaugaaaauaaaagaugaagaacgagaugauacauuaacaauuuuauugaaagcaacacuauuagccguaucugguguguacccucucucaauuccagcaacucuauucguaugguauuuuuggcagaaaaagaaacaacguucaggaguucucugggauacuccuagcccacccgaaguggaaagggcaguguuagaugacggaauuuaucgaaucaugcaaagagguuuauuaggcagaucacaaguagguguuggaguuuuucaagaaaauguauuucacacaauguggcauguuacgagaggcgccguacuaauguaucaagggaaaagacuugaacccaguugggccucuguuaagaaagaucuaauuaguuacggaggaggauggagauuacaaggcaguuggaacacuggagaggaagugcaaguaauagccguagaacccggcaaaaaucccaaaaacguacaaacagcaccugggaccuucaaaacgucggaaggagaagugggcgccauagcacucgacuucaaaccuggcacuucuggauccccaauaguuaaucgggagggaaaaauuguuggcuuguacggaaacggugugguuacaacgagcggaacuuauguaagugcaauugcucaagccaaagcaagucaagaagguccacugccugaaauagaagaugaaguauucagaaaaagaaacuugacuaucauggacuugcauccgggaaguggaaaaacacgaagauauuuaccugccauaguaagagaggccaucaaacgcaaauuaagaacacucauuuuagcacccacaagagugguugcgucugagauggcagaagcgcucaaagggaugccuauucgcuaccaaaccaccgcaguaaaaucugaacauacaggcaaagaaaucguugauuugaugugccaugcaacauucacuaugagacugcuauccccuguaagagugcccaacuauaacaugauuauaauggacgaggcacauuuuacggauccaucuucgauugcugcaagagguuacauuucaacgcgaguuggaaugggugaagcugccgccauauuuaugacagcaaccccaccuggcaguguugaagcguucccccaaaguaaugcagucauucaggaugaagaaagggauauaccugaacguaguuggaacucugguuaugaauggauuaccgacuuuccaggaaagacaguaugguucguuccaaguaucaaaucaggcaacgauauagccaauugucuuaggaaaaacggaaaaagagugauccagcuaagcaggaaaacauuugacacugaguaucagaagaccaaaaauaacgacugggauuauguaguaacaaccgauauaagugagaugggagcaaacuuuagagcugauaggguuauagauccacggcgaugucuaaaaccuguuauccugaaggaugguccagaacguguaauacucgcagggcccaugccuguuacaguggccucagcugcccaaagacgagguagaauuggcagaaaucauaauaaggaaggagaccaauacauuuauauggggcaaccguugaacaaugacgaagaucacgcccacuggacugaagcuaagauguuauuagacaauauaaacaccccugagggcauaaucccggcccuauuugaacccgaaagagaaaaaucugcugcaauugauggugaauaccgccugcgaggugaagcucguaagacauucgucgaacugaugagacgaggcgacuugcccguuugguuaucguauaaaguagcaucugagggauuccaauauucagacagaagauggugcuucgacggugagagaaauaaucagguccucgaggaaaacauggacgucgagaucuggacgaaagaaggagaaagaaagaaauuacgaccacgauggcuagacgcuaggaccuauucugacccguuggcacuaagagaguuuaaagaauuugcagcagguagaaggagcgucucaggggaucuaauacuugaaauuggaaaauugccacaacaccucacacagcgggcacagaaugcucuggacaauuuaguuauguugcacaacagugaacaaggugggcgagccuauagacaugcuauggaagaacugccagauacuauugaaacuuugauguugcuugcacucauugcaguccuuacaggcgguguuacauuauuuuuccuaucagguaggggccuagguaagacaagcauaggcuuacuuuguguuauggcaucaucaguacuacuguggauggcaaguguugaaccccauuggauagcugcgaguauaauacuggaguucuuucuaauggugcuuuuaauacccgagccugacagacaaagaacuccacaagauaaccaauuagccuauguaguaauaggacuuuuauuuaugaucuugaccguugcggccaacgagauggguuugcucgaaacuacgaagaaagaucuggggauaggccauguugcgguugaaaaccaucaucacgccgcaaugcuugauguggacuuacauccagccucagcauggacauuguaugccguagcuacaacaauaauuaccccaaugaugaggcacaccauagaaaacacuacggcaaacauuucacugacagcuauagcaaaccaggcagccauacuaaugggauuagauaaaggcuggccaaucaguaagauggacaucggagucccauugcuagccuugggaugcuacagccaaguuaacccacuuacauuaacggccgcagucuuaauguuagucgcgcacuaugcaauuauugggccuggcuuacaggcaaaagcaacacgagaagcucaaaagagaacugcagcugggauuaugaaaaacccaacuguugaugguaucguugccauugauuuagaccccguuguauacgaugcgaaauucgaaaaacaauuaggacaaauaauguuacuaauacucuguacuucacaaauccuacuaaugcgcacaacuugggcuuugugugaaucuauaacucuagcuacgggcccucuaacaacgcuuugggaaggaucaccuggcaaauuuuggaacacaacaaucgcuguuucaauggcuaacauauuuagagggaguuaucuugcaggagccggucuagcguuuaguuugaugaaaagccuaggcggcggaagacgagguaccggcgcgcaaggggaaacacuaggggagaaguggaaacgacaauuaaaucaacuuucaaaauccgaguuuaacacauacaaaagaucgggaaucauggaaguugacagaucagaagcgaaagaaggacuaaaaagaggugaaacaacaaaacaugcuguaagccguggcaccgcaaaauuacguugguucguugaacgaaaccuuguuaaaccugaaggaaaaguaaucgacuuaggauguggccgcggugguuggucuuauuauugcgcgggucuaaagaaaguaacugagguaaaaggcuacaccaaaggagguccaggacaugaagaacccauacccauggcuacauaugguuggaaucuagugaaacuacacucuggcaaagauguauucuuuguaccgccggaaaaaugugacacacuccuaugugacauuggugaaucuagcccaaauccgacaauagaggaggguaggacgcuacgaguuuuaaagauggucgaaccauggcuaagaggcaaucaauucuguauaaagauauuaaauccguauaugccuucggugguugaaacauuagaacagaugcaacgaaagcacggcgggauguuaguucgcaauccguugagcaggaauaguacucaugaaauguacuggguuucaugcgguacagguaauaucgugucagcuguuaacaugaccagcagaaugcuacucaaucgauuuaccauggcccacagaaaaccaacuuaugaacgugauguggaucuaggcgcaggaacacggcacguagcaguagagccggaaguagcuaauuuagacauaauaggucaaaggaucgagaacauaaaacacgaacacaaaucaacuuggcauuaugacgaggauaacccguauaaaaccugggcuuaccacggcucuuaugaaguuaaaccgagcggaucagcaucaagcaugguuaaugggguaguaaaauuacuaacuaaaccuugggacguaauuccgaugguuacccagauugcaaugacagauaccacaccauucggacagcaaagaguguucaaagaaaagguagacacacggacgccaaaggccaaaagggguacagcacaaauuauggaagugacugcaaaauggcuuugggguuuucugucaagaaauaagaaaccacgcauauguacacgagaagaguucacaagaaagguuagaucuaacgcagcuauuggagcaguguucguagacgaaaaccaguggaacagcgcuaaagaagcaguagaagacgagagauuuugggacuuaguacauagagaaagagagcuccauaaacaaggcaaaugugcgacuugcguauauaauaugaugggcaaaagagagaagaaacuaggcgaauuuggcaaagcaaaaggcucuagggccauaugguacaugugguugggagcuagauuucucgaguucgaggcuuuaggauucaugaacgaagaucacugguucucgagagaaaacucauuauccggaguugagggcgaaggcuugcacaaauuggguuacauacugcgggauauuucgaaaauuuccgggggcaacauguacgccgaugauacagccggaugggacacacggauaaccgaagacgacuuacagaaugaagcgaaaauaacagauauaauggaacccgagcaugcuuuauuagcuaaaucgauauuuaaacuuacauaucagaauaaaguuguaaggguacaaagacccgccaaaaauggaacaguuauggauguuauaucaagacgugaccaaagggggucuggacaaguaggaacauauggauuaaauaccuucaccaauauggaagcacaacuaaucaggcaaauggaaucagaaggaauauuuagccccagugaacuagagacuccaaauuuagccgaaaggaccuuagauugguuagaaaaacauggggucgagcguuuaaaaaggauggcuaucagcggugaugauuguguuguaaaaccuaucgaugaccgcuuugccacugcucuuacagccuuaaaugauaugggaaaggucagaaaggauauaccacaaugggagccuagcaaagguuggaaugauuggcaacagguacccuuuugcagucaucauuuucaccaacuuaucaugaaagaugguagagaaaucguagucccaugucguaaccaagaugaacucguggguagagcuaggguaagccaaggcgcuggauggagcuuaagagaaaccgcuuguuuaggaaaaagcuaugcgcaaauguggcagcucauguacuuucaccgaagagaucugcgauuggcagcuaacgcuaucuguucagcugucccaguagauuggguaccuacgucacgaaccacuuggucaauacaugcccaccaucaauggaugacaacagaggauaugcuaucagucuggaacagggucuggauugaggaaaauccguggauggaagacaaaacacauauuucuucgugggaggaugugccuuauuuaggcaaacgcgaagaccaauggugcggauccuugauaggucuaacagcgagagcaacaugggcaacaaauauacagguggcaauuaaucaagugcguagauuaaucgggaaugagaauuaccucgauuacaugacgaguaugaaaagauucaaaaacgaaagugaccuugagggagcguuaugguag

SEQ ID NO: 21204 - RNA, 9879 nt, Artificial Sequence
  derived and/or modified CDS sequence (opt6) from DENV-1__FJ639692__SS-prME
aguguaacgauguuauuaauguuaaugccuacagcucuagcauuccaccuaacuacaagagguggagaaccgcacaugauuguaucaaaacaagaaaggggaaaaucucuccuauuuaaaaccucugccgggguaaauaugugcacuuuaauagcaauggacuuaggugagcucugugaagauacaaugacauauaaaugcccuagaaucacagaagcggaaccagacgauguagauuguugguguaacgcaaccgacacauggguuacauaugguacauguucacaaacuggugaacacaggcgugauaaacggucaguugcuuuagcaccgcaugugggauuaggucuagaaacucggacggaaacauggaugagcagcgaaagcgcauggaaacaaauucaaagaguugaaacuugggcuuugcgucauccugguuuuaccguuauagcguuauuuuuggcccacgcaaucggaacuuccauaacucaaaaaggaauuaucuucauauuacuaaugcuugucacucccaguauggcaaugcguugcgucgggauuggaucgagagacuuuguagaaggacucucaggugcgaccuggguagacguuguauuagagcaugggaguuguguaacaacuauggcuaaagauaaaccuacacuagauauagaacuauuaaaaacggagguuaccaaccccgcaauacugagaaaacuuugcauagaagcuaaaauaucgaauacgacuacggacucacguugcccgacacaaggagaagccacauugguugaagaacaggaugcaaauuuuguaugucgacgaacauuuguagacagaggcuggggaaacggcuguggcuuauuuggaaaaggcaguuuaaucacuugugcuaaauucaaaugcgugacuaaacuagaagguaaaaucguucaguacgaaaauuuaaaauauucagugauaguuacagugcauacgggcgaccaacaccaaguuggaaacgagucaacagagcauggaacgacugcgacuauuacuccucaggcuccaacaacugaaauucaacuuacagauuauggagcucuaacuuuagauuguucaccaagaaccgggcuagauuucaaugagauggucuuauugacgaugaaagagaaaagcuggcuaguucauaaacagugguuucuggacuugccgcuuccuuggaccuccggugcaucaacuagccaagaaacauggaaccggcaagacuuacucgucacguucaaaacagcgcacgccaagaaacaggaagucguaguuuuaggcagucaagaaggugccaugcauacagcucuaacaggagcaacagaaauacaaacuucgggcacaacgacgauauuugcagggcaccuaaaaugccgauuaaaaauggauaaauuaacacugaaggguaugaguuacguuaugugcacaggcaguuucaaacucgagaaagaagucgcagaaacgcaacacggaacaguucucguucaaauaaaguacgaaggaacggacgcgccauguaaaauuccuuuuucgacacaagaugaaaaagguguaacccaaaaugguagacuaauaaccgcaaacccaauagucacagauaaagaaaaaccuguaaauauugaagcggaacccccauuuggagaguccuacauugugauuggugcaggggagaaggcuuuaaaguuaucaugguucaagaaaggaucaaguauaggaaaaauguucgaagcaacagcucgaggggccagaagaauggcaauauuaggagauacugcaugggacuuuggaaguauagggggaguuuuuaccucaguugguaaauugguccaccagauauuuggaacggcauaugguguguuguucuccggggucaguuggacaaugaagauagguaucggaguauuacuuacauggcuugguuuaaauuccagaucgacaucuuuaucaaugacaugcauagcaguuggucuuguuacacuauaucuagguguaaugguacaagccgacucgggaugcguaauuaauuggaaaggacgcgagcucaagugcggaaguggcauuuuugugacaaaugaaguacacacauggaccgaacaauauaaguuccaagcggauuccccaaaacgacuguccgcugcaaucggcaaggcuugggaagaaggaguuugcgguauacgaagcgcuacaagacucgaaaauauaauguggaaacaaauaucaaaugagcuaaaucauauacuacuggagaaugauaugaaauuuacuguugucguaggcgauguagccggaauccuggcccaaggcaagaaaaugauaagaccacaaccaauggaguauaaguauagcuggaagaguuggggcaaggcuaagauaauuggagcugauguacaaaauacuacauuuauaauagaugguccaaauacuccagagugccccgaugaccagagggcguggaacauaugggaagucgaagacuacgguuuugggauauucacaacgaauauaugguuaaaacucagagacaguuacacacaagucugugaccauagacuaaugucugccgcgauaaaagacaguaaagccguccaugcagauauggguuauuggauugaaucagagaaaaaugaaacuuggaaguuagcgagagcaucauucauagaagucaagacguguauuuggcccaaaucacacacauuguggaguaauggaguucuagaaagugaaaugauuauaccaaaaauauauggaggaccaauuagucagcauaacuauagacccggguauuucacucagacugccggaccauggcaccugggcaaacuagaacuggacuucgaccuaugcgaaggcacaacgguuguugucgaugaacacugugggaauaggggcccuucccucagaacgacaacagugacagguaaaauaauacacgagugguguuguagaaguugcacacuuccuccacuaagguucagaggcgaagaugguugcugguacggaauggaaauccgcccgguaaaagagaaggaagagaaucuaguaaaaucaauggugucugcgggaaguggagaaguagacagcuuuucuuugggacuauugugcaucaguauaaugauagaggaagucaugcgcaguagauggagcagaaaaaugcugaugacagguacauuggccguauuccuacuuuuaauuaugggccaauuaacauggaacgaccuuauacgauuaugcauaaugguaggagccaacgcauccgaucggaugggaauggguacaacuuaccucgcacuaauggcuacguucaagaugagaccaauguuugccgugggcuuauuguucaggaggcuuacaagucgggaaguauuacuauuaacaaucggucucucucuuguagcgucgguagaauuaccaaauucgcuggaagaauuaggcgauggauuagcaauggguauuaugauauuaaaauuauuaaccgacuuucaaagccaucaguuaugggcuacauuauuaagccuaacauucauaaaaacuacguuuuccuuacauuacgccuggaaaaccauggcaaugguguuaucuaucguuucuuuauuuccacuauguuuaagcacuacgucucagaaaacaacauggcuaccuguacuauuagggucacuaggauguaaaccacuaacaauguuucugauugcggaaaacaaaauauggggacgcagaucuuggccguuaaacgagggcauuauggcugucggaauaguaagcauacuccuaagcucauuacucaaaaaugacgucccccucgcagggccacucauagcaggcggcauguuaauugcguguuacguaauaagcgguucuagugcagaccuaagucucgaaaaagccgcagaagugaguugggaagaagaagcggaacauuccggcgcaagccauaauauauugguggaagugcaagacgacggaaccaugaagauuaaggacgaggaaagagacgacacccuaacaauacuucuuaaggcuaccuuguuagcaguuucagguguguauccucuuucaauuccggccacucuauucguaugguacuuuuggcagaaaaagaaacaaagaucaggaguauuaugggauacaccguccccaccagaaguagaacgagcgguacuugacgauggaauuuaccgcauaaugcagcgcggccuuuuaggcagaucccaaguuggagucggagucuuucaggagaauguguuucauacuauguggcaugugacacgaggugcaguucuuauguaucaagguaaacggcuggaaccaagcugggcgagcgucaagaaagaccuaauuaguuauggaggaggauggcgacugcaaggauccuggaauaccggcgaagaaguacaaguaauagcuguagaaccugggaaaaauccuaagaaugugcaaacagcuccggggaccuuuaaaacgccagaaggagagguaggggccauagccuuagauuuuaaacccggaacuucagguagcccgauagucaaccgagaggggaagaucgucggacuguauggaaauggagugguuacuaccagugguacguauguaucagccaucgcacaagcuaaagcaucucaagagggccccuuaccagaaauagaagacgagguauuucgcaaaagaaauuuaacuauaauggacuugcacccuggaucaggaaaaacaaggagauaucugcccgcuauagucagggaagcgauaaaaagaaaauuaagaaccuuaauucuagccccuaccagaguaguagcgucagaaauggcagaggcacugaagggaaugccaauuagauaccaaacuacggcaguuaaaucggaacacacagguaaggaaauuguagacuuaaugugccacgcuacguucacaaugagacuacuuucucccguucgaguaccuaauuauaacaugauaauaauggaugaggcgcauuucacagacccgucaucaaucgcagcaagaggauauauaucaacuagagucgggaugggugaagcggcggcuauauucaugacugcaacaccaccugggucaguagaagcauuuccgcaauccaacgcacugauccaagaugaggagcgugauauaccagaaagaucauggaacagcggcuaugaguggauuacagacuucccagggaagaccguuugguuugugccaucaauuaaaucaggaaaugacauagcaaauugcuuacgcaaaaaugguaaaagaguaauucaacuaagccgaaaaaccuuugacacugaauaucaaaagaccaaaaauaaugauugggauuacguaguaacgaccgacauaucggagaugggugcuaauuuucgagccgaucgcguaauagauccaagaagaugucuaaaaccagugauucucaaagacggaccugaacgugucauauuagcaggaccaaugccuguaaccguggcaucagcggcacaacgacgagggcguaucggaaggaaucacaauaaagagggagaucaauauauauacaugggacagccgcugaauaacgaugaagaccacgcccacuggacugaggccaaaauguuacucgacaacauaaauacuccggagggcauaauuccugcacuguuugaaccagaacgugaaaagagcgccgcuauagacggcgaauaucgauuacguggugaagccagaaagacauuuguagaauuaaugcguagaggagaucuacccguauggcucucauacaaaguagcguccgaaggauuucaguacucugacagaagguggugcuuugacggggaaaggaacaaucagguacucgaagaaaauauggacguagaaauauggaccaaagaaggggagaggaagaaacuaagaccaagguggcuagaugcaagaacauacagugauccucuagcauuacgagaguuuaaagaauuugcugcuggcagacgauccguaaguggagaucuaauucuggaaaucggaaagcugccgcaacaccuaacgcagagagcucaaaacgccuuggauaacuuagucaugcuacacaacagcgaacaaggugggcgugcguauagacaugcaauggaagaauuacccgauacgauugagacguuaaugcuccuggccuuaauugcaguucugacaggaggagucacauuguucuuuuuaucuggacguggccuugguaaaaccucaauugggcuguuauguguuauggcaagcucuguacuucuuuggauggcgagcgucgaaccucauuggauugcagcaaguauuauccuugaauuuuucuugauggucuuauugaucccagaaccggauagacaacggacgccccaagacaaucagcuugcuuaugucguuaucggacuauuguuuaugauuuuaacuguugcagccaaugaaaugggccuacucgagacuacaaagaaagauuuagggauaggacacguugcuguagguaaucaccaccaugcggcaauguuagaugucgaccuacauccagcaagugcuuggacacuauaugccguagcgaccacuauuauuacucccaugaugaggcacacuauagaaaacaccacggcaaauauaucuuuaacugcgauagcgaaccaggcagcaauauugaugggccuugauaaaggcuggccaauuaguaaaauggauaucggugucccacugcuugcauuagguuguuacagccaagucaauccauuaacguuaacagccgccguacuaaugcuagucgcacacuacgccauuauaggccccggguuacaagcaaaagcaacuagggaggcacagaaaaggaccgccgcggggauaaugaaaaauccaacgguagauggaaucguggcaauagaccuagauccgguaguauacgaugcgaaauuugagaaacaacuaggacagaucauguugcuuauacuuuguacaagccagauucuacucaugagaacaaccugggcgcuaugcgaauccauuacucuugcgaccggcccuuuaacgacgcuaugggagggaaguccaggaaaauuuuggaacacaacaauagcaguaucuauggcaaauauauuuagaggaucauacuuggcuggugcuggauuagcauuuagcuugaugaaaucuuuaggagggggacguaggggcacaggggcacagggagagacccuuggugagaaauggaagagacaacuaaaucagcuauccaaaagugaauuuaauacuuauaaaagaagcggaaucacagaaguagauaggucugaagcaaaggaaggccugaaacgaggagaaacuaccaaacaugcuguaagccggggaacagccaaacuaaggugguuuguagaaagaaauuugguaaaaccagaagggaaaguaauagaccucggauguggcagaggcggauggucauacuauugugcaggccuuaagaaaguuacugagguaaaaggauauacuaaaggcgguccuggucacgaggagccaauaccgauggccacguauggauggaacuuggucaaacugcauucugguaaggacguguucuuuauaccuccagagaaaugugauacccuuuugugugauauuggagaaaguucaccaaacccaacuauugaagaaggacguaccuuaagaguauuaaaaaugguagaaccgugguuacggggaaaucaguuuugcauuaaaauuuuaaacccuuacaugccgucggugguagagaccuuagaacaaaugcaacgaaaacauggcggaauguugguaagaaauccacuaucuagaaacucuacucacgaaauguauugggugucgugcgguacugggaauauagucagcgcuguaaauaugaccaguagaaugcuucuuaaccguuuuacaauggcacacaggaaaccuacauacgaaagggauguagaucuuggcgccgguacgagacauguagcgguagaaccagaaguugcuaacuuagauauaaucggccagagaaucgagaacauaaaacacgagcacaaaucgacuuggcacuacgaugaagauaauccauacaagaccugggcauaucacggaucauaugaagucaaaccuucaggcucagcaaguagcaugguuaauggaguugucaaacucuugaccaaaccgugggaugucaucccaaugguuacccaaauagccaugacagacacaacuccguuuggucaacaaagaguauuuaaggagaaaguagacacuagaacaccaaaagccaaaagagggacagcccagauaauggaaguuacagcuaaaugguuauggggauuucucucaaggaacaagaaaccaagaauaugcacgagagaagaguuuacgcggaaaguacguuccaaugcagcaaucggugcugucuuugucgaugagaaccaauggaauagugcgaaagaagccguugaagaugagagauucugggaccuaguccaucgggagagagaauuacacaaacaagggaagugugccacaugugucuauaacaugaugggaaagagggagaagaaacuuggagaguucggcaaggcaaagggaucaagagcuauaugguauaugugguugggggcaagauuccuugaguucgaggcuuuaggcuuuaugaaugaagaucauugguuuagucgggaaaacucccuaucugggguggaaggcgaagggcugcauaaauuggguuacaucuugagagacaucucaaagauaccaggaggaaauauguaugcagaugacacugcgggcugggacacaagaaucacagaagaugacuugcagaaugaggcccgaauuacggauauaauggaaccggagcaugcucuuuuagccaaaaguauauucaaacuuacuuaccaaaacaaaguaguaagaguucaacgcccagccaaaaacggaaccgugauggacguaaucaguagacgagaucaaagagggagcggucaaguugggacauauggacuuaacacauuuacuaauauggaagcacaacuaauucgccagauggagucugaagguaucuucagucccucagaauuagaaaccccaaacuuagcagaacgcguucucgacuggcuggaaaaauauggcgucgaacgccuaaagcgaauggcaauaagcggggaugauuguguugucaagccuauugaugauagauucgcuacagcguugacagcauuaaacgacaugggaaaagugagaaaagauaucccacaaugggaaccauccaaaggguggaaugauuggcaacaagucccauuuugcucucaucacuuucaucaacuuauaaugaaagacgggagagagauaguuguacccuguagaaaccaggaugaauuaguaggccgcgcuagggucucucaaggugcgggauggagccuaagagaaacugcuugcuugggaaaaagcuaugcacaaauguggcaguugauguacuuccauagacgagauuuaagacucgcugcgaaugccauuuguagcgcaguaccugucgauuggauucccacaagcagaacuacuuggaguauucaugcgcaccaccaauggaugacgacagaagacaugcuaaguguguggaauagaguguggaucgaagaaaaucccuggauggaagauaaaacucauauaagcaguuggggagaugugccguaucuuggaaagcgagaagaucaauggugcgguucucucaucggacuuacagcaagagcuacuugggccacaaacauacaaguggcuaucaaccaaguacgacgccuuauagguaaugagaacuacuuggacuauaugaccaguaugaaacgcuucaaaaaugaaucagauccugagggagcauuaugguag

SEQ ID NO: 21205 - RNA, 9879 nt, Artificial Sequence
  derived and/or modified CDS sequence (opt6) from DENV-1__FJ639693__SS-prME
agcguuacuaugcugcuaaugcuaaugccuacggcacuggcauuucauuugacgacuagagguggugaaccacacaugauaguaagcaaacaggaaagagggaaaaguuuauuauucaaaaccagugccgggguuaauauguguacacuaauugcuauggaucuuggggaguuuugugaagacacaaugacauauaaauguccaagaaucagcgaagcagaaccugaugacgucgacugcugguguaacgcaaccgauacguggguaacauacgguaccuguagccagacaggagagcaccgucgcgauaaacgaucaguagcacuugccccucaugucgguuugggauuagaaacacgcacugaaacauggauguccagcgaaggugcauggaaacaaauccaacgaguagaaacgugggcauuacgccauccugguuucacaguuauagcuuuauuccuugcacaugcaaucgguacgaguauaacgcagaaagggauuauauuuauccuauuaaugcucguaacuccuucuauggcuaugcgauguguaggaaucggaucaagagauuuuguugaaggauuaucaggcgcaacuuggguagauguggugcucgaacacggcaguugcguaaccacuauggcaaaagacaaaccuacucuugacauagaacuacuaaaaacagaaguaacgaauccagcaguguuaaggaaauuaugcauagaagccaaaauuuccaauaccacaaccgacucuagauguccaacccaaggagaagcuaccuuaguagaggaacaagaugcgaauuuuguuugccgacguacguuugucgacagaggauggggcaaugggugcggauuauucgguaaaggcagucuuauaacaugcgcuaaauuuaaaugcguaacuaaauuggaagggaaaauuguucaauacgagaaucucaaauauucggucauaguuaccguacauaccggugaccagcaucaaguagguaacgaaagcacagaacauggaacaacggccacuauaacaccacaagcuccuaguacggaaauccaauuaacagauuauggugcucuaacauuagauugcuccccgagaacaggacuagauuuuaaugaaauggucuuacuaaccaugaaggaaaagucuugguuaguacacaaacaaugguuuuuagauuuaccucuaccuuggaccucuggcgcaucaaccucgcaggaaacuuggaaccgucaagauuuacuuguuacauucaaaacagcacaugcaaagaaacaggaaguuguaguccuggggucacaagaaggugcaaugcauacagcacugacuggagccacagaaauacaaacaucugguacgaccacaauuuucgcaggccaccugaaaugcagauugaagauggauaaacuaacacuuaagggaaugaguuaugucaugugcacagggaguuucaaacucgagaaagaaguagcagaaacucaacacgguacuguuuuaguucaaauuaaauacgagggaacggacgcacccuguaagauaccuuuuucuacucaagacgaaaagggcguuacccaaaacggaagacucauuacugcaaacccaauagugacagauaaggaaaaaccagugaauauagaagcagaaccucccuuuggggaaucguacaucguaauaggggcuggagaaaaagcccuaaaauuaucaugguuuaagaaggguucaaguaucggaaaaauguucgaggccacugcacgaggagcacgaagaauggcuauauuaggagacacggcuugggauuuuggaagcauuggcgggguauucacgucagugggaaaauugguucaccagauauuuggaacugcuuacgguguacuauuuagcgguguaaguuggaccaugaaaauagggauagguguccuuuugaccuggcucggacuuaacaguagaaguacaucgcuuaguaugacaugcauagcgguuggauuaguaacucuguaucuugggguaaugguucaagcugauagugguugcguaaucaauuggaaaggaagagaguuaaagugcgguagcgggauuuuuguaaccaaugaaguccauacuuggaccgaacaauauaaauuucaagcagacuccccgaaacgauugagugcugcuaucggcaaagcaugggaggaggguguaugugguauaaggucagcaacucgauuggaaaauauaauguggaaacaaaucucaaacgaauuaaaccauauacuccuugaaaaugauaugaaauuuaccguuguuguuggcgaugucgccggcauauuagcgcaaggcaagaaaaugauaagaccacaaccgauggaauacaaauacuccuggaaaaguuggggcaaggcaaaaaucauaggagcugauguccagaauacaacauuuaucaucgauggaccaaauacuccagaguguccggaugaccaaagggcguggaauauaugggagguggaagauuaugguuuuggcaucuuuaccacgaauauaugguuaaaacuccgugacuccuacacacagguuugcgaccaucggcuuaugagugcugcuaucaaggauucuaaagcaguucaugcagauauggguuauuggauagagagugagaaaaaugaaacauggaaacucgcucgagccuccuuuaucgaaguuaagacuuguauauggccgaaaucccacacauuguggucaaaugguguacuagaaucagaaaugauaauuccgaaaaucuacggcggaccgauuagccaacauaauuacagaccaggauacuucacucaaaccgcuggaccuuggcauuugggaaaguuggaacuugacuuugaccuuugugaagggacuacaguugucguagacgaacacuguggcaauagaggcccuuccuuaaggacuaccacaguaacaggaaaaaucauacaugaaugguguugucggucuuguacauuaccaccauuacguuucaaaggcgaagaugguugcugguacgguauggagauaagaccuguuaaagaaaaagaagaaaacuuaguaaaaagcauggugagcgcugggucaggcgaaguggauaguuuuucauuaggacuucuauguauuuccauaaugauugaagaagucaugcgaucuagguggaguagaaaaaugcuuaugacaggaacccuagcuguguuuuucuuauugaucaugggucagcugacauggaaugaucuuauacgucuuuguauaaugguaggggcaaaugcaucagacaggaugggcauggguaugaccuacuuagcauugauggcaacauucaagaugagaccaauguucgcaguggggcuauuguuucgacgccuaacaaguagagagguuuuauuacuuacuauuggguuauccuuaguagcaagcgucgaauuaccaaacucacucgaggaauuaggagauggacuagcaaugggaauuaugauacuaaaacuacuuacugauuuccagucgcaucaauuaugggcaacacuacugucacuaaccuucauuaaaaccaccuuuucucuucauuaugccuggaaaacuauggcgaugguuuuaucaaucguaagccuauuuccccugugcuuaaguacgacaucccagaaaaccacuuggcuacccguuuuacuugggaguuuaggaugcaaaccuuuaaccauguucuuaauugcggaaaacaaaauauggggacgcaaaucuuggccgcuuaacgaagggauaauggcgguagguauaguguccauauuauuaucgagucuacucaaaaaugacguaccacuggcagguccguugauagccgguggcauguuaaucgccuguuacgucauaucaggaucaucagccgacuuaucccuagaaaaagcagcagaaguuucaugggaagaggaagcagaacacucuggagcuagucauaacauucugguugaaguccaagacgaugggacaaugaaaauaaaagaugaagaacgcgaugacacauugacgauacuguuaaaggcaacauuacuagcuguaucgggaguuuaucccuuaagcauccccgcuacauuguucguuugguauuucuggcagaagaagaaacaacgauccggcguauugugggauaccccgucgccaccugaaguagagagagccguacuagaugacggaauuuaucgaauuaugcaaagaggacuauuggguaggucacagguaggaguuggcguguuucaagaaaauguuuuucacacaauguggcauguuacacgaggggccguauuaauguaucaaggaaaaagacuagagcccucaugggcaagugucaagaaagacuuaauaucauauggcggaggcuggagacuucaaggcaguuggaauacaggggaagaaguccagguuauugcgguagaaccggguaaaaaccccaaaaauguacagacagcaccggguacauuuaagacuagcgaaggggaaguaggugcaauagccuuagauuucaaaccaggcacgucugggaguccaauaguuaaucgugaaggaaaaauaguagggcuuuaugggaauggaguaguaacgacaagugguacauauguuucagcaaucgcccaagcaaaggcaagucaagagggaccucuccccgagauagaagacgaaguuuucagaaaaagaaaucugacaauaauggaucuccacccaggcucaggaaagacucgacgauacuugcccgcuauuguaagagaggcaauaaaacgaaaauugcgaacauuaauauuagcgcccacaagaguaguagcgucugagauggcggaggcuuuaaagggaaugccaauaagauaucaaaccacagccguuaaaagugagcacacuggaaaagagaucguugauuugaugugucaugccacuuucacaaugaggcugcuaucaccuguacgaguucccaacuauaauaugauuaucauggaugaggcacacuucacagaucccaguucaauugcugcaagaggauauauuagcacuaggguuggcaugggugaagcagccgcaauuuuuaugacagcaaccccgcccgggucagccgaagcauuuccucagaguaaugcaguuauucaagacgaagagagagacauuccugagagaucguggaacucuggcuaugaauggauaaccgacuuuccgggaaaaacaguaugguuuguaccuaguauaaaauccgguaacgauauagcgaauuguuuaaggaaaaaugggaaacgaguaauccagcuaagucgaaaaacguucgauacagaauaucagaaaacuaaaaacaacgauugggacuauguagugaccacagacauuuccgaaaugggggcuaauuuuagggcagacagggucauagacccccgaagaugccuuaaaccaguaauucucaaagauggcccugagcgaguaaucuuagcuggaccuaugccaguaacggucgcaucagcggcucaaaggcguggucgaaucggacggaaucacaacaaggaaggagaccaguauauauauauggggcagccauugaacaaugaugaggaccacgcgcauuggacugaagcaaagaugcuacuagauaauauaaacacuccagaagggauaauaccagcgcuauuugaaccagagcgugagaaaucagccgcuauagauggagaguaccgccucagaggagaggcaagaaaaacauuuguggaacuaaugagacgaggggaccuaccaguauggcucaguuauaaaguagcgagugaaggauuccaguauucggauagacgauggugcuuugauggugaacggaauaaccaaguguuagaggaaaacauggauguagaaauuuggaccaaagaaggcgagagaaagaaacuccgaccacgguggcuagacgcacgaaccuacagcgacccguuagcauugcgcgaauuuaaagaguucgcagcaggaaggagaucugugaguggugaccuaaucuuagagauagguaaacucccgcagcauuuaacccagcgcgcacaaaaugcuuuagauaaccuaguaaugcuacauaacucugaacaaggcgguagagccuauagacacgcgauggaagaauugccagauaccauagaaacgcuaauguuguuggcacugauagcaguuuuaacaggagggguaacacuguucuuucuaagcggaagggguuuggguaagacaaguauuggucuacuaugcgucauggccucaagcguacucuuguggauggcgagcguggaaccacauuggauugcagcuaguauaauauuagaauuuuuccuuauggucuuguuaauuccagagccugacaggcaacgaacaccucaagauaaccaauuagcauauguggucauaggccuccuuuucaugauacuaacaguggcagcuaaugaaauggggcuccuugaaaccacgaagaaagacuuaggaaucggccacguagccgucgagaaccaucaccaugcggcuauguuggauguggaucuacacccugcuagugcauggacccuuuaugcaguugcuacaacaauaauuacaccuaugaugcgucauacuauugaaaacacaacugcaaauaucaguuuaaccgcuauugcuaaucaagcugcaauuuuaaugggauuagauaagggcuggccaauaucgaaaauggacauaggggucccauugcuagcguuaggcuguuauagucagguaaauccgcucacauuaacggcugcagugcugaugcuuguagcccauuaugcaauaauaggaccagguuuacaggcuaaagcuacgcgcgaagcacaaaaacgaaccgcggcaggaaucaugaagaauccuacaguugacggcauuguggcaauugaucuagacccaguuguauaugaugcaaaauuugagaaacaauuaggacaaauuauguuacuuauacuuugcaccucucaaauauugcuaaugagaacgaccugggccuugugugaaaguaucacuuuagccguuggauuccaaacuacccuaugggaagggucacccgggaaguuuuggaauacaacuauagccguuucuauggcaaauauauuucggggcaguuaucuugcaggggcaggacucgcauuuagcuugaugaaaucguugggaggaggccgacgaggaaccggagcacagggagaaacacugggugaaaaguggaaacggcaauuaaaccaacuaucuaaauccgaauuuaauacauauaaaagaaguggaaucauggagguggaccgauccgaggcaaaagaagggcuuaaaagaggugaaacuaccaaacaugcagucagcagagguacugcgaaacugcgcugguuuguugagagaaaccuaguuaagccagaagggaaaguuauagaccucggauguggcagaggcgguuggucuuacuacugugcaggucucaagaaagucacugaaguaaaaggcuauacuaaaggagggccagggcaugaggaaccaauaccaauggcgacguauggauggaaucuuguaaagcuacacucaggcaaagauguauucuuugucccgccagagaaaugugacacauuacugugcgauauaggagaaucaucuccuaacccaaccauagaagaaggcagaacauugagaguguugaagaugguugagccauggcugagggguaaccaguucuguaucaagauccugaacccauauaugccgaguguaguugaaacauuggaacaaaugcagcgaaagcauggaggaaugcuaguacgaaacccacuuucuagaaauucaacccaugaaauguauuggguaucuuguggaacuggaaauauuguaucagcaguaaauaugacaagccgaauguuacucaaucgguuuaccauggcacaccgaaaacccacauacgaacgagacguugaccuaggagcaggcacccgacacguugccguagagccugaaguagccaaccuugauauaauaggucaacguauugagaauauaaaacaugaacacaagagcacauggcauuaugacgaagauaauccauauaagacuugggcguaucacgguaguuaugaagugaaaccaagugguucggccaguaguaugguuaacggaguugucaaauuacuaacuaaaccuugggauguuauaccuaugguaacacaaaucgccaugacagauacaacaccuuuuggccaacaacgggucuucaaagaaaagguagauacaagaacacccaaggcuaaacgaggaacagcccaaauaauggaagugacugcuaaaugguuauggggauuccuuucacgaaauaagaaaccgcgaauauguacuagagaagaauuuacacgaaaaguaagaagcaaugccgcuauaggugccguguucguagacgaaaaucaauggaacuccgcaaaggaagcuguugaggaugaacguuucugggacuuaguucauagagaaagagaauuacacaaacaaggaaagugcgcaacguguguauauaacaugaugggaaaacgugagaaaaagcuaggagaauuugguaaagcaaaaggaagcagggcuauaugguauaugugguuaggggcgagguuucuugaauuugaagcccuuggauuuaugaacgaggaucauugguuuucgcgcgaaaauuccuuaagugggguagagggugaaggccuacacaaguugggauauauauuacgagauauuucuaagauaaguggaggaaacauguacgcagaugauacggcuggcugggauacacggaucacagaagacgaucuucaaaaugaagcaaaaauaacugauauuauggaaccugaacaugccuuguuagcuaagaguauuuuuaaacugacuuaccaaaauaaagucguuagaguucagcguccagcuaaaaaugggacagucauggauguaauuucaaggagagaucaacgcggaucuggucaaguaggcacauaugggcuaaauacguuuacuaauauggaagcccaacuaauucgacaaauggaaagugaaggcauauucucaccaucggaacucgaaacuccaaauuuagcagaaagggcauuggauugguuagagaaacauggaguugaaagacuuaaaaggauggcaauaagcggugacgacugcguuguuaaaccaauagacgaucgguucgcaacugcuuuaacagcacucaaugauaugggaaaaguacgcaaggauauaccacagugggagccuucaaaaggauggaacgauuggcaacaaguaccuuucugcagucaccauuuccaucagcugauaaugaaagauggaagggagauuguaguuccaugcagaaaucaagacgaauuaguaggacgagccagaguaucccaaggagcaggauggucguugcgggaaacugcuugucuuggaaaaucuuaugcccagauguggcaauuaauguacuuucaccggagagaucuucgacucgcugccaaugcaauuuguucugccggcccaguagauuggguuccuaccaguaggacaacuuggaguauucacgcacaucaucaauggaugacaacagaagauauguuaucaguauggaaucggguuuggauagaagaaaaucccuggauggaagauaaaacacacauaagcucgugggaagacguaccauacuuaggaaaaagggaggaucaguggugugggagccuuauagggcucacugcuagggcgacgugggcaaccaauauacaaguagcaauaaaccaaguucgucgacugauaggaaaugaaaacuauuuggauuauaugacuucuaugaagagguuuaaaaacgaaucagacccugaaggcgcgcucugguga

SEQ ID NO: 21206 - RNA, 9879 nt, Artificial Sequence
  derived and/or modified CDS sequence (opt6) from DENV-1__FJ639694__SS-prME
ucugucacaauguugcucauguugaugccgaccgcacuagcguuucaucuaacuacacguggaggagaaccccauaugauaguaaguaaacaagaaagaggaaaaaguuuauuguuuaaaacaucagccggugucaauaugugcacacuaauagcuauggaccuaggagaauugugugaagauacgaugaccuacaaauguccgcgaauaacugaagcagaaccagaugacguugauuguuggugcaacgcaacugauacauggguaacauaugguacaugcucucagacuggcgaacaccgacgagauaaacggagcguggcauuagcaccccacguuggucucggccuggaaacaaggacugaaacauggaugucuucugaaggagcguggaaacaaauccaacguguggaaacaugggcacucagacauccugguuucacgguuaucgcacuauuucuugcacacgccauuggaacaagcaucacacagaaaggaauaauauuuauucuacuuauguuaguaacaccgucaauggcgaugagaugcguaggaauugguaguagagauuuugucgaaggcuuaucuggugcuacguggguugauguagugcuagaacacggcucaugcguuacuacaauggcaaaagauaaaccuacccucgauauugaacuauuaaaaacagaagucacaaauccugcaauuuuacgcaaauuaugcauagaagcuaaaauuaguaauacgacaacagauagccgcugucccacccaaggugaagcuacguuaguugaagaacaagacgccaacuucgugugcagacguacuuuuguagauaggggaugggguaacgguuguggacuguuuggaaaaggaucacucauaacuugugcuaaauuuaaaugcgucacaaaauuagaagguaaaauaguucaauaugaaaacuuaaaauacagcgugaucgucacugugcauacaggggaucagcaccagguaggcaacgaaucaacugaacauggaacaacagcaacaauuacaccacaggcuccuacaacagaaauccaauuaacagacuacggagcacuuacauuagauugcagcccacgaacaggacucgacuuuaacgaaaugguauuauuaacuaugaaagagaaaaguugguugguccauaaacaaugguucuuagacuuaccauuaccauggacuagcggcgcaaguaccucucaggaaaccuggaaucgacaggauuugcuagucaccuuuaaaacggcucaugccaagaaacaagaagucgugguacuugguagucaagaaggugcuaugcacacagcgcucacuggcgcuaccgaaauucagacaagcggaacgacuacuaucuuugccggacauuugaaaugcagauuaaagauggauaaacuuacacuuaaaggcaugucauauguaaugugcacugguucauuuaaauuagaaaaggaaguggcugaaacacaacacgggacugugcuuguucaaauaaaauaugaaggcacugaugccccauguaaaauaccauucaguacacaagaugaaaaaggcgugacccaaaacggacgauuaaucaccgcuaacccaaucgucacugacaaggaaaaaccaguuaacauugaagcagaaccuccguuuggagaaaguuauaucgucauuggugcgggcgaaaaagcguuaaaauuaagcugguucaagaagggcucaucuauuggaaaaauguucgaagccacugcacgaggcgcucgucgaauggcgauacuaggagauacagccugggacuucggaaguauuggaggaguauuuacaucaguagggaaauuaguucaucagauauuuggcacggcauaugggguacuauucucugguguuagcuggaccaugaaaauugguaucggaguauuacuaacaugguuagggcuaaauagccguucaacaaguuuuucuaugacguguaucgcaguagguuuaguaacguuauaucuugguguaaugguacaagcagauucugguugcguaauuaauuggaaagggagagaacuuaaguguggguccggcauuuucguaacgaaugaaguccacacauggaccgagcaauauaaauuucaagcagacuccccaaaaaggcucucagccgcaauaggaaaggcuugggaagaaggagugugcgguauacgcagugcaacuagauuagagaacauaauguggaaacaaauaaguaacgaacucaaucauauacuacuagaaaaugacaugaaauucacaguaguugucggugauguagcagggauucuggcccaagguaagaaaaugaucagaccgcagccuauggaauacaaguacucauggcgaucuugggguaaagccaaaauuauaggggcggacgugcaaaauacgacuuucauuaucgauggaccaaauacaccggaguguccagaugaucaaagggcuuggaacauaugggagguggaagauuacggauuugggauauuuacaacaaacauuuggcugaaacugcgugacaguuacacucaaguuugugaccauagacucaugucagcugcuauuaaagacuccaaagcaguucacgcggauaugggauauuggauagaaucagagaaaaaugaaacuuggaaguuagcuagggccucuuucauagaaguaaaaaccuguauauggccaaaaucccauacucuguggaguaacgguguguuggaauccgaaaugauaauaccaaaaauauacggaggacccauaucgcagcauaauuauagaccaggcuacuucacacaaacagcugggccauggcauuuaggaaaauuagaauuagacuuugaucugugugaaggaacaacagucguuguagaugaacauuguggaaaccggggcccgucguuacguacaacuacaguaacuggcaagauuauacacgaaugguguugucguucaugcacacuaccuccacuccgauucagaggagaagauggcugcugguacggaauggagaucaggcccgugaaagaaaaagaagaaaauuugguuaagaguaugguuucagcgggcucuggagaagucgauagcuuuagcuuaggacuacuaugcauaagcauuaugauugaagaagucaugcgaagcagauggaguaggaaaaugcugaugaccggaacucucgcaguauuucuauuauuaauuaugggacaacuaacuuggaaugauuuaauuagacuaugcauaaugguaggcgcaaaugcgagcgacagaaugggaaugggcaccacuuaucucgcacuaauggcgacuuuuaaaaugcguccaauguucgccguaggguuguuauuucgaaggcucaccucaagagaaguauuguuauuaacuauaggccucagcuuagucgcgucaguugaauuaccuaacagcuuggaagaauuaggugaugguuuagcuauggggaucaugauccuuaagcuauuaacagacuuccaaagucaccaacuuugggcgacacuucucaguuuaacguuuauuaaaacaaccuuuuccuuacacuaugcauggaaaacuauggcaaugguauuaucuauuguaucacucuuucccuuauguuuaucgacaacgagccagaaaacuaccuggcuaccaguguuacucggaaguuugggcuguaaaccucuaacaauguuucugaucgcugaaaacaaaauuugggguagacgaucuuggcccuuaaaugaaggaaucauggcugucgggaucgugaguauauuacuaagcucucucuugaaaaacgauguaccccuugcagggccccugauugcgggcggaauguuaauagcauguuauguuauaucaggaucaucagcagaccuaucuuuggaaaaggcagcagaggugucuugggaagaggaagcggaacauuccggcgccucacauaauauucugguugaaguacaagacgacggaacaaugaaaauuaaagaugaggaaagggacgauacauugacaauacuauuaaaagcaacgcuccuugcagucuccggcguguacccucuaucuauaccagccacccuuuuuguaugguauuuuuggcaaaagaagaaacaacgaagugggguucuuugggauacgccuaguccaccagagguugagagggcuguauuagacgacggcauauaccgcauaaugcaaagagggcuacuaggaaggucgcagguaggggucggaguuuuccaagaaaaugucuuucacacuauguggcauguuacacguggcgcaguacuaauguaucaggggaaacgcuuagaaccuucuugggcaagugugaagaaagacuuaauuucguauggagguggauggagauuacagggaaguuggaacaccggugaggagguucaaguaauugcagucgaaccuggcaaaaacccuaaaaauguucaaacugccccggguacauuuaaaacaccugaaggugaggucggugcuaucgcucuagauuuuaaaccuggcacuucagguagcccaauagucaacagagaagguaaaauaguagggcucuacggaaauggagucgucacuacaagcggaacguauguuucugccauugcacaggcuaaagccagccaagaagguccccuaccagaaauugaagaugaaguauuucguaagcggaaucucacuauuauggaucuacacccaggaucagguaaaaccagaagguacuugcccgcaauugugcgggaagcaauaaaacguaaacuuagaacccuaauacuugcaccaacacgugucguugccucagaaauggcugaagcucuaaaaggaaugccuauaagguaucaaacaacugcugugaaaagcgagcauacuggaaaggaaauuguagaucuuaugugucacgcgacauucacaaugagacuguuaaguccuguuagagucccaaauuacaauaugauaauuauggacgaggcccacuuuacggauccaaguucaauagcugcucgagguuacauuucgaccagaguaggcaugggugaagcggcggcaauauuuaugacugccacgccgccaggguccguugaagcauuuccacaaucaaacgcugugauccaagaugaggaaagagacauucccgaaagauccuggaacucuggcuaugaguggauaacugacuucccaggaaaaacugucugguucguuccgucaauuaagaguggaaacgacauugccaacuguuugaggaagaauggcaagcgaguuauccaauuaucaagaaagaccuuugacacagaguaccagaaaaccaaaaauaacgauugggacuauguaguaaccacagauauaagugaaaugggagcaaacuuuagggcugaccguguaauagacccucgaaggugucuaaaaccagucauacuaaaagacggaccggaacgagugauauuagcagguccaaugccaguaacaguugcuucagccgcgcaaagacgaggccguauaggcagaaaucauaauaaagaaggugaucaauauaucuacauggggcaacccuuaaauaacgaugaagaccaugcgcauuggacagaggcaaaaaugcuacuagacaauauaaacacuccagagggcauaaucccugcgcuguuugaaccagaaagagagaaaagugcggcaauugacggcgaauaucggcugagaggagaggcucguaaaacauuuguagaacuaaugagaagaggggaucuaccaguauggcuuaguuacaaaguggcaagcgaaggguuucaauacagugaccgaagguggugcuuugacggcgagagaaauaaucaaguccuggaggaaaauauggauguagaaauauggacgaaggaaggagaacguaagaaauuaagaccacguuggcuugacgcucguacauauagugacccgcucgcauugcgggaauuuaaagaguucgcagcuggcaggagaagugucuccggggauuuaauauuggaaaucggcaaauugccucagcaucucacacagagagcacagaacgcauuggacaaucuaguuaugcuacacaacagcgagcaaggagggcgggcauaccgucaugcaauggaagaguuaccugauacgauagagacucuaaugcuacucgcuuuaauugcuguauugacugguggcgucacgcuauucuuucuuagcgggcgaggucucggcaaaacgucgauaggauuacuauguguuauggcaucaagcguucuccucuggauggcaagugucgagccacacuggaucgcagcaucuauaauucuggaauuuuuccuaaugguauugcugauaccggaaccagacagacaacggacgccucaggacaaucaacuugcuuacguaguaauaggacuacuuuucaugauacuaacaguggcggccaaugaaaugggguuauuagaaacaaccaagaaagacuuagggauuggucauguugcagugggcaaccaccaccaugccgccauguuagauguagacuuacacccagccucggcauggacucuauaugcuguggcgaccaccauaauuacaccgaugaugagacauacaaucgagaauacaaccgccaauauaucucuaacugcuauagcgaaccaagccgcgauauuaauggggcuagacaaaggauggccgauaaguaaaauggacauuggagugccuuuacuagcguuaggaugcuacucacagguaaacccucuaacguuaacggcagcugucuuaauguuaguagcccauuaugcaauaauaggaccagggcuccaggcaaaagcgacaagagaagcacaaaagcgaacugcugcaggaauaaugaagaauccaacaguagacggcauaguagccauagaucuugacccagugguauacgaugccaaauucgaaaaacaacuuggacaaaucaugcuucuaauucuuuguaccucacaaauccuauuaaugcguacaacaugggcauuaugugaaucaaucacauuggcaacaggaccucugaccacacucugggagggcucaccgggcaaauucuggaacacaaccauagcagucaguauggcuaauauuuucagggggaguuauuuagcaggagcaggacuagcguuuagucugaugaaaaguuuaggaggaggaaggcguggcacgggcgcucaaggcgaaacacuuggugaaaaauggaaacgucaacuaaaucaacuauccaagagcgaauuuaauacauauaaacgaagcggcauaauggaaguugauaggucagaagcgaaagaaggacuaaaaagaggagaaauaaccaaacacgcaguuucacgagggaccgcgaaacuuaggugguuuguugaacguaacuuaguaaaaccugaagggaaaguaauagaccuaggaugugggagaggaggcuggucauauuacugugcaggucuaaagaaagucacugaaguaaaaggauauacaaaagguggaccgggucacgaagaaccgauuccuauggcaacuuacggauggaaucuuguuaagcuacauucugguaaggauguauucuuugugccaccagagaaaugcgauacacuacuuugugauaucggggaaucgaguccaaacccgacgauagaagaaggucgcacacuccguguuuugaaaaugguagaaccaugguuacgcggaaaccaauucugcauaaagaucuuaaacccauauaugccuucaguaguugagacuuuagaacaaaugcaacggaaacauggagguaugcuuguacgaaauccacuaucucguaauaguacccacgagauguauuggguaaguuguggaacugguaacaucguuucagcagugaacaugacaucccgcaugcuuuugaaucgauuuacuauggcucacaggaagccuacguacgaaagagacguugauuuaggugcggggacacggcauguagcuguagaaccugaaguagcuaacuuagacaucauuggacagcgaauugaaaauauaaaacaugaacacaaaucaacauggcacuaugacgaggauaacccauauaaaacgugggcauaccacggaucuuaugaaguaaaaccuagcgguucggcgucuagcaugguaaauggaguaguaaaacuacucacaaagccaugggacgugauacccauggugacccagauugcgaugaccgacacuacgccguuuggucagcaaagaguauucaaagaaaagguggacacaagaacaccaaaggccaagcgcgguacagcacagauaauggaaguaacggccaaauggcuauggggauuuuuaucacgaaacaaaaagccuaggauuuguacacgagaagaauuuacccgcaaaguuaggaguaacgcagcuauaggugcuguuuuuguagaugaaaaccaauggaacucagcuaaagaagcugucgaagaugagcgauuuugggaucugguucaucgagaaagagaacugcacaagcaagguaaaugcgccacaugcguauacaauaugaugggaaagagggagaagaaauuaggugaguucggcaaagcaaagggaaguagagccauaugguauaugugguugggagcaagauucuuagaguucgaagcauuagguuuuaugaaugaagaccacugguuuucuagagaaaacucauuaucugguguagaaggagaagggcuacauaaguuaggauacauauugcgugacauauccaaaauaccgggugguaacauguaugcagaugauaccgcagggugggauacuagaauuacggaagacgacuugcaaaacgaagccagaauuacagacauaauggaaccagaacaugcucuguuagcgaagucaauuuuuaaauuaacuuaucaaaauaaagugguaagagugcaaagaccagcuaagaacgggacagucauggauguaauaucaagaagagaccaacgugguuccggacaagucggaacauacggcuuaaauacauucacaaacauggaggcgcaacucauccgucaaauggagagcgaaggaaucuucucaccuucagaacuagaaacuccgaaucuagcggaaagaguguuagauuggcucgaaaaauacgguguagaacgacuaaaaagaauggccauaaguggagacgacuguguaguaaaaccaauagaugaucgauuugcuacagcacuuacggcgcuaaaugauauggguaaagugaggaaggauauaccucaaugggaacccucaaagggauggaacgauuggcagcaaguaccauuuuguucucaccauuuucaucaacugaucaugaaggacggucgggaaaucgugguuccuugucguaaucaagaugagcuuguugguagggcucgugucagucaaggugccggguggagccuaagagagacugcaugucuaggaaaaaguuaugcacaaauguggcaguugauguauuuccauagacgagaucuacguuuagcugcgaaugcaaucuguuccgcugugccaguagacuggauucccaccucuagaaccacauggucaauacaugcucaucaccaauggaugacaacagaagacauguugagugucuggaauaggguuuggauagaagaaaacccuuggauggaggacaaaacacauauuucaaacuggggagaugugccuuaucuaggaaaaagagaggaccaguggugugguucccugauuggacuaacugcucgagccacaugggcuacgaauauacaaguugcaauaaaucaggugaggcgcuuaauugguaacgaaaacuaccucgauuacaugacgucgaugaagcgguucaaaaaugaaucagauccagagggugcuuuaugguaa

SEQ ID NO: 21207 - RNA, 9879 nt, Artificial Sequence
  derived and/or modified CDS sequence (opt6) from DENV-1__FJ639695__SS-prME
uccguuacaaugcuauugaugcuaaugccaacggcucuagcauuucaucugacuacacgagggggugaaccacacaugaucguaagcaaacaagaacgugggaaaaguuuacuauuuaaaacaagugcagggguaaauauguguacguuaauagcaauggacuuaggagaacuaugcgaagacacaaugacguacaaaugccccaggauaacagaagcugaaccagaugacguagacuguuggugcaaugcuacagacacauggguaacauacgguacuugcagccaaacgggagaacauagaagagauaaaagaucaguagcucucgcaccacauguuggguuaggacuggaaacucgcacggaaacguggaugaguagugaaggggcguggaaacaaauucaacggguagaaacaugggcacuaaggcaccccgguuuuacgguaauugcucuuuuucuagcacaugcaaucggaacaucuauuacccaaaaaggcauaauuuuuauauuguuaaugcuuguuacgccgucuauggcaaugagauguguaggaaucgguucacgagauuuuguggaaggguugaguggagccacauggguggauguuguuuuagaacauggaagcuguguaacaacaauggcuaaagauaaaccaaccuuagauauagaauuauuaaaaacggaaguaacgaauccagcgauacuccguaaacucugcauagaggcgaaaauaaguaacacaacuacagauagcagaugcccgacccaaggagaggcaacuuuaguagaggaacaagacgcuaauuuugugugccgaaggacuuuuguagauagaggaugggguaaugguuguggccucuuuggcaaaggcucauugaugacgugcgcaaaauuuaaaugcguaacuaaacuagaagguaaaauagugcaguaugaaaauuugaaauauagugucauuguuacgguucauacgggugaucaacaucaaguugggaaugagagcacugaacaugggacuaccgcuacaauuacuccacaagcuccuacaacagaaauucaacucacugauuacggagcgcuaacccuagauugcuccccaagaacuggacuagauuuuaacgaaaugguauuguuaaccaugaaagaaaaaucuuggcucguacacaagcagugguuuuuagauuuaccgcuuccuuggaccuccggggccaguacuagccaagaaacauggaauagacaagaccuacucgucacguuuaaaacagcacaugcaaagaaacaggaagucguaguguuagggagccaggagggugcuaugcacaccgcuuugacgggugcaacggaaauacagacgucagguacaacaacaauauuugcuggccauuuaaaaugccgacuuaaaauggacaaauuaacauuaaaagggaugucauaugucauguguacgggaucuuucaaacuagaaaaagaaguagccgaaacacaacauggaacaguccuaguacaaauaaaguaugagggaaccgacgcaccgugcaaaaucccuuuuucaacgcaggacgaaaagggaguaacacaaaauggaagacuuauaacagcaaauccgauugugacugauaaagaaaaaccuguaaacauugaggcagagccuccguucggugaaucuuauaucgugauaggcgcaggagaaaaggcuuuaaaacuaagcugguuuaagaaaggaucgagcauaggaaaaauguuugaagcgaccgcacgaggcgcgcgucggauggcaauuuuaggugauacggcuugggauuucgguucaauugguggagucuucacuucaguaggaaaauuaguucaucaaauauucgguacagcuuauggaguuuuguucucagguguaucauggacaaugaaaauuggucucggaguacuccuuacauggcuaggucuaaacucaagaucuaccagucuaagcaugacauguauugcagugggccuaguaacacuuuacuuggguguuaugguacaggcugacagcggauguguuaucaauuggaaaggaagagagcuaaaguguggaucgggaauauuugucacaaaugagguacauacauggacagaacaauacaaauuccaggcagacucaccaaaacguuugucugcggcuauugguaaagcgugggaagaaggcgugugcggcauaagguccgcaacacgucuugaaaauaucauguggaagcaaauaagcaacgaauugaaucacauacuacucgaaaacgacaugaaguucacugucgucgucggugauguugccgguauacucgcacagggcaagaaaaugauaagaccccaaccuauggaauauaaauauucauggaagucuuggggaaaggcaaagaucauaggagcagacguacaaaacacaacguuuauaauugauggaccaaacacaccggaaugccccgaugaucagcgagcuuggaacauaugggaggucgaagacuacggcuuuggaauuuucacaacuaacaucugguuaaaacuccgggacucauacacacaaguaugcgaccaucgacugaugagcgcagccaucaaagauaguaaggccguacaugcagauaugggguacuggauugaaagcgagaagaaugaaacauggaaauuggcuagagcuucuuucauagaaguaaaaacaugcaucuggccaaaaucucauacacuauggucaaaugggguucuggagucugagaugauaaucccaaaaaucuacggggguccgauuagccaacacaauuaucgaccgggcuauuuuacacaaacugcuggaccauggcacuuggggaaauuagaacucgacuuugaucugugugagggaacaacaguuguagucgaugaacauugcggaaacaggggccccucauuaagaacaaccacaguuaccggaaaaauaauacaugaauggugcuguaggaguuguacacuaccuccauuacgcuuucgaggcgaagacggaugcugguauggaauggaaauaagacccgugaaagagaaagaagaaaauuuagugaaaaguaugguaagcgcagguucaggagaagucgacucauuuagccuaggucuauuaugcauuaguaucaugauugaagagguuaugagaaguagguggaguagaaaaauguugaugacagggacgcuagcagucuucuuauuacuaauuaugggucagcuaacauggaaugauuugauucgacuaugcaucauggugggugcuaaugcgagugaucgaaugggaaugggcacuacauaccuugcguuaauggcgacauucaaaaugagaccaauguuugcuguugguuugcucuuuaggaggcuuacaagucgagaagugcuauugcuaaccauuggacucagucuagucgccucugucgaacuccccaauucauuggaagaacuaggcgauggacuagcaauggggaucaugauauuaaaauuacuaacggauuuucaaucacaucaacucugggccaccuuguuaucacuaacguucauaaaaacaacauuuucuuuacacuaugcauggaaaacaauggcaauggucuugucuauugucaguuuauucccacuaugccucucuacaacaagucagaagacuaccugguuaccgguuuuauuagggucauugggguguaagccauuaacaauguuucuuauugccgagaauaaaaucuggggaaggcgcucuuggcccuuaaacgaaggaauuauggcuguaggaauagugucuauucuauugucuagucugcucaaaaacgauguuccgcuggcaggaccacuuauugcuggcgguaugcucauagcguguuauguaaucucgggcagcagugcugaucucaguuuagagaaagcagcagaaguguccugggaagaagaggccgaacauagcggggcaucgcacaauauuuuaguagaaguccaagaugacgguacaaugaagaucaaagaugaagaaagggacgauacauuaacaauauuauuaaaagcgacauugcuggcgguuucagguguuuacccccucaguauaccagcuacacuauucguuugguauuuuuggcaaaagaagaaacagcgaaguggaguuuugugggacacuccgagcccuccugagguugagcgcgccguucuugacgauggcauauaucgcauaaugcaacgaggauugcuugguagaucacaagucggaguuggggucuuccaagaaaacguauuccauacaauguggcacguaacucguggagcaguccugauguaucaagguaaaagguuagaaccgucaugggcuucagugaaaaaggaucuaaucaguuacggugggggauggcgacuucaagguucauggaacacaggugaagaaguucaaguaauagcuguagaaccuggcaaaaauccaaagaacguacaaacagcaccugggacuuucaaaacaccugagggagaagucggcgcaaucgcguuggauuuuaaaccuggaacaucaggcaguccaauuguaaacagggaaggaaagauaguagguuuauauggaaacgguguaguaacaacgaguggaacauacguuucugcaauagcgcaagcaaaggcuagccaggaaggaccguuaccagaaauugaagacgaaguauuuagaaaacguaaucugaccaucauggaccugcacccuggguccggaaaaacacgucgcuacuuaccggcaauuguucgggaagcuaucaaaagaaaguugaggacccuuauauuagcuccaacaagggugguugcaucagaaauggcagaggcuuugaagggaaugccuauucguuaccaaaccaccgcuguuaaaagcgaacacacagguaaggaaauugucgaucuuaugugccacgccaccuucacaaugcgcuugcucaguccuguaagaguucccaacuauaauaugauaauaauggaugaagcccacuuuacagaucccucaucuauagccgcaagaggauauauaucuacccgagucggaaugggagaagccgcagcaaucuucaugacugcaaccccaccaggaucugucgaggcuuucccccaaagcaaugcaguaauucaagaugaagaacgagauauuccagaacggucauggaacucaggauaugaauggauaaccgauuucccgggaaaaacaguuugguucguaccaagcauaaagucugggaaugacauugcaaauuguuuaaggaaaaauggaaaaagagucauacaguugagcagaaaaacuuuugacacagaauaccagaaaacuaaaaacaacgauugggacuacguggugaccacagauauuucagaaaugggggccaacuuuagggcggauagaguaauagauccucgucgcugucuaaaacccguaauauuaaaagauggucccgaaagagugauauuggcgggaccgaugccggucacgguagccucagcugcccaaagaagagggagaauuggacgaagccauaacaaagagggugaccaguacauauauaugggacagcccuuaaauaaugacgaggaccaugcacauuggacagaagcuaaaaugcuuuuagauaacauaaacacaccugagggcauuauaccagcucuauucgagccagaaagagagaaaagugccgcuauugacggcgaauauagauuaagaggcgaagcaagaaaaacauuuguagaauuaaugagaaggggugaucuaccagucugguuaucauauaaggucgcaucggaaggguuucaauacagcgaucguaggugguguuucgauggggaacguaauaaucagguucuagaagagaacauggaugucgaaauuuggacaaaagaaggagaaagaaagaaauuacgaccaagguggcuggacgccaggacuuauagcgacccccuagcauuaagagaauuuaaagaauuugcugcagguagacgaucaguaucaggugauuuaauccuagaaauaggcaaacuaccacaacaucuaacacaaagggcucaaaaugcccuagacaacuuaguaaugcuucauaauucagagcagggaggcagggcuuauagacaugcaauggaagaacuacccgauacuauugaaaccuuaauguuauuggccuuaauugcgguguuaacuggcggaguuacucuauuuuuccugucggguagagggcugggcaaaaccaguaucggguuacuaugugucauggcguccucgguacucuuauggauggcuaguguagagccacauuggaucgcagccagcauuauucuggaguucuuucuaaugguauuacucauaccugaaccagacagacaacgaacaccccaagauaaucaguuagcauacguuguaauuggucuauuauuuaugauauuaacagucgcugcuaacgagauggguuugcuagaaacaaccaagaaagauuuggggaucggacauguagcugucggaaaccaccaucaugcugcuaugcuagacguggacuugcauccugccucagcuuggacauuauacgcaguagccacuacaauuauuacuccaaugaugaggcacacuauagaaaacacaacggcaaauaucaguuuaacugcuaucgccaaucaagcugcaauucucaugggauuagacaagggcuggccuauaaguaaaauggauaucggaguaccucugcuagcuuuaggaugcuacagccaagugaacccucucacacuaacagcagcuguacuaaugcuuguggcacacuaugcaauaauugguccaggccuucaagcaaaggccaccagggaggcucaaaagcgaacggcagcgggaauaaugaaaaacccuacaguugacgguauaguugccauagaucuggacccuguaguguaugaugccaaauucgagaagcaacuuggucaaaucauguuacuuauacucuguacuucacagaucuuauugaugcgaacaacaugggcacuuugugagucaauuacacuagcuaccggcccuuuaacaacauuaugggaaggaaguccuggcaaguuuuggaacacaaccauagcaguauccauggcaaauaucuuuagaggguccuaccucgcaggggcaggccuugcuuucagucuaaugaaaagucucggcgguggacgcagaggaacuggcgcucagggggaaacguuaggugaaaaauggaaaagacaauuaaaccaauuaucuaaaucagaauuuaauacauauaaacguucugggaucauggaaguagauagaucagaagcuaaagagggcuuaaagagaggggaaacaaccaaacaugcagucaguagaggaacagcgaagcuaagaugguucguagagcgcaaccuugugaaaccagaagguaagguuauagauuuaggaugcggccgagguggcuggaguuauuauugugcgggacucaaaaagguaacagaagugaaaggauacacaaaaggagggcccggccaugaagaaccuauuccgauggcuacguauggauggaauuuaguuaaacuucauucuggcaaagaugucuucuuuauuccgccagagaaaugugauacguuauuaugcgacauaggugaaagcucuccgaaucccacaauugaagagggccguacuuuacguguucucaaaaugguugaaccuugguuaagagguaaccaguucugcauuaagaucuuaaauccauauaugcccucagucguagagacccucgaacagaugcaaagaaaacaugguggaauguuaguaagaaauccacucucuagaaauuccacacaugaaauguauuggguuaguuguggcacaggcaauauagugagugcuguaaauaugacuucgagaaugcucuugaauagauuuacaauggcucauagaaaaccgaccuaugaaagggacguugaucuaggagccggaacaagacacgucgccguagaaccagaaguagcaaaucucgauaucauuggucaacgaauagaaaauauuaaacacgaacauaaaucaacauggcauuacgaugaagacaaucccuauaagaccugggcauaccaugguucauaugaaguaaaaccgaguggaucugcgaguuccaugguaaauggcguugucaaacuauuaacgaaaccaugggaugucauaccaauggugacucaaaucgcgaugacagauacgacucccuucggacaacagagaguauucaaagaaaaaguagacacaaggacaccuaaggcaaaacgcgguacugcgcagauuauggagguuacggcaaaauggcuaugggguuuucuaagucgaaauaagaaaccaaggauauguacaagagaagaguucacaagaaaaguacguucuaaugcggcgauuggagccguuuucguugacgaaaaccaauggaacucagccaaagaagcagucgaagaugaaagauucugggauuuaguacaccgugaaagggagcuucauaaacaggggaagugugcaacuugcguauacaacaugauggguaagagggagaagaaauuaggcgaguucggaaaagcuaaagggucacgagcgaucugguacauguggcugggggcaagauuucuugaguucgaggcacuaggauuuaugaacgaggaccacugguuuagucgggaaaauucacuuucgggaguagaaggugaagggcuacacaaacucggauacaucuuacgugauaucucaaaaauuccaggagggaacauguacgcagaugauacagccggaugggacacucgaauuacagaagacgaucuucagaaugaagccagaaucacagauaucauggagccagaacacgcauuauuagcuaaaucaaucuucaaacucacauaucaaaauaaaguaguaagaguacagagaccggcuaaaaauggaacaguaauggacguuaucucacggcgagaccagaggggaaguggucaagucgguacuuacggucuaaauacguucacgaauauggaagcccaauuaauaaggcaaauggaaagugaagggaucuucagcccgucggaauuggaaacucccaauuuagcagaacgaguguugguauggcuggaaaaauacggaguugaaagauuaaagcguauggccauaucaggagaugacugcgucguuaaaccuaucgacgauagguucgcaacagcacucacagcccuuaaugauaugggcaaaguacgcaaggauauaccucaaugggagccaucuaaaggauggaacgacuggcaacagguaccauuuugcucgcaucacuuccaucaacucauaaugaaagacggaagagaaauugugguaccgugcagaaaucaagacgaauuagucgggcgugccagagugagucagggagcaggguggagcuuaagggaaacagcuuguuuagguaaaagcuaugcacagauguggcaauuaauguauuuucaucgucgagaucucagauuagcagcaaacgcuauauguagcgccguaccagucgauuggauuccuacaucaaggacuaccuggaguauacacgcucaucaucaguggaugacgacagaagacaugcuuaguguauggaauagaguguggauugaagaaaauccuuggauggaggauaaaacgcauauaucgucuuggggagaugugccuuaucucgggaaaagagaagaccaaugguguggguccuuaauuggacuuacagcacgggcaacaugggccaccaauauacagguagcuauuaaucaaguaagaaggcuaauuggcaacgaaaacuaccuagacuacaugacauccaugaaaagguuuaagaaugaaagugauccugaaggagcguuaugguag

SEQ ID NO: 21208 - RNA, 9879 nt, Artificial Sequence
  derived and/or modified CDS sequence (opt6) from DENV-1__FJ639696__SS-prME
aguguuacaaugcuucuuaugcugaugcccacagcacuugcauuucaucuuacgacaagagggggagaaccccacaugauaguuucaaaacaagaaagagguaaaaguuuauuguucaaaacaagugcgggaguaaauaugugcacacuuauagcuauggauuuaggggaauuuugugaagacaccaugacuuacaaauguccuagaaucagugaagcagaaccggacgauguugauugcugguguaacgccacggauacuugggugacuuauggaacauguagucaaaccggagaacacaggcgagauaaacggucgguugcacuugcuccccauguggggcuuggucuugaaacaaggaccgaaacauggaugaguucagaaggugcguggaaacaaauucaaagaguagaaacaugggcuuuaagacauccaggauuuacaguaauagcccuuuucuuggcccacgcuauuggaacaucaauaacucagaaagguauaauauuuaucuuguuaaugcuaguaacaccuaguauggcuaugagauguguuggaauagguagucgagauuuuguagaagggcuuucaggugcaacaugggucgauguaguuuuggaacauggcaguugcguaacuacuauggcaaaagauaaaccaaccuuagacaucgaauuacuuaaaacagaaguuacgaauccagcgguacugaggaaacuauguaucgaagcaaaaauaagcaauacaacuacagacagcagauguccaacucaaggcgaagcaaccuuaguagaagaacaggacgcuaauuucguuuguagacgaacuuucguagaucgcgguuggggcaacgguuguggacuguucgggaaaggaaguuuaauaacgugugcaaaauucaaaugcgucacgaaauuagaggggaaaauagugcaauaugaaaaccucaaauacucaguaauaguaacuguacauacgggugaccagcaccaggucggcaacgaaucaacagaacacgggaccacagcgacaaucacuccccaggcgccaucaacggaaauacagcucacggauuauggcgcgcuaacguuagacugcucgcccagaacgggacuugauuucaacgaaaugguauuguugacuaugaaagaaaaaucauggcuaguucacaaacaaugguucuuggauuuaccccuaccauggacguccggagcaucuacuucgcaagaaaccuggaauaggcaagauuuacucguaacauuuaagacugcucacgccaagaaacaggaaguaguaguacucgggucacaagagggagcaaugcacacagcccugacgggcgcaacugaaauacaaacaucuggaacuaccacuauuuucgcggggcacuugaaguguagacugaaaauggacaaacuuacccuuaaaggcaugaguuauguaauguguacuggcagcuuuaaacuugaaaaagagguagcugaaacucaacaugguacuguacucguccaaauaaaauaugagggaacagaugcaccuugcaaaauaccuuucagcacgcaagaugaaaagggugugacacaaaaugguagacuuauaacagcuaacccuauaguaacagauaaagaaaaaccgguaaacauugaggcagaaccuccuuucggcgaaagcuacauaguaauuggugcuggugagaaagcccuaaaauuaucuugguucaagaaagggaguucuauagggaaaauguuugaagcaacugcacgaggagcacggcggauggcuauuuuaggggacacagcaugggacuuuggaucgauaggaggaguauuuacaucagugggcaagcuaguucaccaaaucuuuggcacggcauaugguguccuauucucaggcgugaguuggacuaugaaaauagggaucggaguauuacucaccugguuaggacuaaauucccgaucaaccucccuaucaaugacuuguaucgcaguaggauugguaacauuguauuuaggggucaugguccaagccgacaguggaugugugauuaacuggaaagggcgcgaacugaaauguggaaguggcauauuugucacgaacgagguacauacuuggacagaacaguacaaauuccaagcugacucaccuaagcgguuaagugcugcuauugguaaagcaugggaggaggguguuugugggaucaggucagcgacucgacuagaaaauaucauguggaaacagaucucaaacgagcuuaaccauauucuguuggagaacgacaugaaauuuacgguugucguuggagacgucgcgggcaucuuagcacagggcaagaaaaugauccgcccgcagccuauggaauauaaauauucauggaaauccugggggaaagcuaaaaucauuggagccgacguccaaaauacgacauuuauuauugauggaccgaacaccccagaaugcccagaugaucaacgggcauggaauauuugggagguagaagacuauggauucggaauauuuacaacgaauauuugguuaaaguuaagggauaguuauacacaagucugugaucauagacuaaugucugcagcuauuaaagauuccaaagcugugcaugcagauaugggauauuggauagaguccgagaaaaaugaaacguggaaauuagcgagggcaucguuuaucgaaguaaaaacauguauauggccaaaaagccacacgcuauggaguaaugguguucuugaauccgaaaugaucauaccuaaaauauauggugggccgauaucucaacauaauuauagaccuggauauuuuacucaaacagcgggaccauggcacuuagguaaacuggaacuagauuuugacuugugugaagggacaacagucguuguggaugagcauugcggaaauagaggccccagcuuaaggacaacaacggugacugguaaaauaauacaugaguggugcugucguucuugcacgcuaccaccccugcguuuuaaaggagaggauggcugcugguauggaauggagauacgaccaguaaaagaaaaggaagaaaaucuagucaaaaguauggucucugcaggcaguggugaggucgauucguuuagucuaggccuuuuguguaucucgauaaugauagaagaaguaaugcgaucacgcuggagcagaaagaugcuaaugacaggcacucuugcgguauucuuucuucuaauuaugggacaacucaccuggaaugacuuaaucagauuauguauaaugguuggggcaaacgcauccgacaggaugggaaugggcaugacguauuuggcuuugauggcgacauucaagaugagaccaauguuugcaguggggcuucucuucagacgauuaacuagcagggaaguacuuuuguuaaccauaggucuaucauuaguggcuucuguggaacuuccaaacaguuuggaagaacucggggacggauuagccaugggaauuaugauauuaaaacuuuuaacagauuuucaaagucaucaauuaugggcaacacuuuuaucucucacauucauaaaaaccacauuuucguuacauuacgcauggaagacgauggcaauggugcuaucuauugucagucuguucccguugugcuuaagcacuacgucacaaaagacaaccuggcuuccuguacuuuuaggcaguuuaggcugcaaaccuuuaacaauguuccuuauugccgaaaauaaaauauggggaagaaagucguggccacucaaugaaggaauaauggccguuggcauaguuucuauauuacugucaucauuauugaaaaacgauguuccacuagcuggaccuuuaauugcgggagguaugcuaauagccugcuacgugaucagcgguuccagcgcugaucucagcuuggagaaagcugcggaaguguccugggaagaagaggcagaacauuccggagcaagccacaauauucuagucgaaguccaagaugaugggacaaugaagauaaaagacgaggaaagagacgauacuuugacgauacuauuaaaagccacacucuuagcuguaucaggaguauauccauugucaauaccugccacucucuucguaugguauuuuuggcaaaagaagaaacagcgauccgggguucuuugggacacaccuaguccaccggaaguggaacgagccguacucgaugacggaauauaccgaaucaugcagcguggccuucuugguagaagccaaguaggcgucgggguguuucaagaaaacguuuuucacacgauguggcaugucacgagaggugcagucuuaauguaucaggguaaacggcuugagcccucaugggcgucugugaaaaaggauuuaauuucuuacgguggugguuggcgucuccaaggaucuuggaacacgggugaagaaguacagguuauugccguggagccuggcaaaaaccccaaaaauguccaaacagcuccgggaacuuucaagacaucggaaggcgaagugggagcgauugcucuagacuuuaaaccuggcacuucuggaaguccuauuguuaauagagaagguaagauaguuggucuauaugggaacggaguagucacaacaucaggaacauauguaucagcuauugcacaggcaaaagcaagucaggaaggaccacuaccugagauugaagaugaaguauuuaggaaaagaaaucugacaauaauggacuuacaucccggcucgggcaagacaagacguuaucuuccagcaaucguuagggaagcaauaaaaagaaagcuccgaacucuaauacuugcaccaacaagaguaguagcgagugaaauggcggaggcacuuaaaggaaugccaauacgcuaucaaacuacagcgguaaaaucugagcacacggggaaagagauaguggaucugaugugucaugcuacuuuuacaaugaggcuauuaucuccagugcgugucccaaauuauaacaugaucauaauggacgaagcacauuuuacugacccuuccucgauagcagcacgaggauacauuucuacaaggguaggcaugggcgaagcagcagccaucuucaugaccgccacuccuccuggaaguguugaggcauuuccucagucaaaugcaguaauucaggacgaagaacgagauauuccagaaagaaguuggaauagcggguacgaauggaucacagacuuuccagguaaaacuguuugguuuguaccguccauuaaaaguggcaacgacaucgcaaacugccuuaggaaaaacggcaaacgcguuauacagcuguccagaaagacauucgacacugaguaccagaaaacaaagaacaaugauugggacuacguagucacuacugacauuucugagaugggugcgaacuuuagggccgauagagucauugacccccgaagaugccucaaaccaguuaucuuaaaggauggaccugaaagggugauacuugcaggaccaaugccuguaaccguagcgucggcggcacagagacgaggaaggauaggaaggaaucacaauaaagaaggagaccaauauauuuauaugggacaaccacuaaacaacgacgaagaucaugcacacuggacugaggcgaaaauguuacuagauaacauuaauacucccgaaggaauaauaccugcgcuguucgagccggaacgggagaaaagugcggcuauagauggagaauauaggcuucgaggagaggcgcguaaaacauuuguugaacuuaugagaagaggcgaucuaccaguguggcugaguuacaagguagcaucugaagguuuccaguauuccgaccgacgaugguguuuugacggugaaaggaauaaucaaguauuagaagaaaacauggacguagaaauauggacaaaagaaggagaacgaaagaaacucagaccaagaugguuggacgcaagaaccuauucugauccauuagcccuacgagaauuuaaagaauuugcugcaggacggagauccgucagcggagaucuuauacuugagauaggaaaacuuccgcaacaucuuacgcaaagagcacaaaacgcacuugauaacuuaguaaugcuacauaacucagaacaagggggaagggcuuaccgacaugcaauggaagaauuaccugauacuauugaaacacuaauguugcuggcgcucaucgcggugcugacgggugggguuacgcuauucuuucuuucaggccggggacuuggaaaaacuucaauuggacuucuauguguuauggccaguaguguauuauuguggauggcaucuguggaaccacauuggauagcagcuucgauuauucuggaguucuuucugaugguccuacuaauuccagaaccagauagacaaagaacaccccaagacaaccaacuugccuauguggugauuggcuuauuguucaugauuuugacagucgcugcgaacgaaaugggucuauuggagacuaccaagaaagaccuagguauaggucauguggcgguagagaaccaccaccaugcagcuaugcuugauguagaucuucauccugcuagcgcauggacgcuguacgcgguugcaacaacaauuauaacaccuaugaugcgccauacgauagagaacaccacggcaaacauaucucucaccgcaauagcaaaccaagcggcuauacuaaugggacuagauaaaggauggccaauaucaaaaauggauauaggcguaccucuauuagcucuaggguguuauucucagguaaauccauugacccugacagcggcuguacuaauguuaguugcccacuaugcaauaauugguccaggccuucaagcaaaggccacucgggaggcccagaagagaacagcagcuggaauaaugaaaaacccaacagucgacgggauuguagccauagaucucgauccuguaguuuacgaugccaaauucgaaaaacaacucggacaaauuaugcugcuaauccuuuguacaucccagauucugcuaaugcgaacuacuugggcguuaugcgaaaguauaacccucgcuaccggaccauuaacuaccuuaugggagggaucaccagguaaauuuuggaauacaacuauagcaguaucaauggcuaacauuuucagaggaucauaucucgcgggugcaggauuagcguucucacuuaugaagaguuuaggugguggcagaagagggaccggugcacaaggcgagacauuaggcgagaaguggaaaagacaauuaaaccaacuuucaaaaagugaauuuaacaccuacaaaagaucaggaauaauggagguagaucgaagugaggcgaaagaaggucuuaaaagaggggaaaccacuaaacaugccgucagcaggggcacggcaaaacuccggugguuuguugaaagaaaucuaguuaaaccagaagggaaaguaauagauuuaggcugcggucguggaggauggucauacuacugcgccgguuugaaaaagguaacagagguaaaggguuauacgaaagggggaccggggcaugaagaaccuaucccaauggcaacauauggcuggaaucuaguuaaauugcacucuggaaaggauguauucuuuguaccgccggaaaaaugcgauacgcuacuaugcgacaucggugaaucuagcccgaauccgacaauagaagagggcagaacuuuaaggguacuaaagauggucgaaccgugguuacgaggaaaucaguuuugcauaaagauacuuaacccuuauaugccgucaguaguagagacauuggagcaaaugcagagaaaacacggagguaugcuggugcgcaacccucuuucgagaaauucuacacacgaaauguacugggugucgugugggacaggaaauaucgugucugcuguuaacaugaccagcagaauguuacugaauagauuuacaauggcacaccgcaaaccaacuuaugaaagggacguagauuuaggugcuggaacccgccacguagcaguugagccugaaguagcaaaucuagauauuauuggucaaagaauagaaaacauaaaacacgagcauaaaagcacauggcacuaugaugaagacaacccuuacaaaacaugggcguaucacggaucauaugaaguuaaacccagugggagugcauccagcaugguaaacgggguuguaaagcuguuaacaaaaccgugggaugucauuccaaugguaacacaaauugcuaugacagacacgacgccauuuggacagcaaagaguauucaaagagaaggucgauacacgcaccccaaaagcuaaaaggggaacagcacagauuauggaaguaacugcuaagugguuauggggguuccuuaguagaaauaagaaacccagaauaugcacuagagaagaauuuaccagaaaaguuaggucuaacgcagcgauuggagcaguguuuguugaugaaaaccaauggaacagcgcgaaagaagcuguugaggacgagcgauuuugggaccuaguacauagagagcgagaauuacacaaacaaggaaagugcgcaacuuguguauacaauaugaugggaaaaagggaaaagaaauugggugaguucggaaaggccaagggaucaagagccauaugguacaugugguuaggcgcaagguucuuagaguucgaagcauuaggauucaugaaugaagaucauugguucaguagagagaacagccuaaguggcguagaaggagaaggauuacauaaauuaggcuauaucuugagagauauuagcaaaauuaguggaggaaauauguacgccgacgacacugcgggaugggauaccagaaucaccgaagacgaucuccaaaaugaggcuaaaauaacagacauaauggaaccagagcaugcucuauuagccaaaucaauauuuaagcuaacuuaucagaacaaagucgugagaguucaaagaccagccaaaaacgguacuguuauggaugucauaucgcgcagagaucagcgaggcucgggacaaguugguacauacggacuuaauacguuuacgaauauggaggcccaauuaauaagacaaauggaaagcgaaggaauauuuuccccaucggagcuugaaacaccaaauuuagcggagcgggcgcuugacuggcuugagaagcauggcgucgaaagacuaaagagaauggcaauuucaggagaugauugugucguuaagccaauagaugaucgauuugcuacugcgcugacagcuuugaaugacaugggaaaagucaggaaagacauuccucagugggaaccuaguaagggcuggaaugauuggcagcagguaccuuucugcucacaccacuuucaucaacuuauaaugaaagauggucgggaaauuguagucccuugucgaaaucaagacgaauuaguagguagagcucgaguaagucaaggggcaggauggaguuugagagaaaccgcuuguuuaggaaaaucauaugcgcagauguggcaacuaauguauuuucaccgaagagauuugagguuagcagcaaaugcuauuuguucagcugucccaguggauuggguaccaacaucacguacaacuuggucgauacaugcucaucaucaguggaugacaaccgaagauauguugucagucuggaauagaguauggauugaagagaauccauggauggaagauaaaacgcacaucagcucaugggaagauguccccuaucuagggaaaagagaagaucaaugguguggaucucucauaggccuaaccgcuagagccacuugggcaacaaauauacagguugccauuaaucaaguacguagauugauugggaaugaaaauuaucuagacuauaugacgaguaugaaaagguuuaaaaaugaaagcgaucuggagggagcucuaugguag

SEQ ID NO: 21209 - RNA, 9879 nt, Artificial Sequence
  derived and/or modified CDS sequence (opt6) from DENV-1__HM181937__SS-prME
aguguaacaauguugcucaugcuaaugccaacugcacuggcauuucaucuuacaacaagaggaggagaaccucauaugauuguaucgaaacaagaaagagggaaauccuuauuauucaaaacauccgcgggugugaacauguguacauuaauugcuauggaccuuggagaacucugcgaagauacaaugaccuauaaaugucccagaauuacagaagcugaaccugaugauguugauugcugguguaaugccacagacacaugggugacuuauggaacauguucacaaacgggggaacacagaagagauaaaagaaguguugcccuagcaccucacguugggcuuggguuggaaacgagaacagaaacauggaugucuucagaaggagcauggaaacaaauucaacgcguugagacuugggcacucagacaucccggguuuacagugauugcacuguuccuagcgcaugccauagggacaagcauaacacaaaaaggaauuaucuuuauacuacuaaugcuagucacaccaagcauggccaugcgaugcguaggcauugggucaagagauuucguggagggacugagcggagcgaccuggguagauguaguacuagaacaugguuccugcguaaccacuauggcaaaagacaaacccacuuuagacauagaacuauuaaaaaccgaagucacaaauccugcuauucuacgaaaacuuuguauugaagcaaaaauuuccaauacaacaacugauucacgaugcccgacacaaggugaagcuacacuugucgaagaacaggaugcaaauuucguaugccggcgcacuuuuguggacaggggauggggcaauggguguggucuuuuugggaaagguucccugauuacaugugccaaauucaaaugcguuacgaaauuagaagguaaaauagugcaauaugaaaaucuaaaauauagcguuauuguuacaguacauacaggagaucaacaucaagucgguaaugaaucaacagaacauggcacuacggcgacgauaacaccacaagcaccaacaacugaaauacaacugacagauuauggcgcacugacucuagacugcucaccacgcacgggguuggacuucaaugagaugguacuacuaacaaugaaagagaaaagcugguugguacauaaacaaugguuucucgauuuaccauuacccuggacaagcggagcuucgacaagccaagagacauggaauagacaagauuuacucgugacauucaaaacggcacaugcuaagaaacaggaaguagugguguuagguagccaagaaggagcaaugcacacagccuuaaccggagcaacagaaauccaaacgucaggaacaacuaccauauucgcgggucaucucaaauguagacucaaaauggauaaauuaacucuaaaagggaugucauauguaauguguacagggucguucaaauuagaaaaagaaguggcugaaacacaacacggcacgguucuuguccaaauaaaauaugaaggcacggacgcgcccugcaaaauucccuuuaguacccaagaugagaaagggguuacccaaaacgguagguuaauuacagcaaacccuaucgucaccgauaaagaaaaaccaguaaauauagaagcagaaccaccuuuuggagagaguuacauaguuaucggagcaggagaaaaagcacugaaacuuaguugguucaagaaaggaucauccauaggaaaaauguuugaagcuacggcucguggugccaggcgaauggccauacuaggugauacagcaugggacuuugggagcauugguggaguguucaccaguguugguaaauuaguucaccaaauauucggcacugcuuaugguguguuguuuucuggcguuagcuggacuaugaaaauagguauaggaguauuacuaacauggcugggcuuaaauucaagaagcacuucucuaucaaugacauguauugcagucggcuugguaacguuauacuuagguguuaugguacaggcagacuccggauguguaauaaauuggaaagguagagaacuuaaaugugguaguggaaucuuuguaacuaaugagguacauacauggacugagcaauauaaauuucaagcagacaguccuaaaagauuaagugcugcaauugggaaggcgugggaagaaggcguaugcggaauaaggucggcuacaagauuagagaauauaauguggaaacaaaucuccaaugaacugaaucauauccuauuggaaaacgauaugaaauuuacggucgucguaggcgacgucgcuggcauucuugcucagggcaagaaaaugauacgaccgcaacccauggaguauaaauauagcuggaaaucaugggggaaagcuaaaaucauuggugcagauguucagaauaccaccuucauaaucgacggaccuaacacuccagagugcccagacgaucagcgugcguggaacauaugggaaguagaagacuaugguuucggcauauucacaaccaauaucuggcugaaguuaagagacuccuauacucagguuugugaucauagacugaugucagcugcgauuaaagacucuaaggcaguacaugcagauauggguuauuggauagaauccgaaaagaaugaaacauggaaacuagcucgagccagcuuuauugaaguaaaaacuuguauuuggccuaagagccacaccuuauggucgaauggaguauuggaaagugaaaugauaauaccuaaaauauacggggguccaauaagccagcauaauuauagacccgguuacuucacacaaaccgcuggcccuuggcacuuaggcaaacucgaguuagacuucgaccugugugaggggacaacuguaguuguagaugaacauugcgggaaucggggaccaaguuuaagaacaaccacaguuacuggcaaaauaauacaugaaugguguugucgaucuuguacucuacccccucuuagauucaggggugaagaugguugcugguaugguauggaaauuagaccaguuaaagaaaaagaagaaaaucuuguuaaaagcauggugagugcugggagcggcgaaguggacucuuuuagucuuggauuacucuguauuucuaucaugauugaagaaguaaugagaaguagauggagucgaaagaugcuaaugacaggaacuuuagcuguuuuucuauuauugauaaugggccaauuaacuuggaacgaucucauacgccuuugcauaauggucggugcuaaugcuucugauagaauggggaugggaacuacuuaucuagcacugauggcuacauucaagaugcgcccaauguucgcaguuggacuuuuguuccgcagauugacgagucgagaagugcuguugcucacuaucggacugucacuuguugcaucuguagaauugccaaauucacuagaggaacuaggugacggauuagcuauggguauuaugauuuuaaagcuacuaacugauuuucaaucccaucaauugugggcaacacuucuaaguuuaacauuuauaaagacuacuuucucacuacauuaugcauggaaaacaauggccaugguucuuagcauagucagcuuauucccauugugucuuagcacaacgucacagaaaacuaccugguugccaguacuacucggcucauuagguugcaaaccuuuaacgauguucuugauagcggaaaauaaaauauggggaaggcguuccuggccguuaaaugaagggauaauggcuguaggcaucguaucaauccucuugaguucguuguuaaagaaugaugucccacuggcagguccauuaauagcugggggaaugcugauagcaugcuaugugaucucugguucuucugcagauuuaucuuuggaaaaagccgccgaaguuuccugggaggaggaggcugaacauagcggagcuagccacaauauacugguagagguucaagaugacggcacaaugaaaaucaaggaugaagaaagagacgauacacuaacuauccuuuugaaagcaacguuauuggccgucucaggaguuuauccguuaucaauaccagcgacacuuuucguaugguauuucuggcaaaagaagaaacaacgcucaggaguacucugggacacaccaaguccaccagaggucgaacgagcaguauuagacgacggaauuuauaggaucaugcagcguggcuuacuugguaggagccaagucgguguuggugucuuucaagaaaauguuuuccacacaauguggcauguaaccagaggugcuguacuuauguaucagggaaaaagacuugaaccgucaugggcaucaguaaagaaagaucucaucaguuauggaggaggguggagacuucagggaagcuggaacaccggagaagaaguucaaguuauagcggucgagccugguaagaaucccaaaaacguccaaacagcaccgggaacauucaagacaccggagggagaaguaggugcgaucgcacuagauuucaagccaggaacaagugguucaccaauuguaaaucgagaagguaaaauaguaggacucuacggaaauggcgugguuacaacuagcgguaccuauguaucugcgauugcacaggcuaaagcaucucaggaagguccuuuaccggaaauagaggacgaaguguucagaaaaagaaacuuaacaauuauggaucuacacccugguucagggaaaacaagacguuaccugccagcgauugucagagaggcuauaaaaaggaagcuacguacccucauccuagcaccaacacguguuguagccagcgagauggcugaggcccuaaaggguaugccuauucguuaucaaacaacagccgucaaaucggaacacacaggaaaagaaauaguugauuugaugugccaugcaacauucacaaugaggcuauugucaccaguaagaguaccgaauuauaacaugaucauaauggaugaggcacauuucacagauccaucuucaauagcagcucguggauacauaucgacaagaguaggaaugggcgaggcagcggcaauuuuuaugacagccacaccacccgguucuguugaagccuuuccucaaaguaaugcagugauacaagacgaggaaagagacauacccgaacguaguuggaauaguggguaugaguggauaacagauuucccgggaaagacgguaugguucguuccaaguauuaaaucaggcaacgacaucgcaaacuguuuaaggaaaaacggaaaaagaguaauacagcuuucuagaaaaacguuugauaccgaauaccagaaaaccaaaaauaacgacugggauuaugucguaacuacugauaucucggaaaugggagcaaauuuccgagcagacaggguaauugauccaaggagauguuuaaagccggugauauuaaaggauggcccagaaaggguaauauuggcaggaccaaugccggugacaguugcuucagcugcacaacggcggggccgaaucggaaggaaucacaacaaagaaggagaccaauauaucuauaugggacaaccacuaaacaaugacgaggaucaugcgcauuggacagaagcaaagaugcuucuagacaauauaaauaccccggaagggauaauaccugcucuauucgaaccagaaagagaaaaaucagcggcaauugauggugaauauagauuacggggcgaagccaggaaaaccuuuguagaauuaaugagacgcggcgauuuacccguaugguuaucauacaaaguagcaagugagggauuucaauacucagaccgccguugguguuucgauggggagcgaaacaaucaaguucuagaagagaacauggacguggaaauauggacuaaagagggcgaacgaaagaaacugcgaccacgguggcuugaugcucgaacauacuccgauccauuggcuuugcgugaguucaaagaguuugcugcaggaagaaggucgguaucgggagauuuaaucuuggaaaucggaaaacuuccucaacauuuaacacaacgcgcacaaaacgcacucgauaaucuaguaaugcuacauaacucugaacaagguggcagggcguauagacacgcuauggaagaauuaccggauaccauagaaacucugauguuacuggcguuaaucgcuguacuaaccggaggcguaacuuuauuuuuccugucaggaaggggauuaggaaagacaucaaucggauugcuuuguguaauggcaagcucuguccuccuauggauggcuagcgucgaaccucauuggauagccgcaucuaucauauuagaauuuuucuuaaugguguugcuaauuccagaaccagacagacaacgaacuccgcaagacaaccagcuagcguacguggugauaggguuacuauuuaugauuuuaacggucgcagccaaugagaugggacugcuagaaacaaccaagaaagaucuagguauaggacacgucgcaguugguaaucaccaccaugcggcaaugcuagauguagaccuacauccagccagugccuggacucucuaugcaguugccacaacaaucauaaccccuaugaugcgacauaccauagaaaauacuaccgcaaauauuagcuuaaccgcaaucgcaaaccaagcugcaauucucauggggcuagacaaaggauggccaauuagcaaaauggauauaggcguaccuuuauuggcucucgggugcuauucacaggugaauccucuuacauugaccgcugcaguauuaauguuaguggcccauuacgcuauuauuggccccgggcuacaagccaaggcaacacgugaagcacagaagagaacugcagccggaaucaugaaaaacccaacgguagacgguaucguagcgauugacuuagauccugucguguaugaugcuaaauuugaaaaacaauuagggcaaauaaugcuccuaauauuaugcacgagucaaauucuucugaugcggacuacaugggcauugugcgaaagcauaacacucgcaacggguccauuaacaacgcuuugggaaggaagcccgggaaaauuuuggaauacaaccauagcaguaucaauggcaaacauuuuccggggcucauauuuagcuggagccggucuagcauucagccuaaugaaaucucuagggggcggacgcagagguacgggagcccagggagaaacccucggggagaaauggaaaagacaacuaaaucaacugaguaagagcgaguucaacacuuacaaacguucuggaauaauggaagucgaucggucugaggcgaaagaaggauugaaaagaggcgagaccacgaaacacgcuguaagcagaggaacagcaaaauugcggugguuuguagagagaaauuuaguaaaaccugaaggaaaaguaauagacuuaggcuguggucgagggggcuggagcuacuacugugcaggucucaagaaaguaacugaggucaaaggguauacuaagggaggcccuggacaugaagaacccauaccgauggcaacauacgguuggaaucucguaaaauuacacucgggaaaagauguauucuuuauaccaccugaaaaaugcgauacguugcuuugugauauaggagagaguucgcccaauccaacaauugaagaagguagaacauuaaggguacucaaaaugguugaaccaugguugagagguaaucaauuuuguauaaaaauauuaaacccguauaugccuaguguaguugaaacgcuagaacaaaugcaaaggaagcauggaggaaugcucguacgaaacccccuuucuagaaacaguacccacgaaauguauuggguuucuugcgguacagguaauaucgugucugcaguaaacaugaccucaaggaugcuccuuaacagguuuacaauggcacacagaaaaccuacauaugaaagagauguagauuugggugcggguacuagacaugucgcaguagaaccagaaguagcgaaucuagacauaauaggacaaaggauagaaaauauuaaacacgagcacaaaucaacguggcacuaugaugaagacaaucccuacaagacuugggcuuaucauggcuccuaugaaguaaagccgagugggucggccucaucuaugguaaacgguguaguaaagcuacucaccaagccuugggacguaauccccaugguaacacaaauagcaaugacggauaccacccccuuuggucagcagagggucuuuaaagaaaaagucgauacucggaccccaaaagccaagcguggaacugcccaaauaauggagguaacagcuaaauggcucuggggcuuccuaucaagaaauaaaaagccaagaauauguacgagagaagaguucacgcgcaaaguucguagcaacgcugcuauaggagcaguauucguugacgaaaaccaauggaacucugcaaaagaagcaguagaagaugaaagauucugggaucuggugcacaaagaaagggagcuacacaagcaaggaaaaugcgcuacauguguuuacaauaugauggggaaaagagagaagaaacugggcgaauuuggcaaagcaaaagggucuagggcuaucugguauauguggcuaggugccagauucuuagaguucgaagcacugggauucaugaaugaagaccauugguuuaguagagaaaauuccuuaucggguguagagggugaaggauugcacaaacucggcuacauucugcgggacauaucaaaaauuccgggcggcaauauguaugcagacgacacagcaggaugggauaccagaauaacggaagaugacuugcaaaacgaagcccguauuaccgauauaauggaaccggaacaugcucucuuagcaaaaaguauuuuuaaacuaaccuaccaaaauaaaguugucagagugcaacguccagcuaaaaacggcaccguaauggauguuauaucaaggcgagaccaaagaggaagcggucagguaggaacauacggccucaauacauuuacgaacauugaagcucagcuuauucgucaaauggaaucagaagguauauuuucgccaucugaauuagaaacacccaaccuugcggagcguguacuugacuggcuagaaaaauacggaguugagcgauuaaagaggauggcgauuucgggugaugacugugucguaaaaccgauagaugaucgauucgccacggcguuaaccgcauuaaaugacaugggaaaaguaagaaaagacaucccacagugggaaccaucuaaaggcuggaacgacuggcaacaagugccuuucuguucacaucacuuccaccaacucauaaugaaagacggaagagagaucguggugccuuguagaaaucaagacgaguuggugggcagagcacgugucagucaaggagcuggguggagccuccgcgaaacagcauguuugggaaagaguuaugcacaaauguggcagcuaauguacuuucacaggagagaucuuaggcuagcagcaaacgcuauuugcucagccgucccgguagacuggaucccaacaucucgaacaaccuggucuauccacgcucaccaucaauggaugacaacagaagacauguuaucagucuggaauagaguuuggauagaagagaauccguggauggaagauaagacgcauauaucaucuuggggcgauguaccuuaucuuggcaaacgugaagaucaauggugugggucucugaucggcuuaacagcaagagcuacuugggcaacaaacauacaagucgcuauaaaccaaguaagaagauugauugguaaugaaaacuacuuagauuauaugaccaguaugaaacgauucaagaacgagucagaucccgagggugccuuaugguaa

SEQ ID NO: 21210 - RNA, 9879 nt, Artificial Sequence
  derived and/or modified CDS sequence (opt6) from DENV-1__HM181939__SS-prME
ucaguaacaaugcuacuaauguuaaugccgacggcgcuugcauuucauuuaacaacucgggguggggaaccgcauaugauugugucuaaacaagaacguggaaaaucucuuuuauuuaaaacguccgcuggaguuaauaugugcacacuaauagcgauggaucuuggcgaauuuugcgaagauacaaugacuuauaaauguccuaggaucagugaggccgaaccagaugacguugauuguuggugcaaugcaacagacacauggguaaccuacggaacuugcucacagacuggagaacaccgacgagauaaaaggucaguugcacuagccccacauguuggauuaggacuagaaacgagaacagagacauggauguccucagaaggcgcuuggaaacaaauucaaagaguugaaacaugggcacuuagacauccaggauucaccguaauugcguuguuuuuggcacaugcaauuggaaccucaauaacgcagaaagggauaauauuuauauuacuaaugcucguuacucccuccauggcuaugcguugcguaggcauaggaucccgcgacuuuguggagggacuaaguggggcuacuuggguugacguuguacuugagcaugguaguugugugaccacuauggcaaaagauaaaccaacuuuagauauagaauuacuaaaaacggaaguaaccaauccugccgucuuacgaaaacuaugcaucgaggcaaaaauaagcaauacuacaacagauuccagaugcccuacccaaggagaggcgacauugguggaggagcaggacgccaauuuuguauguagaaggacguuuguagauagaggcuggggaaauggaugcggacuuuuuggaaaaggaaguuugauaacaugcgcaaaauucaaaugcgucaccaaacuggaaggcaaaauuguacaauaugaaaaccuaaaauauucagugauaguaacuguacauacuggcgaccaacaccaaguggggaacgagucgacggaacacggaacaacugcaacgaucacaccccaagcaccaaguacagaaauucaguugaccgacuacggagcacuuacucuagauuguaguccucgcaccgggcuugacuucaaugaaaugguuuuacugaccaugaaagaaaaaucauggcuaguucacaaacagugguucuuagauuugccacucccauggacaagcggugccaguacaucgcaagaaaccuggaacagacaggauuuauugguaacauuuaaaacugcacaugccaagaaacaagagguaguuguccuaggaucccaagaaggcgccaugcauacugcucucacuggagcuacagagauacaaacaagugguacuacuacaauuuuugcaggucaccuaaaaugucgacuaaaaauggauaaguuaacccuaaaggguaugucauacguuaugugcaccggaaguuuuaaguuggagaaagaaguggcggaaacgcaacaugggacuguccuaguucaaauuaaauacgaaggaaccgaugcaccguguaagaucccuuucuccacucaagaugagaagggagugacgcaaaacggaagacucaucacagcuaauccuauaguaacagacaaagaaaagccaguuaacauagaagccgagccgccuuuuggagaaagcuacauaguuauaggcgccggugaaaaagcauuaaaauuaucuugguuuaagaaaggaucuuccauaggaaagauguuugaggcaacugcaagaggagcgcgaagaauggcgauuuuaggugauaccgcuugggauuucggaucaauagguggaguauucaccucggucggcaaauugguacaccagauuuucggaacugccuauggaguauuauuuucuggcgucagcuggacuaugaagauugggaucggaguauuguugacaugguuaggacuuaacaguagaucaacaucucugucuaugaccugcauugcuguaggccuagugacguuauauuuaggagucaugguucaggcugauucgggaugugucauuaauuggaaagguagagaacuaaaaugugguucuggaauauuuguaaccaaugaaguucauacauggacagaacaauauaaguuucaagcugacaguccaaaaagacuaucagcagccauuggaaaggcuugggaagaaggaguuugugggauuagaucugcuacaagacuugaaaauaucauguggaagcagauaucaaaugaacuaaaucauauuuugcuugaaaaugauaugaaauucacuguuguugucggugauguugcuggcauuuuagcucaggggaagaaaaugauccguccgcaaccaauggaguauaaauauucuuggaaauccugggguaaagccaagauaauaggcgccgauguucagaauacuaccuucaucauagaugggccgaacaccccagaguguccagacgaccaaagagcauggaauauaugggaagucgaagauuacggauucggaaucuucacaacgaacauauggcugaaacuaagagacaguuauacccaaguaugugaccacagguugaugucagcggcgauuaaggauaguaaagcaguacacgcugauaugggauacuggauagaaucagaaaagaaugaaacauggaagcuagcgagagcauccuucauagaaguuaaaacauguauauggccaaaaucacacacucuauggucuaauggaguacuggaauccgaaaugauuauuccaaaaauuuauggagggccaauuagucaacauaacuauagaccuggcuauuucacccagaccgcggggccauggcaucuuggaaaguuagaacuggacuucgauuuaugcgaggguaccacuguaguaguagacgagcacugcgggaaccgggguccaucauuacguacaacgacaguuacaggaaagaucauacacgaauggugcugcagaagcuguacuuuaccaccacugagguuuaaaggggaggaugguuguugguauggaauggaaauacguccaguuaaggaaaaagaagaaaacuuaguuaaauccauggucucagcugguucgggagaaguagauagcuucagucuaggacugcuaugcauaagcauaaugauugaagaaguuaugagaucgagguggagcagaaaaauguuaaugacuggaacgcuugcgguuuucuuuuuguugauuaugggucagcuaacauggaaugaucuaauacgucuguguauaaugguaggugcaaaugcgucagaucgaauggguauggguaugacauaucuagccuuaauggccacuuuuaagaugagaccuauguuugcugucggauuauuguucagaagacucacuucucgugaaguacuuuuauugacgauugguuuaucauuaguggcgucaguagaacugccaaacagcuuggaagaacuuggagauggauuggccaugggaauuaugauccuaaaacuuuugacagacuuucaaagucaucaauuaugggcaaccuuguugagccucaccuuuauaaaaacaaccuucucacuucacuaugcuuggaaaacgauggcaaugguguuaucgauaguuucccuuuucccgcuaugccuaucuacaacgagucagaaaacgaccugguuaccaguucuuuuggguucuuugggcuguaaaccauuaacaauguuuuuaaucgcagaaaacaaaaucuggggacgaaagucguggccucucaacgaaggcauuauggcugucgguauaguuagcaucuuauuauccagucuauugaaaaacgaugugccgcucgcaggaccacuaauagcuggaggaaugcuaauagcguguuaugucauaaguggcaguagugcggaucuaagccucgaaaaagccgccgaggucucgugggaagaggaagcagagcauagcggcgccucccauaacauccucgucgaaguucaggaugacggcacaaugaaaaucaaagacgaagaaagagaugauacgcuaacuauccuccugaaggccaccuuacuggcgguauccggaguuuauccucucucaaucccagcaacauuauuuguaugguauuucuggcagaaaaagaaacaacgaucagggguguugugggauacuccaucacccccugagguugaaagagcaguguuggacgaugguaucuaucguauuaugcagagaggauuauuaggucggagccaagucgguguagguguuuuucaagaaaauguauuccauacaauguggcaugucacaaggggagcggugcuaauguaucaagggaaaagauuggaaccuucgugggcguccgucaagaaagacuuaauuucauacgggggagguuggcgucuucaaggauccuggaauaccggggaagaaguccaagucauagcaguagagccaggcaaaaauccuaagaauguccaaacagcgccagguaccuucaagacaucggaaggcgaaguuggagcuauagcacuagauuucaaacccgggacuucuggaagcccaauagucaaucgggaaggaaaaaucguaggacucuauggaaauggcguuguuacaaccucugguacauacguaucugccauugcacaagcaaaagcaucucaagagggaccauuaccagagauagaggaugaaguauucaggaaacgaaaucuuacuauaauggauuuacauccaggaaguggcaaaacuagacgauacuuaccagcaauaguaagagaggcuauuaagcgaaaacuucgaacuuuaauacuagcuccaacccgcguaguagcauccgagauggcggaggccuugaaagggaugccuauucgguaucagacgacugcuguaaaaucugaacauacaggcaaagaaauaguugauuuaaugugucacgcaacuuucacuaugcgauuauuaucaccgguccggguuccuaauuacaacaugaucauaauggaugaagcacacuuuacagacccaucgaguauugcagcaaggggauauauaucuacaagagucgguaugggugaagccgccgcgauuuucaugacugcuacaccuccuggcucaguagaagccuuuccccaaucuaacgcuguaauccaggaugaggaaagagauauaccugaaagguccuggaauagcgguuaugaauggauaacagauuucccggggaagaccgucugguuuguucccagcauuaagagugguaaugauauagcaaacuguuugagaaagaauggaaaaagaguaauacaacuuuccagaaaaaccuuugauacagaauaccagaaaacuaagaacaaugacugggauuauguagucacgacagacaucucugaaaugggagcaaacuuccgagcugaccguguaauugacccucgacgcuguuuaaaaccaguaauacuaaaggauggaccugaacgugucauccucgcuggaccgaugcccguaaccgucgcaucagcugcucaacgucgcgggcgaauugggagaaaucacaauaaggaaggagaucaauacauauauaugggacaacccuuaaacaaugacgaagaucacgcucauuggaccgaagcaaaaaugcuacuugacaauauaaacacaccugaaggaauuauaccagcguuguuugaaccggaacgcgaaaaaucugcugcaauagacggggaauaucgauuacguggugaagcacguaaaaccuucguagaacuuaugagacgaggcgaucucccuguuugguuaucauauaaaguugcguccgaagguuuucaguauagugacaggcgauggugcuucgauggcgagcguaacaaccaaguauuggaagagaacauggacguggaaauauggacuaaagaaggagaaagaaagaaacugagaccacguuggcucgaugcaagaacguauucagauccgcuugcuuuaagagaauuuaaggaguucgccgcgggaaggagauccguguccggagaucucauucuugaaauuggaaaguugccccagcauuuaacucaacgagcucaaaacgcccuugacaauuuaguuaugcuacacaacagugaacaaggggguagagcauaucgacaugcgauggaagaacuaccagacacaauagagacauuaauguuacuggcucucaucgcagugcuuacgggaggaguaacacuauucuuucuuuccgggcguggguuaggcaaaacgucaauaggauuacuaugcguaauggcgucgagugucuuguuauggauggcuaguguagaaccucacuggauagcugcuucgauaauauuagaauuuuuccuaaugguccuccuuauucccgaaccagauagacagcggacgccccaggauaaucaacuggcuuacguaguuauuggcuuacuauucaugauuuugaccguagcugcuaacgaaaugggcuuauuagaaacaaccaagaaagacuuggggaucggucacgucgcuguagaaaaucaucaucacgcugccaugcuagacguugauuuacauccugcuucugcauggacguuguacgcugucgcaaccacgauaauuacgccuaugaugagacauacaauagaaaauacuacagcuaauauaucgcucacugcuaucgcuaaccaagcagcaauuuuaaugggacuugauaaggguuggccuaucucaaagauggauauaggggugcccuuacuggcucuagguugcuauagucagguuaacccccuaacacucacagcagcgguccugaugcugguagcccauuacgcaaucauaggacccgguuuacaggccaaagcaacuagagaagcucaaaagcgcacggcggccgggauaaugaagaacccgacuguugacggaauaguugcgauagaccucgaucccguagucuaugacgcgaaauucgagaaacagcucggacaaaucaugcugcuuauuuuauguacaucacaaauacuccuaaugaggacuacaugggcucuaugcgaaucuaucacucuagcaacugguccacuaacaacuuuaugggaaggcucuccaggaaaauucuggaacacaacgauugcaguaucuauggcuaacauauuccgagguaguuaucuugcuggagcaggucuagcauucagucuaaugaaaucauuagguggaggccgaagaggaacaggggcucaaggagaaacauuaggugaaaaauggaaaagacaauuaaaccagcuaagcaaaagcgaguucaauaccuacaaaagaucagggauuauggagguagaucguagcgaagcaaaagagggauuaaagagaggugagacaacgaagcaugccguaucuaggggcacagcuaaacucaggugguuuguagagagaaaucugguaaaaccagaagggaaagugauagaccuuggguguggaagagguggcuggagcuacuauugugccggacucaagaaagugaccgaaguaaaggguuauacaaaagguggucccggccacgaagaacccaucccuauggcuaccuacggguggaauuuaguuaaauugcauagcggcaaagacgucuucuucguuccgccagaaaaaugugauaccuuauugugugacauaggugaaaguucgccaaacccgacaauagaagaagggagaacucuucguguacuaaagauggucgaacccugguuacggggcaaccaauucuguauuaaaaucuuaaacccauauaugccaucaguaguggagacacuagaacagaugcaacguaagcaugguggaauguuaguacguaauccucugaguagaaauuccacucacgagauguauugggugagcugcggaacgggaaacauaguaucugcuauaaacaugacaagcagaaugcuauuaaacagauucacuauggcacauagaaaaccuacguacgagcgagacguagaccucggagcaggaacaaggcauguagcuguggaaccagaaguugcaaaccuagauauuaucggacaacgaaucgaaaauauuaaacaugaacacaaaucuacauggcacuaugaugaagauaauccguauaaaacaugggcauaccaugguaguuacgagguaaagccaagugggucagcaaguucuauggugaacggugucgugaaacuacuuacaaaacccugggauguuauacccauggucacacagauugcuaugacugacaccacaccuuuuggacagcagagaguuuuuaaggaaaaagucgauacacgaacccccaaagcaaaacgaggcacagcacagauaauggaagucacggcuaaaugguuauggggguuccuaaguaggaauaagaaaccgagaaucugcacuagagaggaauuuacaagaaagguaagaucuaaugcggcgaucggggccguauuugucgaugaaaaccaguggaacuccgcaaaagaagcgguugaagaugaaagguuuugggaucuagugcaccgagaacgcgaacuacacaagcaagggaaaugcgcaacaugcguuuacaauaugaugggaaaaagagagaagaaacuuggagaguuuggaaaggccaagggcucacgugcgauaugguacaugugguuaggcgcaagauuuuuagaauuugaggcuuuagguuuuaugaaugaagaucauugguucuccagggagaauaguuuauccgguguagaaggcgaaggucuacauaaacugggauauauauugcgcgauauaagcaaaauuucaggagggaauauguacgcagaugauacagccgguugggacacacguaucaccgaagacgaccuacagaaugaggcaaagauaacagacaucauggaaccugagcaugcguuacuagccaauucgauauuuaagcuaacauaccaaaauaaagucgucagaguccaaaggccagcuaaaaacgguacaguuauggacguaaucaguagaagagaccagagagguucaggacaaguaggcaccuacgguuuaaacaccuucacaaacauggaagcgcagcuaauccgacaaauggagucugaagguauauucucccccucagaauuagaaacgccaaaccuagcagaacguguacuugauuggcuagaaaaacaugggguugagagauuaaaacgcauggcuauuucgggugacgauugcguuguuaaaccuauugacgauagguuugcaacagccuuaacagcguugaaugacauggggaagguccgcaaagacaucccgcaaugggaaccgaguaaggguuggaaugauuggcaacaaguaccauuuugcucucaucauuuucaucaacuuaucaugaaagacggcagagagauaguuguaccaugucggaaucaagacgagcucguagggcgugcaagaguuucacaaggugcagguuggucguuacgcgagacugcuugucugggaaaaucguacgcucagauguggcaacuaauguauuuccaccgucgagauuuacguuuagcugcgaacgcgauuugcucagcaguaccaguugauuggguaccuacaucaagaacgacuugguccauacacgcacaucaccaauggaugacaacagaagauauguuaaguguuuggaauagaguguggaucgaagagaauccauggauggaggacaaaacgcauauuucuagcugggaggacguacccuaccuuggcaagcgcgaagaccaauggugcggaucacuaauaggauuaacugcaagagcuaccugggcaacaaacauccaaguugccauuaaucagguuagacgacuuauuggaaacgagaauuaucuugauuauaugacuucaaugaaacgauuuaaaaaugaaucggacccagaaggggcccuuugguga

SEQ ID NO: 21211 - RNA, 9879 nt, Artificial Sequence
  derived and/or modified CDS sequence (opt6) from DENV-1__HM181942__SS-prME
aguguaaccaugcuguugauguuaaugccaacagcguuagcuuuucauuugacgacgcgaggcggugaaccacauaugaucguaagcaaacaagaacgagguaaaaguuuacucuuuaaaacuagcgcgggcgucaauauguguacacuaaucgccauggaccuaggagaauuuugugaagauacuaugacauauaaaugucccagaauuuccgaggccgaaccagaugauguugacugcugguguaacgcuacagauacaugggucacauaugguacuuguucacaaacuggcgaacauagacgcgauaaacguaguguagcacuagcaccccaugucggacuuggauuagaaacgcguaccgagaccuggaugagcucugaaggggccuggaaacaaauacaacgaguugaaacaugggcauuaaggcauccagguuuuacaguaauugcacuauuccuggcccaugcaauuggaacuagcauaacacaaaaaggaauaauuuuuauauuauuaauguuaguaacuccauccauggccaugagaugcguuggcauugguucccgagacuuugucgagggccuuaguggcgcuacuuggguagacgugguguuggaacacggaagcugugugacuacaauggcgaaagauaaaccaaccuuagauauagaacuacuaaaaacggaaguuacaaauccugcuguucuaagaaaauuauguaucgaagccaaaaucagcaauacuacuacggauucacguugcccaacccaaggugaagcuacucuaguagaagaacaagacgcuaacuucgucugccgaagaacauucguugauagagguugggguaaugguuguggacuuuucggcaaaggcagcuugauuaccugugcuaaauucaaaugugugaccaaacuagaaggaaaaauaguucaguacgagaaccuaaaguauuccguaauaguuacuguucauacgggagaucaacaccaaguaggcaacgaaucaacagaacauggaacaacugcgacaauaaccccacaagcgccuucuacggagauacaacuaacugacuacggugcauugacauuagacuguagcccucgaacgggacuagauuuuaaugaaaugguacuguuaacaaugaaagaaaaaucauggcuuguucauaagcaaugguuucuugauuuaccuuugccauggacaaguggugcaucuacuucucaagagacauggaaucgacaagaucucuugguuaccuucaaaacagcucaugcaaagaaacaggaagugguuguacuagggagucaagagggcgcaaugcauaccgcucuuacuggggccacggaaauacaaacaaguggaaccacgacaauuuuugccggacauuuaaagugccgguugaaaauggauaaguuaaccuuaaaaggaaugucauauguuaugugcacagggagcuuuaagcuagaaaaagaaguugcugaaacgcaacaugggacuguucuuguccaaauaaaauaugaaggaacugacgcaccuuguaaaauuccauuuucaacccaagaugaaaaaggggugacccaaaaugguagguuaauaacggcaaaccccaucgugacagauaaagaaaagcccgugaauauugaggcugaaccucccuuuggagaaaguuacauagugauaggggccggugaaaaagcccucaaauugagcugguuuaagaaaggcagcucgauaggcaaaauguucgaagcgacggcacgaggagcaaggagaauggcaauauugggagauacagcaugggacuuugguaguaucggagggguuuuuaccucugucggaaaacucguccaucaaauauuuggaacggcauacggcguuuuauuuagugguguaucauggacuaugaagauaggcaucggcguacugcucacauggcuaggauugaacagcaggagcacuucccucucaaugacauguaucgcuguaggucucguuaccuuauacuuagguguaaugguucaggcugauagugguuguguaauaaauuggaaaggucgggaauugaagugcgguagcggaauuuucgugacaaacgagguacacacguggacagagcaauacaaauuucaagcugacagcccaaaaagacuaucagcagcuaucgguaaggcuugggaagaggguguuugcggcauacgaagugcaacucgauuggagaauauuauguggaaacaaauuaguaaugagcuaaaccauauccugcucgaaaacgauaugaaauuuaccguagucguuggggauguggccggaauauuagcacaggggaagaaaaugauucgaccacaaccgauggaauacaaauauucuuggaagucauggggaaaagcaaaaaucauaggugcugauguacagaauacaacguuuauuaucgauggcccaaauacgccggaauguccugacgaucaacgugcauggaacauuugggaaguggaagauuauggguuuggcauauuuacuacaaauauuuggcuaaaauuacgggauagcuacacgcagguaugugaucaucgcuuaaugagcgcugccauuaaggacucuaaagcaguccacgcagauaugggauacuggauugaauccgaaaagaaugaaacauggaaacuggcgcgcgcaucguuuauagaaguaaaaaccugcauauggccgaaaucacauaccuuauggucgaacggcguuuuggagucagaaaugaucauaccaaaaaucuacggcgggccaauuagucaacauaauuacagaccagguuauuucacccaaacagcgggaccuuggcaccuaggaaaacucgagcuggauuuugaucuuugugaggggacuaccguaguaguugacgaacauuguggaaauagaggcccgagccuaaggacaacgacagucacugguaagauuauacaugaguggugcugucgaucauguacauuaccaccccuacgauucaaaggugaagaugguuguugguacggaauggaaauacgacccgucaaagaaaaagaggagaaucucguaaaaagcaugguuagugcaggaaguggagaaguagacuccuuuagcuugggcuuauugugcauaucaauuaugaucgaagaagugaugagaagccgcuggucaagaaaaauguuaaugaccggaaccuuagcaguauucuuccuucuaaucaugggacaauugacauggaacgaucuaauucgcuuaugcauaaugguaggcgcaaacgcaucggauagaaugggaaugggaaugacauaucuagccuuaauggcuacauuuaagaugaggccaauguucgcagucgggcuauuauuccguagacuaacaagucgagagguuuuauuauuaacuauaggauugucauuagucgcaucuguggagcuaccuaauucacuagaggaacuuggugauggauuagcgaugggaaucaugaucuuaaaauuacuuacugauuuccaaagccaucaauuaugggcaacuuuacuuucauugaccuucauaaaaacuacauucagccugcauuacgcauggaaaacuauggcaaugguuuuaucaauagucucuuuguuuccucuaugccuaucuacuacgagucagaaaacaacuugguuacccgucuuauuaggaucauugggaugcaagccacuuacaauguuucuaauagcggaaaacaaaaucuggggucgaaagucauggccccucaacgaagguauuauggcuguaggcauuguuucaauacuuuuaaguaguuuacucaaaaaugauguaccccuagcaggcccauuaauagcagggggaaugcuuauagcuuguuacgucauuuccggaaguagugcagaucucucgcuggaaaaagcugcugaaguaagcugggaagaagaagccgagcacucgggagcaagucacaauauccugguagaaguucaagacgaugguacuaugaaaaucaaagacgaagaaagagaugauacacucacaauucugcucaaagcaacucucuuagccgucucaggaguauauccucucaguauaccagcuacccuguuuguaugguauuuuuggcagaagaagaaacaaaggucuggaguauuaugggacaccccaagcccacccgaaguggagagagcaguacucgaugacggaauuuaccgaauaaugcaacguggguuacuagguagaagucaaguuggaguugguguuuuucaagagaacguauuccauacgauguggcauguaacacgaggagccguucuuauguaccaaggaaaaagauuggaaccaucaugggcaaguguuaagaaagaucugauaucuuauggaggaggauggaggcuacaaggcucguggaauacaggagaagagguccaagugauagcaguagagcccgguaaaaaucccaaaaaugugcagacagccccaggaacauucaaaaccagugagggcgaaguuggugcuauagcgcuagauuucaaaccuggcaccucagggucgccuaucguaaauagagaagggaaaaucguaggauuauacggaaaugggguaguuacaaccucugguacauacgucuccgcgauagcacaagcaaaggcaucgcaagaaggaccacugccugagauagaagacgaggucuucagaaaacgaaacuuaacgaucauggaucuucauccaggcagugggaagacacgaagauacuugccagccauagucagagaagcuauuaaaaggaaauuaagaacucuaauucucgcgccaacacguguugucgccagugaaauggccgaggcacugaaaggcaugccgaucagguaucagacuaccgcugucaagucggaacacacaggaaaagaaauuguugaucuaaugugucacgcaacauucacaaugcgguuacuuucucccguuaggguuccaaauuauaauaugauaaucauggacgaagcacauuuuacagaucccucuucuauagccgcaagagguuauauaaguacacgaguagguaugggggaagccgcugcaaucuucaugacugcuacaccuccggguaguguugaggccuuuccucaaucgaacgccgugauacaagacgaagagagggauauaccugaacgaucguggaauagcggcuacgaauggauuacagauuucccaggcaaaacuguaugguuuguucccaguauaaaaaguggaaacgacaucgcgaacuguuuacgaaagaauggaaagcgaguuauacaacuaaguagaaaaacuuucgauacagaauaucagaaaacgaaaaauaaugauugggauuauguggucacaacggauauauccgagaugggagcgaauuucagggccgacagaguaauagauccgcggagaugccuaaaaccaguuauacuuaaagauggaccagaaagggugauuuuggcaggaccaaugcccgucacuguugcaucggcugcacaacgaagagguagaaucggcagaaaucauaacaaggaaggagaccaguacauuuauaugggucaaccgcuaaacaaugaugaagaucacgcacauuggacagaagcgaagaugcuucuugacaauauaaacacccccgaagguaucauuccagcucuauuugagccugagcgugaaaaaucggccgcaauugacggcgaauaucgccucagaggugaagcgagaaaaacauuuguagaacuaaugcggaggggcgaucuuccugucuggcuuucauauaaaguagcgagugagggauuucaauauagcgacagaagauggugcuuugauggagaacgaaacaaccagguguuagaagagaacauggauguugagauauggacgaaagagggagaacguaagaaacuaagaccgagaugguuagacgcacgaacguacagugauccgcuggcccuacgggaauuuaaagaauuugcagcaggacguagaaguguaucuggagaccuaauacuagaaauaggcaaauuaccucagcacuuaacucagcgcgcacaaaaugcucuagauaaucuaguuaugcuccacaauucggagcaaggugguagagcauaucgacacgccauggaagaauuaccagauacaauugaaaccuuaaugcuuuuggcacuaauagcuguucucacuggcggaguaacgcuauucuuuuuaagugggagaggacuagggaaaaccaguaucggcuugcuaugcguaauggcaaguagcguuuuauuauggauggcaucgguugaaccccauuggauagccgcauccaucauacuugaauuuuucuuaaugguacuacuaauaccagaaccugaccgccaacggacaccccaagauaaucaacuggcuuauguggucauaggacuucuuuuuaugaucuuaacuguagcagccaacgaaaugggacuacuagaaacaacuaagaaagaccuaggaauaggacacguagcagucgaaaaccaucaucaugcagcaauguuggauguagacuuacaccccgcaucugccuggacgcuguaugcaguugcaacaacaauaaucacaccuaugaugagacacacgauagaaaacacaaccgcuaauauaucauuaacagccaucgcaaaccaagcugcuauauugaugggucuagacaaagguuggccuauuucaaagauggauaucgguguccccuugcucgcccuaggauguuauucccaaguaaauccacuaacgcuuacugcggcuguuuuaauguugguagcacacuacgcuauaaucggacccggacuucaagccaaagcgacccgagaagcgcaaaagaggacagcugcugguauaaugaaaaauccgacaguagacgguauagucgcaauugaccuugaccccgucguauacgacgccaaauuugaaaaacaauugggccaaaucauguuguuaauacuauguacuucacaaaucuuauuaaugagaacuacaugggcucuuugugagaguauuacacuagcuacggguccuuugacgaccuuaugggagggaagucccgguaaauucuggaacacaacuauugcuguuuccauggcuaauauauuuagagggucuuauuuagcaggagcaggccuggcauuuucauugaugaaaucguuaggaggaggucgacgugggacuggcgcacaaggggaaacucuaggagaaaaauggaaaagacaacuaaaccaauuaucaaaaagcgaguucaauacauacaaaagaagugguauuauggaaguugacaggucagaagcuaaagaaggacuaaaaagaggugaaacaacgaaacaugcaguaucacgcggaacggcgaaacuccggugguuuguugagagaaaccuggugaaaccugaaggaaaaguaauagauuuaggaugugggcggggaggguggaguuacuacugcgcaggauuaaagaaagucacugaagugaaaggauacaccaaaggcggcccaggacaugaagaaccaauacccauggcuacguacggauggaacuuagucaaauuacacucugggaaagacguguuuuucguucccccagaaaaaugugauacucuacuuugugauauaggcgaaucaucgccaaacccgacaauagaagaaggcaggacccuaaggguucuaaaaaugguugaaccgugguuaagaggcaaucaauuuugcauaaagauacuaaaucccuauaugccuucaguuguagagacucuugagcaaaugcaacggaaacacggcgguaugcugguucgcaauccucuaagcagaaauucaacccaugaaauguauuggguuucauguggcacaggaaauauagugucugcaguuaacaugacaagucggaugcuucuuaacagauuuacaauggcacaucgcaaaccuacauacgaacgugauguugauuuaggagcagguacuagacacgucgcuguagagccagaaguagcaaauuuagauauuauaggucaacgaaucgaaaauauuaaacaugaacacaaaagcacguggcacuaugaugaagauaacccauauaaaacuugggcguaucauggaucguacgaggugaaaccuucuggcucugcuaguuccauggucaacgguguuguaaaguugcuaacgaaaccaugggauguuauaccaaugguaacucaaauagcuaugacggauacaacacccuucggucaacagagggucuuuaaagaaaaaguagauacccggacuccgaaagcaaaacgggggacagcgcaaaucauggaaguuacagcgaaauggcucuggggcuuuuuaucacgaaauaagaagccuagaauaugcacucgagaggaguuuaccagaaagguuagaaguaaugcagcaauaggugcaguguuuguggacgagaaucaguggaauagugccaaagaagcaguagaagacgagagauuuugggaccuggugcacagggaacgagaguuacauaaacaagggaaaugcgcaacaugugucuacaacaugaugggcaaaagggagaagaaauuaggcgaauuugguaaagcaaagggaucaagagcuauaugguauauguggcugggggccagauuucuugaauuugaagcccugggguucaugaaugaagaucauugguucagucgugaaaacagccuaucaggaguugaaggagaaggauugcacaaauuagguuauauauuaagagacaucucuaaaauuaguggagguaacauguaugcggaugauaccgccgggugggacacaagaauaacugaagaugauuugcagaacgaggcaaagauaacugauauaauggaaccagaacaugcccuucuagcaaacaguaucuuuaaauuaacuuaccaaaauaaaguaguaagaguucagaggccugcaaagaacgguaccguuauggauguaauaagucgucgggaccagagaggcucuggucagguuggaacauauggccucaauacguucaccaauauggaagcacaauugauucgacagauggaaucagaggggauuuucucuccgagcgaauuggagacaccaaaucucgcugaaagaguacuagauugguuagaaaagcaugguguugaacgacugaaaagaauggccauaucaggagacgauuguguaguaaagccaauagacgaccgcuuugcaaccgcucuaacugcacucaaugauauggggaaaguaagaaaagauauaccacagugggagcccucaaagggauggaaugacuggcaacaaguuccuuuuuguucucaucauuuucaucaacucauaaugaaggacggucgugaaauaguaguucccuguagaaaccaggaugaauugguagggagagcacgugucagccagggcgcaggauggagucucagagagacugcgugucucggaaagaguuaugcgcaaauguggcaauuaauguacuuccauaggcgagauuuaagacucgcagcaaaugcaauuuguucggcgguuccagucgacuggguuccuaccagcagaaccacuuggaguauucaugcccaucaucaguggaugacuaccgaagauaugcuaucaguuuggaauaggguauggauugaagaaaacccguggauggaagauaaaacccacauuucaucuugggaagauguuccuuauuuagggaaacgugaagaccaaugguguggaucccuuauagguuuaacugcacgugcgaccugggcuacuaacauacaaguggcgauaaaucaaguaagaaggcuaaucggaaaugaaaauuaucuugacuacaugacaucuaugaaaagauucaaaaacgagucugauccagaaggggcacuaugguaa

SEQ ID NO: 21212 - RNA, 9879 nt, Artificial Sequence
  derived and/or modified CDS sequence (opt6) from DENV-1__HM488255__SS-prME
aguguaacuauguuacuaauguuaaugccaacugcucuugcuuuucaucugacuacuagagggggagaaccucauaugauaguaucgaaacaagaaaggggaaaaagucuguuauuuaaaacauccgcgggaguaaauauguguacccuaauugcaauggaccuaggagaacuaugcgaggauacuaugaccuauaaguguccucgaauaacugaagcggaaccagaugauguagauugcugguguaaugcaacggacacauggguuacauaugguacuugcucacaaacuggagaacacagacgagacaaaagaucagucgcucuugcuccccauguaggacuagguuuagaaacacguacagaaacuuggaugucaucagaaucagcauggaaacagauacaacgaguagagacaugggcacucagacauccuggauuuacggucaucgcacuauuuuuagcacacgcaauugggacauccauaacccaaaaagguaucauuuuuauccuguuaaugcugguaacaccuucgauggcuaugagaugcgugggaaucgguucgagagauuuuguugaggguuuaaguggagcuaccuggguagacgucgucuuagaacaugguucuugcguuaccaccauggcaaaagauaaaccaaccuuagauauagaauuauuaaaaaccgaaguaaccaauccagcaauacuuagaaaacugugcauugaagcaaaaauuucaaauacaacgaccgauaguagaugccccacgcaaggugaagcgacauuaguagaagaacaagaugccaauuuuguauguagaagaacauucguagauagagguuggggaaauggaugcggauuauuuggaaaagguucauuaauaacuugugccaaauucaaaugcgucacaaaacuggaggguaaaauuguacaauaugaaaauuuaaaauauagcguaauaguuacuguacauacuggagaccaacaccaaguaggcaaugaaucaacugaacauggaaccaccgcaacuaucacuccgcaggcgccuacaacagaaauucaacuuacggacuauggcgcuuuaacauuagauugcagcccaagaacugggcuagacuucaacgaaaugguucuucucacuaugaaagaaaagucauggcugguucacaaacaaugguuucuugauuuaccauugccguggacuucgggagcaucuacuucucaagagacuuggaaucggcaagaucuuuuagucacauucaaaacugcucaugccaagaaacaagagguagucguacuuggaucucaagagggagcaaugcacacagcacucaccggcgccacggaaauacaaacaaguggaacaacaacgauuuuugcuggacaucugaaauguagauuaaaaauggacaaauugacuuugaaaggcauguccuacgucauguguacagguuccuucaaguuggagaaagaagucgcagaaacucaacacgggacaguccugguacaaaucaaauaugaaggcacugacgcaccauguaaaauaccuuucucuacacaagacgaaaaaggaguaacgcaaaacgggagauuaauuacagcaaauccgaucguaacugacaaagaaaaaccgguuaauauagaggccgaaccacccuuuggugaaucauauauuguaaucggggcuggggagaaagcauugaaauuaaguugguuuaagaaaggaucgaguauaggcaaaauguuugaagccaccgcccggggcgcaaggagaauggcaauucuaggcgauacugccugggacuucgguagcauaggagggguuuuuacaucugugggaaaacuuguccaccaaauauucggaacagcuuacgggguucuuuuuagcgggguaagcuggacaaugaagauugggaucggugugcuauugaccugguuaggucuaaauucgagauccaccagucuuaguaugacuuguauagcaguaggguugguaacguuguacuuaggaguaaugguccaagcugauucagggugcguaauaaauuggaaaggaagagaacugaaauguggaucaggaauauucguaacaaaugagguacauacauggacagagcaguauaaguuucaggcagauucaccuaagcgucugucugccgccauagggaaagccugggaagagggaguauguggcauaagaucggcaacaagauuagaaaauaucauguggaaacagauaaguaacgaacuuaaucauauacuccucgaaaacgacaugaaauucacagucgucguuggcgacguagcgggcauucuugcacaagguaagaaaaugauaagaccccaaccaauggaauauaaauauagcuggaaaaguuggggaaaggcuaaaauuaucggagccgacguacagaauacaacauuuauuauagacggaccuaacaccccagaaugcccugacgaucaacgagcuuggaauauuugggaaguggaagauuacggguucggaaucuuuacaacaaauaucugguuaaaacuucgagacucauacacgcaagugugugaucacagacugaugucagccgcgauuaaagacucaaaggcaguacaugcugauaugggguacuggauugaaucugaaaagaacgagacauggaaauuagcucgagcuucauucauugagguaaaaacuugcaucuggccuaagucacauacacuuuggucaaauggaguacuagaguccgaaaugauaauaccaaaaauauaugggggcccaauaucccaacauaauuauagaccuggauacuuuacgcaaacugcugggccauggcaccuuggaaaauuagaacuugacuuugaucuuugugaaggaacaacggugguaguugaugagcauugcggaaauaggggcccuucacuacgaacuacgacaguuacugguaaaauaauucaugaauggugcugccguucguguacauuaccuccucuacgauucagaggagaagauggauguugguacggaauggaaauuaggccaguuaaagagaaggaagaaaacuuagugaagucgaugguuucggcuggcaguggagaaguagauaguuuuaguuugggacuccuaugcauaucgaucaugauugaggaaguuaugaggaguagguggagucggaaaaugcuaaugacagguacauuagcaguuuuucuccuauugauaaugggucaacuaacauggaacgaucuuauacgacuaugcauuaugguaggcgcuaaugcaucugaccgaaugggaauggggacaacuuaucuggcacugauggcuacauuuaaaaugcggcccauguucgcuguaggccuucucuuuagaagguuaacgucacgggagguuuuacuauugacaauaggcuuaucuuuggucgcuucaguagaacuaccaaacagcuuggaagaauuaggagaugguuuagcuauggggauuaugauacugaaauugcucacugacuuucaaagccaccaguuaugggcaacuuuacucuccuuaacauucauuaaaacaacauuuagcuuacauuacgccuggaagacgauggcuauggugcuaaguauaguaucgcuauuuccccuuugucugaguaccacgagucagaaaacaacuuggcugccuguucucuuaggaucuuugggauguaaaccucugacaauguuuuuaauugcugaaaauaaaauuuggggaagacgaucguggccauuaaacgaagguaucauggcagugggcauaguaagcaucuuacugucaucacuucugaaaaaugauguaccauuagcagguccacugaucgcaggaggaaugcuuauagcaugcuauguaauaucugguucaagcgcagacuuaucucucgagaaagcugcggaaguuucaugggaagaggaagcagaacacagcggugcgucacacaacaucuuaguagaaguccaagaugacggaacuaugaagauaaaagacgaagaacgagaugauacucuaaccauacuguuaaaagcaacuuuauuggcagucucugguguguauccacucucaauacccgccacauuguuuguuugguacuuuuggcagaagaagaaacagcggucuggaguacugugggacacuccaucuccuccggaaguagaaagagccguacuggacgaugggauuuaucguaucaugcaaaggggacuucuagguagaagccaaguugguguuggcguauuucaagaaaacguauuucauacaauguggcaugucacuagaggagcaguacuaauguaccagggaaaaagacuggaacccucuugggcaagcguuaaaaaggaucugauuucuuauggugggggauggaggcuccagggaucuuggaauacaggugaagaaguacagguaauagcgguagaaccuggcaaaaauccuaagaauguacaaacggcucccgggaccuuuaagaccccugagggggaggucggugcuauagcacuagauuucaaaccggguacaagugguucuccaauugucaacagagaaggaaaaauaguuggucuguacgguaauggcgugguaacuacuagcgguaccuaugucucagcaauagcacaggccaaagcaagucaagaggguccacugcccgaaauugaagacgaagucuucagaaaacgcaauuuaaccauaauggaucuccauccggguucgggaaaaaccagaagauaccuuccggcgauaguuagagaagcuauaaagcguaaacuuaggacguuaauacuagcaccaacccguguuguugcgucagagauggcagaagcacuuaaaggaaugccaauuagauaccaaacuacggcgguaaaaucggaacauacuggaaaggaaauaguugacuuaaugugccaugccacuuuuaccaugcgacuguuaucaccuguucgagucccuaauuacaauaugauuauaauggaugaagcgcacuucacagacccaucaaguauugcggcaaggggauauauaucgacucguguuggaaugggagaggccgcagcaauauuuaugaccgcuacuccgccuggcucaguugaagcauucccccaaucaaaugcaguaauucaagaugaagaaagggauauuccagagcgcucuuggaacuccgguuacgaauggauaaccgauuucccugggaaaacggucugguuuguaccaucaauaaaaagugggaacgauauugcaaauugcuuacgaaagaauggaaaaagggucauacaauugagucguaaaacuuucgauaccgaauaucaaaagacgaagaauaaugauugggacuaugugguuacgacggacaucucugaaaugggggcaaauuuucgagccgauaggguaauagauccacgacguugucuaaaaccagucauacucaaggacggaccugaacgggucaucuuagcuggcccuaugcccguuacgguagcaucugcugcgcaacgacguggacgaaucggucgaaaccacaacaaagaaggggaucaauauauauauaugggucaaccuuugaauaaugacgaggaucacgcacacuggacugaagcaaaaaugcuguuagacaauaucaauacaccagaaggaauaauaccugcacuauucgaaccagagcgcgagaaaagugcagcuaucgauggcgaauaccguuugcgaggagaagcuagaaagacuuuuguggaauuaaugcggcguggagaucuaccaguaugguugaguuauaaaguagcuucagaaggauuucaguauagugacaggcggugguguuucgacggagaaagaaauaaucagguucuagaagaaaacauggauguggaaauuuggacaaaagagggagagaggaagaaacuacguccaagguggcuugacgcgcgcacguauucugauccccuggcucuuagggaauuuaaagaguuugcggcagguaggagauccguuucgggcgauuugauacuagagauagguaaacuaccccaacauuugacacaaagggcacaaaaugcacucgacaauuuggugauguuacauaauagugagcagggaggaagggcguauagacacgcaauggaagaauugccugauacuauugagacccugaugcuauuagcucuaauagcaguauugacagggggugugacuuuauucuuucuuagugguagaggauuggguaaaacuucuauuggauuacuauguguuauggcuaguaguguuuuacuauggauggcgucaguagaaccgcacuggauagcagcaagcauuauucucgaauuuuucuuaaugguucuucuaauacccgaaccugacagacagagaacgccccaggacaaucaacuugcauauguaguaauaggccugcuuuuuaugauauuaacggucgcagcaaacgaaaugggguuacucgaaaccacgaagaaagaccuaggcauagggcacguagcagucgguaaccaucaucacgccgcuauguuggacguagauuuacauccggcauccgccuggacacucuacgccguagccacaaccauaaucacgccaaugaugaggcauaccauagaaaauaccaccgcuaauauaucauugacggcgaucgcaaaucaagccgccauccuaaugggacuugauaaggguuggccgauaaguaagauggauaucggagucccgcuuuuagcuuuaggcuguuacucucaaguaaacccauuaacacucaccgcugcaguccuaaugcuaguagcacauuacgcgauuauaggaccuggauuacaggcuaaagcuacucgugaggcacagaaacgaacugcggccgguauaaugaaaaaccccacgguagacgggauaguagcaauagaccuggauccaguaguguacgaugccaaauucgagaaacagcucggucaaauaauguuauuaauacuuuguacaagccaaauucugcuaaugcgaacuacuugggcucucugugagagcauaacauuagcaacaggcccacuaacgacauuaugggaaggaucaccagguaaauuuuggaauacaacaauugcaguuaguauggccaauauauuuagaggaagcuaucuugccggugcaggucuagcauuuucuuuaaugaagucccuaggucgaggacgaagaggaacaggagcgcaaggugaaacacuaggugaaaaauggaagcgucaacuuaaucaacuuaguaaaucggaauuuaauacuuacaagcgguccggcaucauggaggucgacaggucagaagcaaaagaaggcuuaaaaaggggugaaacaacaaaacaugcuguaucccguggcaccgcgaaauuacgaugguucguagaaaggaauuuaguaaaaccugaggguaaagucaucgaucuggguugugggaggggcgguuggucauauuacugugcgggacuaaagaagguaacggaggugaagggguacacaaaaggcggcccuggacaugaagaaccaauaccuauggccacauacggauggaacuuaguuaaacugcacucugggaaagacguauuuuucaucccacccgagaaaugugauacguuauuaugcgacaucggagaaaguucucccaaucccacuauugaggaaggacgcacgcucaggguccuuaagauggucgaaccauggcuucgaggaaaucaauuuuguauuaaaauccuuaauccuuauaugccaucuguaguagaaacguuagaacaaaugcaacguaaacacggugggaugcucgucagaaauccauuaaguaggaacucaacucaugaaauguacuggguuuccugcgguaccggcaacauaguaagugcugucaauaugacaaguagaauguuauuaaacagauucacgauggcccaucgaaaaccgacuuacgaaagagauguagaucuuggagccggcacucgucacguugcaguagagccggaaguagccaaccuagauauaauagggcaacggauagagaacauuaaacaugaacacaaauccacauggcauuaugacgaagacaauccauauaaaacaugggcauaucacggaucguaugaaguaaaaccuaguggaucugcaucgucaaugguaaauggaguaguaaaacuuuuaacaaaacccugggacgucauaccaaugguaacgcagaucgcaaugacggauacaacgccauucggucaacaacgaguauucaaagagaagguagauacuagaaccccaaaggcuaagagggggacagcucaaauuauggaaguaacagcuaaauggcuuuggggauuucuuaguagaaacaagaaaccgcgcauuuguaccagggaggaguucacucguaaaguucguucaaaugcugcuauaggagcugucuuuguugacgagaaucaguggaacagcgcaaaagaggcagucgaagaugaaagauuuugggacuuagugcauagggaacgagaauuacacaaacaagggaagugcgcgacauguguguauaacaugaugggaaaaagagagaagaaacuaggagaauuuggcaaagcaaaagguuccagagcuauaugguacaugugguuaggagcgagauuuuuagaauuugaggcuuuaggauucaugaaugaagaccauugguuuucaagagaaaacucacuaagugguguagaaggugaaggacuucacaaacuugguuauauauuaagggacauuucgaaaauaccaggcgggaauauguacgcugaugauacggcaggaugggacacaagaauuacugaagaugauuuacaaaaugaagcaagaaucacagauauaauggaaccugaacaugcacuucuugcaaaaagcaucuucaagcuaacauaucaaaacaaaguaguccguguccaaagaccagcuaagaacgguaccguuauggacguaaucucaaggagagaccaaagagguucaggucaaguaggcaccuacggccuuaauacauuuacgaacauggaagcacaauuaauccgacaaauggagucagaagggaucuuuucuccuucagaauuagaaacgccaaaccuagcggaacggguacuagauugguuagaaaaauacgguguagaacgcuuaaaaagaauggccauaucaggagaugacuguguaguuaagccaauagacgaucgcuuugcaacugcucuuacagcacuuaaugauaugggcaaaguacgcaaagacauuccacagugggaaccuucaaaaggauggaaugacuggcaacaaguuccauuuuguucgcaccauuuucaccaauuaauaaugaaagacggaagagaaauagucguaccaugccgcaaucaggacgagcucguugggagagcccgagucucacaaggugcaggguggaguuuaagagagacugccuguuuagguaagagcuaugcacaaauguggcaguugauguacuuucauagaagagaucugagacuugcggcaaaugcaaucuguuccgcaguaccuguugauuggauucccacaagcagaacaacauggucaauacacgcacaucaccaauggaugacuacggaagacaugcuuaguguguggaacagaguuuggauagaggagaauccauggauggaggacaagacacauauaaguaguuggggugauguacccuaucugggcaaacgugaggaucagugguguggaucucugauagggcugacagcaagggcaaccugggcaacaaacauucaaguagccaucaaccaaguacguagauugaucggaaacgagaauuacuuagacuacaugacuucaaugaaaagguuuaaaaaugaaucugauccagaaggagcucuaugguaa

SEQ ID NO: 21213 - RNA, 9879 nt, Artificial Sequence
  derived and/or modified CDS sequence (opt6) from DENV-1__HM181944__SS-prME
ucgguuacaauguugcuaaugcuuaugcccacugcucuugcauuucaucuaaccacacgcgguggagaaccacauaugauuguuucaaaacaagaacgagguaaaucccuuuuauuuaaaacgucagcuggugucaacaugugcacacuaauagcuauggaccucggggaauuaugcgaagauaccaugacauauaaaugcccuaggauuucagaagcugaaccagacgacguugauuguugguguaacgcgacagauaccuggguaacauaugggacauguagucagacaggagaacacaggcgagauaaacggucaguugcacuggcuccucaugucgggcuaggauuagaaacucgcacagaaacauggaugucuucugaaggagcguggaaacaaauucaaaggguagaaaccugggcacugcgacauccgggcuuuacugucauagcauuauucuuagcacacgcaauaggcacgaguauuacccaaaaaggcauaauuuucauucuucuuaugcuagugacucccagcauggcaaugaggugcguaggcauugggagucgcgauuucguagaaggacucagcggagcaacguggguagaugucguauuagaacauggaucauguguuacuacuauggcgaaagauaaacccacacuugauauugaauuacuaaaaacagaaguaacgaauccagcagugcuccgcaaauuguguauugaagcgaaaauuucaaauacaaccaccgacaguagguguccuacgcaaggggaagccacacuuguagaagaacaagacgcuaauuuugugugccgacgaacauucguagaucgagguugggguaaugggugugggcuauuuggaaaaggcucccuaauaacgugugcaaaauuuaaaugcgucacaaaauuagaagguaaaauaguucaauacgaaaauuuaaaauauaguguuauuguaacaguucauacaggugaccaacaucaagucgguaaugaaaguacugaacauggaacaacggcaacaauuacgccacaagcaccgucaacagaaauacaacucaccgacuacggagccuuaacguuggacugcucuccaaggacgggcuuagauuucaaugaaaugguauuacugaccaugaaagaaaaaucaugguuaguacacaaacaaugguuucuagauuuaccacuacccuggaccagcggagcaaguacaagucaagaaacguggaaucgucaggaucucuuagugacauuuaaaaccgcccaugccaagaaacaagaaguggucguuuuaggcucacaggaaggugcaaugcauaccgcacuaacuggcgcaacagagauucaaacuucggguacaacuaccaucuucgcaggacauuuaaaaugccgauuaaaaauggacaaacucacacuuaagggaaugucauacguaaugugcacuggcucauucaaauuagaaaaagaaguagcugaaacacaacauggaacgguacuggugcagauuaaguaugaaggaacggaugccccauguaagaucccuuuuucaacucaagaugaaaaaggaguaacucaaaauggucgacugauaacagcuaacccaauaguaacagauaaggaaaaacccguaaauaucgaagcugagccaccauucggugagucguauauaguaauaggagcgggggaaaaagcucuaaaacugucuugguucaagaaaggaagcagcauaggaaaaauguucgaagcuacugcuaggggagcgaggagaauggcaauauuaggggauacugcaugggacuuuggcuccauuggaggggucuuuacaucagucggaaaacuugugcaccagauuuuuggcaccgcguacggcguacuauucaguggcguuucauggacgaugaaaaucggaauagggguacucuuaacaugguugggccuaaauucccguagcaccucacugucgaugaccuguauagcagucgggcugguuacucuuuaccugggagucaugguucaagcggauagugguuguguaauuaacuggaaaggucgggaacuaaaauguggaagcgguauuuuuguaacaaacgaaguccacacuuggacugaacaauacaaguuucaagcugauucuccgaaaaggcuaucagccgcuauagguaaggcuugggaagaaggcgucuguggcauucggucugcuacacgccuagaaaacauaauguggaaacaaauaaguaaugaauugaaccacauuuuauuggaaaacgacaugaaauuuacuguuguugugggagaugucgcaggaauuuuagcgcaagguaaaaagaugaucagaccgcagccaauggaauauaaauacucauggaagaguuggggaaaagcaaaaaucauaggugcagacguacaaaauacaacuuucauaauugauggaccaaacacacccgaauguccagacgaccagcgagcauggaauauuugggaaguagaagauuacgguuucggcauauuuacuacuaauauuuggcuaaaacuucgcgauucguauacucaaguuugugaucauagacuaauguccgcugcaauaaaagauucaaaggcagugcacgcggacaugggauauuggauagaguccgagaaaaaugaaacguggaaauuagcgcgugcuaguuuuaucgaagugaaaaccuguauauggcccaaaucacacacauuauggucaaacggcguauuagagucagaaaugauaauuccgaaaaucuauggaggaccaaucagucaacacaauuacagacccggauauuucacccagaccgcuggaccuuggcacuuagguaaacuggaauuagauuucgaccuaugugaagguacuacgguaguaguagacgagcacuguggaaauagaggaccaaguuuacggacuaccacgguuacaggcaagauuauucaugagugguguugcagauccugcacacugccaccccuacguuucaaaggagaagaugguugcugguaugggauggaaauccguccaguaaaggagaaggaagaaaaucucgucaagaguauggucucggcgggaucuggggaagucgauucguuuucacuagguuuacugugcauuaguauaaugaucgaagaaguaaugcgaucuagaugguccagaaaaaugcuaaugacagguacacuggcaguauucuuucucuuaauaaugggccagcuaacauggaacgaucuaauacgcuuaugcauaauggugggcgcaaaugcgagcgacagaaugggaaugggaaugaccuacuuggcauugauggcuaccuuuaaaaugcgaccaauguuugcaguuggccuacuauuuagaagacuuaccagccgagaaguccuucuucuaacuauaggucuuagccuugucgccuccguagaacuaccuaacagccuugaagaacucggagauggcuuagcgaugggcauaaugauauugaaacuauugacugauuuucagucccaccaacucugggcgacacuccucucucuuacauuuauuaaaacuacauucucccuacauuacgccuggaaaacaauggcaaugguccuaagcauaguuucauuguuuccucuuugucuaucaaccacuucacagaaaacgacuuggcuaccgguacucuuagguucuuuaggcuguaaacccuuaacaauguuccugauugccgaaaauaagauauggggacguaagaguuggccacuaaacgaaggcaucauggcgguaggaaucguuaguaucuuauuaucuucauuacuuaaaaaugauguaccauuggcagguccgcuaauugcggguggcaugcugauugcuuguuauguaauaucaggauccagugccgaucugucuuuagaaaaagcugcugaaguaaguugggaagaagaagccgagcauaguggggcuagccauaacauccuagucgaaguucaagaugaugggaccaugaagauaaaagacgaggagagagaugauacgcuaacaauauugcuaaaggcaacacugcuagcuguaucagguguauacccacucuccaucccggcuacacuuuuuguaugguauuucuggcaaaagaagaaacaaagaagcggaguguuaugggacacaccaaguccaccagaaguagagagggcaguacuagacgacggaauauaccgaauuaugcaaaggggcuuacugggucgaagucaagugggcguagggguuuuucaagaaaacguuuuucauacaauguggcacguuacgcguggagcgguacuuauguaccaaggaaaacgguuagaacccucuugggcaagcgucaaaaaggauuuaauaucauacggugguggguggagauuacagggaucauggaauacaggggaggaaguacaaguaauugccguugagccaggcaaaaaccccaaaaacguccaaacugccccuggaaccuuuaaaacuuccgaaggcgaaguaggugcaauagcacuagacuuuaaaccagguacaucuggcucaccuauaguaaacagggaaggaaaaauaguuggacucuauggcaacgguguggugacgacaucagggacguauguuuccgcaauagcccaagcaaaagcuagucaagaaggcccacugccggagauugaagacgagguguucagaaaacggaaucuaacaauuauggauuugcacccuggaagugguaaaacacgcagauaucuacccgcaauuguacgugaggcuauaaagagaaaauuaagaacuuuaaucuuagcuccgacgcgcguuguagccuccgaaauggcagaggcuuugaaagguaugccaauacguuaucagaccacagcagugaagucagagcacacgggaaaagaaauagucgauuuaaugugccaugcuacuuuuacaaugagacuucuaucaccuguaagaguucccaauuacaauaugaucauuauggacgaagcacauuuuaccgacccaucaucaaucgcugcaagaggguacauuucaacucgagucggaaugggugaggcugccgcaauauucaugacggcgacaccgccaggauccgucgaggcauuuccgcagagcaaugcgguuauacaagaugaagaacgagauauaccggaacggucauggaacucaggauacgaauggauuaccgacuuuccagggaaaaccguuugguuuguuccauccauuaagagcgguaacgauauugcaaauugccuacguaaaaacgguaagagaguaauucaacugucuaggaaaacauucgauaccgaauaccagaaaaccaaaaauaacgauugggacuauguaguaacuacugauauaucugaaaugggugccaacuucagagcagaccgggucauugauccgagaagguguuugaagccuguuauucuuaaggacggaccagagagagugaucuuagcaggaccaaugcccgucacaguugccucugcggcucaacgcagggggaggauuggacgaaaucacaauaaagaaggagaucaauacaucuauaugggacaaccacuuaacaacgacgaagaccacgcucacuggacggaagcuaaaaugcuacucgauaauauaaauacgcccgaaggaaucauaccugcauuguuugagccugaaagagagaaaagcgcagcgauagauggcgaauauagauuaagaggugaagcaaggaaaaccuucguugaacucaugagaagaggugacuuaccugucugguuaucguacaaagucgcuagugaaggauuccaauauucugacaggcguuggugcuuugauggcgagcgaaacaaucaagugcuggaagaaaacauggaugucgagaucuggacuaaggagggagaacggaagaaacuaagacccagauggcuagacgcucgcacuuacucggauccacuugcacuuagagaguucaaagaguucgcagcuggcagaagaucagucaguggugaccugaucuuagagauaggaaaacuuccccaacaucuaacccagagggcacagaaugcucuagacaaccuggugaugcugcacaacucagaacaaggcggacgugcguauaggcaugcuauggaggagcuacccgacacuauagagacucugauguuauuggcauuaauagcuguucuuaccggaggaguuacccuauucuuucuaucaggcagaggucuaggaaaaacaaguauugggcuucuuugugucauggcaaguucugucuuguuauggauggcaucaguagagccgcacuggauagcagccucuauaauacuagaguucuuucuaaugguguuacuaauaccugaaccugauagacaaagaacuccccaagacaaucaguuagcauacguuguaauaggccuacuauucaugauauuaaccgucgcagccaaugaaaugggauuacuugaaacgacuaagaaagaucuagguauuggucacguggcuguugaaaaucaucaccaugcugcaaugcuagacguagaccugcaucccgcaagugcauggacccuguacgccguggcaacuacuauuauuaccccaaugaugaggcacaccauagaaaauaccacggcuaacauuagucuaacggcuauugcgaaucaagcggcuauacuaaugggcuuagacaaggguuggccuauaucgaagauggauaucggcguuccacuguuagcauuaggcuguuauucccaagucaauccucuuacucuaacggcagcagugcuaauguuaguagcgcauuaugcgauuauaggaccaggucuccaagcaaaagcaacgagagaagcacaaaaacguacugcagcgggaauaaugaaaaacccgacaguagaugggaucguugcaauugauuuagacccuguuguuuaugaugcaaaguuugaaaaacagcuaggucaaauaauguuacugauacuuuguaccucacaaauauuguuaaugagaacaacaugggcccuaugcgaaaguauaacauuagcgacugguccccugacgacccuaugggaagggagcccgggcaaauuuuggaacacaaccauagcaguuaguauggcuaacauuuuccgagguaguuaucuugcaggagcggggcuagcauuuucucuuaugaagaguuuagguggcgggcgcaggggaacuggagcccagggugagacucucggagagaaguggaaacggcaacuaaaucaacucucgaagucagaguuuaauaccuacaaaagaagcggcauuauggaaguagauagaucagaagcgaaggaaggccuaaagagaggggaaacaacaaagcacgccgugucaagaggaacggcgaaauuaaggugguuugucgaacgaaaccuugucaaaccugaagggaaggucauugaccucggaugugggagaggaggauggaguuacuacugugcaggacuaaagaaagugacagaaguaaaaggguauaccaaaggaggaccaggacaugaagaaccuaucccaauggcaacauacgguuggaacuuggugaaacuacauuccggcaaggauguauuuuucguaccaccugagaaaugcgacacauugcuaugcgauauaggagaaaguucuccaaacccuacuauagaagaagggagaacauuacggguacucaaaaugguagagccgugguuaagaggaaaucaauuuuguauuaaaauuuuaaacccuuacaugccaagcgucgucgagacucuagaacagaugcaacggaaacauggaggcaugcuugugcgaaaucccuugucuaggaacuccacacacgagauguauuggguaucuugcgguaccggaaauaucguaagugcugugaacaugacaucaagaaugcuuuuaaauagauuuaccauggcacaucguaaaccaacauaugaacgggauguugaucuaggugccgguacaagacauguugcugucgaaccugaaguagcaaauuuagacauaauuggacaaaggauugaaaauauaaaacacgaacauaagucuacuuggcacuacgaugaagauaacccuuacaaaacaugggcauaccauggaaguuaugaaguaaaaccgucaggaagcgcuucauccaugguaaacggcguaguuaaacuucuuacgaaaccgugggauguuauaccaaugguaacucaaaucgcaaugaccgauacaacuccuuuuggucaacaacgaguauucaaagaaaagguggauacaagaaccccuaaggcaaaacgggguacugcacaaaucauggaagugaccgcaaaauggcuguggggcuuucuuaguagaaacaagaaaccccgaaucuguacccgcgaagaguucacuaggaaaguaaggaguaaugccgcaauaggagccguuuuugucgacgaaaaucaguggaacuccgcaaaggaagcagucgaagacgaaagguucugggacuuaguucaucgagaaagggaauuacauaaacaaggaaagugugccacaugugucuauaacaugaugggaaaacgagagaagaaauuaggugaguuuggcaaagcuaaagguucgagagcaauaugguacauguggcugggggcaagauucuuggaguucgaagcguuggguuuuaugaaugaagaucauugguuuuccagagaaaauagccuaucuggaguagaaggggaaggucugcauaaacuaggcuauauauuaagagauauaagcaaaauaagcgggggaaauauguacgcagaugauaccgccggcugggacacuagaauaacagaagacgauuuacaaaaugaagccaaaauaacugauauuauggaaccagaacacgcacuucucgcaaauagcaucuuuaaacuaaccuaucaaaacaaaguuguaagagugcaaagaccagcuaaaaacgguacuguuauggacguuauaagucgaagggaccaaagaggaucuggccaagugggaaccuauggacuuaacacuuuuacaaauauggaagcucaacuaauaagacaaauggaauccgaagguauauuuaguccaagugaacucgaaacuccaaaucuugcagaaagagucuuagauuggcuagagaaacacggaguugaacgauuaaaaagaauggccauaucaggggaugacugcguaguaaaaccaauugacgaccgauuugcaacagcauuaacagcucuuaaugauaugggcaaaguacguaaagacaucccgcaaugggagccaucuaaaggguggaacgauuggcaacaagucccauuuuguucacaccacuuucaucaauugauuaugaaggauggcagagagauuguaguuccauguagaaaucaagacgaauuggugggccgggcuagggugucucaaggcgcugguuggucucuaagggagacagcuugccuagguaaaucauacgcucaaauguggcaauuaauguacuuucacagacgugaucucagauuagcagcaaacgcgauauguucggcgguacccguagacuggguacccaccucucgaacaacguggaguauacaugcacaucaucaguggaugaccaccgaagacaugcuaucagucuggaaccguguauggauagaggaaaaucccuggauggaagauaaaacucacauaaguagcugggaggacguuccuuaucugggcaagcgagaggaccaauggugcgguucucucaucgguuuaacagcucgagcaacgugggcgacaaacauacaaguggcuauaaaccaaguuagaagacucauaggcaaugaaaacuacuuagacuacaugaccucuaugaagagauuuaaaaacgaaagcgauccagagggagcacugugguaa

SEQ ID NO: 21214 - RNA, 9879 nt, Artificial Sequence
  derived and/or modified CDS sequence (opt6) from DENV-1__HM181946__SS-prME
aguguuacaaugcugcuaaugcuaaugccgacugcacucgcauuccauuuaacaacaagggguggagaaccacacaugauaguaagcaaacaggaaagggggaaaucucuacuuuuuaaaacaagugcaggcgugaauaugugcacccugaucgcgauggauuuaggcgaacuaugcgaagacacaaugacuuauaaaugcccgcgaauaacggaagcagaaccagaugacguagauuguugguguaacgcuacggauacauggguuacauaugggacuuguucacagacaggcgaacaccgaagagauaaacgaaguguugcacuggccccacacguaggacuaggauuagaaacaagaacugaaacauggaugaguagugaaggcgccuggaaacaaauucaacguguggaaacaugggcacuucgacauccaggcuuuacugugauagcacucuuuuuagcccaugcaauugguacgaguauaacacaaaaaggaaucaucuuuauuuuguuaauguugguaacuccuucuauggcaaugcgaugcgucgggaucgguucaagagauuuuguugaaggacugagcggcgcuacauggguugauguagugcuagaacauggaagcugcguaacaacaauggcuaaagauaaaccaacccuagacauugaauuauugaaaacugaaguuacgaacccggccauucugagaaaauugugcauagaagcuaaaaucucaaauacaacaacagauucgagguguccuacccaaggagaggcaacccugguggaggaacaagaugcuaacuuugucuguaggaggacauuuguggacagaggguggggcaacggguguggacuuuuuggaaaaggaagucuaaucacaugugcuaaauucaaaugcguuacuaaacucgaaggaaaaaucguacaauaugaaaaucucaaauauagcgugauaguaacaguucauaccggagaccagcaucaagugggaaacgaaaguacggagcaugguacaacggcuacaaucaccccacaagcuccaacaacggaaauacagcugacugauuacggagccuuaacauuggauugcucaccaaggacgggacuagacuucaacgagauggucuuguugaccaugaaagaaaaauccugguugguucauaaacagugguuucuagacuuaccccuaccauggacaaguggagccagcacaagucaggaaacauggaaccgacaggaucucuugguaacuuuuaaaacugcacaugccaaaaagcaagaaguuguaguacucggaucgcaagaaggagcgaugcauacggcacugacgggugcaacugagauacaaacaaguggaacaacaaccauauuugcgggucaucuuaaauguagguuaaaaauggacaaacuaacauuaaaggguaugucuuaugucaugugcacugggagcuucaaacuggaaaaagaaguagcugaaacccagcaugguacagucuuaguacaaauacgauaugagggaacugaugccccaugcaagauaccauucucaacucaggacgaaagaggagucacacagaacggcagacuaauaacggcaaacccuauaguaacagauaaagagaaaccagugaauauagaggcagagccaccguucggggaaaguuauauuguaauaggcgcgggagagaaagcacuuaaacuaaguugguuuaagaaaggaucuucgauaggaaaaauguuugaagcgacagcuagaggagcucgacggauggcaauauuaggugauacggcgugggauuuugguaguauaggaggcguauuuacaagcguaggaaagcuaguacaucaaauuuucgggacugccuacggggucuuauucucugguguaagcuggaccaugaaaauugguauugggguacuccuaacuugguuaggucuuaauagcagauccacaucauuuaguaugacgugcaucgcaguaggccuaguaacguuauacuuaggcgucaugguacaggcugacuccgggugcguuauuaacuggaaggggagagaauuaaaaugcggaagcgggauauuugucacuaaugaagugcauacauggacugagcaauauaaauuucaagcugacuccccaaaaagacugagcgcagcaauugguaaggcuugggaagaaggagucugcggaauaagaucagcaacacgauuggaaaacauuauguggaagcaaaucucgaacgaauugaaccacauuuugcuagaaaaugauaugaaauuuacuguaguugucggagacgucgcggguauauuagcacagggcaagaaaaugauuagaccccaacccauggaauacaaauauagcuggcgcagcuggggcaaagcaaaaauaauaggggccgacguacaaaacaccaccuuuauaaucgacgguccaaauacaccugaaugucccgacgaucaacgagcauggaauauuugggaaguggaagacuauggauuuggaauauucacaacaaauaucugguuaaaacuaagagauagcuauacccaaguaugcgaucaucguuuaaugucugccgcaauaaaagauucuaaagcuguucaugcggauauggguuauuggaucgaaucugaaaagaaugaaacuuggaaauuggccagagcauccuuuaucgaggugaaaacauguauuuggccgaaaucccauacgcuauggaguaaugguguccuugagucagagaugauaauaccaaagauuuaugguggaccaauuagucaacauaacuauaggccgggguacuuuacccaaacagcagggccuuggcaucuaggaaaacuagaacuagacuucgaccuuugugaaggcaccacaguaguaguagacgagcacuguggaaacagagggccaucauuaaggacuacaacgguaacuggaaaaauaauccacgaauggugcuguaggagcuguacgcuaccuccccuucgauucagaggggaagaugggugcugguaugguauggaaauaagacccguuaaggaaaaagaagagaauuugguaaaaagcaugguaagcgcgggaaguggcgaagucgauucauuuucccugggguuacuaugcaucaguaucaugauagaagaaguuaugagaucaagguggucaaggaaaauguugaugacugggacccuagcuguguuccuucugcucaucauggggcaacuaacuuggaaugaccuaauccggcuaugcauaaugguuggcgccaacgcaagugauagaauggguaugggaacaacauacuuagcacucauggcaacuuucaaaaugaggccuauguuugcaguaggauuacuuuuuagaagguuaacaucaagggaaguacuuuuacucacaauaggucucaguuugguagcuagcguagagcuaccuaacagcuuagaggaacugggugacggucuagcaaugggaaucaugauccuuaaacuccuaacggauuuucaaucacaucaauuaugggcuacauuacuuucucuaacauucauaaaaacaaccuuuagccuacacuaugcauggaaaaccauggcaaugguguuaaguauagugucuuuauucccgcuuugcuuaucuacuacaagucagaaaacuacauggcugcccguacuucuugguucguuaggauguaagccucugacgauguuucuaauagccgaaaacaagauaugggguagaagaucguggccguuaaacgaaggaaucauggcuguuggcauuguaaguauauuauugaguucauuacucaaaaacgauguaccuuuagcagguccacuaaucgcaggaggcauguuaaucgcauguuacguuauaucugggagcucugcagaucuuucauuggagaaagcugcggagguaagcugggaggaagaggcagaacauuccggagccucgcauaacauccuaguugaaguucaagaugacggaacaaugaagauaaaggaugaagagagagaugacacauuaacaaucuuacuaaaggcuacacuccucgcaguaucugguguauauccucugucuauccccgcuacauuauuuguaugguauuuuuggcaaaagaaaaagcaacggagugggguauuaugggauacaccuaguccaccugaaguggaaagagcgguauuggaugauggaaucuacagaauaaugcagagaggguugcuggggagaagucaaguuggaguagggguauuccaggaaaacguauuucacacgauguggcacguuacccgaggcgcaguuuugauguaccagggaaagcgauuagagccguccugggcgucaguuaagaaagacuuaauauccuacgguggagguuggagacuacagggaaguuggaauacuggagaagaaguucaagugauagcuguagagccagguaaaaacccaaagaacguucagacggcuccaggaacguucaagacaccagagggggagguaggagccauugcauuagauuuuaaacccggcacuucaggcagcccaauugucaaccgggaaggcaaaauuguugggcuuuaugguaacggaguaguuacuaccucuggaacauaugugucugcaauagcgcaagcaaaagcaucucaggaaggcccuuuaccugaaauagaagaugaaguuuuuaggaaacgcaaccuaacuauaauggauuuacauccaggaagcggaaaaacaaggagguauuugccugcgauaguaagagaagcaauaaaacgaaaauuacgaacucucauauuagcgccuacccggguuguagcauccgaaauggcggaggcuuuaaagggaaugccuauacgcuaccaaacaaccgcggugaagucagaacacacugguaaagaaauaguagauuuaaugugucacgcaacauuuacuaugagauuacuuucaccaguccgaguccccaauuauaacaugauaauuauggacgaagcgcauuuuacugauccuaguucgauagcugccaggggauauauuucgacccgagugggcaugggagaagcugcugcaauauuuaugacagcuacaccgccuggauccguagaagcguucccacaauccaaugcaguaauacaagaugaggaaagagauauucccgaaaggucuuggaacucuggguacgaguggauuacagauuucccaggaaaaacaguuugguuuguuccgucaaucaaaagugguaaugacaucgcuaacuguuuacgcaagaacgggaaacggguaauacagcucucgagaaagaccuucgauacggaauaccagaaaacuaaaaauaaugauugggauuacgucguuacgacagacaucagcgaaaugggugcgaacuuuagggcagauagggucauugaucccagaaggugucuaaaaccaguuauauuaaaagauggaccagaaaggguuauucuggcagguccuaugccagucacaguggcaucagcagcccaaaggaggggaagaauagggagaaaucacaauaaagaaggggaucaauacauuuacaugggacagccucuaaacaacgacgaggaucaugcacacuggacggaagccaagauguugcuggauaauauaaauacccccgaaggaauaauacccgcgcuauuugagccagaaagggaaaagagugcagcgaucgauggugaguacaggcuucggggcgaagcucgcaaaacauuuguagaauuaaugaggcgaggcgaucuuccagucugguugucuuacaagguagcgagugagggauuccaguauagugaucgaagaugguguuuugauggagaacgaaauaaucaggucuuagaagaaaauauggauguggaaaucuggacaaaagaaggcgaaagaaagaaauuacgcccgagaugguuagaugcccgaaccuauagcgacccccuugcacuccgcgaauuuaaagaguuugcggcuggaaggagaagcguuuccggggaucugaucuuagaaauaggaaaauuaccgcagcaucucacacagagagcgcaaaacgcgcuugauaaucuuguaauguuacacaauucagaacaagggggaagggccuauagacaugcuauggaagaguugccggauacaauagaaacguugauguugcuggcauuaauagcugugcucacaggugguguuacuuuauuuuuccuuuccggaagggguuuaggaaagacaucgauagguuuauuguguguaauggcaucuucagugcuauuguggauggccagcguggaaccacacuggaucgcugcgucuaucauuuuagaguucuuucugaugguauuauuaauaccugaaccagaucgacaaagaacgccccaagauaaccaauuagcuuacguggucaucggcuuguuauuuaugauacuaacaguagcagcaaaugaaauggggcuacucgaaacuaccaagaaagaccucgguauuggucacgucgcaguugguaaccaccaccacgcagccaugcuagauguggaucuacauccagcuucggcauggacccuuuaugccguugcaacuacuauuauaacccccaugaugcgacauacgaucgaaaacacuacagcuaacaucagcuuaacagcaauugcaaaucaagcagcaauuuuaaugggguuggauaagggauggccgauaagcaagauggauauagguguaccuuugcucgcacucggaugcuacucucaaguaaacccgcugacacuuacugcagcugugcuuaugcuaguagcgcacuacgcaauuauagggccuggacuucaagcaaaagcgacucgagaagcacagaaaagaacagccgcugggauaaugaaaaauccgacagucgacggaauaguagcuaucgaucuugauccaguuguauacgaugcuaaauucgaaaaacaauuaggacagauuauguuguugauacuguguacaucgcagauauuacuuaugagaacaacuugggcgcuuugcgaaucuaucacacucgcgacggguccauuaacuacuuugugggaagguucaccaggaaaauucuggaacacuacaauugccguaucaauggcaaacaucuuucgugguucuuauuuagcuggagccggcuuagcuuuuucauuaaugaaaucgcucggagguggacgaagaggaaccggagcucaaggcgaaacccuaggagaaaaauggaaaagacagcuaaaucaacuuucgaaaagcgaauuuaauacauauaaacgaucgggcauaauggagguagauagaagcgaagccaaagaggggcuuaagcguggagaaacaacgaagcacgcagugucacgugggacggccaagcuacgaugguuuguugaaagaaauuuagucaaaccggaggguaaggucauagaucuugguugugggagagguggaugguccuauuacugugcaggucuaaagaaaguaacagaagucaaaggauauacaaaggguggaccugggcaugaagaacccauuccaauggcgacguauggauggaauuuaguuaagcuccacaguggaaaggacguauucuuugugccgccugaaaagugugauacccuacugugcgacaucggcgaaucaucuccuaauccaacaauagaagaaggcagaaccuuaagaguauuaaaaaugguagagccaugguuacgagguaaccaguucuguaucaagauacugaauccauauaugccuucaguagucgaaacacuagaacaaaugcaaaggaaacacgguggcaugcugguucgaaauccauuaucaagaaacucuacgcacgaaauguauugggucuccuguggcacugggaauauugugagcgcgguaaacaugacaucuaggauguuauuaaacagguucacaauggcacauagaaaacccacauaugaaagggacguggacuuaggggcaggaacucgccaugucgcuguagaaccggagguagcaaaucucgauauuauaggacaaagaaucgaaaacauaaagcaugaacacaagagcaccuggcauuaugaugaagauaauccauacaaaacuugggcauaucauggaagcuaugaaguaaagccaucuggaucggcuucaaguauggucaaugggguuguaaaacuucuaacaaaaccaugggacguaauccccaugguaacacaaauugcaaugacagacacgacaccguuuggucaacaacgggucuucaaagagaaaguagauacaagaacaccgaaagcuaaaagaggaacggcucaaauaauggaaguuacagcuaaauggcucugggguuucuugucuaggaacaagaaaccgcguauuugcacacgagaggaguucacuagaaaaguccgaagcaacgccgcaauaggugcaguguuuguagacgaaaaccaauggaauagugcuaaagaggcgguagaagaugaacgauuuugggauuuaguucauagagaacgugaguugcauaaacagggaaaaugugccaccuguguauauaauaugauggggaaacgagagaagaaauuaggagaauuugguaaagcuaaagggucucgagccauaugguauauguggcuuggagcccgcuuucuagaguucgaagcauuaggcuucaugaacgaggaucauugguucucuagagagaauagccugagugggguagaaggggagggacuacauaagcuaggauacauuuugagagauauuagcaaaauaccaggagguaacauguaugcugaugauacagcgggaugggauacccguauuacggaagacgaccuacagaacgaagcccgcaucacagauauuauggaaccugaacaugcguuguuggcaaaaucaauuuuuaaauuaacauaccaaaauaaaguugucagaguucaaagaccagcuaagaacgguaccguaauggaugucauuucaagaagagaccaaagaggaucuggacaaguaggcacuuaugguuuaaauacauuuacaaacauggaggcacagcuuauucggcagauggagucagaagggaucuucaguccuagcgaacucgagaccccaaauuuagcagaaagaguacucgauugguuggaaaaguacggcguugagagacucaagcguauggcaaucucaggugaugauuguguaguaaaaccuauagacgaucgcuuugcgacggccuugacagcacuaaaugauauggggaaaguucguaaagauauaccucaaugggaaccuucaaaaggauggaaugacuggcaacaggugccauuuuguagucaucacuuucaucagcugauaaugaaagacggaagggaaaucguaguaccaugcaggaaucaagaugaauugguuggacgagcucgugucucgcaaggagcaggauggaguuuaagggagacggcuugccuaggaaaaagcuacgcucaaauguggcaauugauguauuuucauagaagagauuuaagauuggcagcuaacgcaauauguagugcuguuccaguagauuggauaccuacaagucgaacgacuuggaguauucaugcacaucaucaauggaugacaacagaggauaugcucucuguauggaaucgaguguggaucgaggaaaauccuuggauggaggauaaaacucauauuucgagcuggggagacguccccuaucuaggaaaacgugaggaccaauggugugggucgcugaucggacuuacagcucgagcuacuugggcuacgaauauacaaguagcaauuaaucaggugcgaagacucaucggaaaugaaaauuauuuagacuacaugacaucaaugaaaagauucaagaacgaauccgacccagaaggggcauuaugguaa

SEQ ID NO: 21215 - RNA, 9879 nt, Artificial Sequence
  derived and/or modified CDS sequence (opt6) from DENV-1__HM181948__SS-prME
ucgguaacaauguuauuaauguuaaugccaacagcacuagcauuucaucuaacaacacgagggggagaaccacacaugauuguaucaaaacaagaacgagggaaaaguuuacuauuuaaaaccucggcgggaguaaauauguguacccuaauagcaauggauuuaggagaauuaugcgaggauacaaugacauauaagugcccaagaauuacugaaguggaaccagaugauguugacugcuggugcaaugcaacagauacauggguuacauauggaacuugcagccaaacuggggaacacaggagagauaaaagaucagucgcguuagcuccucacguuggauuagguuuggagacacgaacggaaaccuggaugucuagugaaggugcauggaagcaaauacaacgcguagaaacgugggcgcuacggcauccgggauuuacaguuauagcauuguuucuggcucaugcuauaggaacuucaaucacacaaaaagggaucaucuuuauacuacuuauguuggucacaccuucuauggcgaugcguuguguagguauaggaucaagagauuucguagaaggacuaaguggugcgacguggguggauguaguucuagaacauggauccugcgugacuacaauggcaaaggauaaaccaacacuagacauugaauuacuaaagacggaaguuacaaauccugcuauacugaggaaauuauguauugaggcuaaaaucucaaacacuacaaccgauagcagauguccgacgcaaggagaggcuaccuuaguagaagaacaagacgcuaauuucgucugucguaggacauucguagaucgggguugggggaaugguugugggcuauucgguaagggaucauuaaucacaugcgcuaaguuuaaauguguaacaaaacuagaagggaaaauagugcaauaugaaaacuuaaaauacagugugaucguuacaguccacaccggagaucaacaucaaguagggaaugagucaacggaacaugguaccacggcaacuauaacaccacaagcuccaacaaccgaaauacaacuaacugauuacggugcgcuuacacucgacuguagcccaagaacaggacuagauuuuaaugaaaugguuuuauuaacaaugaaagagaaauccugguuagugcacaaacaaugguucuuggaccuuccguuaccuuggacaaguggggcaaguaccagucaagaaacauggaaucgacaagaucuccuuguaacauucaaaacagcucaugcuaagaaacaagaaguaguuguucuugguucacaagaaggagcgaugcacacggcuuuaaccggagcaacugagauucagacaagcggaacaaccacgauauuugcaggacacuuaaaauguagacuaaagauggacaagcucacuuuaaaagggaugaguuacguuaugugcacugguucauucaaguuagaaaaagaaguggcggaaacgcaacaugguacggucuuaguacaaauaaaauaugaggguacggaugcaccguguaagauccccuuuucgacccaagacgaaaaaggcguaacucaaaaugggagacuuauaacggccaacccuauugucacagauaaggaaaaacccguaaauaucgaagcugaaccaccguuuggagaaagcuauauagugauaggagcuggagagaaagcacuaaaguuaagcugguucaagaaaggguccucgauaggaaaaauguuugaagcaaccgccagaggagcgagaagaauggcuauucuuggggauaccgcaugggauuuuggcagcauuggaggggucuuuacaagcguagguaagcucguacaucaaauuuucggaacagcguaugggguuuuguucucugggguuuccuggacaaugaagauaggaauagguguauuguugacauggcuaggauuaaauucgcgcucuaccagucuuaguaugaccuguauugcuguuggauuaguuacucuuuauuugggcgugaugguacaagcggauucaggcuguguuaucaacuggaaggggagagaauuaaaguguggcucaggaauauucgugacuaacgaaguacacacuuggaccgaacaauacaaauuucaggcugacucuccaaaacgacuaucggcagcaaucggcaaggcaugggaagaaggaguuugcggaauaaggucugcaacacgccucgagaacauaauguggaaacaaauuucaaacgaauuaaaccacauuuuacuagaaaaugacaugaaguuuacaguuguaguaggggauguagcaggcauacucgcccaaggcaagaaaaugauacguccucagccaauggaguauaaauacaguuggaaaagcuggggcaaagccaaaauuaucggugcggauguccaaaacacgacuuuuauuauugacggcccaaacacaccggaguguccagaugaucaaagggcauggaauauaugggaaguggaagacuacgguuuugggauauuuacaacgaauauuuggcuaaaacugcgggacucuuacacacaagucugugaucaucgacuaaugucggcugcuauaaaagauuccaaggcaguucacgcugacauggguuacuggauagaauccgagaagaacgaaacguggaagcuggcgagagccucuuuuauagaaguaaaaaccuguaucuggccaaaaucacacacauuauggaguaacggaguauuggaaagugaaaugauaauaccuaaaauuuacggaggcccaauuucgcaacauaauuaccggccgggauauuuuacgcaaacugcagggccuuggcacuuaggcaaguuagaacuugauuuugacuuaugugaggggacaacugugguuguagacgagcacuguggcaauagaggcccuaguuuaaggacuaccacugugacagggaaaauuauccacgaauggugcugucguaguugcacucugccaccgcugagauucaggggagaagauggauguugguacggcauggaaauucguccuguaaaagaaaaagaagaaaaucuaguaaaaaguaugguaucagccggaaguggagaaguagauucauuuagucuagggcuauuaugcauaucuauaaugauugaagaaguuaugcguagucgcuggucccgaaaaaugcuuaugaccgggacgcuugccguauuucuguuguuaauuaugggacaacuuacuuggaaugaucuaauuaggcuauguauuauggugggcgcaaacgcuagugaccguaugggaaugggcacaacauaccuagcguugauggcuaccuuuaaaaugaggccuauguuugcggucggauugcuauuucgacgauugacaucacgugaaguauuacuauuaaccauuggacugaguuuaguggcaaguguagaacugccgaacagucuagaggaacucggggacgggcuagcgaugggaauaaugauuuugaagcuccugacagacuuucagucacaccaauuaugggccacacuacucagcuuaacauucaucaaaacaacuuucucauugcacuacgcuuggaagacgauggcaaugguauuaucaauaguuucguuauuuccauugugcuugagcaccacaagucagaaaacaacuuggcuacccguucuacuggguucgcuagguugcaagccgcugacuauguuucuaaucgcggaaaauaaaauuuggggaagaaggaguuggccuuuaaacgaagguauuauggcagugggaauugugucaauacuucuuaguagucuccucaaaaaugauguaccucuagcugguccacuaaucgccgguggaaugcuaauagcgugcuauguuaucuccggaagcagugcugaccucagcuuagaaaaagcagccgaagucuccugggaagaggaagcagaacauucuggagcuagucacaauauucuaguagagguccaggaugacgguacaaugaagauuaaagaugaagaacgagaugacacguuaaccauccucuugaaagcaacacuccucgcuguaucaggcguauauccauuaucaauaccugcaacguuauucguaugguauuuuuggcagaagaagaaacagagaagcgguguauuaugggauacacccucuccaccagagguagagagagccguacuagaugauggaaucuaucggaucaugcaaagaggacuguuggggagaagucaaguugguguuggggucuuucaagagaauguuuuucauacgauguggcaugugacuaggggagcaguguuaauguaccaagguaaaagauuagaaccaaguugggcaagcgucaagaaagauuuaauuaguuaugggggaggauggagguuacaaggaagcuggaauacgggggaagaaguccaggucauugcggucgaaccaggcaaaaauccuaaaaauguccaaacugcgccaggaacauuuaaaacaccugaaggcgagguuggagcgauagcacuggacuuuaaacccggaacaagugguucgccuauaguuaaucgagaaggcaaaauuguaggccucuauggaaacgguguugucacuacaucagggacuuaugugucugcaauagcacaggcaaaagccucucaagaaggucccuuaccugaaauagaagaugaaguauuuagaaaacgaaaccuuacuauaauggaucuucacccaggguccgguaagaccaggagguauuugccagcaauuguucgugaagcaauaaaaagaaaacuacgaacacucauacuagccccgacucguguggucgcaucugagauggcagaggcauugaagggaaugccaaucagauaucaaacuacugcaguaaaaagugaacauacggguaaagaaaucguagauuuaaugugucacgcaaccuucacaaugagguuacuuaguccaguucguguacccaauuacaauaugauuauaauggaugaagcucauuucacggauccaucaucgauugcagcuagaggauacauaucaacaaggguugguaugggggaggcugccgcuaucuuuaugacugcgacaccaccuggcuccguggaagcauuuccucaaucuaaugcagugauccaagacgaagaaagggauauuccagaacguucauggaacaguggcuaugaauggauuacugacuucccaggaaaaacaguaugguuugucccaucaauaaaaucuggaaacgauauugcuaauuguuuacguaaaaacggaaagagagucauccagcuaucacgcaaaacauucgauacugaauaucagaaaaccaaaaacaacgauugggauuauguaguaacuacggauauaagcgagaugggagcaaauuuuagggcagauagaguaauugaccccagacguugucuuaagccgguaauucugaaagauggcccagaaaggguaauacuagcugggccuaugccuguuacagucgccucagcagcucaaagaagggguagaaucggaagaaaccacaauaaagagggggaccaauauaucuacaugggccagccuuuaaacaaugacgaggaucaugcacauuggaccgaagcuaaaaugcuacuagauaacauaaauaccccagagggaauuaucccugcguuauucgagccagaacgugaaaaaucugcagcaaucgacggcgaauaucgucuaaggggagaagcaagaaaaaccuucguggaauuaaugcgucgaggcgaucucccgguguggcuaucauacaaaguggcuagcgaaggcuuucaauacagugacagacgcugguguuuugacggugaacgcaauaaucaagugcuggaggaaaacauggauguugaaauauggacaaaagagggcgaacgaaagaaauugagaccccgauggcuggaugcgagaacguauagugauccuuuagcgcuccgugaauuuaaagaauuugcagcagguagacggucaguuucaggagauuuaauacuagaaauuggaaaauuaccucagcacuuaacacaaagagcacaaaaugccuuagauaacuugguuaugcuucauaacuccgaacaaggagggagagccuaccgucacgcuauggaggaacugccagauacuauagaaacacuaaugcuuuuagcucugauagcagucuugacaggcggaguaacucucuucuuccucucggggaggggauuaggaaaaacaaguauuggacuauuaugcguaauggcauccucggugcugcuauggauggcaucaguagaaccgcacuggauagccgcaaguaucauacuagaguucuuuuuaaugguuuuguugauuccugaacccgaucgucaacguaccccucaagacaaucaacuugcauauguagugauagggcuauuauucaugauucucaccgucgcugccaacgaaauggguuuacucgaaaccacaaagaaagacuugggaauagggcauguagcagugggaaaucaucaucacgcugcaauguuagacguggauuuacauccugcgucagcuuggacgcuauaugcaguggcaacaacuauaauuaccccuaugaugagacacacaauagagaacacaaccgcaaauauuuccuuaaccgcaauagcaaaucaggcagcaaucuuaauggggcuugauaaagguuggccaauuagcaaaauggauauagggguaccauuguuagccuugggaugcuauagccaaguaaaccccuugacguuaaccgcugcaguguuaaugcuuguagcucauuaugcgaucauagguccaggucuacaggcaaaagcgacuagagaggcccaaaaacgaacagcagccggaauuaugaaaaauccuacuguugacggcauuguugccauugauuuggacccaguggucuaugaugcuaaauucgaaaaacaacuuggacaaauaaugcucuuaaucuuauguacgagucaaauuuuauuaaugaggacaacgugggccuuaugcgaaaguauaacacuugccacaggccccuuaacgacccugugggaaggaaguccggggaaauuuuggaacacaacuauugcgguaucuauggcgaauauauucagggguucuuaucuagccggagcaggauuagccuucucucucaugaaaucacuugggggagguagacgagguacgggugcacagggcgaaacccucggugaaaaauggaaacggcaauuaaaccaauuaucaaaaucagaauuuaacacauacaaacgaucuggcauaauggaaguagaccgaagugaagccaaagaaggccuuaaaaggggugaaaccacgaaacaugcaguuagucgagguacggccaagcuaagaugguucgucgaaagaaaccucguaaaacccgaagguaaaguaaucgaccuagggugugguagagguggauggagcuauuacugcgcuggccuaaagaaagucacagagguaaaagguuacacgaaaggggguccagggcaugaagaaccaauuccaauggccaccuacgguuggaauuuaguuaaauuacacagcgggaaagacguuuucuucauaccaccugaaaaaugugauaccuuguuaugugauauuggugagaguucaccgaauccgacaauugaagaaggaagaacauuacgggucuuaaaaaugguggagccgugguuacgggggaaucaauucugcauaaaaauacuaaauccauauaugccaucaguaguugagacucuugaacagaugcaacggaagcauggagggauguugguuagaaacccacuaucaagaaacagcacgcaugagauguacuggguaucaugcggaaccggcaacauugucagugcaguaaauaugacaaguagaaugcuacuaaaccguuuuacgauggcacacagaaagccgacauaugaaagagauguugauuuaggagcgggcacuagacauguugcgguggaaccugaaguugcaaacuuagauauaauuggacaacgaauugaaaauauaaaacaugagcauaaaagcacauggcauuacgaugaagauaacccuuauaaaacgugggccuaucaugguucauaugaaguaaaacccucagguucagcaucaaguauggugaauggggucguaaaacuauuaacaaaaccaugggacgugauacccaugguaacgcagauagcaaugacagacacgacgccuuucgggcaacagcgcguauuuaaagagaagguagacacacguacaccaaaggcaaagcgagggacggcucaaauaauggaaguuacggcaaaaugguuguggggauuuuuaucacgcaacaagaaaccaaggauauguacuagagaagaguucacgaggaaaguaagaucaaacgcugcaauaggggcaguuuucguagaugaaaaucaguggaacuccgcuaaagaagcuguggaagacgaaagauuuugggaucuaguucaucgagaacgcgaauuacauaaacaagguaaaugcgcuacauguguuuauaacaugauggggaagagggagaagaaacuaggcgaguuuggaaaagccaaaggaucucgugcuauaugguacauguggcuaggagcuagauucuuagaguucgaagcucuaggauucaugaaugaagaccacugguuuucacgggaaaauucccuaucagguguagaaggugaaggucuccacaaauuaggguauauacuucgugacauaucuaagauucccggagggaauauguacgcggacgauacugcggggugggauaccaggaucacggaagaugacuuacagaaugaggcacgaauaacugauauaauggaaccugagcaugccuuguuagccaaaagcauauucaaacugacuuaucagaacaaaguuguuaggguacaaagaccagccaaaaacggaacuguaauggacguaauaagucgacgggaccaacgcggaagcggacaaguugguaccuauggucuaaauaccuuuaccaauauggaagcccaacuaaucagacaaauggaaucagagggaaucuuuaguccaucagaauuagaaacaccgaaccuugccgagcggguacuugauuggcuggagaaauacggcguagaacgacuaaaaagaauggcuaucaguggggacgacugugucgucaagccgauagaugauagguuugcuacagcacugacagcacugaaugauaugggaaaaguacgaaaagauauuccacaaugggaaccgucgaagggauggaacgauuggcaacaggugcccuuuugcucccaucauuuccaccagcuaauaaugaaggauggacgggaaauuguaguaccuuguaggaaccaagacgaauuaguugguagagcgagaguaagccaaggggcaggauggaguuugagggaaacagcuugccuaggaaaaucuuaugcccaaauguggcaguugauguauuuucaucgacgagaucugcgguuggcagcgaacgcgauaugcagugcugugccuguggacuggauuccaacaaguaggacaacauggucuauccaugcacaucaccaauggaugacaacugaagauauguuaagcgucuggaaccgcguguggauagaagagaacccguggauggaagauaagacacauauaucaucauggggugauguaccuuauuuaggcaagcgugaagaccaaugguguggaagccuuaucggacuaacggcccgggccacgugggcaacgaacauacaaguugcuauuaaccaaguacgaagacuuauagggaaugaaaauuaucuagauuauaugacuagcaugaaacguuuuaaaaaugagucugauccagaaggcgcgcuuugguaa

SEQ ID NO: 21216 - RNA, 9879 nt, Artificial Sequence
  derived and/or modified CDS sequence (opt6) from DENV-1__HM181949__SS-prME
uccguaacuauguuacuaaugcugaugcccacggcauuagccuuucaucuaacaacucgagguggcgaaccacauaugauuguuucaaaacaagaacgugggaaaagucuuuuguucaaaacuuccgcgggaguaaauauguguacgcugauugccauggaccuaggggaauugugcgaagacaccaugacuuacaaauguccaaggauaacugaagcagaaccagaugauguugacuguuggugcaaugcaacggauacguggguuacauaugggacuugcucgcaaacaggugaacacagaagagauaaaagaagcguugcauuagcgccacacguugggcugggauuagaaacgaggacagaaaccuggaugucuagcgaaggagcauggaaacaaauucaaagaguagaaacaugggcacuucgacacccgggauucaccguuauagcauuguuccuugcucacgcuauaggaacaucgauuacgcaaaaagguauuauuuucaucuuacucauguuaguuacgccgaguauggcuaugagaugcguugguauaggaaguagggauuuuguagaaggcuuaucaggugcaacuuggguugauguaguucuugaacacggcucaugugugacuacuauggcgaaagauaaacccacgcuagauauagaauuauugaaaacugaaguaacaaauccagcaauccuucgaaaauuauguauagaagccaaaauaaguaauacaaccacagacucaaggugccccacacaaggcgaagcgacacucguagaggaacaagacgcaaauuuuguaugucgaagaacauuugucgauaggggguggggaaauggguguggacucuuugguaaaggcucuuugauuacgugugcuaaauucaaaugugucaccaaauuggaaggaaaaauuguucaguacgagaaucuaaaauauucaguaauaguuacaguccacacaggcgaucaacaccagguugguaaugaaucgaccggccaugggacaacagcaacuauuacgccacaggcuccaacuacugaaauucaacuaacagauuauggcgcauugaccuuagauuguucaccacgaacaggucuagacuuuaaugaaaugguccuacugaccaugaaagagaaaagcuggcuuguacacaaacaaugguuccuugauuugccacuaccauggacaaguggagcauccacaucgcaggagacauggaaccgucaagaucuauuaguaacuuuuaaaacggcgcacgcuaagaaacaagaaguggugguacuuggaucccaagaaggggcaaugcauacugcauuaacgggugcuaccgagauucaaaccaguggcacgacaacuauauucgcuggucaccuuaaauguagacuaaaaauggauaaacuaacuuuaaaagggaugucuuacguaaugugcacugguagcuuuaaacuagaaaaagaaguugcagaaacccagcaugguacaguucucgugcaaaucaaauaugaaggcacggacgcacccuguaagauuccauucagcacucaagacgagaaaggggucacacaaaauggacggcuaauaacugcuaauccuauagugacagauaaggaaaaaccaguaaacauugaagcggaaccuccuuuuggugagaguuauauuguaaucggagcuggggagaaagcucuuaaacuaagcugguucaaaaagggaucuagcaucggaaaaauguucgaagcgacagcacgaggagcgagacgaauggcaauacuuggagauaccgcgugggauuuugguucaauaggcggaguauuuacauccguagguaaacugguacaucaaauuuuuggaaccgcauaugguguccuauuuucuggagugagcuggacaaugaaaauugguaucggcgugcuacucacaugguuaggucuaaauucuaggucaaccagcuuaaguaugacauguauagccguaggucuagucacucuguaccuuggcguuaugguucaagcugauagcgguuguguuaucaauuggaaaggucgugaacugaaaugcgguagcggaauuuuuguaacaaacgaaguacauacguggacagagcaauauaaauuccaagccgauagucccaaaaggcuaucagcagcaauagggaaggcaugggaggaagguguuuguggaauacguagugcgacaagauuagaaaauaucauguggaagcaaauauccaacgaauuaaaucauauauuacuagaaaaugacaugaaauucacaguagugguaggugauguagcaggcauccuugcucaaggaaagaagaugaucagaccgcagccaauggaauauaaguauucauggaaauccuggggaaaagcuaaaauuauuggagcggaugugcaaaauacaacauucaucauagaugguccaaacacaccagaguguccagaugaccaaagagcuuggaauauaugggaaguugaagauuacggauucggcauauuuaccacaaacauaugguuaaaacuuagagacaguuauacacagguaugcgaucaucgacuuaugagugcugcaauuaaagauucaaaagcgguacaugccgauaugggcuacuggaucgaaagcgagaaaaaugaaacauggaagcucgcucgagcgaguuuuauugaaguaaaaacauguaucuggccaaagucccacacguuauggucgaaugggguacuggaguccgaaaugauuauuccuaagaucuauggaggaccuauaucgcagcauaacuaucgaccuggguauuucacacagacugccggacccuggcaccuagggaaauuggagcuagacuuugaccuaugcgagggaacuacaguggucguugaugaacauugcgggaaucgaggaccuucauuacguacaacaacaguuacaggaaagauaauacacgaaugguguugcagaagcuguacauuacccccucuaagauucaggggcgaggacgguugcugguauggaauggaaauucggccagugaaagagaaagaagaaaacuuaguuaaauccaugguaagugcuggaucgggagaaguagauagcuucucacucgguuugcuuuguauuuccauaaugauagaagaaguuaugcguucuagguggucucgaaaaauguuaaugacaggaacuuuagcuguguucuuauuauuaauaaugggacaauuaacuuggaacgauuuaauaagguuauguaucaugguuggugcaaaugcaucagauagaaugggaaugggaacaaccuauuuagcacucauggccaccuucaagaugagaccuauguuugcuguaggacucuuguuccguagauuaacaucacgggagguuuuacuucuaacuaucggccuaagucuaguagcuaguguagaauuaccaaacucauuagaagaacuaggugauggguuagcaaugggaauuaugauccuaaaacuuuuaacagauuuucaaucacaccaguugugggcaacccuccuaucgcuaacuuucauaaaaacuacguucucauugcauuacgcauggaagacuauggcuauggugcucucgauugucucguuauuuccacuaugccuaagcaccacuucccagaaaacaacuugguuaccgguacuauuagggucgcuugguuguaagccgcugacaauguucuugauagcugaaaacaagauuuggggacgcagaucguggccccucaacgaaggcauaauggccguuggaauaguuaguauauuauuaucaucguuguugaaaaacgacguuccauuggcuggucccuuaauagcuggagguauguugauugcuuguuauguaauuucuggaaguagugcggaccuuucacuugagaaagcagcagagguaagcugggaagaggaagcugaacauucaggggcaucucauaauauccugguagaaguucaagaugauggaacuaugaaaauuaaggaugaagaacgugaugauaccuuaacaauccucuuaaaagccacuuuauuagccguaagcggagucuauccucuuucaauaccagcaacccuguuuguuugguacuucuggcagaagaagaaacaaagaucugguguuuugugggauacuccuaguccuccagaagucgaaagagcaguccuggacgaugguaucuaucggauuaugcaaagaggacuauuaggaagaagucaaguagggguaggaguuuuccaagaaaacgucuuucauacaauguggcacgugacuagaggcgccgugcugauguaccaggguaaacgacuagaaccaucgugggcuagugucaagaaagaucucauuuccuauggaggaggauggagguuacaagguucuuggaauacaggggaggaaguucaaguaauugcugucgaaccgggcaaaaauccaaagaauguccaaacagccccuggcacauuuaaaaccccagagggagaagucggcgccauagcauuggauuuuaaaccgggaaccaguggcaguccuauaguaaaucgggaagggaagauagugggacuauaugguaauggugugguaacaaccucgggcacuuauguuucagcaaucgcccaagcaaaagccucacaagaaggaccuuuacccgagauagaagaugaaguguucagaaaaaggaauuuaaccauaauggaucuccacccugggucagguaaaacaagacgcuaucucccagcuauuguacgagaagcaauuaaaagaaaguugagaacgcuaauuuuggccccgacacguguaguugcaucugaaauggcugaggcauugaaaggaaugcccauaagauaccagacgacugcgguaaaaucagagcauacuggaaaagagaucguugacuuaaugugucacgcuacguuuacaaugaggcuguugagcccuguuagggugccaaauuacaauaugauaauuauggaugaagcucauuuuacugauccuaguucuaucgcugcucgagguuacauauccacaagaguugguaugggugaggccgcagcuaucuuuaugacggcaacaccuccaggaucagucgaagcauuuccacaaucuaacgccguaauccaggacgaagaacgggacauuccagaacgaaguuggaacucggguuacgaguggaucacagauuuuccuggcaaaacagucugguuuguccccaguauaaaaagugguaaugauauagcgaacuguuuaaggaaaaauggaaagcguguaauacaguuaucaaggaaaacauuugauacggaguaccagaaaacgaaaaauaaugacugggauuaugugguuacuacagauauaagugaaaugggugcuaauuuucgagcagauaggguaaucgaucccaggcgaugccuaaaacccguaauacuuaaagaugguccugagagagugauucuugcuggacccaugccuguaacuguagcgagcgcagcucaacgacgcgggaggauugguaggaaucauaauaaagagggagaccaauacauuuacaugggacaaccucuaaacaacgacgaagaucacgcgcacuggaccgaagcgaaaauguuacuagauaacauaaacacucccgaaggcauuauaccagcauuauuugagcccgagagagaaaaauccgcagcaaucgauggagaauacagauugcggggugaagcacgaaagacauuuguugaauugaugagacggggagaccuuccuguauggcuaucuuacaaaguugccucagaaggauuucaguauagugaccgaagauggugcuuugauggggagcguaauaaccagguauuggaagaaaacauggacguagaaauauggaccaaggaaggagaacgaaagaaguuaagaccacguugguuagaugcucggaccuacucagauccucuagcacuccgggaauuuaaggaguucgccgcgggaaggagaucugugagcggugauuugauccuugaaauuggaaaacuuccacaacaucucacgcaaagagcgcaaaaugcucuggacaaccucguaaugcuucacaauucggaacaaggagguagagcuuaucgacacgcuauggaagaguuaccugacacuauugaaaccuuaaugcuacuugcacugauugcaguccucaccggaggggugaccuuauuuuuccuauccggaaggggucuugguaaaacuucgauagguuuacuaugugugauggcuuccagugugcuacuauggauggcaaguguggaaccgcauuggauagcagccucaaucauccuugaguucuuccuuauggucuuguugauuccggagccagacagacagagaacuccucaagacaaccaguuagcauauguuguuaucgguuugcuauuuaugauucucacaguugcugccaacgagaugggguugcuugagacaacgaagaaagaucuaggaauugggcacguggcgguaggaaaucaccaucaugcagcuaugcucgauguagauuuacauccagcuagugcauggacauuauaugccguugcgaccacaauuauaaccccaaugaugagacacacgauugagaauacaacggcaaauauuaguuugacggcgauagccaaucaagcagcgauacugauggguuuggauaagggauggccuauuagcaaaauggacaucggcguuccguuacuugcacuugguuguuauucucaagucaauccauuaacucugacugcugcaguacugaugcucguugcacacuaugcgauaauaggcccuggucugcaagcgaaggcaacucgagaagcacagaaacggacggcagcuggcauuaugaaaaacccaaccguagaugguauagucgcuaucgaucuagacccuguuguauaugaugccaaauucgagaaacagcugggacagauaauguuacuuauacuaugcacaagccaaaucuuauugaugagaacaacaugggcuuuaugcgagagcauaacuuuagcaaccgggccguugacaacgcuaugggaaggaucaccggguaaauucuggaauacaacuauagcgguguccauggcuaacauuuucagaggaucuuaccuagccggugcaggcuuggccuucaguuuaaugaaaaguuuaggaaggggucgaagaggcacuggagcacaaggggaaaccuuaggagaaaaauggaaacgacaauuaaaccaauuaucaaaaucugaauuuaauacuuauaaaaggucggguaucauggaaguagacagguccgaagccaaggaaggacugaaaagaggugaaacuacgaaacaugcgguuagucgaggaacagcaaaauuaagaugguuuguagagaggaaucuuguaaaaccugaaggaaaaguaauugaucuaggauguggaagagggggauggagcuacuacugugcuggacugaagaaagucacagaaguaaaagguuauacgaaaggagguccaggacaugaagaaccaauaccaauggcuacuuacggcuggaauuuaguaaaauuacauucagguaaggauguauuuuucauucccccggaaaaaugugauacauuauugugugauaucggagagaguucacccaauccuacuauugaagaagguagaacgcucagagugcuuaagaugguggagcccuggcuuagagggaaccaauuuuguaucaaaauuuuaaauccauauaugccuaguguaguagaaacauuagaacaaaugcaaaggaagcacggagguauguuggugcgaaauccauugagcaggaauaguacucacgaaauguauuggguguccuguggcacugggaauauaguuucggccguuaauaugacuagccggauguuacugaacagauuuaccauggcacauagaaaaccuacauacgaacgugauguagauuuaggagcuggaacuaggcauguagccguagaaccagaaguugcgaauuuagauauaauaggccagaggaucgaaaauauaaagcacgaacacaaaucaacguggcauuacgacgaagacaacccuuacaaaaccugggcauaucacgguuccuaugaaguaaaaccgagcggaucugcaucuaguaugguaaacggaguuguuaaacuucucacuaaacccugggauguuauuccuaugguuacucaaauugcaaugacugacacuacgccguuuggucaacaaagggucuucaaagaaaaaguggacacgagaacaccuaaagcaaaacggggcacagcacagauaauggaaguuacugcgaaauggcuauggggauuucuaagcagaaauaagaaaccaagaauauguacgagggaagaguuuacucguaagguaagaaguaaugcggcaaucggcgcaguguuuguugacgaaaaucaauggaacucugcgaaagaggcgguagaagacgaaagauuuugggaucugguacauagagaaagagaacuacauaagcaaggaaaaugugccacaugcgucuauaauaugaugggaaaaagagagaagaaauuaggugaguucggcaaagcuaagggcucccgcgcaaucugguacauguggcuuggcgcaagauuccuugaguuugaggcuuuaggguuuaugaaugaggaccauugguucucucgagagaacucauuaucuggaguugaaggagaaggcuuacauaaauuaggcuacauacuacgagacauuagcaaaauaccugguggaaauauguaugcagaugauacagcgggaugggacacaaggaucaccgaagaugauuuacagaacgaagcgagaauaacggauauaauggaaccagaacaugcacuacucgcuaaaucaauuuucaaacuuacauaccaaaauaagguaguacguguacaaaggccggcaaagaauggaacagugauggauguuauuucgcguagagaucagcgaggcaguggucaaguagguacauauggauuaaauacguucacaaacauggaagcucagcugauaaggcaaauggagucggaaggaauauuuucuccuucggaauuggaaacgccuaaucuagcagaacggguccuagacuggcuugaaaaauauggaguggaaagauuaaaaagaauggcuaucucaggugacgauugugugguaaaacccauugaugaucgguuugcaacagcauugacagcacuaaaugacaugggcaaagugcggaaggauauaccucaaugggagccgucgaaaggcuggaaugauuggcaacaaguaccguucuguucucaccauuuccaccaauuaauuaugaaggauggaagagaaauugucguuccuugucguaaucaagaugaacuggucggucgcgcaagaguaagucaaggugcugguuggaguuuacgcgaaacagcauguuuagggaaauccuaugcacaaauguggcagcuuauguauuuucacagacgagaucuaagguuagccgcuaaugcuauuuguucugcaguaccaguagauuggauuccaacuagccgcacaacuuggaguauacacgcgcaccaccaguggaugacgacagaggacaugcuaucaguuuggaaucguguguggauagaagaaaacccauggauggaagauaagacccacauauccucauggggagauguaccauaucuugggaaaagagaggaccaauggugugguucauuaauaggguugacagcacgugcuacgugggcaacaaacauucaagucgcuaucaaucaggugcguagacuaauuggaaacgagaacuaucuagauuacaugaccaguaugaaacgcuucaaaaacgaaagugacccagagggcgcuuuaugguga

SEQ ID NO: 21217 - RNA, 9879 nt, Artificial Sequence
  derived and/or modified CDS sequence (opt6) from DENV-1__HM181950__SS-prME
agcguaacaaugcuacuaauguuaaugcccacagcacucgcauuccaucuaacgacucgagguggagaaccccauaugauugugucaaaacaagaacgugggaaaagucuacucuucaaaacgucagcugguguaaauaugugcacuuuaauagcaauggaucuuggggaacucugcgaagauacaaugacauauaaaugcccacguauaacggaagcagaaccagaugauguggauuguuggugcaacgcgacggacacgugggucacauaugguacuuguucgcaaacuggagaacauagaagggauaaaagaagcguugcacucgcaccacacguaggguugggcuuagaaacaagaacagaaacauggaugaguucagaaggagcauggaaacagauacaaagaguagaaacuugggcacugaggcauccaggauuuacggucaucgccuuauuccuagcgcaugcgaucggaacaaguaucacacaaaaaggaauaauuuucauucuacuuaugcuaguaacaccgagcauggcuaugcgcuguguagguauaggaucccgagacuuuguagaaggcuugucuggagcaacaugggucgacguaguuuuggaacacggaucuuguguaacuacaauggcaaaagauaaacccacccuagauauagaacuguuaaaaaccgaggucacaaauccagccauauuaaggaaacucuguauagaagcgaaaauuucuaauacaacgacugauucucgaugccccacucagggggaagcaacucuuguagaagaacaggaugccaauuuuguuugucgccguacuuuuguggauagaggauggggaaauggauguggcuuguuuggcaaaggcucucuuauuacaugugccaaauucaaaugcgucacuaaacuagaagggaaaauaguucaauaugaaaauuugaaauauaguguaaucguuacaguacacacuggggaucagcaccaaguagggaacgaaaguacagaacauggaacaacagcaaccauuacgccccaggcaccuaccacugagauacagcugacagacuacggagcucuaacacuagauuguucuccacgcacaggauuggauuucaacgaaaugguccuacuuacaaugaaggaaaaaucguggcuaguccacaaacaaugguuucuggauuugccguuaccauggacaucaggcgcaucaacaucacaggaaacguggaauagacaagauuuauuggugacauucaaaacggcccacgccaagaaacaagagguggugguccuagggagccaggaaggagcaaugcauaccgcgcuaacaggagcaacagaaauacaaacaaguggaacgacaacaauauuugcaggacacuuaaaaugucguuuaaaaauggacaaacuaacucugaaagggaugagcuauguuaugugcacaggaucuuucaaauuagagaaggaagucgcagagacucagcauggaacugucuuaguacaaauaaaguaugaggggaccgacgccccaugcaagaucccuuucaguacgcaagaugaaaaaggagucacucagaacggcagacuuauaacagccaauccaauugugacagacaaagaaaagccuguuaauauagaagcugaaccacccuuuggcgaaagcuauauaguuauuggagccggagaaaaagccuuaaaguugaguugguuuaaaaagggcaguucaaucggcaaaauguucgaggccacggcacgaggagcgagaagaauggcuauucuuggggauacagcuugggacuuuggaaguauuggaggcguauuuacaucugucgguaagcuaguucaucaaaucuuuggagcugcauacggagugcucuuuucggggguuagcuggacuaugaaaauugggauuggaguuuugcuuacuugguuaggcuuaaacucucgaucaacaagucuaagcaugacguguauagcugucggauugguaacccuguauuuaggcguaaugguucaggcagauucugguugcguaauuaauuggaaggggcgagaauugaaaugcggaagcggaauuuucguaacaaaugaaguacacacauggacagaacaauauaaauuucaagcagauucgccuaaaagguuauccgcugcaauagggaaagcgugggaagaaggaguuugcgggauaagauccgcaacuagauuggaaaacauuauguggaaacaaaucaguaacgaacuaaaccacauauuacuugagaaugauaugaaauuuacaguagucgucggugauguagcgggaauauuggcucaaggcaagaaaaugauccgcccacaacccauggaauacaaauauagcuggaagucaugggguaaagcaaaaauaaucggagcagacguccaaaauacaacauucauuauagauggucccaauacucccgaaugucccgaugaccaaagggcauggaauauaugggaagucgaagauuaugguuuuggcauuuuuaccacuaauaucugguuaaaauugagggacucguauacacaaguuugugaccaccgauuaaugucagcggccauuaaggauaguaaagcuguacaugcagauaugggguacuggaucgaauccgagaaaaaugaaacuuggaaacuugcacgagcaucuuuuauagagguaaagaccugcauauggccaaaaucacauacacuaugguccaauggcguauuggaaucagaaaugauaauacccaagauauauggagggccuauuagccaacauaacuauagaccagguuacuuuacacaaacagcaggaccuuggcauuuaggcaaguuagaauuagauuucgacuuaugugaaggaacuacagugguaguggaugaacauugcggcaaccgggggccuagccuaagaaccacgaccguuacagguaaaaucauacaugaaugguguugcaggucgugcacauuaccuccacuacgauucagaggcgaagacggaugcugguacggcauggaaauaagaccggugaaagaaaaagaagaaaaucugguuaaaagcaugguaucugccggguccggcgaaguugacagcuucagcuuaggacuacuuugcauaucaauuaugauagaagaaguuaugagaucaagguggucgagaaaaauguugaugacggguacgcuagcgguuuucuuauuauuaaucaugggucaauuaaccuggaaugaucugauuagguuauguauuaugguuggggccaaugcaucagaccggauggguaugggaacuacauauuuagcccuaauggcaaccuucaaaaugaggccuauguuugccgucggucuacucuucaggagauuaacuucaagagaaguauuacugcucacgauuggucuuuccuugguagcaucaguugaauugcccaacucauuggaagaauugggcgacgguuuagcuaugggaauuaugauacuaaaguuauugacggacuuucagucucaucagcucugggcuacauuguuaucguuaacuuucauaaaaacaacauuuucacuacauuacgccuggaagaccauggcaaugguacuaagcauugucagcuuauucccacugugcuuauccacuacaagccaaaagacaaccuggcuaccagucuuauuagggagccugggauguaagccuuuaaccauguuucuaauugccgaaaauaagaucuggggaaggaggucauggccuuuaaaugaaggaauaauggcagucggaauaguuucuauauuguuaucaucacugcuaaagaacgaugugccuuuagccgguccucugauagcaggagguaugcuaauagcguguuacguuaucucuggguccucugcugaccuaagucuagagaaagcagcagaaguuaguugggaggaagaagcugaacauucgggugcuagccauaacauccugguggaaguccaagaugacgguacgaugaaaauuaaagaugaagaacgagaugacacacuuaccauauuauuaaaagcaacucuucuugcgguuucaggagucuacccuuuaucaauccccgcuacauuauuugugugguauuucuggcagaagaagaaacaacguagcgggguucuaugggauaccccuucaccacccgaaguagagcgagcaguuuuagacgauggcauuuaccgaauaaugcaacgaggauuacuggguagaagccaaguaggaguagggguuuuucaggaaaauguguuucacacaauguggcacguuacuaggggagcaguucuaauguaccaagguaaaagauuagaaccauccugggccucagugaagaaagaucucauaucguacgguggaggauggagguuacaagguagcuggaacacaggagaagaaguucagguaauagcgguagaaccaggcaaaaauccaaagaaugugcaaacagcaccggguacauuuaaaacaccugaaggagaggugggggcuauagcguuagauuuuaaaccagguacaucagggaguccaauuguuaauagggagggcaagauuguuggauuauauggcaacggagugguuacaacaucagggacuuauguuucggcgauagcccaagcaaaagcuagccaagaaggaccguuaccagaaauagaagaugaaguuuuuagaaagagaaaccucacuauuauggaccuacaucccggaagcgggaaaacucggagguacuuaccggccauuguuagagaagcgaucaaacgaaaacuacguacacugauucuggcucccaccagggugguggcaagcgagauggccgaggcccuuaaaggaaugccaauacguuaucaaacuacugcaguuaaguccgaacauacaggaaaagaaauaguugacuugaugugccacgccacguuuacuaugcgacucuuaucaccaguuaggguucccaauuauaacaugauaauaauggacgaggcccacuuuacugauccgucaagcauagcugcaagaggauauaucagcaccagaguaggaaugggugaagcugcagcuauauuuaugacugcaacaccuccugguucaguugaagccuuuccgcagaguaacgcaguuauacaggaugaagaacgugacauaccugaacgaucauggaacuccggguacgaauggauaaccgauuucccugguaagacaguaugguuugugcccucgauaaaaaguggaaaugauauagcaaacugucugagaaagaaugggaaacgagucauacagcuauccagaaaaacauuugauacggaauaucaaaagaccaaaaacaaugauugggacuauguggugaccacagacauaucagaaaugggagcuaauuuucgugcagacagaguaauugaucccagacguugucuaaaaccugugauauuaaaggacggcccugaaagagugauacuagcuggaccaaugccugucacgguggcuagugcagcucaacgccgcgguagaauuggaagaaaccauaacaaagaaggagaucaauauauauacaugggacagccacucaauaacgaugaagaccaugcccauuggaccgaagcaaaaaugcuacuugacaauauaaauacaccggaggguauuaucccagcauuauucgaaccggaacgagagaaaucugcggcaauugauggagaguauagacugagaggggaagccaggaaaacauucgucgaauuaaugcguaggggagauuuaccaguuuggcuaucuuauaaaguggcaucugaaggcuuucaauauucggacagacgguggugcuucgauggagaacguaauaaucaaguauuagaggagaauauggacguagaaauauggacuaaggagggggaacguaagaaacuaaggccccguuggcuggacgcaaggacuuacucagacccucuagcucuuagagaauuuaaagaauuugcagcaggucggagaucuguaaguggggaccuuauucuagaaauaggaaagcuaccacaacauuugacucaacgugcacaaaacgcacucgacaaucucguuaugcuacauaauagugaacaaggaggccgugccuauagacacgccauggaggaacuaccagacacaauugagaccuuaaugcuauuagcuuugaucgcagucuuaacuggagggguaacccuauucuuucuuaguggacgugggcuagguaaaacuucaauaggacuguuaugcguuauggcuucuaguguguuacuguggauggcgucaguagaaccccauuggaucgcugcaucaaucauuuuagaguucuucuuaaugguacugcuuauaccagaaccagacaggcaaaggacgccccaagauaaucaacuugccuaugucguaauagguuuacuuuucaugauccuuacagucgccgcaaacgaaaugggauugcuagaaacaaccaagaaagaccuuggcauaggacauguggcgguagguaaccaucaucaugccgccaugcuggauguagaucuacacccugcuuccgcauggaccuuauaugcgguugcaacuacaauaauaacaccuaugaugcgucauacaauugagaacacgacagcaaauauaucucuaacagcgauugcaaaccaagcagcaauccuaauggguuuagacaaaggauggcccauuaguaaaauggacaucgguguuccauuguuagccuuaggauguuacucgcaaguuaauccucugacauuaacagcggcuguacucauguuagucgcacauuaugcaauaauaggaccaggccuucaggcaaaagcgacaagagaggcccaaaaacgcacugcagcuggaauaaugaagaauccuacugucgacggaauuguagcuauagaucuggauccagucguguaugacgcuaaguuugaaaaacaguugggccaaauuaugcuucuuauccuuugcacaucccaaauucuacuuaugcguacaacuugggcguuaugugaaucgauuacauuagccacgggaccacucaccaccuuaugggaaggaucuccugggaaauucuggaauacaacaauugcaguaaguauggccaauauauuuagaggaagcuaccucgcaggcgccggccuugccuucuccuuaaugaaaucacucggaggcggccgacgcggcacgggcgcacaaggagaaacacuaggggaaaaauggaaacgacaauuaaaucaacuaagcaaauccgaauuuaauaccuauaagagaucaggcauuauggaaguggacagauccgaagcuaaggaagguuuaaaaagaggugagacuaccaagcaugccguaucgcggggaacagcuaaauuaagaugguuugucgaaagaaacuugguuaaaccugagggcaaaguuaucgacuuagguuguggacgaggaggaugguccuauuauugcgcaggauuaaagaaaguaacggaggugaaaggauauacaaaaggagggcccggacaugaagaaccuauaccuauggcaacauacgguuggaaucuaguuaaacuccauuccgggaaagacguauucuuuauuccuccagaaaaaugcgacacacuacuaugcgauauaggggaaucaucuccuaacccuacgaucgaagaagguagaacacuaagaguauuaaaaauggucgaacccuggcugagggguaaucaauucuguauaaaaauacuaaaccccuacaugccaagugucguugaaacacuugaacaaaugcagagaaaacacggcggaauguuaguucgaaauccuuugagucgcaacaguacacaugaaauguauuggguuucauguggaacaggaaauauaguaagugcagugaauaugacguccaggaugcugcucaauagguucacaauggcacaucgcaaaccuacauacgagagagacguagaccuuggagcugguacacgucauguugcaguugaacccgaaguggcgaaccuagauauuauagggcaaaggaucgaaaauaucaaacacgaacacaaaucgacauggcauuaugaugaggauaaccccuacaaaacaugggcauaucauggaucguaugaagucaaaccaucuggaagugcaucuucaaugguuaacggcguaguuaaauuacuaacaaaaccgugggauguaauaccaaugguuacacaaauagcgaugacugauacuacgccguuuggucaacaaagaguauuuaaagaaaagguagacacaaggacaccuaaagcuaaacgugguacugcgcaaauuauggaaguaacagcaaaauggcuuuggggauuucuuucaaggaacaagaagccaagaauauguacuagagaagaguucacgcgcaaaguucgaucaaacgcugcgaucggugcaguauuugucgacgaaaaccaguggaacagcgcuaaggaggcagucgaagaugaacgauuuugggaucuagugcauagagaaagggaacuacauaagcaaggaaaaugugcaacaugcguauauaauaugaugggcaaacgugagaagaaacuaggggaguuugguaaagccaagggaagucgggcaauaugguauauguggcucggugcaagguuuuuggaauuugaggcucuaggauuuaugaaugaagaccauugguuuucaagagaaaauagccuaucaggcguagaaggagaaggacuacauaaauuagguuacauuuuacgagauauaucaaaaauaccuggaggaaacauguaugcagacgacacagcaggcugggauacuagaauuaccgaggacgaccuacaaaaugaagcacgaaucacugacauuauggaaccagaacacgcuuuacuugcuaaaucuauuuucaaguugaccuaucaaaacaaagucguccgggugcaacgccccgccaaaaaugguacuguaauggauguaauaagccgaagggaucagaggggaagcggacaaguaggcacuuacagcuuaaacacauucacuaauauggaagcacaacucauacgacaaauggaaagugagggaauauucagcccguccgaauuagaaaccccgaauuuagcagaacgaguacuagauuggcuagaaaaguacggaguugagagacuuaaaaggauggccauaaguggugaugacugcguugucaagccuauagaugaccgauucgcaacagcacugaccgcccugaacgauaugggaaaaguaagaaaggauaucccgcaaugggaaccgaguaaaggauggaaugauuggcagcaaguaccuuucugcucacaucacuuccaccagcuaauuaugaaagacggaagagaaauaguaguucccugucguaaccaagaugaacuuguagggagagcacgaguaagucaaggagcgggauggucuuugagagaaaccgcaugcuuaggaaaaagcuaugcucagauguggcagcuaauguacuuucacagaagagauuuacgacucgcugcaaaugcuaucuguucggcaguuccagucgacuggauacccacgagucggacaacuuggagcauucaugcucaccaccaguggaugacgaccgaagacauguugagcguuuggaaccgcguauggaucgaggaaaacccguggauggaagacaaaacucauauaucaaguuggggugauguccccuacuuggggaagcgcgaagaucaauggugugggucacugaucggccucacugcaagggcuacaugggcaacuaacauacaaguagcaauuaaccagguucguagacugauuggaaacgaaaauuaccuagauuauaugacaucgaugaaacgauuuaaaaacgaaucugacccagaaggagccuugugguaa

SEQ ID NO: 21218 - RNA, 9879 nt, Artificial Sequence
  derived and/or modified CDS sequence (opt6) from DENV-1__HM181952__SS-prME
aguguuacuaugcuacuuauguugaugcccacugcacucgcuuuccaccuaacaacacgagguggugaaccacacaugaucgugagcaaacaagaaagaggcaaaagccugcucuuuaaaacaucugcuggcguaaacauguguacauugauagcuauggaucucggagaauuaugugaagacacaaugacuuacaaauguccacgcauuacugaagcagaacccgacgauguagauuguugguguaaugcaacagauacauggguuacguauggaacguguagucaaacaggcgaacaucguagagagaaaagaucaguggcauuggcaccccauguugguuuaggucuagaaacucgaacagaaacguggaugucgagugaaggagcauggaaacagauucaaagaguggaaacaugggcgcuaagacauccagguuuuaccguuauagcuuuauuucuagcacaugcuauugggacaagcauaacacaaaaaggaauaauuuuuauacuauuaauguuaguuacaccuucuauggcaaugagguguguagggauuggcucuagagauuuugucgaagguuugaguggcgcgacuuggguugauguuguacuggaacauggaaguuguguaaccacaauggcaaaagauaaaccaacucuagacaucgagcugcuuaaaacugaaguaacaaacccagcgguacuaagaaaauuaugcaucgaggcaaaaauuuccaacacaaccaccgauagccguuguccuacacaaggagaggcuacguuaguagaagaacaagacgcuaacuuugugugcaggcgcacauuuguagacagaggguggggaaacgguuguggucuuuuuggaaaaggcagcuuacuaacuugcgcaaaauuuaaauguguaaccaaacuugaaggaaaaaucguacaauacgaaaaccuaaaauauagcgucauuguuacgguucauacaggagaccaacaucagguaggaaacgaaaguacagagcauggaaccacagcuacuauaacuccucaagcaccuacaacugaaauacaauugacugauuacggggcccuuacacuggacuguucuccuagaacugggcucgacuucaaugaaaugguucuucugacaaugaaagagaaaagcuggcuaguucauaagcaaugguuucuagaucugccacuaccuuggacuucaggugcuucuacaucucaagaaacuuggaaucgacaagaucucuuagugacauuuaaaacagcccacgccaagaaacaagaaguugugguauugggcagccaggaaggcgcuaugcauacagcacuuacuggugccaccgaaauacaaacaucaggaacaaccaccauauuugcaggccacuugaaaugcagauuaaaaauggauaaauuaacacugaaagguaugucguacgugaugugcacaggaucauucaaauuagaaaaggagguagcggaaacccaacauggcacuguucuaguacaaauuaaauaugagggcacagaugcuccaugcaaaauaccauuuaguacucaggaugaaaaggguguaacacagaacgguagacugauaacagcaaauccaauugucacugauaaagaaaaaccaguuaauauugaagcagaacccccuuuuggcgagucauacauuguaauaggggcaggggaaaaagcguuaaaauuaaguugguucaagaaaggcucgucuauugguaaaauguuugaagcuaccgcaagaggggcuaggagaauggcuauccuaggggauaccgcaugggauuuugggaguauaggcggcguuuuuacgucugucggcaaguuaguacaccaaauauuugguacagcguauggaguacuguuuucaggagugagcuggacaaugaaaauuggaauaggcguccuauuaaccugguuaggauuaaauucaagaaguacgucauuaaguaugaccuguauugccgucggucucgugacacuuuaccuaggaguaaugguacaggcggacaguggaugcgugauuaauuggaaaggacgagaauuaaaauguggcaguggaauauucguuaccaacgaaguacauacauggacagaacaauauaaauuucaagcagacuccccaaaaagacugucagccgcaauagggaaggcaugggaagaaggugucugcggcauaagaagugcaacacggcuugagaacauaauguggaaacaaauuucgaaugaauuaaaccauauauuauuggaaaaugauaugaaauuuacuguuguuguaggugauguagcgggaauuuuaguacagggaaagaagaugauacguccucaaccgauggaguacaaauacucauggaaaucguggggaaaagcaaagauaauaggugcugaugugcaaaauagcacauuuauaauagaugguccaaauacacccgaauguccagacgaucaacgagcguggaauauuugggaagucgaagacuacggguuuggaauuuuuacgacaaauauaugguugaaauuacgagauucguauacacagguaugugaccauagguuaaugagugcugcaauaaaagacucaaaagcuguacacgcugauauggguuacuggaucgaauccgagaaaaacgaaacauggaaacuugcaaaggcaucguucaucgagguaaaaacaugcauuuggccaaaaagccauacccuauggucuaaugguguacuagaaucggaaaugauuauaccaaaaauacacggaggaccaauuucgcagcacaauuacagaccagguuacuuuacccaaaccgcgggacccuggcauuuaggaaaacucgagcucgacuuugaucuuugcgaaggaacuacugucguaguggacgaacauugcggaaaucgaggaccgaguuugaggacaacuaccgugacgggaaagaucauacacgaaugguguugcaggucauguacacugccaccauuaagauuccguggugaggauggcuguugguaugguauggaaauacgaccaguaaaagaaaaagaagaaaaccugguaaaaucuauggucagcgcuggcaguggggaaguugauucuuuuucuuuaggauugcuuugcauaucaauaaugaucgaagaagucaugaggucuagauggagccgaaagauguuaaugacuggaacauuagcaguauucuuuuuauuaauaaugggccaauuaacuuggaaugaccuaaucagauuauguauaauggugggugcaaacgcuuccgaucgaauggggaugggaacuaccuauuuggcacugauggcaacguuuaaaaugcgaccgauguuugcaguaggcuuacuauuucgucgccuaacaagccgcgagguucuauuauuaacuauaggacuauccuuagucgcaucaguggaacuuccgaacuccuuagaagaacugggugauggucuagccauggguaucaugauccuaaaguuauuaacagacuuucaaucauaucagcugugggccacgcuuuugucucuaacuuucaucaaaaccacguuuuccuuacauuacgcuuggaagacgauggccaugguacuuagcauuguaucacucuuuccguuaugucuaagcacgacuucucagaaaacgaccuggcuuccaguucugcuaggaucgcuaggcugcaaaccauuaacgauguuuuuaauagcagagaacaaaauauggggaaggaaauccuggccuuugaaugagggcauuauggcuguaggaauaguaaguauucuacuuucgucucuucuaaagaacgauguuccauuagccggaccucuaaucgcgggaggcaugcuuaucgcaugcuacguuauuuccggauccucagcagaccuauccuuggaaaaagcagccgaaguaucuugggaagaagaggcagaacauaguggugcaagccauaauauauuagucgagguacaggaugacggaacgaugaaaauaaaagacgaggaaagggaugauacucuaaccauuuuacuuaaggcgacccugcuggcaguaucagggguguauccucuaaguauuccagcuacacuuuucgucuggcauuuuuggcagaagaagaaacaaagaucagggguauugugggauacaccuaguccaccugaggucgagcgagcggucuuggacgacggaauauauagaauuaugcaaaggggacucuuagggagaagucaaguugguguaggaguauuccaggaaaacguauuccacaccauguggcacguaacucguggagcuguucuuauguaucaagguaaacgcuuagaaccgaguugggcaucggugaaaaaggaccuaauuagcuaugguggaggguggcgcuuacaaggaaguuggaacacuggagaagaaguucaggucauugcaguugaaccugguaaaaacccuaaaaaugugcaaacggcgccggggaccuuuaaaacacccgaaggagaaguaggugcuauugccuuagauuuuaaaccagguacuuccgggaguccuauaguaaaucgagaaggcaaaauaguuggacuauauggcaacgguguagucaccacaaguggaacauacgucucagcaaucgcucaggccaaggcaucacaagaaggaccucucccugagauagaagacgagguguucagaaaacgaaaccuaacaauaauggaccuucauccugggaguggaaaaacacgacguuaucuaccagccauaguuagggaagcaauaaaaaggaagcuacguacucuuauccuugcaccaacaagagugguagcuagugaaauggcagaggcgcuaaaagguaugccaauucgguaucaaacaacugcagucaaaucugagcauacaggaaaggaaauuguugaucuaaugugucacgcaacguuuaccaugcgucuucucucaccaguacgagucccuaauuacaauaugauuauuauggaugaagcccauuucaccgacccaagcagcauugcagcucgggguuauaucucaacucgaguugguaugggggaagcagcggcuauauuuaugaccgcaacgccuccagggucgauggaggcguuuccccaaucuaacgcgguaauacaggaugaagaacgcgacauucccgaaagaucguggaacuccggauaugaauggaucacggacuuuccagguaaaacaguuugguucgugccaaguaucaaagccggcaacgauauagcaaauugccuacgcaagaauggaaagaggguuauacaauuauccagaaagacuuuugauacagaauaccagaagaccaaaaauaacgauugggacuaugucguaacuacagauauauccgagaugggggccaauuucagagcggauagaguaauagaccccaggagauguuuaaaaccaguaauacuaaaggauggaccugaacgcgucauccuugccggacccaugccagugacggucgcuagugcggcacaacgcaggggccgcauaggaagaaaucacaauaaagagggcgaucaauacauauauaugggucaaccauuaaauaaugacgaagaucaugcgcauuggacugaagcuaaaaugcuuuuagauaacauuaauaccccugaaggcaucauaccugcacuauuugagccggagagggagaaaagcgcagcuaucgauggggaauaucgacugagaggugaagcaaggaaaacauuuguugaauuaaugcgacgaggugauuugccaguauggcugagcuauaagguggcuucagagggauuccaauauagugaccguagaugguguuuugacggagaaagaaauaaccagguauuggaagaaaauauggauguagagauauggacaaaggaaggugaaaggaagaaauuacgaccaagaugguuggaugcacguaccuauucagacccccuugcucuaagagaauuuaaggaauuugcugcaggucgacgcuccguuucuggugauuuaauucuagagauuggaaaguugccccagcaucugacucaacgcgcucagaacgcauuggauaaucuuguaaugcuacacaauucagagcaaggugggagagcauauagacaugcuauggaggaauugccagacacaauagaaacauuaaugcuuuuagcucucauagcaguauugaccggagggguaacauuauuuuucuugucaggcaagggcuuaggcaaaacgucuauagguuuauuaugugugauggccaguucuguacuacuguggauggcgucugucgaaccgcauuggaucgccgcuagcauaauucucgaguucuuucugauggugcuguuaauaccugaaccugauagacagcgcacaccucaagacaaccaacuugcguacguugucauaggccuccuuuuuaugauacuaacaguggcggccaaugaaaugggacuuuuggaaaccacaaagaaagaucugggaauaggccauguagcuguugaaaaccaccaucaugcugcaauguuggauguagauuuacauccugcuagugcguggacuuuauacgccguggcuacuaccauaauaacaccaaugaugagacauaccaucgaaaauacaacagcuaauauaucuuugacggccauagcaaaccaagcugccauacuuaugggccuagacaaaggcuggccaauaagcaaaauggacauagguguaccauuacuagcuuuaggcuguuacagucagguuaacccucugacuuugacugcggcuguuuuaauguuaguagcacauuacgccauuguuggacccggcuuacaagcaaaagcaacucgagaagcucagaaaagaacagccgcaggcaucaugaagaauccaacuauagauggaauaguugccauagaccuggauccagucguuuaugaugcaaaauuugaaaaacagcuuggucagauuaugcuuuugauucugugcacaagucaaauacuacuuaugaggacaacuugggccuugugugaaucaauaaccuuagcaacuggcccauugacgacucuuugggaaggcagcccgggaaaauuuuggaacacuacaauugcugugagcauggcaaauaucuuucgugguucauacuuggcaggcgcuggacuagcuuucucguuaaugaaaucccuaggcggcgguagaagggguacaggggcacaaggcgaaacgcuaggagaaaaauggaaacgacaacuaaaccaauuaucaaaaagugaauuuaacacauacaaaaggagcgguauaauggaaguagaucgaucggaagccaaagaaggucuuaagcgcggagaaacuacuaaacaugccguaaguagggguacugcgaaacuaagaugguucguagaaagaaauuuaguuaaaccagagggcaaaguuauagaucucggaugugggcgagggggaugguccuacuauugugcaggucuaaagaaagucacugaagucaaaggauauacaaaagggggaccuggacacgaggaaccaauaccaauggcuacauacgguuggaaucuuguaaagcuccauuccgggaaggacgucuucuuuauaccgccagaaaaaugugacaccuuauugugugauauaggugaaucgaguccgaacccaacgauagaagaaggacgaacuuugcguguacuuaagaugguggaaccuugguuaagaggaaaucaauucuguauaaagauacugaacccauauaugcccucuguaguagaaacauuagaacaaaugcaacgcaaacaugggggaauguugguucgaaauccgcugucuagaaauuccacacaugaaauguauuggguaaguugcgggacuggaaacauaguuuccgcagucaauaugacaucuagaaugcuuuuaaauagauucacgauggcccaccgaaagccgacauaugaaagggacguagaucuaggagcuggcacgagacacgucgcaguugaaccggaaguugcuaaccuagacauaauugggcagcguaucgaaaacauuaaacacgaacauaaaaguaccuggcauuaugaugaagacaaucccuacaagacaugggccuaccacggaaguuaugaagugaaaccgagcgguucagccagcucuaugguaaacgggguaguaaaacugcuuacuaaaccaugggacguaauaccuaugguaacucaaaucgccaugacugauacgacaccauuuggacaacagcggguauuuaaagaaaaagucgauacaagaacuccuaaagcaaaaagagguaccgcgcaaauuauggaggucacggcucgauggcuauggggauuccucucuagaaacaagaaaccaagaauauguacacgugaagaguucacuaggaaaguccgaucaaacgcggccaucggagcgguauuuguugaugaaaaucaauggaauagcgcgaaagaagcuguugaagacgaccgauucugggaccucguucaccgcgaacgagaguuacacaaacaaggcaagugugcgacauguguguauaacaugaugggaaaaagagagaagaaauugggcgaguucgguaaggcuaaagguaguagagcaauuugguauauguggcuuggugcaagauuccuagaauuugaagcguugggcuuuaugaaugaagaucauugguuuaguagagagaacagccuuagcgggguugaaggagaaggacuacacaaauuaggauacauucuaagagauauuaguaagauaccaggaggcaacauguaugcagacgacacagcggguugggauacucguauuacggaagacgaucuccaaaacgaagcuaaaauaacagacauaauggaacccgaacaugcuuuacuugcaaaaucaauauucaaguuaacuuaccaaaacaaagucguacgcguucagcguccugccaaaaacggaaccguuauggaugugaucagucgcagggaucaacgagguaguggucaagucgggacguacggauuaaauacauucaccaauauggaggcucaacuaauucgacaaauggagagcgaaggaauauuuuuaccaaaugagcuagaaaccccaaaucuugcugaacguguucuagauugguuagagaaguaugguguugaaagacuaaaaagaauggcaauaagcggagaugauugcgucguuaaaccaauugacgauagauucgcuaccgccuuaaccgcucuaaaugacauggggaaagugcggaaagacauuccacaaugggaaccgucgaaagguuggaaugauuggcaacaagucccguuuuguagccaucauuuucaccaacuaaucaugaaagauggccgagaaauagucgucccuugcagaaaccaagacgaacuugucgguagagcgcgcgucucgcagggagccggauggagucucagagaaacugcuuguuuagguaaaucguaugcucaaauguggcaguugauguacuuucaccgacgcgacuuacgucucgcagccaacgcuauuugcuccgcaguaccaguagacuggguaccuacaaguagaacaacuuggagcauacaugcacaccaccaauggaugacaaccgaagacauguugucaguuuggaacagaguuuggauugaggagaauccuuggauggaagacaaaacacgaauaucauccugggaagacguuccguaucuaggaaaaagggaagaucaauggugcggaucacucauaggccuuaccgcgcgcgcgacgugggcaacaaacauucaaguagcaaucaaucaaguaagaagauuaauaggcaaugagaacuauagugacuacaugacuucuaugaaacguuuuaaaaacgaaucagagccggaaggggcgcuaugguaa

SEQ ID NO: 21219 - RNA, 9879 nt, Artificial Sequence
  derived and/or modified CDS sequence (opt6) from DENV-1__HM181953__SS-prME
ucaguuacaauguuauuaaugcuuaugccuacggcccuggccuuucauuuaacaacucggggaggugaaccacauaugauagucagcaaacaagaaaggggaaaaucacuuuuguuuaaaacgucugcggggguuaacauguguacauuaauagccauggaccuuggugaauuaugugaagacacgaugacauacaaaugcccgcgaauuacugaagcugaaccagaugauguggauugcugguguaaugccacugauacuuggguaacauaugggacguguucccaaacaggggaacaucgcagagacaaaaggagcguggcgcuagcuccucacguggguuuaggacuagaaacuagaacagagacguggaugucuagcgagggugcauggaaacaaauucaaagaguugaaacaugggcguuaagacauccugguuucacaguaauugcacuauucuuagcacaugcgauaggaacaaguauaacccaaaaaggaauuauauuuauccuuuugaugcuagugacgccaucuauggcaaugagauguguaggaauaggaucgagagauuuuguagaagguuuaucaggugccaccuggguagaugugguguuagaacauggcucuugcguuacaacaauggccaaagauaaaccaacuuuggacauagaauuauuaaaaacagaagugacaaauccagcgauauuaagaaaauuaugcauugaagcgaaaauuucaaauacuaccacggacagucguugucccacccaaggggaagccacucuaguagaggaacaggacgcuaacuuugucugucgacgaacauuuguagauagaggauggggaaacggauguggucuauucggcaaaggcuccuuaaucacgugugccaaauuuaaaugugugacaaaauuagaagggaaaauaguacaauaugaaaaucuaaaauauaguguaauaguuacgguucauaccggugaucaacaccaagucggaaacgaaagcacggaacacggcacaaccgcuacuauuaccccucaagcaccgacuacagagauucaacuaacagauuauggagcucuaacacuagauugcaguccgagaacagguuuagauuuuaacgaaaugguacuccuaacaaugaaagagaaauccuggcucguacacaaacaaugguuucuagaccuaccacugccguggaccagcggagcuagcacuucacaagaaacauggaauaggcaagaucuccuagucaccuuuaaaacugcacaugcgaagaaacaagaagucgugguccugggcagucaagaaggagcuaugcacacagcacuaacaggugcaaccgaaauacagacaaguggaacuaccacaauuuucgccggacaccuaaaaugucguuugaagauggauaaacugacgcuaaaagggaugaguuaugucaugugcaccgguucuuuuaaauuagaaaaggaaguagcggaaacccaacaugguacggucuuaguucaaauuaaauaugaagguacagacgcucccuguaaaauccccuuuucaacucaggacgaaaagggcgucacacagaauggccgucugauuacggcaaacccaauuguuacugauaaagaaaaaccggugaauauugaagcggaaccgccuuuuggggaaagcuauauaguaauuggggcgggagaaaaagcauuaaaauuaucuugguuuaagaaagguaguucgaucggaaagauguuugaagcaacagcuaggggagccaggcgaauggcgauauugggagauacggcuugggacuucggcucaaucggaggaguguuuacaucuguagggaaauuaguccaucaaauuuucggaacagcuuauggaguacuguucuccggcgucucauggacaaugaaaauuggcauuggcguccuacucacauggcuuggguuaaauaguagaucaacaagucuaucgaugaccugcauagcaguuggacugguaacgcuauaucuaggaguaaugguccaagcggauucugguugcgugauaaauuggaaagggagagaacuaaaaugugguucaggaaucuuuguaacuaacgaaguacauacauggacagagcaauacaaguuccaagcagauagcccaaaaagacuuucugccgccauaggaaaagcaugggaagagggagucugcggaauacgaagcgcuacaagacuggaaaauaucauguggaaacaaauuucuaacgaacuuaaccauauccuguuagagaaugacaugaaauuuacuguaguaguaggggauguugcaggaauccuaguacaagguaagaaaaugauacggccacaaccaauggaguauaaauauucguggaaaucaugggguaaagcuaagauuauaggugcagauguucaaaacacaaccuucauaauugaugguccaaacacccccgagugcccggaugaucaaagggcauggaauauaugggagguggaagacuaugguuuugggaucuucaccacaaacaucugguugaaauuacgagauucuuauacucagguuugugaccauagguuaaugucggcugcgauaaaggauuccaaagccguacacgcugauaugggauauuggauugagagugagaaaaaugagaccuggaaacuugcaagagcuucuuuuauagaaguaaaaaccugcauauggcccaaaagccauacucuguggucaaacggcguauuagaaagcgaaaugauaauuccaaaaauauaugguggacccauaucucaacacaauuacagaccaggauauuucacccaaacggcaggcccuuggcaccuggguaaauuagaacuagauuuugauuugugcgaggguaccaccgucguaguagacgagcacugcgggaacagaggaccaucguuaagaacuacaaccguuacaggcaaaaucauacacgaaugguguugccgaucaugcacccucccgccacuccgguucagaggagaggaugguuguugguaugguauggaaauccgaccaguaaaagaaaaggaagaaaaucuuguuaagucaauggucagcgccggaucaggcgaaguagacuccuucaguuugggacuuuuaugcauaucaauuaugauagaagaaguuaugagaucacguuggucaagaaaaauguuaaugacagggacacucgcaguauuucuacuuuuaauuaugggacaguugacuuggaacgacuuaaucagacuauguauaauggucggugcuaaugcuagcgacagaaugggaaugggaacaacauauuuagcauuaauggcuaccuuuaagaugcguccaauguucgcaguaggucuucucuuccgucgauuaacaagccgagaagugcuacugcuuacgauaggucuaagccuagucgcuagcguugaacuucccaacucguuagaagaacucggagaugggcuugcaaugggaaucaugaucuugaaauugcuuacugacuuucaaucacaucaacuaugggcaacauuauugaguuuaacuuucauuaaaacgacauucucccugcacuacgcuuggaaaacgauggcgauggucuuaaguauaguaucacuguuuccgcuuugucugagcacuaccucgcagaaaacgacguggcuucccgucuugcucggaaguuuggguuguaaaccucuaaccauguuuuuaauagcggaaaacaagaucuggggucgacgaucauggccacucaaugagggaaucauggccguugguauagucaguauucuucuaucaucauugcucaagaacgacguccccuuagcaggaccguugauugcaggagggauguugauagcguguuacguaauaucggguagcucugcggaccuaucgcuggaaaaggcugcagaaguuucaugggaagaagaggcugagcauucgggggcuagccacaacauacucguggagguacaagaugauggaacaaugaagauaaaagacgaggagagagaugauacucuuacaauauuauuaaaagcaacuuuguuagcaguuagugguguauauccucuaucgauacccgcgacgcuuuuuguaugguacuuuuggcagaagaagaaacaaaggaguggcguuuuaugggacacaccuagcccaccagaaguugaaagagcaguucuggaugacggaaucuaucgcauaaugcaaagagguuuauuaggcagaagccaagugggaguagguguguuccaggagaauguauuccacacgauguggcauguaaccagaggggcuguucuaauguaucaagguaaaaggcuagaaccuaguugggcauccguuaagaaagaucuaauaucauauggcggaggcuggcgacuccaagguuccuggaauacaggagaagaaguccaaguuauagccguagaaccaggcaaaaauccuaaaaacguacaaacagccccgggcacguucaaaacucccgaaggagaagugggggccaucgcuuuagauuucaagccagguacaucggggaguccaauaguaaacagggaaggaaaaauugucgguuuauacggaaauggagugguaacgacaucaggcacuuaugugucugcaauagcucaggccaaggccucacaagaaggaccauuaccggagauugaagacgaaguuuuuagaaaacgaaaccuuaccaucauggaucuacacccgggaagcggcaaaacucguagguacuugccagccauaguuagagaagcuauuaaaagaaaauuacgaacgcuuauccucgcccccacacgagugguggcaagugagauggccgaagcgcuuaaaggcaugccaauccgauaucagacaacagcgguuaaguccgaacacacgggaaaagaaauaguugaccuuaugugccaugcaacauuuaccaugagacuauuaucucccgugcgcgucccuaacuauaacaugauuauaauggacgaggcgcauuuuacagaccccaguucaaucgcugcuagaggcuacauaucaacaagaguggggaugggagaagcagcagcuauuuucaugacggcuacaccaccuggauccguagaggcuuuuccucaaucgaaugcgguaauucaggaugaggaacgagacaucccagaacguucauggaacucaggauaugaauggauuacggauuuucccgguaagaccgucugguuugugcccaguauaaaaucagguaaugauaucgcuaauugccuuaggaaaaauggaaagaggguaauacaguuaucgagaaagacuuucgauacagaguaucagaaaaccaaaaacaaugauugggauuauguugucacuacagauaucucagagaugggggcaaauuucagagcggauagaguaauagauccucggagaugcuuaaaaccggugauacuaaaagacgggccugaacgggucauacuagcaggcccgaugccuguaacaguggcguccgcugcgcaaagaagggggagaaucggaaggaaucacaauaaagaaggugaucaauacauauauaugggccagccacugaauaacgaugaggaccaugcgcauuggacugaagcuaaaauguuauuggacaacaucaacacccccgaaggcauuauaccagcccuguucgaaccugaaagagaaaaaucagccgcuaucgacggagaauauagauuacggggugaggcucgcaaaacuuucguagaacuuaugcggaggggagaccugcccguaugguuaagcuauaaaguggcuucggaagguuuucaguacagcgaucgaaggugguguuuugauggcgaaagaaacaaucaaguacuagaagaaaacauggauguagagauauggacaaaggaaggcgagaggaagaaauuaagaccaagaugguuagaugcuagaacauauucagacccgcuagcccuaagggaguuuaaggaguuugcggcuggacgucguaguguauccggcgacuugauauuagaaauuggaaaacuuccccaacacuuaacacaacgagcgcaaaaugcauuagauaauuuagucauguuacacaacagcgagcaaggcggccgagcguaucggcaugcaauggaggaacugcccgauacuauugaaacuuuaaugcuuuuagcucuaaucgccguauuaacgggcggaguuacauuauucuuuuuaucgggcagagguuuaggcaaaacaaguauaggucucuuguguguaauggcgucuucaguauuauuauggauggcuucuguugaaccccacuggauagcggcuaguauuauauuggaguucuuuuugaugguauuauuaauaccggaaccagauagacaacggacaccucaagauaaucaauuagccuauguaguaaucggucuccuuuuuaugauacuuacgguugcagcaaacgaaaugggguuauuagagacuaccaagaaagauuuaggaauuggacacguggccgugggaaaucaccaucaugcggcgaugcuagaugucgaucuacauccugcaagugcguggacacuguacgcaguagcaaccacaauaauuaccccgaugaugagacauacaauugagaauacgacagcuaauauuucacuaacugcgauugccaaccaagcugcuauauuaaugggacuagauaaaggcuggcccaucucuaaaauggacauagguguaccgcuacuagcucuagggugcuauagucaaguaaacccgcuaacacuaacugcagcaguauuaaugcucgucgcccauuaugccaucauagguccaggacuucaagcuaaggcaacaagagaagcccaaaaacgcacugcagcuggcauuaugaagaauccgacaguggauggaaucgucgcuauugaucuugauccuguagucuaugacgccaaauucgaaaaacaacuaggacaaauaaugcucuugauauuauguacaucgcagauacuucuaaugagaacaacaugggcccuuugugagucaaucacacuugccacaggacccuugacaacguuaugggaaggaagcccaggcaaauucuggaacacaacuauugcaguaagcauggcuaauauauuccggggcucauaucuugcgggagcaggacuugccuuuucuuuaaugaaaucacuaggcggcggaagaagggguaccggggcucagggggaaaccuugggagaaaaauggaaaagacaacuaaaccaauuaaguaaauuggaauuuaauacauauaagcgaaguggaauaauggaggucgauaggagugaagcaaaggagggccugaaaagaggggaaacaacaaagcacgcaguauccagaggcacggccaaauuacgaugguuuguugagcgaaaucuuguaaaaccggaggguaaaguuauugauuuggguugcggaagaggaggauggagcuauuauugcgcuggacucaagaaaguaacagagguaaaagguuauacaaaaggaggaccaggacacgaagaaccuaucccaauggcaaccuauggauggaacuugguuaaacuacacucuggaaaagaugucuucuuuauacccccagaaaaaugugauaccuuauuaugugauauaggagaauccaguccuaauccaacaauagaagaaggacguacccuaagaguuuugaaaaugguggaaccaugguuaagagguaaucaauuuuguauaaagauauuaaauccuuauaugccaagcguuguagaaacgcuggaacaaaugcaaaggaaacacggcggaaugcuuguuagaaauccauugucuagaaauuccacacaugaaauguauuggguaucuugugguacaggaaacaucgucagcgcgguuaacaugacaucgagaaugcuucuaaacagguuuacaauggcgcacaggaaaccuacuuaugaaagagauguugaucuaggagcgggaacgaggcauguggccguagagccggaaguggcgaaucuagacaucauaggacaaagaauagaaaacauaaagcacgagcacaaaucaacguggcauuacgacgaggacaauccguauaagacaugggcuuaccaugguucauaugaaguuaaaccgucaggaagcgccucuagcaugguuaacgguguaguaaaacuucucaccaaacccugggauguuauuccgauggucacacaaauugcaaugacagauacaacgccguucggacagcagagaguauuuaaagagaaaguagacacaagaacaccaaaagcuaaacgugguacggcgcaaauaauggaaguaacugcaaagugguuauggggauuucuaucaagaaacaagaaaccgaggauauguacucgcgaagaauuuaccagaaaaguacgaagcaacgcagcaauaggcgccguuuuuguugacgaaaaccaauggaauagugcaaaagaagccguagaagaugaaagauucugggauuuaguucacagggaaagggaguuacauaaacaaggaaagugcgcgacauguguauauaacaugaugggaaaaagagagaaaaaguugggagaauuugguaaagcaaaggguucuagagcaaucugguauauguggcuuggcgcacgauuccuagaauuugaagcgcuugguuuuaugaaugaggaucacugguuuucacgagaaaauucacuuucugggguugaaggagaaggucuucauaaauuaggcuauauauuaagagauauaaguaaaauaccagggggaaacauguaugcugaugacaccgccggaugggacacuagaauuacugaggaugaccuacagaacgaagcaagaauaaccgauauaauggagccagagcacgcuuuguuggcaaaaagcauauucaaauuaaccuaccaaaacaaaguaguaagagugcagcguccagcuaaaaacgguacuguaauggacguaauaucaaggagggaucagagagguuccggccaagucggaacuuauggacucaauacuuuuacuaacauggaggcccaacuaauccggcagauggaaucagagggaaucuucucaccaagugagcuagaaacacccaaucucgccgaaagaguucuugauugguuagaaaaauacggaguugaacgacugaaaagaauggcuauaagcggcgacgauuguguagucaaaccaauugacgauagauuugcuaccgcacucacugcuuuaaacgauauggguaagguaagaaaggauauaccacaaugggagcccucgaagggcuggaaugauuggcaacaaguccccuucuguucacaucacuuccaccaauuaaucaugaaagacggacgcgaaaucguugucccaugccgcaaucaagacgaauuaguugggcgugccagggucucccagggagccggguggucgcugcgugaaacggcauguuuggggaaauccuacgcacaaauguggcaacugauguacuuccacagacgcgaucuaagguuggcugcaaacgccauaugcagugcagucccaguugacuggauuccuaccagcagaacuacuuggucaauccacgcccaucaccaauggaugacaacagaggauaugcuaucaguauggaauagaguguggaucgaggagaacccauggauggaggauaagacccauauaucuuccuggggagacgugcccuaucuaggaaagcgugaagaucaauggugcgguagcuuaaucggauuaaccgcacgggcuacuugggccacgaacauucaaguagccaucaaucaaguucgcagacuaauaggcaaugaaaacuauuuggauuacaugacaagcaugaaacgauuuaaaaaugagucagacccugaaggagcucuaugguga

SEQ ID NO: 21220 - RNA, 9879 nt, Artificial Sequence
  derived and/or modified CDS sequence (opt6) from DENV-1__KF921933__SS-prME
ucuguuacuauguugcugauguuaaugccaacugcucuagcauuccaccuuacaacacgaggaggugaaccucacaugauuguaucaaaacaagaaagaggcaagagcuuacuuuucaaaacaagugccggcgugaauauguguacgcucauagcgauggauuuaggcgaacuaugcgaagacacaaugacguacaaauguccgagaauuacugaagcagaaccagacgacguagauugcugguguaaugcaacagacacguggguaacauauggaacaugcagucaaacaggugagcacagaagagauaaacguuccguagcauuagccccucauguaggcuuaggacuagaaacgagaacugaaacauggaugagcagcgaaggagcuuggaaacaaauacaaagaguagaaacaugggcuuugaggcaucccggcuucacaguuauagcucuauuucucgcacaugcaauagggacuucaauaacccaaaaagguauuauauucauacuguuaaugcuuguuacaccauccauggcgaugaggugcguagggaucggcagucgugauuuuguggaaggguugaguggagcaacauggguagacgucgucuuagaacauggaucuugugugacaaccauggcgaaagacaaaccgacucuugacaucgaacuucugaaaacugaagugacaaacccugcaaucuugagaaaauuaugcauagaagcaaaaauuagcaacacgacaacagauaguaaauguccgacacagggagaagcaacuuuaguagaagaacaagaugcuaacuuuguguguaggagaacuuuuguugaucgaggaugggguaauggaugugguuuauucggaaagggaucuuugauuacgugugcaaaguucaaaugugugaccaaguuagagggcaaaauaguucaauaugaaaaucugaaauacagugucauagucacaguucauaccggagaucaacaucaaguugggaaugaaucgacagaacauggaacgacggcaacuauaacaccacaagcacccaccacagaaauacaauuaacagauuacggggcccuaacguuagacuguagcccaagaacaggguuagacuuuaaugaaaugguucugcuaacuaugaaggaaaagaguugguuaguccacaagcagugguuccucgauuuacccuuaccguggacuucuggagcuagcacuagccaagaaacauggaaucgucaagaucuuuuagugacauuuaagacagcacacgccaagaaacaagaaguaguggucuuaggaagucaagaaggugcuaugcacaccgcgcucacgggggcaaccgaaauacaaacuagcggcacuacuacaaucuuugcaggacaccuaaaaugcagacuaaaaauggacaaacuuaccuuaaaaggcaugucuuaugugaugugcaccgggucauuuaaauuagaaaaagaaguugcggagacgcaacauggaacaguccuaguacaaauuaaauacgaagguacagacgcaccguguaagauaccguuuaguacacaggaugagaaaggaguaacgcaaaaugguagacuuauaaccgcuaacccaauagugacagauaaggaaaaacccguaaauauagaagcggaaccuccauuuggggaaucguauaucgugauaggcgcaggagaaaaagccuuaaaguuaucuugguuuaaaaagggcaguucuaucggcaaaauguuugaggccacggcaaggggugcucgcaggauggcuauuuugggggacacugccugggacuucgguucaauaggugguguuuucacuucgguaggaaaguuaguacaccagauauuuggcacugcuuacggaguacuauucagcgguguaucauggacaaugaagauugguauuggagugcuacuuacgugguuagggcucaacagucgaucaacgucgcuuaguaugacauguauugcugucggcuuaguuacguuguaucuaggaguaauggugcaagccgauaguggauguguuauuaacuggaaaggacgcgaauugaaauguggcucagggauauuuguuacuaacgaaguacauacuuggaccgagcaauauaaauuucaagcagauuccccuaaaagguuaucugcagcaauagguaaagccugggaggaaggaguuugcgguauaagaagugcuacaagguuagaaaauauaauguggaaacaaaucucaaaugagcuaaaccauauuuuguuagaaaaugauaugaaauucacuguagucguuggggauguagccggcauccuagcccaaggcaagaaaaugauucguccacaaccuauggaauauaaauacaguuggaagucaugggggaaagcgaaaaucauuggggcagacguacaaaacacgacuuuuauaauagaugguccaaauacaccagaauguccugaugaucaaagggcguggaacauaugggaaguagaagauuacggcuuugggauauucacuacuaauauauggcuaaaacuaagggauucuuauacucaggucugugaccauaggcucaugagcgcagcaaucaaagauucaaaagcaguacaugcagacaugggcuauuggaucgaaucugaaaagaaugaaacguggaagcuagcuagagcgucuuuuaucgaaguuaaaacuuguauauggcccaaaucucacacacuaugguccaacggcguauuagaaucagaaaugauaauaccaaagauuuauggaggaccgauaucacaacauaauuaucgacuuggauauuucacccagacagcggggccauggcaccuggguaaacuugaauuagacuucgaucuuugcgaaggcacaacaguuguaguagaugaacauugcgggaacagagguccaagucuaagaacgacaacaguaacaggaaaaaucauacacgaguggugcuguagaucguguacucuuccacccuuacgcuuccgaggugaagauggaugcugguauggcauggaaaucaggccagugaaagaaaaggaagaaaauuugguaaagucaaugguaagcgccggaucuggggaaguggauagcuuuucacugggacugcugugcauaaguauuaugauagaagaggugaugagauccagauggagucgaaaaauguuaaugacggggacuuuggcuguuuuccuguuacuaaucaugggccaacuaacuuggaaugauuuaauacguuugugcauaaugguuggagcaaaugcaucugacaggauggggaugggaacuacguauuuagcgcuaauggcuacauuuaaaaugagaccgauguuugcagucggguugcuauuuagaagacugacaagucgugaaguauuauuacuaacaaucggacucagcuuaguggcauccguggaacuacccaauagcuuagaagaauuaggugacggccucgcuaugggaauaaugauacuaaaauuauuaacggauuuccaaagccaccaacuuugggcgacacuucuuucccuuacauuuauuaaaacaacauucucacugcauuacgcauggaaaacaauggcgaugguccuauccauuguuagccuauucccuuuaugcuugucuacaacaagucagaaaacaaccuggcuaccaguacugcuagggucguuaggcuguaagccauugacuauguuuuuaauagcugaaaauaagauuuggggacgaagaucauggccuuuaaaugaaggaauaauggcagucggcaucguaaguauacuacugagcucauugcugaaaaacgaugugccacuggcgggcccacugauagcggguggaaugcugauagcauguuacguuauuagcggaaguagcgcggacuuaucccuggagaaggcugccgaagucagcugggaagaagaggcagaacauucaggugccagccauaacaucuuaguugaaguacaagacgauggaacaaugaaaauuaaggacgaagaacgugacgauacucugacaauucuuuuaaaggcaacacuauuagcaguaagugguguauauccauuaagcauaccagcaacacuauucguaugguacuucuggcagaagaagaaacaaagaucaggagucuugugggauacacccucaccuccagagguagagagggcuguucuagaugacgguaucuauaggauaaugcaaagaggucuucucggacgaucccaaguugggguaggaguauuucaagaaaacgucuuucauacuauguggcaugugacacguggugcgguacucauguaucaaggaaaaagacuugaaccuucgugggcaagcgugaagaaagaucuaauaucguauggcggaggguggaggcuacaaggaucguggaacacaggagaagagguacaagucauagcugucgaaccgggcaaaaaucccaaaaacguccaaaccgcgccaggaacuuuuaagacaccugaaggggaaguuggcgcaauagcacuagauuuuaaaccaggaacuucugguucgccgauagucaaucgagaaggcaagauuguuggucuauaugggaacggaguuguaaccacaucggguacguacguuucugcaaucgcacaggcaaaggcaucccaagagggaccauugcccgaaauugaagaugaaguauuuaggaaacguaaccuuaccauuauggauuugcaccccggaagugggaagacaagacgauauuuaccggcaauaguacgagaagccauuaagagaaaacuaagaacucuaauuuuagcgccaaccaggguaguagcaucagaaauggcagaagcacucaaagguaugccuauuagauaccagacaacagcagugaaaagcgaacauacggguaaggaaauagucgaucucaugugccaugcaaccuuuacuaugcgguugcugucaccugucagaguaccaaauuauaauaugauaauuauggaugaagcucauuuuaccgauccuagcucgauagcagcgcggggauauauuagcacuagagucggaaugggggaagcggcugcaaucuuuaugaccgcaaccccgccagguucaguagaagcguucccacaaucuaaugcaguaauacaagaugaggaacgugauauuccugaaagaucguggaauaguggauaugaguggauaacggauuucccuggcaaaacaguuugguuuguaccaaguauuaaaucagggaaugauauagcaaauugcuuaaggaaaaauggaaagagaguaauucaacuuaguagaaaaaccuuugauaccgaguaucagaaaaccaaaaacaaugauugggauuacguuguaacaacggacauaucagaaaugggggcaaauuuuagagcagauagagucauugaucccagaagaugucuaaaaccaguaauacuaaaagacgguccagaacguguaauccuggcagggccuaugccuguaacuguagcaucagcugcacaacgacgcgguagaaucggccguaaucacaacaaagaaggagaucaauacauauauaugggacaaccucuaaacaacgaugaggaccaugcacacuggacugaagcaaagaugcuacuagacaauauaaacacgccagaagggauuauacccgcacuauuugaaccugagagagaaaaaucagcagcuauagauggggaauauagauugagaggagaagcucguaaaacauucguugaauuaaugcgaagaggagaucugccugucuggcuaucuuauaagguugcgucagaaggguuucaauauagcgauagaagaugguguuuugauggugaacgcaacaaucaagucuuggaggaaaacauggauguagaaauauggacuaaagaaggagaaaggaagaaacuacguccacgauggcucgaugcuagaacauacagugauccauuagcuuuaagagaauuuaaagaguucgcagccggaagaagauccgugagcggugaucucaucuuagaaauaggaaaacugccgcagcauuuaacucaacgcgcacaaaaugcucucgauaaucucgugaugcuucauaacagugaacaagggggucgugcuuacagacaugcaauggaagaauuaccugacaccaucgaaacucuaaugcuauuagcguugauugcgguauugacagguggcgugacacucuucuuucuuagugggcgaggacucggaaaaaccagcauuggacuacuguguguuauggccucaaguguauuauuauggauggcaucaguugaaccgcauuggauugcagcaaguaucauucuagaguucuuuuuaauggugcuucugauacccgaaccagacagacaaaggacaccacaagacaaccaauuagcauauguuguaaucgguuuauuauucaugauucugacaguagcagcuaaugaaauggggcuacuagaaacaacgaagaaggacuuaggaauaggacacguugcuguaggaaaucaccaucaugccgcaauguuagauguugaccuucaucccgcaucagcuuggacccuauaugcaguagcuacaacaaucauaacaccaaugaugcgacauacuaucgagaauacaacugcaaauauuucacuaaccgccauugccaaucaagcugcuauacuaaugggucuagacaagggcuggcccauaucaaagauggauaucgguguaccauuacuagcacucggaugcuacagucaaguaaacccguuaacauuaacagcagccguuuugaugcuaguagcgcauuaugcaaucauuggaccgggacuucaagccaaagcuacgcgugaagcucaaaagagaacugcagcuggcauaaugaaaaauccaacuguugaugggauugucgccauugaucuagaccccguaguauacgacgcuaaguucgaaaagcaacucggacagaucauguuauuaauacuauguacaucucaaaucuuacuuaugcggaccacaugggcacucugcgaaucgaucacgcuugcuacuggaccucuuaccacguugugggaaggaucuccugggaaauucuggaauacuaccauugcuguuagcauggcaaacauauuucgggguucauaccuagcaggagcaggcuuagcauuuaguuugaugaagagucuaggaggaggcagaagaggaacaggagcacaaggagaaacacuaggugagaaguggaaaaggcaacuaaaucaacugucuaaaagcgaauuuaacaccuauaaacggucuggcauuauggaagucgaccgaucagaagccaaggagggauuaaaaagaggggaaacaacaaagcaugcagugagucgagguacagcuaaacucagaugguuuguggagcggaacuuaguaaaaccagaggguaaaguaauagaccuuggaugcgggcgugguggguggaguuauuauugcgcagguuuaaagaaagucacagagguaaagggguauaccaaaggggguccaggucacgaggagccgauaccuauggcaacguaugguuggaaucuagugaaguuacacucaggcaaagacguauuuuucauaccaccugagaaaugugauacauugcuuugugacauaggagaguccagccccaauccaacaaucgaagaaggaaggacacuucgaguuuuaaaaauggucgagccauggcuuagaggaaaucaauuuugcauuaaaauacuuaauccguauaugccaucagugguagagacguuagagcaaaugcaaaggaaacauggagguauguuaguccgcaacccccugucucgaaauuccacacaugaaauguauuggguuucuugugguacggggaauaucguaagugcagugaauaugacguccagaauguuacuuaauagguucacuauggcgcauagaaagccaacuuaugagagagacguggaccugggugcaggaacuaggcaugucgcaguugaaccagagguagcaaaccuggauauaauaggacaacgcauagagaacauuaagcaugaacauaagucgacauggcauuaugaugaagauaauccuuauaaaacgugggcauaucacggaaguuacgaagucaaaccaucaggaagugcaaguuccaugguaaaugguguagugaaauuguuaacaaaaccaugggauguaaucccuauggucacccagauagcaaugacugacacaacaccguuuggccagcagagaguauucaaagaaaaagucgauacgcgaacaccaaaggcuaagagagguacagcacaaauaauggagguaacugcgaaauggcuauggggauucuugagcagaaacaaaaagccucgaaucugcacgcgcgaagaauuuacgagaaaaguaagaagcaacgcagcaauuggagcaguauucguugaugagaaucaauggaauagugcgaaagaggcugucgaggacgguagauucugggaccuuguccaccgagaaagagaacuucauaaacaaggaaaaugugcaaccuguguguauaauaugauggggaaacgugaaaagaaguuaggugaguuuggaaaagcaaaagguucacgagcaauuugguauauguggcuaggggcacgauuccucgaguucgaagcauuagguuuuaugaacgaagaucauugguucagcagggagaauagucucucuggugucgaaggggagggcuuacauaaacuaggauauauauuaagagauauuucaaaaauaccuggugggaauauguaugcugaugacacugcaggaugggacacucgaauaacagaagaugauuugcaaaaugaagcacgaaucacugauauuauggaaccggaacaugcguuauuagcgaaaagcauauuuaaguuaacauaccagaacaaagucguacgaguacaaagacccgcuaagaacgguacgguaauggauguaauuagcagacgggaccagcgcggcaguggacaaguugguacauacgggcuuaacacguucacaaauauggaggcacaguuaauacgacaaauggaaagcgaaggaauauuuucccccagcgaacuagagacaccgaacuuggcagagagaguacucgauuggcuugaaaaauauggugucgaaaggcugaaacggauggcuauaucuggagacgauuguguaguuaaaccgauugaugaucgauucgcuacagcacuaaccgcacuaaacgacaugggaaaagucaggaaagacauaccucaaugggaaccgucgaaaggauggaaugauuggcagcaagugccguucugcagucaccauuuucaucaacuuauuaugaaggacgggcgugaaauaguaguuccaugcaggaaucaggacgaauugguaggacgcgcgcggguaucgcaaggagcagguugguccuugagagagacugccugucuuggaaaauccuacgcucagauguggcaacuaauguacuuccacaggagagaucuaagacuagcugcgaaugcgauauguagugcuguaccgguggacuggauuccaacaucccgaaccacauggaguauacaugcgcaccaccaauggaugaccacagaggauaugcuaucaguguggaaucgugucuggauugaggaaaaccccuggauggaagacaagacccauauuucuucuuggggcgacguuccauauuugggaaaaagggaagaccaauggugugggagucuaauaggcuuaaccgcaagggcuacaugggcaaccaacauucaaguagcuaucaaucaaguaagaagguugaucggcaacgaaaacuaucucgacuauaugacuagcaugaaacguuuuaagaaugaaucggauccagagggagcacucugguga

SEQ ID NO: 21221 - RNA, 9879 nt, Artificial Sequence
  derived and/or modified CDS sequence (opt6) from DENV-1__HM181954__SS-prME
aguguaacgaugcugcuaaugcuaaugcccacggcgcuugcauuucacuuaacaacacggggaggugagccucacaugauagucucgaaacaggagagagguaaaucuuugcuuuuuaaaacuucagcaggaguaaauauguguacucucaucgccauggaucuaggagaacuuugugaagacacaaugacguacaaaugcccuagaauaacugaagcggaaccggacgauguagacuguuggugcaaugcuaccgacacuuggguaacauauggcacauguucacaaaccggagaacacagacgagauaaacgaucaguugcucuggcgccacauguaggucucggguuagaaacgagaaccgaaaccuggaugucuucagaaggugcuuggaaacaaauucaaagagucgaaacaugggcacuuagacaucccggguuuacuguuaucgcacuauucuuagcccaugcuauaggaaccucaauaacucaaaaaggaauuauauucauacucuuaauguuggugacucccucaauggcaaugcgaugcguugguauaggaagccgggauuuuguagaggguuuaucuggcgcuacauggguugacguuguacuggaacaugguaguuguguuacgacuauggcaaaggacaaaccgacauuagacauagaacuccuuaaaacugaaguaacuaaucccgcaauacuaagaaaacuauguauagaagcuaaaauuucgaauacuacgaccgauucacguuguccaacucagggcgaagcuacacuuguggaagagcaagacgcaaacuuugugugucgacgaacauuuguagauagaggauggggaaauggaugcggucuguucggaaaaggaucccugauaacuugcgcuaaauucaaaugcgucacgaaacuugaagguaagauaguccaauaugaaaaucugaaguauaguguaauaguaacgguacauacaggugaccaacaucaggugggaaaugaaucuacugaacaugguacaacagcuacgauuacuccccaggcaccgacaacugaaauccaauuaaccgacuauggugcuuugacucuggauuguucaccucguacugggcuagacuucaaugaaaugguauuguuaacaaugaaagaaaaauccugguuaguacauaaacagugguuuuuggauuugccgcugccauggacuccaggugcaaguacaucucaagaaacauggaaucgacaagaccuccucgucacuuuuaaaacugcccacgcaaaaaaacaagaaguaguuguauuaggaucacaagagggagcaaugcauacagcacuuaccggcgcuaccgaaauacaaacaaguggaacaaccacgauauucgcaggccaccucaaguguagacuaaaaauggauaaacuaacauuaaaagggaugucauauguaaugugcacagggagcuucaaguuggagaaagagguggcugagacacaacacgggacaguacuuguucaaauaaaauaugaaggcacggacgcgccaugcaaaaucccauucagcacacaagacgaaaaaggaguuacacagaauggucggcucauaacugcaaauccuauaguaacugacaaggaaaaaccaguaaauaucgaagcggaacccccauuuggugaaucguacauaguaauaggggccggagaaaaagcgcugaaacugucuugguuuaagaaagguucgaguauaggcaaaauguuugaggccaccgcacguggagcucgaaggauggcaauuuuaggggacaccgcaugggacuuugggucaaucggaggaguauucacgucuguggggaaauuggugcaccaaaucuuuggagccgcuuacgggguacuuuucagugguguaucuuggacaaugaagauagggauaggaguuuuacucacuugguugggacuuaauucaagaucuacuucacucucaaugacaugcauagccgugggucucgucaccuuauaucuaggaguaaugguucaagccgacagcgggugugugauaaacuggaagggucgcgaauuaaaaugcggaagcggaauauucguuacgaaugaaguacacacuuggacugagcaauacaaauuucaagcugacucuccuaagcgacuauccgcagcaauaggaaaggcaugggaagaagggguauguggaauaagauccgcuaccagacuagaaaacauuauguggaaacaaauaucaaacgaacucaaccauauacuacucgagaaugauaugaaguucacuguaguagucggggauguugcuggaauauuagcgcaagggaaaaaaaugauucgaccgcaacccauggaauacaaguauucuuggaaaaguugggggaaagcaaagauaaucggugcagacguucaaaauacaacauuuaucauugauggacccaacacaccugaaugucccgaugaccaacgugcuuggaauaucugggaaguugaggacuaugguuuugggauuuuuacaacaaauaucugguugaagcuucgggauucauauacgcaagcuugugaccauagacuuaugucagcagcuaucaaagauaguaaagccguucacgcagacaugggauauuggauagagucagaaaaaaaugaaacauggaaacuagcaagagccucauuuaucgaaguaaaaacguguauauggccaaaaagucacacacuguggaguaaugguguucuugaauccgagaugaucauaccaaaaauauacggugggccgaucagccaacacaacuacagaccgggguacuuuacacagacggcugggccauggcaccuuggcaaauuagagcuugacuucgaccucugugaaggaacaacaguggugguagaugaacacuguggaaauagaggaccgucauuacguacaacgacgguaacgggaaaaauaauacaugaaugguguuguagaucgugcacuuuaccgccauugcgauucagaggugaagacggguguugguauggaauggaaauacgcccugucaaagaaaaagaagaaaaccuaguaaaauccauggucuccgcggguuccggggaaguagauagcuuuuccuuaggcuuauuauguaucuccauuaugauugaagaagucaugcgaaguagguggucaaggaaaaugcuuaugacugggacacuugcaguauuccuacuuuugauuaugggacagcugacguggaaugaucuaauuagacucugcauaauggucggcgcaaaugccagugaccgaaugggaauggguacaacguaccucgcuuuaauggcgacauucaaaaugagaccaauguuugccguuggacucuuauuuagaagacuaacuagcagagaaguguuacugcucaccauagggcucucacucguagcguccguugaacuuccaaacucauuggaggaacugggagacggccuagccaugggaaucaugaucuuaaaauuguugacugauuuucaaagucaccagcuaugggccacauuauuaaguuuaacauuuaucaagacaacuuuuucuuuacacuaugcuuggaaaaccauggcgaugguguuaucaaucguauccuuauucccauuguguuuaucgacaaccagucaaaaaacuaccuggcucccgguacuucucggaucacucggcugcaaaccuuuaacuauguuccucauugcggaaaacaagauauggggucggaggucauggccauugaaugaagguaucauggccguagguauaguuaguauacugcuauccuccuuauuaaaaaacgauguuccauuagcagguccacuaauugcaggugggauguuaaucgcgugcuaugugauaaguggcucgucagcagauuuaucacuagaaaaagcagcagaaguaaguugggaagaagaagcagaacacucaggagcaucacauaauauacuaguggaaguacaagaugauggaacaaugaaaauaaaagaugaagaaagagaugauacuuuaaccauucuccuuaaagcgacccuuuuagcuguuucaggaguauaucccuuaaguauaccggcuaccuuguuuguaugguacuuuuggcagaaaaagaaacagaggucuggaguauuaugggacacuccaagcccaccggaaguugaacgagcaguacucgacgauggcauauaucgcaucaugcagagaggacuucucggacguagucagguugggguagggguauuucaagagaacgucuuucauacuauguggcauguaacuaggggugcgguauuaauguaccaaggaaaacguuuagagccaucaugggcaaguguaaaaaaggaucucauaucauacggaggaggauggagauuacaaggauccuggaacacuggugaggaaguacaaguuauagcuguugaaccgggcaaaaauccuaaaaacguccagacggcaccaggaaccuuuaaaaccccagagggugaaguaggagcaauagcguuagauuuuaaacccgguacaucaggaucgccgauagugaauagagaagguaagaucguaggucuuuacgguaauggagugguuaccacauccggaacuuauguaucggcuauagcgcaggcgaaagccagucaggaaggcccauuaccggagauugaggaugaaguauuccggaaaagaaaccuuacaauaauggaccuacauccaggcucaggaaaaacccggcgguaccuaccugcuauuguacgagaagcuaucaaaagaaaacugagaacacuaauuuuagcaccuacgagaguuguggcaucugaaauggcagaagcucucaaagguaugccaauucgauaucaaacuacugccguaaaaucggagcauacugggaaggaaauaguggauuugaugugucaugcaaccuuuacuaugaggcuacuuagcccuguaagaguuccuaauuacaauaugaucaucauggacgaagcccacuuuacggaccccucaucuauagcugcccgagguuacauuucaacuaggguggguaugggagaagccgccgcaauuuucaugacagcuacaccgccugguucagucgaggcauuuccacagucaaacgcaguuauacaagaugaagaaagagauauaccugagcgcagcuggaauaguggguacgaauggauuacugacuuuccaggaaaaacuguuugguuuguaccuucaauaaaaucugguaacgacauugccaacugucuacguaagaaugguaagagagucauacaacuuagucgaaaaacguucgacaccgaguaccaaaaaacuaaaaauaaugacugggacuauguuguuacaacagauauaucagaaaugggugcaaacuuuagagcagaccgaguaaucgauccucgaagaugucuaaaaccaguuaucuugaaagacggcccagaacgggugauacuagccgguccaaugccagugacgguggccuccgcagcccagcgaagaggucgcauuggacgaaaccacaacaaggaaggugaucaauauauuuacaugggacaaccacuaaacaacgacgaagaucaugcccauuggacggaagccaaaauguuacuagauaauauaaacaccccggaagggauuauaccugcauuauuugagccugaacgagaaaaaucagcagcaaucgauggugaguaucguuuacgcggagaagcaagaaagaccuuugucgaguuaaugagacgcggcgaucuaccgguuugguuaagcuauaagguugcuagcgaaggauuucaauauagugauagaagaugguguuucgauggagagcgaaacaaccaagugcuagaggaaaauauggauguugagauauggaccaaagaaggagaaaggaagaaacuuagaccccguugguuggacgccaggacauauagugauccgcuggcucugcgcgaauuuaaagaauuugcagcagguagaagaucaguuagcggagaucuaauacuagagaucgggaaauuaccgcaacaucuuacucagagagcucaaaacgcccucgauaauuuagucauguugcauaauucagaacaaggaggacgagccuauaggcaugcuauggaagaauuaccugauacaaucgaaacucuuaugcuauuagcccucauugcaguacuaacaggagggguaacguuauuuuuucugaguggccguggauuaggcaaaacauccauuggacuuuuauguguaauggcaucauccguucugcuguggauggcuuccguagaaccucacuggaucgcugcaaguauaauauuagaauucuuucuaaugguacuacuaauaccagaaccagacaggcagagaacaccacaggauaaucaacuagcuuacguaguaaucgguuuauuguuuaugauccuaacgguagcugcaaaugaaaugggacuauuagagacgacaaaaaaggauuuggguauuggacaugucgcaguuggcaaucaccaccaugccgcuauguuagacguugaucuucaccccgcuucagccuggacuuuauaugccguggcuacaacaauaauuacgccaaugaugcgacacacaaucgaaaauacaacugcuaauauaucacuaacagccauugcuaaucaagcagcaauucuuaugggcuuagauaaaggcuggccuaucucaaaaauggauauaggaguaccacuauuggcguuagguuguuauucccaaguaaacccuuugacguuaacagcggcgguacuuauguuaguugcgcacuacgcaauuauuggaccaggguuacaagcaaaagccacgagagaagcucaaaaacgcacugccgcuggaauuaugaaaaauccuacaguggacggcauaguggcaauugaccuggacccagucgucuacgacgcgaaauuugaaaaacaauuaggucagaucauguuauuaauacuauguaccucgcaaauuuuauuaaugagaacgacuugggcguuaugugaaucaauaacuuuagccacgggcccacuuacgacucucugggagggaagcccggguaaauucuggaauacgacgauugcgguaagcauggcaaacaucuuucgcgggucauauuuagcaggagcuggauuagcuuuuagucugaugaaaagccugggcggcggaagacgaggaaccggagcucaaggugaaacccugggugaaaaguggaaaagacaguugaaccaacugucuaaaucugaauuuaauacuuauaagcgaucagguauaauggagguagaucgaagugaggcaaaagaaggucucaaaaggggugagacaacuaaacaugcaguuucaagagggacagcgaaguuaagaugguuuguugagaggaauuuaguaaagccggaagguaaagugaucgaccugggcugcggaaggggcggauggaguuauuauugcgcaggcuuaaagaagguuacggagguuaaaggguauacuaaaggggggccuggucaugaagagccgaucccaauggccacauacggauggaauuuaguuaaauugcauucuggaaaggacgucuuuuucauaccaccugagaagugcgauacauuauuaugcgauaucggcgaaagcuccccaaacccgacaauugaagaaggacgaacacugagaguucuuaaaaugguagaaccuuggcuacgcggaaaucaauucugcauaaaaaucuuaaacccauauaugccuuccguuguagaaacacucgaacaaaugcagcgaaaacauggaggaaugcucguccgcaauccgcuuucgagaaauaguacacacgaaauguacuggguaaguugcggaacaggaaauauagucagcgcugugaauaugacgagcaggaugcuacucaacagauucacuauggcccaccgaaagccaacauaugagagagauguagacuuaggggcaggaaccagacacguugcaguugaaccagaaguagccaaccuggauauuauaggacagcgcauagaaaauauuaagcaugaacauaaaaguacauggcauuaugacgaggacaaccccuauaaaacaugggcauaucacgggucauaugaagugaaaccgagcgguuccgccucaaguaugguaaacggaguagugaaguuacugacaaaaccgugggacguuauacccauggucacucaaauugccaugacagauacaacgccauuuggucaacaaaggguauucaaagaaaagguagacacucgcacgccaaaggcuaagagagguacagcucaaauuauggaaguuacagccaaaugguuaugggguuuccuuucucguaauaaaaaaccacgcauuugcaccagggaagaauucacgaggaaaguuagaucgaaugccgcuauaggugcaguauuuguugacgaaaaucaauggaauucagcaaaagaagcagucgaagaugagagauucugggauuuaguacacagagaaagggaauuacacaaacaaggcaaaugugcaacuugcgucuacaauaugauggguaaacgcgaaaaaaaguuaggcgaauuugguaaagcaaaaggcucaagagcuaucugguacauguggcuaggugccagauuuuuagaauuugaggcucuagguuucaugaaugaagaccauugguucucucgggaaaacagccuaaguggaguagagggcgagggacuucacaaacugggauauauacuaagagauauaucuaagauuccagguggaaauauguacgcggaugauacagcagggugggauacaagaaucacugaagaugacuugcaaaacgaggcacgaaucacagauauaauggaaccugagcaugccuuauuagcaaaaucaauauucaaauuaacauaccaaaauaaagucguacgugugcaaagacccgccaaaaacggaacuguaauggacguuauuucaagacgagaccaaagaggcuccggccagguagguacauauggacuaaauacauuuaccaauauggaagcucaguuaauacggcaaauggaaucugaaggaauuuuuuccccaucugaacuagagaccccgaauuuagcugagcgggucuuagacuggcuagaaaaauacgguguagagcgcuuaaagagaauggcuaucagcggggaugacugcguugucaaaccuauagaugaucgauuugcaacagcauuaacagcccucaaugauaugggaaagguaagaaaagacauuccccaaugggaaccaucuaaagguuggaacgauuggcagcaaguaccauucugcagccaccauuuucaccagcugauaaugaaggaugguagggagauagugguaccuugccgaaaucaagacgaacugguaggucgcgcuagaguaucgcaaggugcgggauggaguuugcgggaaacagcgugccuuggcaaaucauacgcacaaauguggcaauuaauguauuuucacagacgagaucuucgauuagcugcaaacgcaaucuguucagcuguaccgguagacuggauucccacaucaagaacaacuugguccauccaugcccaucaucaguggaugacaacagaagauauguuaucaguuuggaaucguguauggauugaagaaaauccguggauggaagauaaaacccacauaucaucauggggugauguuccguacuuaggaaaaagggaagaccaaugguguggcucacuuauugguuugacugcaagagcaacuugggcgacaaauauucaggucgcuauuaaccaagugagaagacucauugggaaugagaauuauuuggacuauaugaccucaaugaaaagauuuaaaaaugaaucugauccagaaggggcccugugguag

SEQ ID NO: 21222 - RNA, 9879 nt, Artificial Sequence
  derived and/or modified CDS sequence (opt6) from DENV-1__HM181955__SS-prME
ucgguuaccauguuauuaauguuaaugccuacugcccucgcauuucaccuaacuacaagggguggagaaccucacaugauuguuucuaaacaagaacggggaaaaucucuacucuuuaaaacaucggccgguguaaacaugugcacacuaauugccauggaccugggugaacuaugugaagauacgaugacauauaaaugcccuagaauaacagaagcugaacccgaugacguagacuguugguguaacgcaacugauaccuggguaacguacggaacauguagccagacaggagaacauaggagagauaaacgaucugucgcucuugcuccucacgucggacuuggguuggaaaccagaacagagacauggaugucaucugagagugcauggaagcagauucaacgggucgaaacaugggcguugcgucauccaggauuuacaguaauugcacuauuccuugcgcaugcuauuggaacaaguauaacucaaaaaggaauuauauuuauacuacuaaugcuaguaacaccaucaauggcgaugagaugcguagguauaggaucaagagauuuuguggaaggacuaucgggagcaacguggguugacgugguucuggaacauggcagcugcguuacaacaauggcaaaagauaaacccacauuagauauagaacuuuuaaaaacagaaguaacuaauccggccauauugcguaaacuauguauugaagcgaaaauaagcaacacaacaacagauucacguugcccaacccaaggcgaagcaaccuuaguagaagaacaagacgcgaauuucguuugccgccguacuuuuguagauagaggcuggggaaauggauguggcuuauuugguaaaggcagcuuaauuacuugugcaaaauuuaagugcguuaccaaacucgaaggcaaaaucgugcaauacgaaaacuugaaauauucgguaauuguaacagugcauacgggagaucaacaccaaguuggcaaugaaaguacggaacacgguacaacagcgacaauaaccccacaagccccuacaacugaaauacaacuaaccgauuauggggcuuugacuuuagacugcucaccacggacagggcucgacuucaaugaaaugguacuacuuacaaugaaagagaaaagcugguugguacacaagcaaugguuuuuggaucucccacuaccauggacaagcggugccucgaccucacaagagacuuggaauagacaggauuuauuagucaccuuuaaaacagcacacgcaaagaaacaagagguagucgucuuggguucacaggaaggcgcgaugcauaccgcgcugacuggggccacugagauacaaacaucugguacaacaacuauauucgccggccaucugaaguguagacuaaaaauggacaaauuaacuuugaaaggaaugucauauguaauguguacgggaucuuuuaaacucgagaaagaaguagcggaaacgcaacauggaacaguuuuaguucagaucaaguacgaaggcacagaugcaccauguaaaauacccuuuaguacccaagacgaaaaaggaguaacacaaaacggacgguuaaucacagccaacccaauuguuacggauaaagaaaaaccggugaacauagaagccgaaccacccuuuggcgaaucuuauaucguaauuggagcuggcgaaaaagcacuaaaguugaguugguuuaagaaagggaguucaauugguaagauguucgaagcaacugcaagaggugcaagaagaauggcaauacuaggagauacugccugggauuuugggucuauugggggugucuucacaucgguaggaaaacuuguucaucaaauauuugggacggccuauggaguccuauucagcgguguuagcuggacaaugaaaauuggaauaggcguuuuauugacauggcugggccuuaauucacgaucuaccagucuuaguaugacuuguauagcuguuggccucgugacccuauaccuagguguaaugguucaagcagacucuggauguguuaucaauuggaaagggagagaguuaaagugugguucgggaauuuuuguaacgaaugaaguacacaccuggacugaacaauauaaauuucaggcugacucuccuaaacgccucagugcagcgauuggaaaagccugggaggaaggaguuugcggcauccguucggccacaaggcuggaaaauauuauguggaaacaaauaucuaaugaacucaaucacauacuuuuagaaaacgacaugaaauucacaguuguuguuggagauguagcaggaauacuagcccaaggcaagaaaaugauaagaccacaaccuauggaauacaaauauucguggaaaagcuggggcaaagccaaaauuaucggagcugacguccagaauacuacuuucauaauugauggaccuaauacaccagaauguccggaugaucaaagagcauggaacaucugggaaguagaggauuauggauuuggaauuuuuacaacuaauaucuggcuaaaacuacgugauagcuacacacagguuugugaccaucggcuaaugucagcugcaaucaaagauuccaaagcugugcaugcugauaugggauacuggauugagagugagaaaaacgaaacguggaagcuggccagagcgaguuuuauugagguuaaaacuuguauauggccgaaaucgcauacacuuuggucaaacggaguacuagagucggaaaugauaauaccuaaaauauauggaggaccaauuagucagcacaacuaucgacccggauacuuuacacagacggcugggcccuggcaccuaggaaagcucgaacuugauuuugaucuuugugaggguacuacgguaguaguugaugaacacuguggaaauagagggccuagucuuaggaccacaacaguuacugguaaaauaauacacgagugguguuguagaucgugcacguuaccaccacuaagguuccgaggagaagacggguguugguacgggauggaaauaagaccugucaaagaaaaagaagagaacuuagucaaaaguaugguaucugcgggauccggagagguugauucuuucagucuaggauuacuaugcauuaguauuaugaucgaggaaguuaugagaucuagguggucgagaaaaauguuaaugaccggaacguugguagucuuuuuacuucugauaaugggacaacuuacauggaaugacuugauuagacuuuguauuaugguaggugcaaacgccucagaccgcaugggaauggguacaaccuauuuagcacuaauggcaaccuucaaaaugagaccuauguuugcgguaggguuauuauuucgcagauugacuucaagagagguucuacuauuaacaauagguuuaucacuugucgcaagugucgaauuaccaaacucucuggaagaauuaggagauggccucgcaaugggaaucaugauacugaagcuauuaacggauuuccagucucaucaacuaugggcaaccuuauuguccuuaacauucauaaaaacgacauucucauugcacuacgcuuggaaaacaauggcuaugguucuaucuaucguaagucucuuuccccucugccuaucuaccacuucccagaaaaccaccuggcucccaguucuccuuggaucucuugguugcaaaccacuuaccauguuccuaauagcggaaaacaaaaucuggggaagaagaucuuggccucuuaacgaagguauuauggcugugggaauagucucaauuuuacuaaguaguuuauuaaagaacgauguaccuuuagcgggaccguuaauagcuggcggaaugcuuauugcauguuacgucauuucaggaucuucugccgaccuaucucuagaaaaagcugcugaagucaguugggaagaggaggcagaacauucgggagcgagccacaauaucuuaguagaaguucaagacgaugguacaaugaaaauaaaagaugaagaaagagaugauacgcuaacgauacuucuaaaagccacacucuuagcgguaucaggagucuaucccuuaucuauuccagcgacucucuucguaugguauuuuuggcagaagaagaaacaaagaagcggcguccuuugggauacaccuuccccaccggaggucgaaagagcagugcuagacgacggcauauaucgaauaaugcagagaggucuauuaggacgcagucagguugggguaggaguuuuucaagagaacguauuucauacaauguggcauguaacgagaggagcagugcuaauguaucaaggaaaaagacucgagccaagcugggcauccguuaagaaagauuuaaucaguuauggcggcggguggcgacuucaaggaucauggaacacaggagaggaagugcaagucauagcaguagaacccgguaaaaacccaaagaaugugcaaacugccccugguacauucaaaacaccagagggagaaguuggugcaauagcucuagacuuuaagccagguacuucggggucgccuauuguaaaucgagaaggcaaaauaguagggcuauacggaaacgggguugucacaacgucagguacuuacguaucugcuauagcacaagccaaagcaucucaagaggguccacucccggaaauagaggaugaaguauuuagaaagcggaaccucacgaucauggauuuacacccagggaguggaaaaacccgaagguaucucccagcuauaguuagggaggccaucaaaagaaaauuaagaaccuuaauacuagcccccacucgugucguggcguccgagauggcggaagcacugaaaggaaugccgauucgauaucaaaccacggcggugaaaucugaacacacaggaaaagaaauuguggaucugaugugucaugcaaccuuuaccaugaggcuacuuucuccggugcgagucccaaauuacaauaugauuauaauggaugaagcacauuucacugacccaucgucaauagcggcucguggguauaucagcacuagaguagguaugggcgaagcagcagcaauauucaugacggcuacaccuccuggaucaguugaggcauucccccaaucaaaugcaguaauacaagaugaggagcgggauauaccagaaagaucuuggaacucaggauaugaguggaucaccgauuucccuggaaaaacugugugguuuguaccauccaucaaaucaggaaaugacauugcgaauuguuuacggaaaaacggaaaaagaguaauacagcuaaguagaaaaacauucgacaccgaauaucagaaaaccaagaauaacgacugggacuauguagucacgacagauaucagcgaaaugggagccaacuuucgagcagaucgugucauagauccacguagaugucuaaagccaguaauccuaaaagauggccccgaacgcgucauucuagcaggaccaaugcccgucacaguagcuucagcugcacaaagaaggggaagaaucggaagaaaccauaacaaggaaggagaccaguacauauauauggggcaaccucuaaauaacgaugaggaccaugcucauuggacagaagcaaaaauguuacuagacaacauaaacacgccugaaggaaucaucccggcccuauuugagccugaaagagaaaagucagcagcaauagauggagaauauagacuaagaggugaagcaagaaaaacuuuuguugaacuaaugcggcggggagaccuaccaguuugguugaguuacaaggucgcgagugaaggauuccaauauagugaucgacgaugguguuuugacggugaacgaaauaaccaagugcuagaagagaacauggauguagaaauauggacuaaggaaggggaacgaaagaaacugcgacccagguggcuagacgcaagaacauacucagauccguuggcacugcgcgaauuuaaagaguucgccgcaggucgacgaagugucucuggagacuuaauucuagagauaggcaaacugccacagcaucuuacccagagggcucaaaaugcuuuagauaaccuagugauguugcacaacagugagcagggaggcagagcauacaggcacgcgauggaagaacucccagauacuauugaaacauuaauguuacuugcacuuauagcgguacuaacugggggaguaacccuauucuuuuugucagguagagguuugggaaaaacuucaauaggacuucuuugugugauggcaucuucaguccuacucuggauggcaucugucgaaccccauuggauagcugcaucaauaauacuagaguucuuccucaugguuuuauuaauaccagagcccgaucgccagagaacaccacaagauaaucaacuagcuuauguugugauaggauuacuauuuaugauucucaccguagcagcaaacgagaugggccuucucgaaacgacuaagaaagaccuaggaaucggacauguggcaguugggaaucaucaucaugcugcuauguuagauguggacuuacacccagccagcgcauggacccuauacgccguugccacuacaauaauuaccccuaugaugcgucauacgaucgaaaauaccacggcuaauauaagucuuacggcgauagcuaaccaggcagcaauucucaugggucucgauaaggguuggccaauuuccaaaauggauauaggugucccguuauuggcacuagguugcuauucacaggucaauccauuaacauuaacggcggcagucuugauguuaguagcccacuaugcgauaauuggaccaggacuacaagcaaaagcuacuagagaagcccaaaaacgcacggcggcaggaauaaugaaaaacccuacuguagauggaaucgucgcuauagauuuagacccuguaguguaugaugccaaauucgaaaaacagcuaggacaaauuaugcuacucauacuaugcacuucucaaauacugcuaaugcgaaccacaugggcguugugcgaauccauaacuuuggcaacaggaccguugacaacguuaugggaagggagcccgggcaaguuuuggaauacuaccauagcuguuagcauggcaaauaucuuucgaggaucauacuuagcaggcgcaggauuagcauucucccucaugaaaaguuuaggaggaggacggagaggaacuggagcacagggagagacacucggggagaaauggaaacgacaguuaaaccagcuuaguaaaucagaauuuaacacauacaaaagaaguggcaucauggaaguugauagguccgaggcaaaagaggguuugaaaagaggugaaacuacuaaacaugcuguaaguagaggaacagcgaaacuucgaugguucguggaacgaaacuuaguuaagccagaaggaaaaguaauagaucuaggguguggucguggagguuggucauauuauugugcaggauuaaagaaaguaacagaagugaaaggcuacaccaagggugggccaggucaugaggaacccauuccaauggcaacguaugguuggaaucuaguaaaguuacauucagguaaagacgucuuuuucauaccacccgagaaaugcgauacauugcugugcgacauaggggagucaagccccaacccgacaaucgaggaaggccgcacauuacgcguauuaaaaauggucgaacccuggcuaagggguaaucaauucugcauuaaaauccuaaacccuuauaugccgucaguaguugaaacucucgaacaaaugcagaggaaacauggaggaaugcucguccggaacccccucaguagaaauaguacacaugaaauguacuggguauccugcggaaccggaaauauaguaagcgcuguaaauaugaccucacguaugcuuuuaaauagauuuacaauggcccaccggaagccaacuuacgagcgugaugucgauuuaggagcgggaacccgacauguggcaguugagccggaaguugcaaaccuagauaucauaggccagcgaaucgagaauauaaaacaugaacacaaguccacauggcauuacgaugaagauaaccccuacaaaacgugggcuuaucauggauccuaugagguuaagccguccggaucugcaucuaguaugguuaacggaguaguuaaacuguuaacuaaaccuugggauguuauuccaauggugacccaaauagccaugaccgacacuacuccauuuggccaacaaagaguguucaaggaaaaagucgauacccgaacuccaaaagcaaagagaggaacagcacagaucauggaagucacggccaaauggcuauggggcuuuuuaaguagaaauaaaaagccgagaaucugcacgagagaagaguucacucgaaagguuagaucaaacgcugcaauaggggcaguuuucguggaugagaaccaauggaacucggcaaaagaagcgguugaagacgaaagauuuugggauuuagugcacagagagcgcgaauuacauaaacagggaaaaugugcgaccuguguauacaauaugauggguaaacgcgagaagaaacuaggggaguucggaaaggcaaaagguagcagagcuauaugguauauguggcuaggugcaagauuuuuagaguucgaggcuuuaggauuuaugaaugaagaucauugguucagucgagaaaauucauuaagcggaguugaaggagagggucuacauaaauuagguuauauacuacgcgacauuucaaaaaucccagggggcaauauguacgcggaugacacggccgguugggacacaagaauuacugaggacgacuuacaaaacgaggcacgaauaacugacauuauggagccagagcaugcucucuuagccaaauccauauucaaacuaacauaucagaacaaaguaguacgaguccagagaccugcuaaaaauggaaccgucauggauguuauaagccgaagggaucaaagaggaagcggacaaguaggaacuuacggauuaaacacuuuuaccaauauggaagcccagcuaauaagacagauggaaucugaagggauuuucuccccaagcgaauuggaaacgcccaaccuagccgaaaggguacuugacuggcuagagaaauauggggucgagagguuaaaacgcauggcuauaucaggagacgauuguguagucaaaccgauagacgacagauucgcgaccgcacuuacggcuuuaaacgacaugggaaaaguuagaaaagauaucccacaaugggagccguccaagggauggaacgauuggcagcaaguucccuucuguagccaccauuuucaccagcuaauuaugaaagaugggagagaaaucguuguuccaugucggaaccaagacgaauugguuggcagagccagaguaucucaaggagcaggguggucucuacgagagacagcaugucuagggaagaguuaugcacaaauguggcaacugauguauuuucaccgucgugaucuacggcuagcagcuaacgccauuugcagcgcagugccaguagauuggauaccuaccucucgcacaacguggaguauacacgcgcaccaccaauggaugacuacagaggauauguuaucaguauggaauagaguguggauugaggagaaucccuggauggaggauaaaacgcauauaagcucuuggggugacguucccuaucuagguaagagggaggaucaaugguguggaucguuaauaggauugacugccagggcaacaugggcuaccaauauacaaguugcuaucaaccaaguaaggcgccuaauugguaacgaaaauuaccuggauuauaugacaaguaugaaacgcuuuaaaaaugaaagugaucccgaaggcgcauuaugguag

SEQ ID NO: 21223 - RNA, 9879 nt, Artificial Sequence
  derived and/or modified CDS sequence (opt6) from DENV-1__HM181959__SS-prME
ucaguaacaaugcuauugauguuaaugccuacagcacucgcauuccacuuaacaacuagaggaggggaaccacauaugauuguuagcaaacaagaaagaggaaaaucauugcuguucaaaacuucagcaggcgugaauaugugcacuuugaucgcaauggacuuaggagaauuaugugaagauacuaugacauacaaauguccaagaauaacggaagcugaaccagaugacgucgauuguugguguaacgcaacugauacauggguuacuuauggcacaugcagucaaacaggagaacauagacgugauaaaaggucaguagcacucgcgccucaugucggacucgguuuggaaacaagaaccgaaacauggaugucaucugagagcgcuuggaaacaaauucagagaguggaaacaugggccuuaagacauccuggguucacuguaauagcauuauuccuagcccaugccauaggaacaucgaucacucaaaaaggaaucauuuuuauccucuugaugcuagucacaccaaguauggcgaugagauguguagggauuggaaguagagacuucguagagggacuaucaggagcaacauggguagacguaguccuagaacacgggaguugcguaaccacuauggcgaaagacaaaccuacauuagauaucgaauuauuaaaaacggagguaacaaauccugcuauccugagaaaauuauguaucgaagcaaaaauuaguaauaccacuacugauucccgaugcccgacgcaaggggaagcaaccuuaguugaagaacaagaugccaacuuuguauguaggagaacauuuguagaucgagguugggggaacggaugugggcucuuuggaaaagguaguuuaauuacuugcgcgaaauuuaaauguguuacaaaacuggaggggaaaauuguucaauacgaaaacuugaaauacucaguaauagugacaguccauaccggggaucaacaccaaguugggaaugaaaguacugaacaugguacaacggcuaccauaacuccgcaagccccaaccacagagauccaauuaaccgacuauggugcguuaacacucgacugcuccccacgcaccgggcucgacuuuaacgaaaugguucugcuuacgaugaaagaaaaaucaugguugguacauaaacaaugguuuuuagauuugccgcugccuuggacuuccggcgcguccacaagucaagaaacuuggaauaggcaggaccuauuaguaacauucaaaaccgcacacgccaagaaacaagaagucguggucuuaggaucgcaagaaggagcaaugcauacagcccuaaccggagcaacagaaauccagaccucaggaacaaccacuauuuuugccggucaucuuaaaugccgacuuaaaauggauaaacuuacacucaaaggaaugagcuauguaaugugcacugguucuuucaaauuagaaaaagagguagcggaaacgcaacauggaacgguacucguacaaaucaaauacgaaggaaccgaugcacccuguaaaauuccauuuucaacgcaggaugaaaaaggcguaacucagaacgguagacuuauuacagcuaacccuauaguaacggacaaagagaaaccaguaaauauugaggcggaacccccauucggagaaaguuauauuguuauaggcgcuggagagaaagcacuuaaacugaguugguuuaagaaagggaguaguauagggaaaauguucgaagccacagcuagaggcgccaggcggauggcuauauuaggugauaccgcaugggauuuugggaguauaggaggggucuucacaucaguuggaaaguuaguacaucaaauauucggaacagcauauggaguacuguucucuggugugucguggacaaugaaaauaggaauagguguuuugcuuacaugguugggauugaacaguagaucaacaucuuugaguaugacuuguauagccguaggccucguaacacuguaucugggaguaaugguacaagcugacuccggaugcguaauuaacuggaaaggacgagaauugaaaugcgguagcggaauauucgucacaaacgaaguucacaccuggaccgaacaguacaaauuucaagcugauucaccgaaacgucucagugcggcuauaggaaaagcaugggaagaaggcguaugugguauaaggucugcaacuagacuggaaaauauuauguggaaacaaauaaguaaugaguuaaaccauauccuauuagagaacgacaugaaauucacaguuguaguaggagauguugcgggaauauuagcgcaagggaagaaaaugauaaggccacaaccuauggaauauaaauacucuuggaagaguuggggaaaagcuaaaguaauaggagcagauguccaaaauaccacguuuauuaucgaugggccaaauacaccugaauguccggacgaucaaagagcauggaacaucugggaaguagaagauuacggauucgggauuuuuacaacaaacauaugguuaaaauuaagagauucauacacucaaguaugugaucauagacuuaugagcgcugcaauuaaagauucaaaagcagugcaugcagauaugggauacuggaucgaaagcgagaaaaacgaaacauggaaacucgcuagggcaaguuuuauagagguaaaaacuuguauuuggccuaaaucucauacacuguggucaaauggaguccuugagucagagaugauuaucccaaaaauuuauggaggaccuauaagucaacauaacuacaggccgggauauuucacucaaacagcuggcccauggcaccucgguaaacuugaacuugauuucgacuuaugugaaggaacaacagugguuguagaugagcacugcggaaaucgagguccaagucuacguacaacuacuguuacagguaagauaauacaugaaugguguugcagaucauguacccuaccaccacugagauuuagaggagaggauggaugcugguaugguauggaaauccgacccguuaaagaaaaagaagaaaaucucgugaaaaguauggucuccgcaggaaguggagaaguagauuccuucucacuaggccuauuguguauaucgauaaugauagaggagguuaugagaucaagauggucccgaaagauguugaugaccgguacgcuaguaguuuuccuauugcugauuauggggcaacuuacguggaacgauuuaauccgucuuuguaucaugguaggagcaaacgcauccgauagaaugggcaugggaacuacguaucuagcacugauggcuacauuuaaaaugcggccaauguuugcgguaggguugcuauuuagacgguuaacaaguagggagguccucuuacuaaccauaggucucucucuaguugcaaguguugaguugccaaauucacuugaagaguuaggugacggguuagccauggguauaaugauauuaaagcugcuaacagacuuucagucacaucaacucugggcuaccuuacuuucauugacauuuauaaaaacaaccuucucccuacacuaugcauggaaaacuauggcaaugguuuuaaguauaguuaguuuauucccuuuaugcuuaagcacaaccucacagaagacgacaugguuaccgguguuacucgguucuuugggauguaaaccacugacgauguuuuugauugcugaaaauaagaucuggggccggaggucguggccuuuaaacgagggaaucauggcuguuggaauuguuucuauuuuacugucaucacucuuaaagaacgaugucccgcuagcgggcccacuaauugcaggcgggaugcucauagccuguuauguaauaucuggauccucagcagaucuuucgcuugaaaaagcggcagaaguaucaugggaggaggaagcagagcacaguggcgcgucacacaacauacuuguugaaguacaagaugauggcacuaugaagauuaaggacgaagagagagaugauacccuuacaauauugcuaaaagcuacacuguuagcggucucaggcguuuauccuuuaucgaucccugcuacucuguuuguaugguauuuuuggcagaagaagaaacaacgauccggcguccuuugggauacuccgucuccaccagagguugaaagagccgucuuagaugaugguaucuacaggauuaugcaaagaggauuacuagguagaagucaagucggcguaggaguguuccaagaaaauguguuucacacaauguggcauguuacuagaggagcaguuuuaauguaucaagguaaaagauuggaaccaaguugggcuucagugaaaaaggacuuaauuuccuauggcggggguuggagacuccaaggaaguuggaacacuggagaagaaguacaaguuauugcugucgaaccugguaaaaauccgaaaaacguccaaacagcucccggaaccuuuaagacaccugaaggugagguaggugcaauugcuuuagacuuuaagccaggcacauccgguucgccaauuguuaaucgugagggcaagauuguuggguuauauggcaauggaguugucacuaccucagggacauacguuucagcaauugcacaggcaaaggcuucgcaggagggaccgcuacccgaaauugaagaugaagucuuuaggaaacguaaccucacaaucauggaccugcaccccgguuccgggaagacuaggagauaccuuccagcgauagucagagaagcaaucaaaaggaaacuacguacacugauacuagcucccacucgaguaguugcauccgaaauggcagaagcccuaaaaggaaugccaauuagauaucaaacgacagcugugaagucagaacauaccggcaaagaaauagucgaucuaaugugucaugcgacauucacgaugagacuacuuaguccgguacgagucccaaacuauaacaugaucauaauggaugaggcucacuucacugacccaucuagcauagcggcaagagguuacaucuccacaagaguuggaaugggggaagcagcugcgauauucaugacugcuacuccaccugguaguguggaagcauucccacaaucaaaugcgguaauccaagaugaagaaagggauauaccugaaagaagcuggaacucuggcuacgaguggauaacugacuuuccaggcaagacuguaugguuuguacccucaauaaagucagguaaugacauagcgaauugccuuaggaaaaacgggaagagggugauacaacucucaagaaagacuuuugacacagaauaucagaaaacuaaaaacaacgauugggacuaugucguuaccacugacaucucugaaaugggugccaauuucagagcugaucgcgucaucgauccgcggagauguuuaaagccagucauacuaaaagauggaccagaacgaguaaucuuagcaggcccaaugccagugacaguagcaagugcagcucaacgacgaggacguauaggaagaaaccauaacaaagagggagaccaauacauuuauaugggccaaccucucaauaacgaugaagaucacgcacauuggacggaagccaaaaugcuguuggauaacauaaauacaccagaagggauaaucccugcucuauuugaacccgaaagggagaaaagugcagcgauagacggagaguaucgauuaagaggagaagcaaggaaaacuuuuguagaguuaaugcgacgaggagaccuuccaguguggcucucauacaaaguagcaucggaaggauuucaauauucggaccgacgaugguguuuugauggcgaacgaaauaaucaaguuuuagaagaaaacauggauguggagauuuggacuaaagaaggagagaggaagaaguuacgaccucggugguuggacgcaagaacuuauagcgacccccuagcauuacgugaauuuaaagaauuugcugcuggucguagaagcgugucuggugaccuuauauuggaaauagguaaacuuccgcaacaccugacccaacgggcucagaaugcacuagacaauuuaguaaugcuucacaacuccgaacaggguggacgggcuuacagacaugccauggaggaauuaccggauacgauagaaacucuaauguuauuagcguuaauugcugugcuaaccggugggguuacucuguucuuucugucaggaagaggguuaggaaaaacaucuauagggcuucuauguguaauggcauccucaguuuuacuuuggauggcaucaguagaaccccacuggaucgcagcuucaauaauucuugaauuuuucuuaaugguuuuauuaaucccugaaccagaucggcaaagaacgccacaagauaaucaacucgcuuacguuguaaucggucuguuauuuaugauacuuacagucgcugccaacgaaaugggucuucuggaaacaaccaagaaagacuuagguaucggucacguugcuguuggaaaucaucaccaugcagccauguuggauguugaccuacauccugcuagugccuggacccuauacgcgguagcaacaacaaucauaacccccaugaugagacacaccauagaaaauacaaccgcaaauaucucucuaacggcaauagcaaaucaggcagcaauacuaaugggacucgacaagggauggccaaucaguaaaauggacauaggaguaccauuguuggcguuagguuguuacucacaaguuaauccuuuaacccuuacagcggcuguauuaaugcucguugcacauuacgccauaauuggcccgggacuccaagcuaaagcaacucgugaagcucagaaaaggacagcggcagguaucaugaaaaacccaacaguagauggaaucguagcuauagacuuagauccaguggucuaugaugcgaaguuugaaaagcaauuaggacaaaucaugcuacugauauuaugcacgucgcaaauucuucuaaugagaacaacgugggcccucugugagucuauuacguuagcuacagggccguuaacaacauugugggagggcucaccugguaaauuuuggaauacaacuauagcaguuucuauggcaaauaucuuuagaggaucguauuuagcgggagcuggucuggcauucucacucaugaaaagucugggagguggccgaagggguacaggugcacagggcgaaacgcugggagaaaaauggaagcgucagcucaaccaacugaguaaaucggaguuuaacacuuauaaaaggagcggcaucauggaagucgauaggucagaagccaaggaaggucugaagagaggggaaacuacaaaacaugcgguaucuagaggaacagcgaaacuacggugguuuguugagagaaaucuugugaaacccgaaggaaaaguaauagauuuagggugugggagaggcggauggucauacuacugugccggacuaaagaaaguaaccgaagucaagggguauaccaaagggggaccaggacacgaggaaccuaucccaauggcuacauauggauggaauuuagugaaauugcacucugguaaggacguauuuuucauuccuccagagaaaugugauacauuacuaugugauauaggagaaaguucuccaaauccaacgauugaagaaggacgaacauugcggguacuaaaaaugguagaaccauggcugagggguaaccaauucuguaucaaaauacuaaacccauacaugccaaguguuguagaaacgcuggagcaaaugcaaagaaaacauggcgguaugcuagucagaaauccucuuuccaggaauaguacucaugaaauguauuggguaagcugugguacugguaacauaguaagugcaguaaacaugacaucuaggaugcuacuaaauagguuuacuauggcacaucgaaaaccaacauacgagcgggacguagaucuaggcgcugggacuagacaugucgcuguggaaccagaaguugcuaauuuggauauaauaggucaacgaauagagaacauaaaacaugaacauaaaaguacauggcacuacgaugaagacaauccauauaagacgugggcauaccacggcucauacgaagucaagccgucagguucugcaaguuccaugguuaauggagucguaaaauuacuuacaaagccgugggauguaaucccuaugguuacacagauugcuaugacugacacaacgccauucggucaacaaagaguuuuuaaagagaagguugauacaagaacaccgaaggcuaagagaggcacagcacaaauaauggaaguaaccgcuaagugguuauggggguucuuaucucggaauaagaaaccccgcauuugcacgagagaagaauuuaccagaaaagugcgaucuaacgcggcgauuggggcuguuuuuguagaugagaaucaguggaacagugcaaaagaagccguagaagaugagagauucugggacuugguacacagagaaagggaacuacauaaacagggcaaaugcgcgaccugcgucuacaacaugaugggaaaaagagagaagaaguuaggagaauuuggcaaggcaaaaggcagcagagcaauuugguauauguggcucggagcgagauuucuagaguucgaggcacuagguuuuaugaaugaggaccacugguuuucuagagaaaauucgcuaucaggcguagagggugagggauuacauaaauuaggcuacauauuacgugacaucucaaagauaccagguggaaacauguacgcagaugacacagcaggcugggauacuagaauaacggaagacgauuuacaaaaugaagcacguauaacugauauuauggaaccagaacaugcacuacuugcgaaaaguaucuucaaacuaacauaucagaacaaaguaguaagaguccaaagaccagcgaaaaaugguacagucauggauguuauaucgaggagagaucagagaggaagcggacagguagguacguacggauuaaauacuuucacaaacauggaggcgcaacuaauuagacaaauggagucugaggguauuuuuaguccuagugaacuagaaacuccuaauuuagcagaacgaguuuuagacuggcuggaaaaauauggaguugaacgccuaaaacgaauggcgauaucgggcgacgacugcguagucaagccuauagacgauagguuugcaaccgcccucacggcuuugaacgauauggguaagguacgcaaagauauaccccagugggaaccuucaaaaggguggaaugauuggcaacaaguuccuuucugcucucaucauuuucaccaguugauuaugaaagauggucgagaaauuguagucccgugucguaaucaggaugagcuaguuggcagagcaagagugucgcaaggcgcgggauggucauugcgagaaacagcgugucuaggaaaaucauacgcacagauguggcaguuaauguauuuucaccgccgugaucuuaggcuagcagcaaaugcgaucuguuccgcugugccaguggauuggauacccacguccaggacgacauggucuauccaugcucaucaucaauggaugacaacugaggauauguuaucaguauggaaccggguuuggauugaagaaaauccuuggauggaggauaaaacacacauauccucauggggugauguuccguaucuuggaaagagagaggaucaguggugcggcagcuugauaggguuaaccgcucgagcaacuugggcgacaaauauccaaguugcuaucaaucaaguaagacgacucauaggaaaugaaaacuaucuggauuacaugacgaguaugaagcguuuuaaaaacgaaagugauccugagggugcccuuugguga

SEQ ID NO: 21224 - RNA, 9879 nt, Artificial Sequence
  derived and/or modified CDS sequence (opt6) from DENV-1__JF937651__SS-prME
agugucacaaugcuuuugauguuaaugccgacagcucucgcauuucauuuaaccacacguggaggcgaaccucacaugauucuaaguaaacaagaacgggggaaaaguuuauuguuuaaaacaucagcaggaguuaacauguguacccugauagcaauggacuuaggugaauuaugcgaagacacaaugaccuauaaauguccaagaauuacagaagcagaaccugaugauguagauuguuggugcaaugcaacugauacauggguaaccuauggaacaugcagccaaacaggagaacacagacgugacaaacguucagucgcguuagcaccacauguuggacuugguuuagaaacacggacagaaacuuggauguccagugaaggagccuggaaacaaauccaacgcguagaaacaugggcacuuagacaucccggauucaccguuauagcacuauucuuagcacacgcgauuggcacauccaucacgcaaaaagguauaaucuuuauucugcucaugcugguaacaccuucaauggcgaugcgauguguuggaauaggaucucgagauuucguggaagguuugucaggcgcaacgugggucgauguuguucucgagcacgggucuugcguaacgacaauggcaaaagacaaacccacacuagacauagaauugcuaaaaacugaagucacuaauccagcaaucuuaaggaaauuaugcaucgaagcaaaaauuuccaacacgacuacugacucccguugcccuacacaaggcgaagcuacuuuaguugaggaacaagaugcaaauuuuguuuguaggcggacuuuuguagauagagguugggggaauggcuguggacuauucggcaaagguucucugauaacaugugcuaaauucaaauguguaacaaaauuggaagggaagauaguucaauacgaaaacuuaaaguauucaguaauuguaacaguucauacaggagaucagcaccaggucgggaaugaaucuacugaacaugggaccacagcuaccauuacgccacaagcaccaaccacugaaauucaauugacugacuauggggcuuugacccuugauuguucgccacgaaccgguuuagauuucaacgaaaugguucuacuuacgaugaaggaaaagagcugguugguucacaaacagugguuccuugauuuaccauuaccguggacuucaggagccagcacaucucaggagacauggaaccgccaagaucuucuaguaacuuucaagaccgcacaugcaaagaaacaagaaguaguaguacuagguagccaagaaggggcuaugcauaccgcacuaacaggagccaccgaaauacaaacuucgggaacaacuacuauauucgcuggacaccuaaaaugccgcuugaaaauggacaaacuaaccuuaaagggcaugucauacguaauguguacagggucuuuuaaauuagagaaagaagucgcggaaacccaacacgguacaguuuuggugcaaauaaaguacgaaggaacggaugcucccuguaaaauaccuuucagcacacaagaugaaaaaggagugacacaaaauggccgauuaaucacagccaauccaauaguaacagauaaagaaaaaccaguaaauauagaagccgaacccccauuuggagaguccuauauagucauaggagcgggcgaaaaggcgcuaaaacuaagcugguucaagaaagggaguucaauugguaaaauguuugaagcaacugcgagaggcgcacgucgaauggccauacuuggcgauacagcaugggacuucggcuccaucggcggaguuuuuacuucagucggaaaacuaauccaucaaauauuuggaacugcuuacggaguuuuauuuagcggggucaguuggacaaugaaaauaggaauaggggugcuuuugaccugguuaggauuaaauucacguucaacaagccugucaaugacuuguauagcaguggguuuaguaacauuauacuuaggaguuaugguucaagcagacucagguuguguaauaaacuggaagggaagagaacucaaauguggaaguggcauauuuguaaccaacgagguucauaccuggaccgaacaauacaaguuucaggcagauagccccaaacgauuaagugcagcaauugggaaggcaugggaagaaggggugugcgguauacgaagugcaacucgguuagaaaacauaauguggaaacaaauaaguaacgaguuaaaucauaucuuacuagagaacgauaugaaguuuacuguugugguuggggacguagcaggcaucuuggcucaagguaagaaaaugauaagaccacaaccaauggaauauaaauauagcuggaaaucuuggggaaaagccaagaucaucggugccgauguacaaaauacaacauuuaucauagauggaccuaauacacccgaauguccggaugaucaacgugccuggaacauuugggaaguugaagauuauggauuugggauauuuaccaccaacauauggcuaaaauugagagauuccuauacacaaguaugcgaccauagacucaugagugccgcaauaaaagacucaaaagcgguccaugcagacaugggauauuggauugaaucugagaagaaugaaacauggaaauuagcacgggcgaguuuuauagaagugaaaaccuguauuuggccgaaaucacacacauuauggucaaauggagugcuugaauccgaaaugauuauacccaaaauauauggcggaccuaucagucagcauaauuauaggccagguuauuucacucaaacugcaggcccauggcauuuaggaaaauuagaacuugauuucgacuuaugugaaggaacuacaguuguaguggaugaacauugcggaaacagagguccaucauuacguacaacaaccguuacggggaagauuauacacgaauggugcugucgaucguguacgcuaccgccguuacgauuccgaggugaagacggguguugguacggcauggaaauucgaccaguaaaagaaaaagaagagaacuuaguaaaauccaugguaucggcggguucuggggaaguagauucguuuucgcuuggauuauuauguauaagcauaaugauugaggaaguuaugagaucucgauggagcaggaaaauguugaugacgggaacguuagccgucuuuuuauuguuaaucaugggacaacuuacguggaacgaucuaauucguuuguguauaaugguuggagcgaacgccugugaccgcaugggcaugggaacaacauaccuugcuuuaauggccacuuuuaaaaugagaccuauguuugccguaggccuauuauuucguagauuaacgucaagggaaguacucuuguuaacuaucgguuuaucucuagucgcgagcguugaacuuccgaacucuuuagaggaauugggcgauggcuuagcgauggguauaaugauuuuaaaauuacuuacagauuuucaauccuaccaacuaugggcgacacuacuuuccuuaacauucaucaaaacuaccuucaguuuacacuacgccuggaaaaccauggcgaugguucucuccaucguuuccuuauucccauuaugcuuaaguaccacuagccagaaaaccacaugguuaccaguucuccuggguuccuugggaugcaaaccucugacuauguuuuuaauugcugaaaacaaaauauggggacgaagaaguuggccacugaacgaagguauuauggccgucgggauagucaguauauuacuaucuucgcuucuuaaaaacgauguccccuuggcuggccccuuaaucgcuggugguauguuaaucgcuuguuauguuauaucagggaguucugcagauuuaucgcuugagaaggccgcagaagucagcugggaggaggaagcagagcauucaggcgcuucacauaauauuuuaguagaaguacaggaugacggaacuaugaaaauaaaagaugaagagagagaugauacuuuaacuauauuacuaaaagcuacucugcuugcaguuucggggguauacccacucaguauucccgcaaccuuauuuguaugguauuucuggcagaagaagaaacagcggucuggaguuuuaugggacaccccgucuccaccagaaguugaaagagccgucuuagaugauggaaucuaucguaucaugcaacggggucuuuuaggacguagccagguaggaguggggguuuuccaagagaacguauuccauacaauguggcauguaacacgaggggcuguacuaauguaccaggggaaaagacuagaaccuucgugggccucaguaaagaaagauuuaauaaguuacggagguggauggcgcuuacaaggaucuuggaauacaggcgaagaaguccaggugauagcaguugagccaggcaaaaauccgaaaaauguccagacagcgccaggaacuuuuaaaaccccugagggcgaaguaggagccaucgcacuugauuucaaaccagggacaucggggaguccaauaguaaaccgugagggaaaaauugucggccuuuauggaaaugggguagugacaacuucggguaccuacgucagugcaauugcucaagcgaaagcaagccaagaagguccucuaccagagauagaagaugaggucuuuagaaagagaaauuugacgauuauggaucuacaucccgggucagggaaaacacgaagauaucuccccgcaauagucagagaagcuauaaaaagaaaguuaagaacauuaauucucgccccaacaagaguuguagccuccgaaauggcagaagcacugaaaggaaugccaauaagauaucaaacgaccgcaguuaagagugaacauacuggcaaagaaauuguugauuuaaugugccaugcgacauuuacgaugcgauugcuaucuccagucaggguaccuaauuacaauaugaucaucauggaugaagcccauuuuaccgacccgaguaguauagcagccagggguuauauaaguacccgaguagguaugggugaagcugcugcaauauuuaugacugcaacucccccgggauccgucgaggccuuuccacaaucaaacgcuguaauacaagaugaggaaagagauauuccggaacgcagcuggaacucuggauaugaauggauuacggauuuucccgggaagacugugugguucguuccaagcauuaaaucuggcaaugacauagcuaacugucuaaggaaaaauggaaagagaguaauacaguuaagucguaaaacuuuugauacagaauaccagaaaacuaagaacaacgauugggacuauguugugacaacagacaucucggaaaugggugcuaauuucagggcagaccguguaaucgacccgcgccgauguuuaaagccagucauauugaaggauggaccagaaagaguaauccuggcuggaccgaugcccguuacaguugcuagugcagcacagagaagagguagaauuggaagaaaccauaacaaagaaggagaucaauacauuuauaugggacaaccacuaaacaaugacgaagaucaugcucauuggacugaagcaaaaaugcuacuugacaacauaaauacaccagagggcauaaucccagcccuguucgaaccagaacgugaaaaaucagcugcaauagauggagaauaucguuugagaggggaagcaaggaaaacuuucguugaacuuaugagacgaggcgaccugccaguaugguuguccuauaaagucgccucagaggguuuccaguacagugaccgaagaugguguuucgacggagaaagaaacaaccaagucuuggaagaaaacauggauguagagauuuggacaaaagagggagaacggaaaaagcuacguccgcguuggcuugacgcucgcacauacagugauccgcuugcgcuaagagaguucaaggaauuugcagcaggaagaagaucgguaaguggagaucugauauuggaaauuggcaaacugccgcaacacuuaacccaaagggcgcaaaacgcgcuagacaauuuaguaauguuacauaauucugaacaagguggccgagcauacaggcaugcaauggaggaguuaccugauacuauagagacguugaugcuacuagcacuaauugcaguauuaacagguggugugacauuguucuuccuaucaggaagagguuuagguaaaacaucaauuggguuguugugcgucauggcuaguagcguauuacuauggauggcuucaguagaaccacauuggauagcagcuagcauaauucuggaauuuuucuuaaugguccuguuaauccccgagccugauagacagaggacaccucaggauaaucaacuugcauauguagucauaggauuacuguucaugauauuaacgguagcugcgaacgaaauggguuuauuagaaacaacuaagaaagauuuggggauaggacaugucgcagugggaaaccaucaucacgccgccauguuggaugucgacuuacauccugcaucagcauggacauuauaugcgguagcaacaaccaucauuacaccaaugaugaaacauacuauagaaaauacaacagcaaacauuucguuaacagcuauagcaaaucaagcagcaauucuaaugggcuuggauaaaggauggccaaucucuaagauggauauaggcgugccucuauuagcacuaggcugcuacucacagguuaauccacuaacacuaacagcggcaguacuuauguuaguggcccauuaugcuaucauuggacccgguuuacaagcaaaagcuacaagggaagcacaaaagagaacugccgcagguauaaugaaaaaucccaccgucgacggaauugucgcuauugauuuagacccuguuguuuaugaugcaaaauuugaaaaacaacuaggucagaucauguuacuuauucuauguacuucacagauucuucuaaugagaacuacuugggcuuuaugugaaagcauuacauuagcaacuggcccauugaccacucuaugggaggguaguccuggaaaauuuuggaauaccacaauugcaguaucaauggcaaacauauuuagagggucauaucuagcgggagccggacuagccuucucacuaaugaagucccuaggaggcggucguagaggcacaggugcacaaggagaaacucucggagaaaaguggaaaagacaacuaaaccagcuuagcaaaucugaguucaacacuuauaagcguaguggaauuauggaagucgauaggucagaagcgaaagaaggauuaaaacgaggcgaaacuacuaagcacgcuguaucaagagguacugcaaaacuccgaugguucgucgaaagaaacuuaguaaaacccgaaggaaagguaauugaccuuggaugugggcgaggugguugguccuacuacugugcgggauuaaagaaagugacagaaguuaaagguuauacuaaaggggguccuggacaugaggagccuauaccaauggcuacauacggauggaauuuaguuaaacuacauuccggcaaagacguauucuuuauaccaccagaaaaaugugauacauuacuuugugacaucggggagaguuccccaaauccuacuauugaagaaggccgaacacuuagaguacuaaaaauggucgaaccuuggcuccgaggaaaucaauuuuguauaaaaauauuaaauccauauaugccuucaguuguagaaacccuggaacaaaugcaacgaaaacauggagguaugcuaguaagaaauccucugucucgaaauaguacccacgaaauguacuggguauccuguggaacagguaacauaguaagugcaguuaacaugacaagucggaugcuucucaacagauucacgauggcucaccgaaagcccacguacgagagagaugucgauuugggcgcaggcacacggcauguagccguugagccagaaguagcuaacuuagauauuaucggucagaggauugaaaacaucaaacaugaacauaaguccacguggcauuacgacgaggacaacccauauaaaacaugggcauaccacgggucguaugaaguaaagccauccgguagcgcuucuaguauggucaauggaguugucaaauuguugacuaaaccaugggaugugauaccaauggucacacaaauagcuaugacagauaccacuccuuuugggcagcagcguguauucaaggaaaaaguugauacacguacgccuaaggcaaaacgaggcaccgcacaaauaauggaagugacagcuaaaugguuauggggcuuucucaguagaaacaagaagccaagaauuuguacucgggaagaauuuacuggaaaaguacgaucgaaugcggcaaucggugccguauuuguagaugagaaucaguggaauagugccaaagaagcagucgaggaugaaagguuuugggacuuagugcaucgagaacgagaguuacauaaacaaggaaagugcgcaacauguguauauaauaugaugggaaaacgcgagaaaaaguuaggagaguuuggaaaagcaaaagguucgagggccauuugguauauguggcucggggcuagauuucucgaguucgaagcucuagguuucaugaaugaggaucacugguucucuagagaaaauucauuaucaggaguagagggagaaggcuugcauaaacuugguuacauacuccgugauaucucuaaaauuccuggagguaauauguacgccgaugacaccgcuggaugggacaccagaauaacugaagacgaccuacaaaaugaagcgagaauaacagacauaauggaaccggagcaugcauuguuggcaaaaagcauuuuuaaacucaccuaucagaacaaggucguacguguccaaaggccagccaaaaacgggacgguaauggaugugauuucgcgacgugaccagagaggcucgggacaggucgguacuuauggucucaacaccuucacuaacauggaagcgcaguugauaaggcaaauggaaucagaaggaauuuucucgccaagcgaauuagaaacucccaauuuagcggagagaguacuagauugguuagaaaaauacggaguagaaagauuaaaacgaauggcaaucucgggcgacgauugugucguaaaaccaaucgaugacagguuugcaacggcucuaacagcgcuaaaugacauggggaaaguuagaaaggauaucccccaaugggaaccgaguaaaggcuggaacgauuggcagcaagugccguuuuguucacaccauuuccaccaauuaauuaugaaagauggacgagaaauuguuguccccugccgcaaucaagacgagcuagucggucgggcucgaguaagucaaggagcaggcuggaguuuaagggagacagccugccuagguaaaaguuacgcgcagauguggcaacuuauguauuuucauagaagagaucucaggcuagccgcuaaugcuauauguucagcugucccaguugauuggauaccaacgagucggacaaccugguccauucaugcgcaucaucaauggaugacaacagaagauaugcuauccguguggaauagggucuggauagaggaaaauccauggauggaagauaaaacgcacauuaguucauggggagauguuccguauuuaggcaagcgugaagaccaaugguguggaucucuaauaggacuaacggcaagagcaacuugggcuacaaauauucaaguugcaaucaaucaagugcgaagacugauagggaacgaaaauuaucuagauuacaugacaucuaugaagagguuuaagaacgaaucagacccaaagggagcguugugguaa

SEQ ID NO: 21225 - RNA, 9879 nt, Artificial Sequence
  derived and/or modified CDS sequence (opt6) from DENV-1__GU131956__SS-prME
ucggucacaaugcuacuaaugcugcuccccacagcguuagccuuucaccuaacuacaagaggaggggaaccucacaugauuguuucaaaacaagaacgaggaaaaucacugcuauuuaaaacaucagcuggaguuaauauguguacguugauagccauggauuuaggagaauugugugaagauaccaugacauauaaauguccccaaauaacggaagccgaacccgaugauguggacugcugguguaacgcaacagauacauggguuacuuacgguacuugcucgcaaacgggugaacauagacgagauaaacgaucggucgcgcucgcaccucacgugggauugggguuagaaacgcggacugaaacguggaugucaagugaaggagcauggaaacaaauucaacgcguagaaacuugggcucucagacacccgggauuuacaguaauagcccucuuuuuggcucaugcaaucgguacaucgaucacucaaaaagggacuauauucauccugcuaauguuaguaacaccaaguauggcuaugcgauguguaggaauaggcaauagagacuuuguagaaggucugaguggugccaccuggguugaugucguuuuagaacacggcucuuguguaacuacuauggccaaaaauaaaccaacauuagauauagaacuguuaaaaaccgaaguaacuaauccggccauacuaaggaaauuaugcaucgaagcaaaaaucagcaacacaaccaccgacucaagaugcccgacgcaaggagaagccacuuuaguugaggaacaagaugcaaacuuuguaugucgacgaacauuuguagaucgcggguggggcaacgguuguggauuguuugguaaaggcucauugcuaacuugugcgaaauuuaaaugcgucacaaaacuugaaggaaaaauaguccaauaugagaauuuaaaguacuccguuaucgugacgguacacacuggugaucaacaccaaguugguaacgaaacuacagaacacggaacaaucgcaacaauaacaccgcaagcaccuaccucggagauacaacuaacugauuacggggcacuaacgcuugauugcucgccuaggacaggucuagauuucaaugaaaugguccuccugacaaugaaagaaaaaucuugguuaguacauaagcaaugguuucuagaucucccacuaccauggacaaguggugcaucaacgucccaagaaacauggaaucgucaggaccuccuaguuaccuuuaagacugcacaugcgaagaagcaggagguaguaguacuaggaucacaggaaggugcgaugcacaccgcacucacuggagccaccgaaauucagacgaguggcacuacgacaauuuuugccggacauuuaaaaugucguuuaaaaauggauaagcuaacauuaaagggaacgucguacguuauguguacggguaguuuuaaguuagagaaagaaguagccgaaacacaacacggcaccguccuaguacaaguaaaguacgaaggcacugacgcuccuuguaaaauaccuuuuucgacucaagaugaaaaaggagucacgcaaaaugggaggcuaauuacagcuaauccaauugucacggauaaggaaaaaccaguuaacauugaaaccgaaccacccuuuggggaaucauauaucguaguaggagcgggggaaaaagcauuaaaacugucaugguucaagaaagggaguuccauuggcaaaauguucgaggccacagcgagaggagccagaagaauggcaauccucggugauaccgcuugggauuuugggucaauaggaggugucuucacgucaguaggaaaacucguccaucaaguguuuggaacggcauacgguguacuuuucuccggagucagcuggaccaugaagauagguaucggcauccuauugacauggcuaggauuaaacucacguucaacauccuugucaaugacaugcauagccguugggaugguuaccuuauaccuaggagugaugguucaagccgauucaggcuguguaauuaauuggaaggggagagaacuaaaauguggaucaggaauauuugugacuaaugaagugcauacauggacagaacaauauaaguuccaagcagacucuccaaaacgacuuucagcggcuauaggcaaggcuugggaagaaggggucuguggcauaagaagugcuaccagauuagagaauaucauguggaagcaaauaaguaacgaacucaaccauauuuuacuugaaaaugauaugaaauuuacaguagucguuggugacgcgaauggaauccuagcacagggaaagaagaugauccguccccaaccaauggaacauaaauauuccuggaaauccugggguaaagcuaaaauaauaggcgcagacauacagaauacaacauuuauuauugaugguccggauacacccgaauguccugauaaccaaagagcguggaauaucugggaaguugaggauuauggauucggaauauuuacaacuaauauaugguuaaaacuuagagauucguacacgcaaaugugugaucauagguuaaugagcgcugcuauaaaagauucgaaagcaguucacgcagauaugggauauuggauagaaucagagaaaaaugaaacauggaaacuagcgagagcgucuuucaucgagguaaaaaccugcacauggccuaagucgcacacgcuauggucaaaugguguguuagaaagugaaaugauaaucccaaagauauauggaggcccgauuucucaacacaacuauagaccagguuacuuuacgcaaacagccggccccuggcaccuagggaaguuagagcuagacuuugacuuaugugagggcacuacagucguuguagacgaacauugugguaacagaggcccaucgcuacguacuacaacagucacagguaaaaucauccacgaauggugcugucgaagcuguacacucccuccucuucgguuucggggagaggaugggugcugguauggcauggaaaucagaccugugaaagaaaaagaagaaaauuuaguaaggaguaugguaagcgccggaaguggagagguugauaguuucucguuagggauacuuugugccaguauuaugauagaggaaguuaugcguaguagauggucgcgaaaaaugcuaaugacgggaacgcuugcaguauuucuauuguuaguuauggggcagcugacauggaacgauuugauuagauuaugcauaaugguuggggcaaaugcgagcgacaggaugggaaugggcaccaccuaucuggcacuaauggcaacguuuaaaaugcggcccauguucgcggucggacuguuauuucgacgauuaacaaguagggaaguccuccuacuaacuauaggauugagucuagucgccaguguagaauugccaaauaguuuagaagaauuaggugauggacuggcuauggggauaaugauguugaagcuauugacagaauuucaaccacaccaauuauggacaacgcuauugucauuaacguucaucaagacaacauuaaguuuggauuacgcauggaaaacaacggcaauggcacuaucgauuguaucacuguuuccacuaugucuaucaacgacaucacagaaaacgacaugguuaccaguuuuacuuggauccuucgguugcaagccguuaacaauguuuuuaauuaccgaaaacaaaauuuggggaagaaaauccuggccacuaaaugagggaauaauggcaaucggaauaguuucaauacuauuaagcagcuuacucaaaaacgacguuccacuugcgggaccccuaaucgcuggcgggauguugaucgcuuguuauguaauaucagguucuucagcagaucuuagccuugaaaaagcagcugaaguguccugggaacaagaagcugagcacucuggaacuucccauaacauauuaguugaaguacaagaugacggaaccaugaaaauuaaggaugaagaaagagaugauacccuaacaauuuuauuaaaagcgacauuacuggcaguauccggaguuuacccgaugaguauaccagccacacucuucguuugguacuucuggcagaagaagaaacaaagaucuggagucuuaugggacacgccuaguccaccggaaguugaaagggcagugcuagaugauggcaucuaccgaaucuugcaaagaggucuauuaggacguucgcaaguaggaguugggguauuucaggacggaguuuuccauacgauguggcacguuacucgaggcgcaguacucauguaucagggcaaaagauuagaaccgucaugggcaagcguaaagaaagaucucaucaguuauggugggggauggcgauuucaaggauccuggaauacaggagaagaaguccaagucauugcaguugagcccgguaaaaauccgaaaaauguacagacaacaccuggcacuuuuaaaaccccugagggggaagucggggcaauagcauuggauuuuaaaccggguaccaguggaucuccgauagucaauagagaggggaaaaucgucggccuuuacggaaacgguguaguaaccaccucgggcacuuacguaucagcuauagcccaagcgaaggcaucacaagaaggaccguugccagagauagaggacgaaguauuuaagaaaagaaaccuaacaauuauggauuugcaucccgguaguggcaaaacgagaagauaucugccggcaaugguacgugaagcaaucaaaagaaaacuucgcacucuaauccuggccccuacacgcgucguagcgagugaaauggcggaagcacuaaaaggaaugccuauuagauaccagacgacugccguaaaaucagagcauacuggccgagaaauuguagaccugaugugucaugcaacauuuacaaugagacuccuaaguccgguuagagugccgaauuacaauaugauuauaauggaugaagcacauuuuacagauccugcaucaauagccgcaaggggcuacauuaguacgcggguuggaaugggagaggccgcugccauuuucaugacugcaaccccuccggggucgguagaggcauucccacaaucaaacgcaguuauacaggaugaagaaagggacaucccggaacgaucauggaauaguggcuaugauuggauaacugauuuucccggaaaaacuguuugguucgucccaagcauuaaaagugguaacgacauugcuaacugcuugaggaaaaacggaaaacgaguuauucagcuaucgcgaaagaccuucgauacggaauaccagaaaacuaaaaacaacgauugggauuauguagucacuacagauauaucggaaaugggugcaaauuuuagggcagaccguguaauagauccaaggaggugccuuaaaccggucauucugaaggaugguccggaaagaguaauucucgccgguccaaugccgguaacaguagcaagugcagcucaaagacgaggcagaauaggaagaaaucaaaauaaggaaggggaccaguacgucuauaugggacagccucuaaacaacgaugaagaucacgcgcauuggacagaagcaaaaauguuacuagauaacaucaacacaccagaagggauuauacccgcauuauuugaaccugaaagagagaaaagcgcggcuaucgauggagaauaccgucuccgaggagaggccaggaaaaccuucguggaguuaaugagacguggcgaucuaccuguauggcuuucuuauaaaguugcgagcgaaggauuucaauauagugauaggagaugguguuuugauggcgaaaggaauaaucaaguacuugaagaaaacauggauguagaaauuuggacuaaagaaggagaaaggaagaaauuaagacccagauggcuagaugcacggaccuacucugauccuuuagcauugcgugaguuuaaagaguuugcagcuggaaggagaucugucucaggagaucuaauacucgaaaucggaaagcuaccgcaacaccuuacacuucgggcgcagaacgcauuggacaacuuaguuauguuacacaauuccgaacaggguggcaaggcuuaucggcacgcgauggaagaauuaccugauacaauagaaacauuaaugcuucuagcacuuauagcuguauuaacuggcggaguaacccucuucuuccuaucuggaaaaggacuugguaaaaccucuauuggacuccuguguguaacggcuaguagugccuuauuguggauggccaguguagaaccucauuggauagcagccucaauuauacuagaguucuuuuuaaugguauuauuaauaccugaaccugauagacaacggacuccacaggauaaucaacucgcauaugugguuauaggccuguuauuuaugauacuaacugucgcugcuaacgaaaugggacuucuggaaacuacuaagaaggacuuggguauaggucacguugcagccgaaaaccaccagcaugcaaccaugcucgacguggaccuaaggccagcgucugcauggaccuuauacgccgucgcaacaacugugauaacaccgaugaugagacauacaauagagaacacaacagcaaacauaucacucacagcaauugcaaaucaggccgcaauacucaugggguuagauaaaggguggccgauaaguaagauggacauaggaguuccauuacuagcuuuagguugcuauagucaagugaaucccuuaacauuaacggcagcuguacuaaugcuaguagcacauuaugccaucauaggaccuggauuacaggcgaaagcaacgcgagaggcgcagaaacgaacagccgcugggauuaugaaaaacccaacuguugacggcauugucgccaucgaccuugauccgguuguauaugaugcuaaauucgagaaacaauuaggucaaauaaugcuacucauuuuauguacuucccaaauuuuauuaaugagaacgacaugggcccugugugaaucuauaacacuagcaacggguccauugacaacgcuaugggaggguucuccuggaaaauuuuggaauaccacaauagcuguuagcauggcaaacauauuuagaggaaguuaucuagcaggcgcaggacuugcauuuuccuugaugaaaucuuuaggaggaggacguaggggaacgggagcacaaggugagacucugggugagaaauggaagcgacagcuuaaccaauuaucaaagucagaguucaacacguacaagcgcucugguaucauggaaguagauaggucagaggccaaagaaggacuuaaacguggcgagacaacaaaacaugcagucucacgcgggaccgcgaaauugagaugguuuguagagcgaaauuuaguuaagccagaagguaaaguuaucgauuuaggaugcgggaggggcggaugguccuauuacugugcaggccuuaagaaagugacggaagucaaaggauacacaaaagguggucccggacaugaagaaccgauaccaauggcgacuuauggguggaacuuaguuaaauugcauaguggaaaggauguauucuucaugccaccggaaaaaugugauacacuguuaugugacauaggggaaagcucaccaaacccuacuauagaagaaggacgaacauuaagggucuuaaaaaugguugaaccuuggcuaaggggaaaucaauuuugcauaaaaauuuuaaauccauauaugccuucuguagucgaaacacucgaacagaugcaacggaaacauggcggcaugcuagucagaaauccacuaucacgcaacaguacucaugaaauguacuggguaucauguggaacaggaaauauagucuccgcagucaacaugacuucucggauguuauuaaauagguuuacaauggcacauaggaaaccuacuuacgaaagagacguggacuuaggagcuggaacacggcacguagcaguagagccggaaguugcgaaccuugauauaauaggacagcgaaucgaaaauaucaaaaaugaacauaaaagcacguggcacuaugaugaagacaacccauauaaaacuugggccuaucacggcagcuaugaagugaagccaaguggaucagcgucuagcaugguaaacggaguggugagacugcugacaaagccaugggauguaauaccgaugguuacucaaauugcaaugacagauacaaccccauuuggacaacaaagaguuuuuaaagaaaagguagauacuaggacaccacgggcaaaacgagguacaacccaaauaauggaagugacugcaaaauggcucuggggauucuuaucaaggaacaagaagcccagaauuugcacgagggaagaguucacaagaaaggugcgaucgaacgccgcuauaggagcagucuuuguugaugaaaaccaauggaacuccgccaaagaagcaguugaggaugaacgauuuugggacuugguacauagagaaagagaacuacacaaacaagggaaaugcgcaacaugugucuauaauaugauggguaaaagagagaagaaauugggugaguucgggaaagcaaaaggaagucgcgcuauuugguacauguggcuuggagccagauuucuagaguucgaggcauugggauucaugaaugaagaccacugguuuucaagggaaaauucauuaucaggugucgaaggugaaggccuccacaaacuaggauauauauuacgagacauuagcaaaauacccgguggcaauauguacgcagaugauacugcaggaugggauacccgaauaacagaagaugaccuacaaaacgaagcaaaaauaacagaaauaauggaaccugaacaugcuuuacuggcuacaucgauuuuuaaauugacauaucaaaauaaggugguucgagugcaaaggcccgcuaaaaacggcaccguaauggauguaauuucuaggagagaccagcgaggaagcggacaaguggguacauauggauuaaauacuuucacgaauauggaggugcaacuuauuagacaaauggagucagaggguauuuuccugcccucagaauuggaaacaccaaaucuugcagaaagaguauuagacugguuagaaaaacauggagcugaaagauuaaagagaauggcaauuuccggagaugauugugucguaaagccuauugaugauagguuugcuaccgcgcuuacagcacuaaacgauaugggaaaagugaggaaagauauaccacagugggagccuucaaaaggauggaaugacuggcagcaagucccauucugcucacaucacuuccaucagcuaauaaugaaagauggcagagagauuguaguaccuugucguaaucaagacgaauuaguuggucgugcgaggguuucacagggagccggauggucauuacgggagaccgcuuguuuaggaaagucguaugcgcaaauguggcaacuuauguauuuucauagacgagaucuaagauuagcagccaaugcgauaugcagcgcuguaccgguagauugggugccuacuagcaggacuacauggagcauacacgcacaucaucaauggaugacaaccgaagauaugcuaaguguauggaauaggguuuggaucgaagaaaauccuuggauggaagauaaaacucauguaucaaguugggaagaaguuccuuauuuagggaaaagggaagaucaauggugcggaucccucauaggauuaaccgcaagagcuacuugggccacgaauauccaaguugccauuaaccagguacguagacuaauuggcaacgaaaauuacuuagauuauaugacuucaaugaaaagauuuaaaaacgaaucagaucccgagggagcgcuaugguaa

SEQ ID NO: 21226 - RNA, 9879 nt, Artificial Sequence
  derived and/or modified CDS sequence (opt6) from DENV-1__GU131958__SS-prME
agugucacuaugcuauuaauguuauugccuacagcauuagcauuucaucuuacgacacgaggcggagaaccucacaugauaguaucuaaacaagaacgcgggaaaucucuauuauuuaaaacaucugcgggggugaauauguguacucuaauugcaauggaucugggagaauuaugugaagacacgaugaccuacaaauguccucaaauaaccgaagcagaaccggacgauguagauuguugguguaacgcuacggauacaugggucacguaugggaccugcucacaaacuggagaacaccgcagggacaaacgcagcguugcacucgcgccacacgugggacugggguuagaaacucguaccgaaacuuggaugagcucugaaggcgcauggaaacaaauacagagggucgaaacaugggcucucagacaucccggcuucacaguaauagcuuuauuuuuagcccaugcaauagguacuagcaucacucaaaaaggaaucauuuucauauugcuaaugcuggucacuccgucaauggcuaugagaugugugggaauagguaacagagacuuugucgaaggcuuaaguggugcuacauggguggaugucguccucgaacauggauccuguguaacgacaauggccaaaaauaaaccaacucucgauauagaacuucugaaaaccgagguuacaaaucccgcuauauugagaaaacuuuguauugaggcaaaaauuuccaauacaacaacagauucuagauguccuacccagggagaagcaacccuaguagaagaacaagaugcuaauuuugucugccgaaggacauuuguagaucgaggauggggcaaugguugcggguuguuuggaaaaggcaguuuauuaacaugugcaaaauuuaaaugcguaacaaaguuagaagguaaaauaguucaauaugagaaccugaaauauagugugauaguuacuguacacaccggagaccaacaucaaguaggcaaugaaacaacagaacacgggacgauagcaacuauuaccccacaagcaccgacuagcgaaauacagcuuacagauuacggagcgcuuacgcuagacuguagccccagaacaggacuugauuuuaacgaaaugguucuuuuaacuaugaaagagaaaucaugguuagugcacaaacagugguuuuuggacuuaccgcuuccauggacaucaggagcuaguacaucgcaagagacuuggaaucgacaagacuuauuagugaccuuuaagacggcacaugcuaaaaagcaagagguaguaguucuaggcagccaagaaggggcaaugcauaccgcguugacaggugcaacugaaauacaaacuucagggacuaccaccauuuucgcgggacacuuaaaaugcagauuaaaaauggacaagcuaacgcuuaaagguacaucauacgucaugugcacgggcucuuuuaaacucgaaaaagaagucgcagaaacgcaacauggcaccgucuuaguccagguaaaauaugaaggaacagaugcuccuuguaaaauaccuuucaguacucaagacgaaaaagguguaacucaaaacggcagauuaauuacagcaaaccccauaguaacagacaaagaaaagcccguaaacauagagacagaaccacccuuuggugagucuuauauuguggucggcgccggcgagaaagccuuaaaacuuucuugguucaagaagggaagcaguauaggcaaaauguucgaagcaacggcucgaggcgcccgccguauggcgauccucggagacacggcaugggacuuugguaguaucggaggaguuuuuacgagcguaggcaaacucguacaccaaguuuuuggcacugcauauggaguuuuauuuucaggagucagcuggacgaugaaaauaggaauaggcauucuccuaaccugguugggacuuaacucacgaaguacuucguuauccaugacauguauagcuguggguaugguuaccuuauaucuagggguaaugguacaggcugauaguggcugugugauaaauuggaaaggacgcgaguuaaaauguggaagcgguauauuugucacuaaugaagugcauaccuggacagaacaauauaaauuucaagcagauucgcccaaaagauugucagcagcuauugggaaggcuugggaggaaggagugugugggaucagaagcgcgacacguuuagaaaauauuauguggaagcaaauaucaaaugaauuaaaucauauucuguuagagaaugauaugaaguuuacagugguaguaggggaugccaacggaauuuuggcacagggcaagaaaaugauuagaccacaaccgauggagcauaaauauucuuggaaaaguuggggcaaagcgaaaauaauaggagcggauauacagaauacaacuuucaucauagacggaccggauacgccagagugcccugacaaucagcgagcauggaauauaugggaagucgaagacuacggauucggaauuuucacuacuaauauuuggcuaaaacugcgcgauucauauacccaaaugugugaucaccguuuaaugagugcagcaauaaaagauucaaaggccguacacgcagacauggguuauuggauagagucugagaaaaaugaaacauggaaacucgcaagggcuucuuuuaucgagguaaaaacuuguacguggcccaaaucgcauacccuguggaguaauggcguacucgaaagugagaugauaauacccaaaauauaugguggcccaauuagccaacauaauuaucguccgggauacuucacccagacggcagggccuuggcauuuaggaaaacucgaauuagacuuugauuuaugcgaaggaacuacuguaguaguagacgaacacugcggaaauagagguccgagucucaggacuacaacggugacaggaaaaaucauacacgaguggugcugucguucguguacccuuccaccccuacgcuuuagaggagaagaugguugcugguaugguauggagauuaggccaguaaaagaaaaagaagaaaauuuaguuagaucgaugguuucagcaggaucaggagaaguggacucauucagucuagguauacuuugugcgucgauaaugaucgaagaagugaugcguagucguuggagucgcaagaugcuaaugacgggaacauuagcaguguuuuugcuacuaaucaugggucagcugacauggaacgacuuaauccguuuaugcaucauggugggagcuaaugccagugauagaauggguauggguacaaccuauuuagcauuaauggcgacauuuaaaaugagaccuauguucgccguaggacuucuauuuaggcgauugacaagcagagaaguacuucuauuaacaauaggacuuagccugguggccaguguagagcucccuaauagcuuagaagaauuaggagauggauuagcuaugggaauaaugaugcuaaaacuacuaacagaguuccagccacaucaacucuggacgacacuguugucucuaacauucaucaaaacaacuuuaagccuagauuaugcuuggaaaacgacggccauggcacuaucaauaguaaguuuguuuccacuaugucuuucaacaaccucgcagaaaacuacguggcuacccgucuuauuagguaguuuuggaugcaaaccauuaacaauguuucugaucaccgagaauaaaauaugggguagaaaaaguuggccccuuaacgaaggcauuauggcgauagggauaguaaguauccucuuaucaucuuuauuaaagaacgaugucccauuagcugguccacuaauagccggaggaaugcugauagcauguuacgucauuaguggaucuucagcagacuuaucuuuggaaaaagcagccgaagucagcugggagcaagaggcggaacauaguggaacgucucauaauauuuuaguagaaguacaagacgauggcacgaugaaaaucaaggaugaagaaagggacgauacacucacaauccuuuuaaaagcaacucuacucgcugucagcggagucuacccgaugucaaucccagcuacauuguuuguuugguacuuuuggcagaagaagaaacagaggucuggcguucuuugggauacaccgaguccaccugaaguugaacgagcaguccucgacgauggcauauacaggauccuccaaagagggcuuuuagggcguucgcagguagggguagguguuuuucaagaugguguauuucacacaauguggcacguaacuaggggugcuguguuaauguaucaaggaaaaaggcuugagcccaguugggcgucugucaagaaagauuuaaucucuuauggagguggguggagauuccaagggagcuggaauacaggugaagaaguacaaguaauugcuguagaaccaggcaagaacccgaaaaauguacagacaacaccaggaaccuuuaaaaccccugaaggugaaguuggagcaauugcuuuggauuuuaagccagggacaagugguagcccaauaguaaaucgcgaaggcaaaauagugggcuuguacggaaauggcguaguaacgacuucagggacguauguaagcgcaaucgcacaagcuaaggcuagucaagaagguccacuaccagaaaucgaagaugagguauuuaagaaacgcaaucucacaauaauggauuuacaccccggaagcgguaaaaccaggagauacuugccugcuauugugcgagaagcgauaaaacguaaauuaagaacuuuaauucuagcaccaacaagaguaguagcaucagaaauggcggaagcauuaaaaggcaugccaauccgcuaucagacaacagcugucaaaucagaacacacuggccgugaaauuguugaccucaugugucacgcaacguucacaaugcgcuuauuaucucccguuaggguaccaaacuauaacaugauaauaauggacgaagcgcacuuuaccgacccugcuaguaucgccgcccguggguauauaucaacuaggguggguaugggagaagcagcagcuaucuucaugacagcuacaccuccggguaguguagaggcauuuccucaaagcaaugcugucauccaggaugaggaacgugacauaccugaacgaaguuggaacucagguuaugacuggauaacugauuuuccaggaaagacgguuugguuuguuccaucgauaaaaucagguaaugacauagccaauugcuuacggaagaacgguaaacgaguaauucaacuaucacgcaagacauuugacacagaauaccagaaaacuaaaaauaaugacugggauuauguaguuacaacggauauauccgaaaugggugcaaacuuuagggcugacagaguuauagauccgagaagauguuuaaaaccgguuauacuaaaagaugggccugaacgaguuauuuuagccggcccaaugccugugacuguggccucggccgcgcaaagacguggcaggaucggacgaaaucaaaauaaagagggagaucaauaugucuauauggggcaaccuuuaaacaaugacgaagaccaugcccacuggacggaagcgaaaaugcucuuagacaauauuaacacacccgaagggauaauaccagcacuuuuugaaccagaacgagagaaaagugcggcaaucgauggagaauacaggcuaaggggcgaagcccgaaagaccuuugucgaguuaaugagacgaggugacuuaccagucuggcucagcuauaaaguagcaucagaaggauuccaauacagcgaucguaggugguguuucgauggggaacguaacaaucaaguucuagaagagaauauggacguagaaauauggacaaaagaaggugaaagaaagaaguuaagaccacgcuggcuagaugcacgaacuuacagcgacccacuagcucuaagagaguuuaaagaguucgcugcagguaggagauccgucucuggagaccuuauccuagaaaucggaaaguuaccacagcaccuuacguugagagcgcaaaacgcguuagauaaucuuguaaugcuacacaacucugaacaaggugggaaggcguauagacaugcuauggaagaauuaccugacacuauagaaaccuuaaugcuguuagcauuaaucgcaguguuaacuggagggguaacauuauucuuucucucagggaaagguuuaggcaaaacaucaauagggcuacuauguguuacugcuaguucagcgcuuuuguggauggcuaguguagaaccccacuggauagcugcuucuauaauuuuagaauuuuucuuaauggucuugcucauuccagagcccgacagacaacgaacaccgcaagacaaccaauuagcuuauguuguuauuggauuguuauucaugauucugacaguggccgccaaugaaaugggauugcuggaaacuacgaagaaagaucugggaauaggacauguugcagcagaaaaccaucaacacgccacgaugcucgauguagauuuacgaccugccucugcauggacucuauaugcagucgcgaccacuguuauuacaccgaugaugcgucacacaaucgaaaauaccacagccaauaucucacuaacagcaauagcgaaccaagcugcuauccuuaugggguuagacaagggauggccuaucuccaaaauggauauaggaguaccgcuucuagcauuaggaugcuacucccagguaaacccauugacguuaacugcugcaguacugaugcuagucgcacauuaugcgauuaucggaccuggauuacaagcaaaagccacucgagaagcgcagaaaagaaccgccgccggaaucaugaagaacccaacaguagacggcauaguggcaaucgauuuagauccaguaguauaugaugcaaaauuugaaaagcaacucggacaaaucaugcuuuuaauacuaugcacaagucaaauccuauugaugaggacuacgugggcauugugugaaucgauuacucuagcuaccggaccuuuaacuacacuaugggaagguaguccagggaaguuuuggaauacaacgaucgcuguaucgauggcuaacaucuucagagguucauauuuagcgggggcuggcuuagcuuucucauuaaugaaaucccuaggagggggcaggagagggacgggcgcgcaaggagaaacguuaggagagaaauggaagaggcagcuuaaccagcuaaguaaaucagaguucaacacauauaaacgaagugguauaauggaaguagauagaagcgaggcuaaagagggauuaaaacguggagaaacaacaaaacaugcaguaucacgaggaacggcgaaguugagaugguucguugaaagaaauuuagugaaacccgaagggaaggugauugauuuaggauguggaagaggaggauggucuuauuacugcgcgggucuuaaaaagguuacagaaguuaagggauauacuaaaggcggacccggacaugaagaacccauaccuauggcaacauaugguuggaaucucguuaaacuacauucggggaaagauguguucuuuaugccuccagaaaaaugugauacauuacuaugugacaucggagaaucaaguccgaauccaacgauagaggagggacgcacauuaagaguacucaaaauggucgaaccuuggcuuagaggaaaucaauucugcauuaaaauacuaaacccguauaugccgucagucguggaaacacuagaacaaaugcagcgaaaacacgggggaaugcuagucaggaacccgcuaucuagaaacucaacucaugagauguacuggguuagcuguggaacaggcaacauuguuucugccgucaacaugacaagucgcaugcuucucaacagauucacaauggcacauagaaaaccgacauucgaacgcgaugucgaccuuggagcugguacuagacaugucgcgguggaaccagaaguugcgaacuuggauauaauaggacaaagaauugaaaauauaaagaacgaacauaaaucaaccuggcauuacgaugaagauaauccuuauaaaacaugggcauaccauggaaguuacgaaguuaagccuagcggcucggcgucgagcaugguaaauggcguggugagauuacuaaccaagcccugggaugucauuccuaugguuacccaaauagcaaugaccgacacgacgccuuuuggccaacaaagggucuuuaaagaaaagguugauacuagaacuccuagagcuaagcgcgguacaacucagauaauggaagucacugcuaaguggcuuuggggguuucuaucacgcaauaaaaagccucguauaugcacgcgggaagaguucacccggaaagucagaaguaacgcagccaucggagcuguauucguagaugaaaaccaauggaauagcgcgaaagaggccguagaggacgaaagauucugggaucuaguacauagagaacgugaguuacauaaacagggaaagugugccacuuguguuuacaacaugaugggaaaaagagaaaagaaacuuggcgaauuuggaaaagcgaagggcucaagggcaauaugguacaugugguuaggugcaagguucuuggaauuugaagcucuugguuuuaugaaugaagaucauugguucucaagagaaaauucacuauccggaguagaaggugaaggacuucauaaauuagguuacauacuaagggauauaaguaaaauucccggaggaaacauguacgcugaugacacagcugguugggauacaagaauaaccgaagaugaccuacaaaaugaggcaaagauuacagauauaauggagcccgaacaugcuuuacuggccacuucaaucuucaaauuaacguaucaaaauaaagugguucguguacagcggccggccaaaaaugguacugucauggacguaauaucuagacgugaccagcgaggcucaggacagguaggcacauauggacuaaacacguuuaccaauauggaaguacaauugauaaggcaaauggaaagugaggggaucuuuuuaccuagcgaacuggaaacaccgaacuuagcugaacguguuuuggacuggcuagagaaacauggugcggaaagacuuaaacguauggcaauaagcggugacgauuguguuguaaaaccuauagacgauagauucgcaacggcccucacugcacuuaaugacauggguaaaguuaggaaagauauuccccagugggaaccaaguaaggguuggaaugauuggcaacaaguuccuuuuuguucucaucacuuccaccaauugauaaugaaagacggaagagaaauugugguaccaugccguaaccaagaugagcuaguaggacgugcccgugugucacaaggagcuggcuggucacugagagaaacagcaugcuuaggcaaaucuuacgcacaaauguggcaacuaauguauuuucacagacgagacuugcgucuagcugccaaugcaaucugcagugcgguacccgucgauugggugccuacaucacguacgaccugguccauacaugcacaucaucaguggaugacuacugaagauaugcuaucaguuuggaauagggucuggauugaagaaaauccuuggauggaagacaaaacccacgugagcucaugggaagagguaccauaccuugguaaaagagaagaucaguggugcggaagucuaaucggguuaacggcgagggcaacaugggcuacaaauauucaggucgcaaucaaucaaguaagaagacuaauagguaaugaaaacuaucuugauuauaugaccagcaugaagcgauucaaaaacgaaucugaucccgaaggugcgcuaugguaa

SEQ ID NO: 21227 - RNA, 9879 nt, Artificial Sequence
  derived and/or modified CDS sequence (opt6) from DENV-1__GQ868499__SS-prME
aguguaacgauguuguuaaugcuacuucccaccgcucuggcauuucaccuaacgacaagaggaggagaaccucauaugauuguuagcaaacaagaacgaggaaaaaguuuguuauuuaaaaccagcgcaggaguaaauauguguacauugauagcaauggacuuaggagaacuaugcgaagauacaaugaccuacaaauguccccaaauaacagaagcagaaccugacgauguggauuguugguguaaugcaaccgauacgugggucacauacggaacauguagccaaacaggaggacacaggagagaaaaacggucugucgcguuagcuccacacguaggauuagggcuugaaacccguacugaaacuuggaugucgagugaaggagcauggaaacaaauacagcggguagaaacuugggcuuuacgacauccagguuuuacaguaauugcuuuauuuuuagcacaugcaauuggaacuagcauuacgcaaaaagggauaauuuucauucugcugaugcucgugacaccaucaauggcaaugagguguguagguauuggcaaccgcgauuuugucgaaggacugaguggagcaacguggguagauguaguacuugaacauggaucaugugucacuaccauggcuaaaaauaaaccgacacuugacauagaacuacuuaaaacagaagugacaaauccagccguauuaagaaaauugugcauugaggcgaagauauccaauacaacgacugauaguagguguccuacacagggcgaagcgacguuaguggaagaacaagacgcaaacuuuguauguagacgaacauuuguugaccgcgguugggggaaugguugcggauuguucggcaaagggagccuacuuacuugugcaaaauuuaaguguguaacuaaguuggaaggaaagauuguccaguacgaaaaucuaaaguauucgguaauaguaacaguccauacaggagaucaacaucaaguagguaaugaaacuacggagcacggaaccaucgcuacaauuaccccacaagcaccaacuucugaaauccaauuaacugacuauggugcucuaacacuagacuguuccccuaggaccggauuggacuuuaacgagaugguucucuugaccaugaaagagaaaagcugguugguucacaagcagugguuuuuagaucuaccgcuucccuggacaagcggagcuagcacuucacaggagaccuggaacaggcaagaucuucuggucacuuuuaaaacugcacaugccaagaaacaagaggucgugguacuuggaucgcaagaaggggcuaugcauacggcauuaacuggcgcaacagagauucaaacaucagguacaaccacuauauucgcggggcaccugaaauguaggcucaaaauggauaaauuaacuuugaaggggacuucguauguaaugugcacggguagcuuuaagcuagaaaaagaaguagcagaaacacaacauggaacgguauugguacaggugaaauaugaaggaaccgacgcaccuugcaaaauuccauuuucuacacaggaugaaaaaggaguaacacaaaauggaagguuaauaaccgcuaauccgauaguaacugacaaagaaaaaccgguaaauauagaaacggaacccccauuuggagaaagcuauauagugguaggagcuggggaaaaagcguuaaaguugucuugguuuaagaaagggagcagcauuggaaagauguucgaagcaacagcccgaggggccaggagaauggcaauacuaggcgauacagcgugggauuucggcucgauaggagguguauuuacaucaguaggaaaauugguccaucaaguauuuggcaccgcauauggcguguuguuuagugguguaucuuggacgaugaaaauugguaucggaauacuauugacaugguuaggccucaauucaagauccacuucgcuuagcaugacguguauagcuguugggaugguaacuuuauauuuaggcgugauggugcaagcugacucugguuguguaauaaacuggaaagguagagaguuaaaauguggaucugguaucuucguaacgaaugagguacauaccuggaccgagcaauacaaguuucaagcggacuccccaaaaaggcuuucagcagccauagguaaagcaugggaggagggggucugcgguauaagaucugcuaccagguuagaaaauauuauguggaagcaaauaucaaacgaacuaaaucauauucuuuuagaaaacgacaugaaauuuacaguuguaguaggcgaugcaaacggaauuuuagcgcaagguaaaaagaugauuagaccccaaccuauggaacauaaguacagcuggaaguccuggggaaaggcuaaaauuauuggggccgauauucaaaauaccacguucauaaucgaugggccagacacccccgagugccccgacaaccaaagagcauggaauaucugggaaguugaagauuacggguucggaauauucacgacuaauauuuggcuuaaacuacgagacucuuacacgcaaaugugcgaucauagacugaugagcgcagcaauaaaagacagcaaggccguccacgccgauaugggcuauuggauagagucggagaaaaacgaaaccuggaaacucgcuagagccaguuuuauagaagucaagacauguacuuggcccaagagucauacacucuggaguaauggcguuuuagaaagcgaaaugauaaucccgaaaauauacgggggucccauuucucagcacaauuacagaccgggauauuuuacucaaacagcgggaccuuggcaucuaggcaaauuggaacuugauuuugaccuaugcgaagguacuacaguuguaguagaugaacauugcgguaacagaggaccuagcuugcgaaccacgacaguaacuggcaaaauaauacaugaauggugcuguaggaguugcacauugccaccauugagauuucgaggggaagauggauguugguacggcauggagauucgaccagucaaagaaaaagaagaaaaucuagucagaucuaugguaagugcaggcagcggcgaagucgauagcuucagucuagggauccuuugugcaaguauaaugauagaagaggucaugcgaagucgauggucaagaaagaugcuaaugacaggaacacuagcugucuuuuuacuauuaauuauggggcaacugacuuggaaggaccucauacgccugugcaucaugguuggagccaaugcuucggauagaaugggcauggggacgacuuauuuagcgcuaauggcaacauucaaaaugaggccaauguuugcggucgguuugcuauucaggcgacuuaccagucgcgaaguucuuuuacugaccauaggccucagccuaguagcuucccuugaacucccgaacaguuuagaagaacuuggagauggucucgcuaugggcauaaugauguugaaacucuugacagaauuucaaccccaccaguuauggaccacauuacuaagucugaccuuuauuaaaacaaccuuaucccuugacuaugcguggaaaaccacggcgauggcgcuaagcauaguuucgcucuuuccuuugugccuauccacgacgagccaaaagacgacauggcucccaguacuuuuaggcagcuucggaugcaagccauuaacaauguuccuaaucaccgaaaauaagauuuggggucguaaauccuggccucuaaacgaagguauaauggcaauagguauuguuuccauuuuacucaguucgcuucugaaaaacgacguaccccucgcaggaccacuuauugccggagguauguuaauugcuuguuacguuauaaguggcucaagugcggauuuaagucuagagaagguggcagaaguuagcugggaacaagaagcagaacauaguggcacaucgcauaacauccuagucgagguacaagacgaugguacgaugaagauaaaagacgaagaacgugaugauacgcugacaauauuauugaaggcaacuuuacuggcaguaucuggcguauauccaaugucaauccccgcgacuuuauuugucugguauuuuuggcagaaaaagaagcaacgcucaggggugcucugggauaccccuucaccaccagaaguggaacgagcggugcuggaugauggaauauacaggaucuuacaacgcggguuguugggacgaucgcaggucggaguaggaguuuuccaagacgggguguuccauacaauguggcauguaacucgaggggcggugcuuauguaccaagggaaacgacuagaaccgagcugggcgucugucaaaaaggaucugauaaguuauggcggaggauggcgguuccaaggguccuggaauacuggagaagaaguacagguaauagcaguggagccagguaagaaucccaaaaauguucagacuacucccggaacauucaagacgccggaaggggaagugggagcuaucgccuuagauuucaagccuggaacaaguggcagcccaauagucaaucgagaaggaaaaauaguuggacuauauggaaacggaguugugacuacaucagguacauauguaucggcgauugcacaagcaaaagcgagccaggaaggaccgcugccagaaauagaagaugaaguauuuaagaaaagaaaucuuacuauuauggacuuacacccgggcaguggaaaaacaagaagauaccuccccgcaaucguccgcgaagcgauaaaaagaaaacuucggacgcuaauuuuagcaccgacgcgagugguagcgucugaaauggcagaagcgcuaaagggcaugccaauaagguaucaaacgacagcuguuaaaucagaacacacgggcagagagauaguagacuuaaugugccaugcaacauucaccaugaggcuccucuccccgguaagaguacccaauuauaauaugauuauuauggaugaggcacauuucacagacccagcuuccauagcugcaaggggauauauaucgacaagaguaggaaugggcgaagcggcggcgauauuuaugacggcaacuccuccaggaaguguagaggcuuuuccccaaagcaaugccgucauucaagaugaagaaagggacauaccugaacgaaguuggaacucgggcuaugacuggauaaccgacuucccugguaaaacaguaugguuuguacccucaauuaaaagugguaaugauaucgcaaauugucuaaggaaaaaugggaaacgugucauucaacuuaguagaaagacuuuugauacugaguaucaaaagaccaaaaauaacgauugggauuauguagugacgacggacauuagcgagaugggugcaaauuucagagcggacaggguaauugacccacguagaugucucaagccaguaauacuaaaagacggucccgaacgcgucauccucgcggguccgaugccuguaacaguugcaagugcagcucagcgaagaggucgaauaggaagaaaucaaaauaaagaaggagaucaauauguuuauauggggcaaccauuaaacaacgacgaagaucaugcgcauuggacagaagcaaagauguugcuggauaauauaaauacccccgaagguauaauuccggcucuauuugaacccgaacgagagaaauccgcagcaauugacggagaguauagguugaggggcgaggcucgaaagacauuuguugaauuaaugagacggggugaccugcccguauggcuuucuuauaagguagcaagugaaggguuccaguauucggaucggagaugguguuucgacggcgaaagaaacaaucaagucuuggaagaaaauauggacguagaaaucuggacgaaagaaggggaacggaaaaagcugcgcccaagaugguuagaugcuagaacuuacucggacccccucgcacuaagggaguucaaagaauuugcagcagguagaagaucagucuccggagaccucauacuggaaauugguaaauuaccccaacauuugacgcuuagagcgcaaaaugcucuugacaaucuagugaugcuucauaauucagagcaaggaggaaaggcuuacaggcaugcgauggaagaacuuccggauacgaucgaaacacugauguuacuggcucucauugcuguucuuaccggaggaguaacacuauuuuuccuuucaggcaaaggguuagguaagacaucuauuggguuauuaugugugacugcaucaucagcauuauuauggauggcuucaguagaaccucauuggauugccgcuaguauaauacuagaauuuuucuuaaugguacuuuuaauuccggaaccugacagacaaagaacaccacaagauaaucaacuugcauauguugucauuggacucuuauuuaugauacucacaguagcagccaaugagauggguuuacuagagacaacuaagaaagaccuuggaauuggucaugucgcggcagaaaaucaucaacacgcgacaauguuggauguagauuuacgaccagcuucugcuuggacgcuguacgcgguugcuacuaccguaauuacgccuaugaugagacacacuauugaaaacacaaccgcuaauauaucacuaacggcuauagcaaaucaagcggcaauacuaauggguuuggauaaagguuggccaauuucaaagauggacauagggguuccacugcuagcguugggguguuacucacaaguuaacccgcuaacucuaaccgcagcuguauuaaugcuuguagcacauuacgcuaucauugggccggguuuacaggcuaaagcuacaagggaggcgcaaaaacgaacagccgcugggauaaugaaaaauccuaccguugauggaauaguagccaucgaccucgauccuguaguauacgacgcaaaauucgaaaaacaauuaggccaaauaaugcuccuaauauuauguacaagccaaauucuguuaaugagaacgacuugggcucuuugugaaagcauuacacuagcaaccgggccacuuacaacgcucugggagggaagcccaggaaaauucuggaacacaacaauugcaguauccauggcuaacauauuucgcgguuccuaccuagcuggugcaggacuagcuuucucacugaugaaaucguuagguggaggacgacgaggcacaggcgcccaaggcgaaacauuaggugaaaaauggaaaagacaacuaaaccaacucucgaaaagugaguucaauaccuacaaacgcagcggcauuauggaaguagauagauccgaagcaaaggagggacuaaaacgaggugaaacaacuaaacacgcaguuucgcguggcacagccaaauuaagaugguuuguugagagaaaucuugucaaaccggaggguaaaguaauagaucucggaugcggucggggaggguggaguuauuauugcgcaggcuuaaagaaaguuacagaaguaaaaggcuacacuaaagguggaccaggacacgaggaaccaauaccuauggcuacguacgguuggaacuugguaaaacuacauucaggaaaagaugucuucuuuaugccaccugagaaaugcgauacuuuauuaugcgacauaggugaaucaaguccuaacccaacuauagaggaaggccguacacuuagagugcucaaaaugguagaacccugguuaagaggaaaccaauucuguaucaaaaucuuaaauccauauaugccgagcguaguugagacucuggagcaaaugcaacguaaacauggagguaugcuagugaggaaucccuuaucuagaaacaguacacacgagauguacuggguaagcuguggcacagggaauauuguaucggcgguuaacaugacuucuagaaugcuauugaauagauucacuauggcucaucgaaaaccuacguaugaacgugacguagaucuaggagcgggcacucggcauguugcgguagagccagaaguugcgaaucuggacaucauaggacaaagaauugaaaauaucaaaaaugagcacaaaagcacauggcauuacgacgaagacaauccauauaaaacuugggcauaucaugggaguuacgaaguaaaaccgucuggaagugccucaagcaugguaaacggagucguucgauuguuaacaaaaccuugggauguuauuccaauggucacacaaaucgcuaugacagacacaacacccuuuggucaacagagaguuuuuaaagaaaagguagacacccggacaccaagagcaaagagaggaaccacacagauaauggaggugacggccaagugguuaugggguuuccuauccagaaacaaaaagccgagaauaugcacucgugaagaguucaccagaaaagucagaaguaaugcugcgauaggugcaguauucguagaugaaaaucaauggaacucugcuaaggaagcaguggaggacgaaagauucugggaccucguucacagagaaagagaacuacauaaacaagguaaaugcgcaacuuguguauacaauaugaugggaaaaagggagaagaaauuaggagaauuuggaaaagcaaaagguagcagggcgauaugguauauguggcuaggagccagauuccuagaauuugaggcuuugggauuuaugaaugaggaccacugguucucgagagaaaauucucugaguggggucgaaggggaaggguuacauaaacuaggauauauauugagagauauaagcaagauacccggcgggaacauguaugcugacgauacagcagggugggacacacgcauaacggaagacgaccuucaaaacgaagccaagauaacagauauuauggaaccagaacaugcauugcucgcaacaucaauuuucaaacuaacauaccagaauaaaguagugcgcguucagcggccagccaagaauggaacaguaauggacguaauuagucgucgagaucagcgagguaguggacaaguaggcacauauggauugaacacuuucacgaauauggaaguacaauuaauaaggcagauggaguccgaagguaucuuccuuccgucugaauuggagacuccgaaccuagccgagcgaguacuggauuggcuggaaaaacauggagcggaacgccuaaaacgaauggcuauaagcggggaugacugcguaguaaaaccuauagacgauagauuugccacagccuuaacggcacuaaaugacauggguaaaguaagaaaagauaucccgcagugggagcccucaaaaggguggaaugauuggcaacaaguaccuuuuuguucucaucauuuucaucaacucauaaugaaagauggaagagaaauuguaguacccugcaggaaucaagaugaauuagucgggcgcgcccgaguuagccaaggcgcgggauggucauuaagagaaaccgcuugucuaggaaaaaguuacgcacaaauguggcaauuaauguauuuucauagacgagacuugagacuagcagccaaugccauuuguagcgcuguccccguagauugggucccuacauccagaacaacuuggucaauacaugcccaucaucaauggaugacaacggaagauaugcuuucaguauggaauaggguuuggauugaagaaaacccguggauggaagauaaaacacacguaucuucuugggaagaagugccuuaccucggaaaaagggaagaccaauggugugguagcuuaauaggccuuacagcucgggcuacuugggcgacaaacauucaaguagcgaucaaccaaguaaggcgccuuauagggaaugaaaacuauuuagauuauaugacuucaaugaagcgguuuaaaaacgaaagugauccagaaggagcuuugugguaa

SEQ ID NO: 21228 - RNA, 9879 nt, Artificial Sequence
  derived and/or modified CDS sequence (opt6) from DENV-1__GQ868500__SS-prME
ucagucacgauguugcucauguuacuucccaccgcauuagcauuccauuuaaccacgcggggaggugaaccacacaugauagugagcaaacaagaacgagguaaaucucuguuauuuaaaacaucagcuggaguaaacauguguacgcuuauagcaauggauuuaggagaacuuugcgaagacacuaugacauauaaauguccacaaaucaccgaagccgaacccgaugacguagacuguuggugcaacgcuacagauacauggguuacguauggaacuuguucucaaacgggagaacaucgacgcgauaaaaggucgguugcguuagccccacacguaggacuugguuuagaaacgagaaccgaaacauggaugucaagcgaaggagcuuggaaacaaauccaaagagucgaaacaugggcccuaagacauccugguuucacaguaauugcccuuuuucuagcgcacgcaaucgggacuucuauaacucaaaaaggaauaaucuucauacuguuaauguuaguaaccccaucuauggcaaugcgauguguaggcauuggcaaccgagacuuuguagaagguuuaaguggugcaaccuggguagacgugguccuugaacacgggucuugcguuacaaccauggccaaaaauaaaccuacauuggacaucgaauuacuaaaaacagagguaaccaacccagcaauuuuacgaaaauuaugcauagaggcgaaaauaucuaauacuacuacggacucccguuguccaacacaaggggaagcaacccuuguagaggagcaagacgcaaacuuuguuugcagaaggaccuucguggaucgaggguggggaaacggauguggauuauuuggaaaaggcucgcucuuaaccugugccaaauuuaaaugugucacuaaacucgaaggaaaaauaguacaauaugaaaauuugaaauauagugugauuguaacagugcacacuggagaucaacaucagguagguaaugaaacaacugaacaugguacaaucgcuacaauaacaccccaagcucccacaucagaaauacaacucacagauuacggggcucucacuuuagacuguucgcccaggacaggguuagauuucaacgagaugguuuugcuuacaaugaaagaaaaaucuuggcuaguacauaaacagugguuuuuggauuuaccccuucccuggacaaguggcgcuaguacuagccaagaaacauggaaucgacaggaccuucuaguaacguuuaaaacagcucaugccaagaaacaagagguuguuguccuaggaagucaggagggagcgaugcauaccgcacuaacuggcgcgacggaaauccagacuucagggacuaccacgaucuuugcuggacaucuaaaauguaggcucaaaauggauaaacugacauuaaaaggaacaaguuauguaaugugcaccgguucauucaaacuagaaaaagaaguugcagaaacgcagcacgggacaguauuagugcaagugaaauaugagggcaccgaugcuccauguaaaaucccauuuagcacacaagacgaaaaaggaguaacacaaaacggaaggcuuaucacagcaaaucccauuguaaccgauaaagaaaaaccggucaauaucgaaacugaacccccuuucggagagaguuauauaguaguuggagcuggagaaaaagcucuaaaacucucaugguucaagaaaggaucaucuauugguaaaauguuugaagcaacugcaagaggagcucgaaggauggcaauacuaggggauaccgcaugggacuucggaucaauuggaggcguauuuacaagcgucggcaaauuaguccaccaagucuucgggacagcguacggaguacuuuucaguggaguauccuggaccaugaaaauagggauagguauauuauugacuuggcuaggucucaacucgagaaguacaaguuuaaguaugacuuguauugccgucggaauggugacauuguaucuaggcguaaugguccaagcagauagcggguguguuauaaauuggaaaggaagggaacuaaaauguggaaguggaauauuuguaacuaaugaaguacacaccuggacagaacaauacaaauuucaggcggauucaccaaaacgacugucugcagcaauuggcaaggcuugggaagaaggagucugugggauacgaucggcgacgagacuggaaaacauuauguggaaacaaauaucuaaugaguuaaaucacaucuuacuagaaaaugauaugaaauucacuguaguagucggagaugcuaacggaauacucgcacaaggcaagaaaaugaucagaccucaaccgauggaacauaaauauucuuggaaaaguuggggaaaagccaaaauaauuggugcagacauacaaaauacuacauuuauuauagauggcccagauacgccugaguguccagacaaccagcgagcuuggaauaucugggaagucgaagauuauggguuuggaauauuuacgaccaauauuuggcuaaaacuaagagacaguuauacccaaaugugugaucauagacuaaugucugcagcaauaaaggacucaaaggcaguacaugcggauauggguuauuggauagaaagugagaaaaaugagacuuggaaacuugcuagagcuagcuuuauagagguaaagaccuguacauggccuaagucccauacucuguggucuaaugguguauuggagagugagaugauaauuccaaaaauauauggagguccuauaagccaacauaauuacaggccagguuacuuuacucaaacagcagguccauggcaucuaggaaaauuggaacuugauuuugauuuaugugaaggcacaacuguagucguagacgaacauuguggaaacagaggacccagccugcgaaccacaacgguaacuggcaagauuauccacgaauggugcuguagauccugcacucuaccuccacuccgguuccgcggcgaagaugguuguugguauggaauggagauuagaccaguaaaagaaaaggaagaaaaccuuguucguaguauggucucggcagguucaggugaaguagauuccuucucuuuaggaauacuuugugcgagcauuaugaucgaggaagugaugcgaucucgauggucacgcaagauguugaugaccggaacacucgcaguauuccuacuuuuagucaugggccaacuuacauggaacgaccuaaucagacucuguauaaugguuggcgcaaaugcaucagacaggauggggaugggaacgacauauuuagcacugauggcaacguuuaaaaugagaccaauguuugccgucggucuccuauuccgacgauugacaucacgugaaguguugcuauugaccauuggguuaucucuuguugccaguguugaacuaccuaauucauuggaagaauuaggagacggacuagcaauggguauaaugaugcuaaaacuucuaacggaauuucaaccacaucaacuguggacgacuuuacuaagccuaacauucaucaaaacgacccuuaguuuggauuaugcauggaaaacuacggcaauggcuuuaagcauagucucucuauuuccccugugucuuaguacuacaagccagaaaacgaccugguuaccuguacuacucggaaguuucggguguaaaccauuaacaauguucuuaauaacggaaaauaaaauauggggacguaaguccuggccucuuaacgaggguauaauggcgauagguaucguaucaauuuuguugucuucauuacucaaaaaugauguaccccuagccgguccauugauagcaggagguaugcugauagccugcuauguaauaucaggaucuagcgcagaccucucacuugaaaaggcugcagaaguuucuugggaacaagaggcugaacacagcggaacgucacauaacauucuaguagaaguucaggacgauggaaccaugaaaauuaaagaugaagaacgagaugacacauugacuaucuuacugaaagccacgcuacuagcuguaucaggcguguacccaaugucuauaccagccacacuuuuugucugguauuuuuggcaaaagaagaaacaaagaucaggcguauuaugggacacaccaucucccccugaagucgaacgagccguauuagaugacggcauauauagaauacuacaacggggucuguuagggaggucacagguuggcgugggaguguuccaagauggaguauuccacaccauguggcacguaacucgaggcgcgguauuaauguaccaagguaaaagauuggaaccaaguugggcaagugugaagaaagacuugauaagcuacggaggugguuggagauuucaggggucuuggaauacuggugaagaaguucagguaauugcugucgaaccaggcaaaaacccuaaaaauguccaaacaaccccgggaaccuucaaaacaccagagggugaggugggagccauugcuuuagauuuuaagcccggaaccaguggaucaccuauaguaaauagagaaggaaaaauugugggccucuaugguaauggcguggugacaacaucgggcacauauguaucggccauugcacaagcaaaggcaucacaggaagggccguuacccgaaauagaagaugaaguuuuuaagaaacgcaaccucacaaucauggaucuucacccaggaaguggaaaaacacgacgauaucuccccgcaauggucagggaagcgaucaaacgaaaacuucgcacguugauacuagcaccgacgagaguagucgcaagugaaauggcugaagcccuaaagggaaugccaauaagauaccagacuaccgcagugaagagugaacacacaggcagagaaauagucgaucuuaugugucaugcaacguuuacuaugagacuuuuaucucccguaagaguaccuaacuauaacaugaucauuauggaugaagcucauuuuaccgacccggcaucaauugcagcaagaggauacaucaguacacgaguaggcaugggggaagcggcugccaucuucaugacagccacgccaccaggaagcguugaagcauuuccgcaaaguaaugcagucauucaagaugaggaacgugauauucccgaacgaucuuggaacucuggauaugacuggauaacagauuuuccaggaaagaccgucugguuuguaccaucaauuaaaucugggaaugacauagcuaauuguuugagaaagaauggaaaacgaguuauacaacuaucacgaaaaacauucgacacugaauaccagaaaacuaaaaauaacgauugggauuauguaguaacaacggacauuucugaaaugggggcaaauuuuagagcugauagggucaucgauccaagaagauguuuaaaaccagugauauugaaagacgggccggaacgcguaaucuuagcuggaccaaugccaguaacaguugcgagcgcagcacaacgucggggaagaauaggacgaaaucaaaacaaagagggagaucaauacguauauauggggcaaccucuaaauaaugaugaagaccacgcacauuggacagaggcaaaaaugcuacuagauaacauuaauacgccugaaggcaucauaccggcucuauucgaaccugaacgagaaaaaucggcugcuauagauggugaauauagacuucgaggcgaagcaagaaaaacuuuugucgaacugaugagaaggggugaucuaccgguguggcugucauauaagguggcaagugaggguuuucaauacucggauagaagaugguguuucgauggugaacgaaauaaucaaguguuggaagaaaacauggacguagagauuuggacaaaagagggugagagaaagaaguuaaggccccguugguuagacgcgcgaacauacucggacccccuggcacuaagagaguucaaagaguuugcagcagggcgucgcucaguaaguggagaccuaauacuagaaauuggaaaacuaccucaacaccucacucuuagagcucagaaugcuuuggauaaucucguaauguuacauaauagugaacaaggugggaaggccuauaggcaugcuauggaagaacucccagauacuauagaaacguuaaugcuauuagcauuaauagcaguguuaacugguggaguaacauuauucuuucuaagcggcaagggauuaggaaaaacguccauuggccuccugugcguuaccgcgucaagcgcacuucucuggauggcuagcguagaaccacauuggauugcggcuaguauuauacuagaguucuucuuaaugguacuuuuaauaccagaaccggaucgacaacguacaccacaagauaaucaacucgcguacguaguaaucggacuuuuauucguuauacuaacgguagcugcaaacgaaaugggccuucucgagacuacuaagaaagauuuaggaaucggacacguagcagcagaaaaccaucagcacgcgacaaugcuugauguugauuugagacccgcaucagcauggacacuuuacgccguugcuacgacagugauaacaccuaugaugagacauacaauagaaaacaccaccgcuaauauaucucucacagcaauagcgaaucaggcagcaauucuaaugggauuagauaaagguuggccaauaagcaaaauggauauaggagugccauuacucgcauuagguuguuauagccagguuaauccacucacacuaaccgcagcuguacuaaugcuugucgcacacuacgcuauuauagguccaggauuacaggccaaagcaacaagagaagcacagaaaaggaccgcugcugguaucaugaaaaauccaacuguagauggaauuguugcgauagaucuagacccgguaguauaugacgcaaaauucgaaaaacaacuaggacaaauuauguuguuaauauuauguacaucucaaauacuacuaaugaggacuacaugggcccucugugagucuauaacacuagcgacugggccauugacuacucuaugggaagguaguccaggaaaguucuggaauacgacaauagcaguuucuauggcaaacauuuucagaggaucauaucuagccggugcaggcuuggcauucucucuaaugaaaucacucggggguggucgcaggggaaccggagcacaaggggaaacauuaggagaaaaguggaaacggcaacuaaaucaacuaaguaaguccgaguucaauacuuacaagcgaagcggcauuauggagguagauagaagugaagcuaaggaaggacugaaaagaggggaaacaacaaaacacgcgguguccagaggcaccgccaaacuucgaugguucguagagcgaaacuuaguaaaaccagaaggcaaaguuauagaccucggauguggaagaggugguuggaguuauuacugugccggucuaaagaaagugacugaaguuaaaggguacaccaaagguggcccaggucacgaggagccuauaccaauggcaacguauggauggaauuuaguaaaauugcacuccggaaaagauguuuucuucaugccaccagagaaaugugauaccuuacuaugcgauauaggggaaagcucaccgaauccaaccaucgaggaggggagaacucuccgcguauugaagaugguggaaccgugguugagggguaaucaauucugcauaaaaauacuaaacccauacaugccuaguguaguugaaaccuuagaacaaaugcaacgaaaacacgguggaaugcuuguccguaaucccuugagucgaaauagcacacacgaaauguauugggucagcugcgggaccgguaacauugucucugcagucaacaugacaucaaggauguuauuaaaccgguucacgauggcgcauaggaaaccuacuuaugaacgagauguggauuugggugcuggaacacgccauguggcgguggaaccagaagucgcgaacuuggacauaaucggacaaaggauagaaaauauaaagaacgagcacaaaucuacuuggcacuacgaugaggauaacccguauaaaacuugggcauaccauggaucuuaugaaguaaagccuaguggcagugcgaguagcaugguuaaugguguugugaggcuguuaaccaaaccaugggauguaauacccauggugaagcaaaucgcaaugaccgauacuacaccauuuggucaacagcgaguauuuaaagaaaagguugauacuagaacaccuagagcaaaaagaggaaccacacaaauuauggagguaacagcaaaaugguuguggggauuucucucgagaaauaaaaagccacguauauguacacgugaagaauuuacucgcaaaguucgcucaaaugcggcgaucggugcuguuuucguaggagaaaaccaauggaacagcgcaaaggaagcaguagaagaugaacgaguuugggacuuaguacaucgagagcgcgaacuacacaaacaagggaagugugcaacauguguauacaauaugauggguaagcgugagaagaaauuaggagaauuugguaaagcgaaggguaguagggcuauaugguacauguggcuuggggcgcgguuuuuagaauuugaagcauuagguuuuaugaaugaagaucauugguuuaguagagagaacucuuuaagcgguguggagggugaaggcuuacacaaacuagguuauauauuacgugauauauccaaaaucccagggggcaauauguaugcagacgacaccgcggguugggauacaagaauaacagaagaugaucuacaaaaugaagcaaaaauaacugagauuauggaacccgagcaugcccuauuagcuacgucgauauuuaaacucacauaucaaaacaaaguagugcgcguccagagaccagcgaaaaacggcacgguuauggaugucauaagcaggcgugaccagaggggcucaggacaaguagguacuuacggucuuaauacuuuuacuaauauggaaguccagcuaauuaggcaaauggaaagcgaaggaauuuuucucccuucugaacuagaaaccccaaacuuggcggaacguguuuuagacuggcuugagaaacauggagccgagagacuaaaaagaauggcaauaucaggcgaugauugugugguuaaacccauagacgaccgauucgcgacugcacuuaccgcuuugaacgauauggguaaagucaggaaagauauaccacaaugggaaccgaguaaggguuggaacgauuggcagcaggucccauuuuguagucaucauuuucaucaauugauaaugaaagauggaagggagauaguagugccgugcagaaaccaagaugaacuuguuggccgagcucggguuagucagggcgcggguuggucauugagagaaacagccugccuaggcaagucuuaugcccaaauguggcaacucauguacuuucauagacgcgacuugagacuagcagcaaaugcgaucuguucugcagugccaguugauuggguuccaacauccaggacuacauggucuauccaugcucaucaccaauggaugacuacugaagauauguuaucagucuggaacagaguuuggauugaagaaaacccauggauggaggacaaaacacauguuucaucaugggaagaagucccuuacuuaggaaaaagggaagaccaauggugcggcagcuuaauuggacuaacggcacgcgcaacgugggcuacaaacauucaaguagccaucaaucaggugcgaagacugaucgguaaugaaaauuaucuagauuauaugacaaguaugaagagauuuaaaaaugaaucagaccccgagggagcuuuaugguga

SEQ ID NO: 21229 - RNA, 9879 nt, Artificial Sequence
  derived and/or modified CDS sequence (opt6) from DENV-1__GU131961__SS-prME
ucuguaacuaugcuacuaaugcucuuaccgacagcacuugccuuucacuuaacaacucgcgguggagaaccucauaugauuguuagcaaacaagaaagaggaaaaaguuuauuauuuaaaaccucugcaggagucaacauguguacacucauugcuauggacuugggcgaauuaugcgaagacacuaugacauauaaauguccucaaauaacagaagccgaaccagacgacguugacugcuggugcaaugcaacggacaccugggugacguacgguaccuguucacaaacaggagagcaccguagagauaaaagaucgguagcuuuagccccacacguuggucuuggacuugaaacccgaacggaaacauggauguccucggaaggagcauggaagcaaauucaacguguagagaccugggcauuaagacacccagguuuuacaguaauagcacuauucuuggcacacgcaauugguacaucaauaacgcaaaaagguaucaucuucauuuuauugauguuaguuaccccaagcauggcaaugcguugcguagguauagguaacagagauuuugucgagggacuaucuggugcaacauggguugaugugguuuuagaacauggaucuuguguaacuaccauggccaaaaauaagccgacucuugacauugaauuauuaaagacagagguuacuaacccugccauacuuagaaaguuaugcauagaagcaaaaauaagcaacacaacaacagacaguagauguccaacacaaggugaagcaacauuagucgaagaacaagaugcuaauuuuguguguagaagaacuuuuguugauaggggauggggcaacggaugcggucuauucggaaaaggaagccuccuuacuugugccaaauucaaaugcguuacaaaauuagaaggaaagauuguacaauacgaaaaccucaaauauagugugaucguaacuguacauacaggagaccaacaucaagugggcaaugaaacgacagagcauggcacaaucgcuacaauuacaccucaagcgccaacaucugaaauacaacucaccgacuauggcgcguuaacacuagauuguaguccucgaacgggacuagacuuuaacgaaaugguguugcuuacgaugaaggaaaagucaugguuaguccauaagcaaugguuucuagaucuaccuuuaccguggacaagcggggcaucgaccucccaagagacauggaauagacaagaucuuuuaguaacauucaaaacugcucaugcgaaaaagcaagaggucguaguauuagguucucaagagggcgcgaugcauacugccuugacaggagccacggagauacagacaucagguacuacuacaauauucgcuggccauuuaaaaugccgacuuaagauggauaaauugacccuaaaaggcacuucauaugucauguguacaggcaguuucagacuagagaaggaaguugcugaaacacaacauggaaccguguuaguacaggugaaguaugaaggaaccgaugcucccugcaaaaucccuuuuaguacacaagaugaaaaggguguaacucaaaacggaagauuaauaacagccaauccaaucguuacugacaaggaaaagccuguaaacauagagacagaaccucccuuuggugagucauauauaguuguuggagcuggagaaaaagcauuaaaauugucuugguucaagaaagggucuucuaucggcaaaauguuugaagccacagcucggggagcaagaagaauggcuauuuugggagacacagcgugggacuucgggucaauuggagggguguucacgucaguaggaaaacuuguacaucaggucuucgguacugcuuacggaguuuuguuuucuggaguuaguuggacuaugaaaauaggcauaggcauauuacuuacuugguugggguuaaauucacgaucaacgucgcuuucuaugacuuguaucgcaguaggcaugguuacccuguaucuugguguaauggugcaggccgauucaggaugugugauaaauuggaaaggcagagaauuaaaguguggaucaggaauauuuguaacaaaugaaguucacacuuggacggaacaauacaaguuccaagcugacaguccuaaaagacuaucagcagcaauuggaaaagcaugggaagagggcguaugugguauaagaucagcaacaagacuagaaaauauaauguggaaacaaauaucuaacgagcuuaaccauauacuacuagagaaugauaugaaguucacagucgucgucggcgaugcuaauggaauacuagcgcaggguaagaaaaugauccgaccgcaaccaauggaacacaaguauaguuggaaaaguuggggaaaagcuaaaauaauaggagccgauauccagaauaccacguuuauaauagaugguccggauacgccggaaugcccagauaaucaaagagcuuggaacaucugggaaguugaagacuauggauuugggauauucacgacgaauauauggcugaaauuaagggacaguuacacgcaaaugugugaucaccguuuaaugagugcugcaauaaaagacucaaaggcaguacacgccgauaugggauacuggauagaaagugagaaaaaugaaacuuggaaguuagccagagcgucguuuaucgagguuaaaacauguacauggccaaaaucacauacuuuguggucaaaugguguguuagaaucagaaaugauaauucccaaaaucuacggcggccccauuucgcagcacaacuaccgaccuggcuacuucacucaaacugcgggcccuuggcaucuagggaaauuggaauuggauuuugauuugugugaggguacuaccguaguaguggaugaacauuguggaaaccguggaccaagucucagaaccacaacagugaccgguaaaauaauacacgaaugguguugcagaucauguacauuaccuccauuaagguucagaggagaagacgggugcugguauggcauggaaauacgacccgugaaagaaaaagaggaaaaccuuguuaggucuaugguaucggcaggaucgggugaaguggacucuuuuaguuuagguauuuugugcgcgagcauaaugauugaagaaguaaugcgaagcagauggucuagaaagaugcuaaugacaggaacacucgcaguauuuuugcuguuaauaauggggcaauuaacuuggaaugauuuaauaagacuguguauuaugguaggugccaaugcaagugacagaauggggauggguacgacauauuuagcccucauggcaacuuuuaagaugcgaccaauguucgccguaggccuccuguuccggagacuaacaagcagagaaguacuucuucugacuauaggauugagccuaguugcaaguguggaacuuccuaacucacuggaggagcuuggcgauggauuagcuaugggcauaaugauguuaaaacuacuuacagaauuucaaccacaccaacuguggacaacuuuauuaaguuuaacuuuuauaaaaacaacauuaagucuugacuaugcguggaaaacuacagccauggcuuuaucuauaguaagucuauuuccuuuauguuugucaacaacgagucagaaaacuacaugguuaccaguacuucuaggcucauuugggugcaaaccacuaacaauguuucuuaucacggaaaacaaaauuuggggcaggaaauccuggccauugaaugagggaauuauggcuauugguauagugaguauucuguuaucuucccuccugaaaaaugauguaccguuagcaggcccacucauugcuggugguauguuaauagcuuguuauguaaucuccgggagcucugcugauuuauccuuagaaaaagcagcagagguaucuugggaacaagaagcugaacauaguggaacaagccauaacauuuugguugagguccaagaugacggaacaaugaaaauuaaagaugaggaaagagaugauacuuugacaauauuauugaaagcuacccuguuagcaguaaguggcgucuauccuauguccauaccggccacucuguuuguaugguauuucuggcaaaagaagaaacaacgcagcggaguuuugugggauacaccguccccuccugaggucgagagagcuguuuuagacgaugguauauacaggauauuacaaaggggguuacuggggaggucacaagugggcgugggcguauuucaagacgggguguuucauacaauguggcauguuacgagaggugcgguguuaauguaccaaggcaaacguuuagaaccuuccugggcgucggucaagaaagauuugauaaguuauggcggugguuggagguuccaaggaucuuggaauacuggugaagaaguacaagugauugcaguagaaccggggaagaaucccaaaaauguacaaaccacuccugguacauuuaaaacaccagaaggagaaguaggugccauagcuuuggauuuuaagccagggacaucaggaaguccuaucguaaauagagaaggcaaaauaguaggacucuauggaaacggaguagugacaacuagcggaacuuauguaagugcuauagcucaggcaaaagccucacaagaaggcccacuaccagagauugaagacgaaguauuuaaaaagcguaacuuaacaauaauggaucuacacccagguagugggaaaacccgacgauacuugccagcgauugucagggaagcuauaaaacguaaauuaagaacuuuaauacuggcuccgacccgaguuguagcaucugaaauggcugaagcguuaaaggguaugccgauucguuaccaaacuaccgcuguuaagucagaacauaccggacgagagauaguagauuugaugugccaugcaacuuuuacgaugcguuuguuaagcccagugcgggugcccaauuacaacaugauuauuauggacgaggcccauuuuacagauccggccucaauugccgcuagaggauauauuaguacgcgcgucgguaugggagaagcggcugcuauauuuaugacugccacaccacccggaaguguagaagcauuuccacaaaguaaugcaguaauacaggacgaggagcgugauaucccagagagaucauggaauagcgguuacgauuggauaacugacuucccagguaagacuguaugguuuguaccaucaauaaaaucagguaaugacauugcaaacugcuuaaggaaaaauggaaagagaguuauucagcuaucacgaaaaacauuugauacugaauaucagaaaacuaaaaauaaugauugggacuauguaguaacaacggauaucucggagaugggggcaaacuuuagggcggaccgaguaauugacccccguagaugcuuaaaaccgguaauauuaaaggauggaccagagcgaguaauuuuagcagguccgaugccugugacaguugcaagugcggcacagagacgagggaggauuggacgaaaucaaaacaaagagggagaccaauauguguauaugggacaaccccuaaauaacgaugaagaucacgcacauuggacagaagcaaagaugcuacuugacaauauaaacacaccagaggggauaaucccugccuuauucgaaccggaacgcgaaaagucagcagcuauugauggugaauauagauugcgaggagaggcacgaaagacuuuuguugaacuuaugcggagaggggaucugccuguauggcuaucguacaaagucgcgagugaaggcuuccaguauucugaccgccgaugguguuuugauggagaaaggaacaaucaaguccuagaagaaaacauggauguggaaauauggacaaaagagggagagagaaagaaacuacgaccaagauggcuagaugcaaggacuuauagugacccauuagcccuucgugaauuuaaagaauuugccgcaggccgccgaucgguaaguggagaccugauacuagaaauagggaaauuaccgcaacaccuuacgcuaagagcucaaaaugcgcucgauaacuuaguaaugcuacacaauagcgaacaaggagggaaggcauauaggcaugcuauggaagaauuaccagacacaaucgaaacuuuaauguugcuagcacucauugcuguccucacaggaggagugacgcuguucuuuuuaucaggaaaaggucuaggcaagacgucuauaggacuuuuaugcguaaccgccaguuccgcuuuacuuuggauggcaucaguugagccucauuggauugcagcaucaauuaucuuagaauuuuuccuaaugguacuguuaauaccugaacccgaccgacagcgcacaccucaagauaaucagcuugcauauguagugauuggauugcuauuuaugauauuaacaguugcugccaaugaaaugggacuauuagaaacuacuaagaaagaucuggggaucggucauguagcagccgaaaaccaucaacacgcgacaaugcuggauguagaccuucgucccgcgagugcauggacacuauaugcgguugcgacgacggugauuacgcccaugaugcgucauacaaucgaaaacacaacagcuaauauaucuuuaacagcaauagccaaucaagcagcgauuuugauggguuuagauaagggauggccaauaaguaagauggacauaggagugccacuauuagcguuagguuguuauagccaagugaauccacuaacauuaacggcagcaguucuaauguugguagcacacuacgcaaucauagguccuggucuacaagccaaggcaacgcgcgaggcacaaaagcgaacagcugcaggaauaaugaaaaacccgacaguugaugguauuguggcuauugaucucgaccccgugguauaugaugcaaaguuugaaaagcaauugggucagauaauguuauuaaucuuguguacaagucaaauccuguugaugagaacaaccugggcacucugugaaucaaucacacuggcaacggggccacuaacaaccuuaugggagggaagcccgggcaaauucuggaauacaacaaucgcagugucaauggcgaacaucuucaggggauccuaucuugcaggagcugggcucgcauucucccuuaugaaaucccuggguggaggaaggagggguacgggugcgcaaggagaaacauugggugagaaauggaaacgccaauuaaaccaauuauccaagucagaauuuaauacguauaaacguucagguauaauggaagucgaccgaagugaagcaaaagaaggcuugaaacgaggagagacaacuaagcaugcugucucacgaggaacagccaaacugagaugguuuguagaacguaacuuggucaaaccugagggaaaagucauugacuuaggcugcggaagagggggauggucguauuauugcgcaggacuaaagaaaguaaccgaagucaaaggauauacaaaaggaggaccaggacaugaagaaccgauacccauggcaacuuauggauggaaucuggugaaacuucacucgggaaaagacguuuucuucaugccaccagagaaaugugacacacuucuaugugauauaggugaaaguucaccaaaccccacaauugaagaaggaaggacacuacgaguacuuaaaaugguagagccgugguuacguggaaaucaguuuuguauaaagauuuugaacccauacaugcccuccgucguagagacguuagagcaaaugcaacguaaacauggaggaaugcucguucgaaacccgcuaucgagaaauucgacucaugaaauguacugggugaguugcggaacugguaacaucgucagugcggucaacaugacgagccgaauguuauuaaauagauucaccauggcacaucguaagccuacauuugaaagggauguugaccugggggcugguacaagacauguggcaguagaaccagaaguagccaauuuagacauuauaggacaaaggaucgaaaauaucaaaaaugaacacaagucuaccuggcauuacgacgaagauaacccauacaaaacgugggcuuaccauggaucauacgaggucaagccgagugguucugcaaguucuauggucaacggaguugugagguuauuaacgaagccuugggacgucauaccuauggugacacagauagcgaugacagauacuacaccauucggccaacaacgcgucuucaaagagaaagucgacacgagaacgccucgggccaagagagguacuacucagauuauggaagugaccgccaaauggcuauggggauuccugucuaggaauaagaaaccgagaauauguacacgggaagaauuuacaagaaaaguuagaaguaacgcugcaaucggagcugucuucguagaugaaaaucaguggaacucagccaaagaggcagucgaagaugaaagauuuugggaucucguacaucgagaaagagaacuacacaaacaaggaaaaugugccacaugugucuacaacaugaugggaaaacgagagaagaaauuaggagaauuugggaaagcaaaaggaucaagagcuauaugguauaugugguuaggagcaagauuccuugaguucgaggcguuaggcuuuaugaaugaagaucacugguuuaguagagaaaacucucuuucugggguagagggagagggcuuacacaaauugggauauauccugcgagacauaaguaagauaccaggaggcaauauguacgccgaugacacagcggggugggauacacgaauaaccgaagacgaucuacaaaacgaggcaaaaauuacagauauuauggaaccggaacaugcacuacuagcgacaaguauauuuaaauugacguaccaaaauaaggugguccgcguucaacggccggcaaagaaugggacgguuauggauguaauaucucgucgggaucaaaggggaagugggcaaguaggaacauacggacuaaauacauuuacaaauauggaagugcaauugauacgacaaauggaauccgagggcauauuuuuaccgucugaacuggagacaccaaaucuggcugaaagaguacuugauugguuagaaaagcacggagcugagagguuaaagagaauggcgaucucaggugacgauuguguaguaaaaccaauugacgauagauucgccacggccuugacggcuuuaaacgauauggggaaaguaaggaaagauauaccgcaaugggaaccgagcaaggguuggaaugacuggcaacaagugccauuuuguagucaucacuuccaccaacuuauaaugaaggacgguagagaaauaguggugccuugcagaaaucaggaugagcuaguagguagagcccgcguaucgcaaggggcgggcuggagccuaagagaaacggcguguuuggguaaaucauaugcccagauguggcaacugauguauuuccaucgaagagaucuaaggcuugcugccaaugcuaucuguucagcaguuccggucgauugggugcccacgucgagaacgacauggaguauucacgcgcaccaucaauggaugacaaccgaagauaugcuauccguauggaauaggguuuggaucgaggagaauccauggauggaggauaaaacacacgucucgucgugggaggaagugcccuaccuuggcaaacgggaagaucaaugguguggaucauuaauuggauugaccgcgagggccacuugggccacgaacauccaaguggcgauaaaccaaguacgucguuugauugguaaugaaaacuauuuagauuauaugacaaguaugaaacgauuuaaaaaugaaucugauccggagggcguauuaugguga

SEQ ID NO: 21230 - RNA, 9870 nt, Artificial Sequence
  derived and/or modified CDS sequence (opt6) from DENV-1__GU131962__SS-prME
ucagugacaauguuauuaauguuauuaccaacggcucuugcguuucaucuuacgacaaggggaggagaaccucacaugauagugagcaaacaagaacggggaaaauccuuauuauuuaaaacaucugcaggcguuaauauguguacacucauagcaauggauuuaggugaauuaugugaagacacaaugaccuauaaauguccgcaaauaacagaagcugaaccagaugauguagauuguugguguaaugcuacagacacuuggguuacauacggcacuuguucucaaaccggugaacauagacgugauaaaagguccguugcguuggccccucauguaggacuuggacuugaaacucguacagaaacauggaugagcagcgaaggagccuggaagcaaauacaaagaguagaaacuugggcacuaaggcacccaggauucacgguaauagcacuuuuucuagcccaugcaaucggaacuucaauaacucagaaagggauaauuuuuauuuuacucauguugguuacuccaucuauggccaugagaugcgucggaauaggaaaucgggauuucguugaaggauuaucaggagcaacauggguggauguaguuuuagaacacgggucuuguguaacuacuauggccaaaaauaaaccaaccuuagacaucgaacuuuuaaagacugaagucacaaaccccgcuauuuugagaaaacuuuguauagaagcaaaaaucucaaacacuacuaccgacucccgcugcccaacccaaggugaagcaacauuaguagaagaacaagaugcgaauuuuguaugccgacguacguucgucgacagagggugggguaauggauguggauuauuuggcaaagguaguuuauuaacaugcgcaaaauuuaagugcguuaccaaacuugaaggaaaaaucguucaauacgaaaaccuaaaauauucgguaaucguuacaguccauacuggcgaccaacaucaaguaggaaacgaaacaaccgaacauggcaccauagcuacuaucacgccccaagcccccacaagcgaaauucagcuaacugauuauggcgcgcuaacacuagacugcucuccacguacaggacuggauuuuaaugagaugguacuauuaacuaugaaagagaaaagcugguuaguacauaaacaaugguucuuagacuuaccacuaccauggacaagcggugcaucaaccagucaggaaacuuggaaccgacaggacuugcuagucacauuuaaaaccgcucaugcaaagaagcaagaaguagucgucuuaggcagccaggaaggugcgaugcauacagcgcuaacuggggcaacagaaauccaaacuucaggcacaaccaccaucuuugcugggcauuuaaaguguagauuaaaaauggauaaacuaacuuugaaaggaaccagcuauguuauguguacagggucuuuuaaacuagaaaaagaaguagcagaaacucaacacggcaccgucuuagugcaaguuaaguaugagggaacagacgcaccuugcaagauaccguuuuccacacaagaugaaaaaggaguuacacaaaacggacgccuaauuacagcaaauccuauugucacugacaaagagaaaccagucaauaucgaaacagaaccacccuucggcgagaguuauauaguagugggcgcaggggaaaaggcacuaaaacuuucaugguuuaagaaaggauccucaaucggaaaaauguuugaagcaacagcccgcggggcaagaagaauggcaauuuuaggagauacugcuugggauuuuggcucgaucgguggcgucuuuacuucgguggguaaacuuguccaucaaguauuugguacagcguacggagugcuguucucagguguaagcuggacgaugaaaaucgguauagggauucuacuaacauggcuuggacugaauagucguaguacgucauuaaguaugacuugcauagcuguuggaaugguaacauuguacuuaggaguuaugguacaagcagauucgggauguguaauaaauuggaaaggacgggagcuaaaauguggcucgggcauauuuguaacaaaugagguucauacuuggacagaacaguauaaauuucaagccgacuccccaaagcgccuuagcgcugcaauaggcaaagcgugggaagagggaguaugcgguauaagguccgcaaccagacuagaaaauaucauguggaaacaaaucaguaacgaauuaaaccacauucuucuagaaaacgauaugaaguucacaguagugguuggcgacgccaauggaauacuagcacaagggaagaagaugauaagaccucagccaauggaacauaaauacucauggaaaagcuggggcaaagcgaaaauuaucggagcagauauacagaauaccacguuuauuauagacggcccagauacacccgaaugcccagacaaccaaagagcuuggaauaucugggaaguugaagauuacgguuuugggauauucacaacaaacaucuggcuaaaguuaagggauucguauacgcaaaugugcgaccaucgacuaaugagugcagcaauaaaggauucaaaggccguacaugcugacauggguuauuggauagagucugagaaaaaugagacuuggaaacuggcaagagcaucuuucauugaaguuaaaacuuguacuuggccaaaaucacauacuuuauggaguaacggaguguuagaaucugaaaugauaauaccaaagauuuacggcggcccgauuucacaacacaauuaucgaccaggauauuucacacaaacagcgggaccauggcauuuaggcaagcuagaacuagacuucgauuugugcgaagguacuaccguuguuguggacgaacauugugguaauagaggacccagcuugagaacgacaacagucaccggaaaaauaauacaugaauggugcugccgaucguguacgcucccaccacuaagguucagaggugaggauggauguugguacggaauggaaauaagaccggugaaagaaaaagaagagaacuugguacguucaaugguaucagcgggaagcggagaaguagauucuuuuaguuuaggaauauuauguguaaguauaaugauagaagaaguaaugcgauccagauggagucgaaaaauguuaaugacgggaacguuagcaguauuucuacuuuuaguaaugggucaauuaacguggaaugaccuuauaagauuauguauuaugguaggugcuaacgcgucagauagaauggggauggggacgaccuaccuugcacucauggccacguuuaaaaugaggccuauguucgcagucggacuauuauucagaagauugacaucccgcgaaguucuccuucuaacgauagguuugucauuagucgcuucgguggaacugccaaauucuuuagaggaacugggagacggguuggccaugggaauaaugaugcuuaagcuauuaacggaauuucaaccgcaccaacuauggacaacacuucuaucacuuacauuuaucaaaacaacccuuuccuuagacuaugcauggaaaacuaccgcaauggcauuguccauaguaaguuuauuuccuuuaugccuaagcacgacaagucagaaaacuacuuggcuuccuguauuacuuggcaguuucggcuguaagccgcuaacuauguuuuuaauaacagaaaauaaaauauggggacgaaaaaguuggccgcuuaaugaagguauuauggcuaucgguauuguaucuauacuuuuaagcucauuacugaagaaugauguaccguuggcgggcccacugaucgcaggagggaugcugauugcuuguuacguaaucucagguucaagcgccgaccuuucucuagaaaaagcugccgagguuuccugggagcaggaggcagaacacucugguacaagucauaauauauuaguagaaguccaagaugauggaaccaugaaaauuaaagacgaagaaagagacgauacuuugacuauccuucuuaaggccacauuauuagcugugucugguguauaccccaugagcauucccgccacguuauucgucugguauuuuuggcagaagaagaaacaaaggaguggaguauuaugggauacaccgucaccuccagaaguagaaagagcaguuuuagacgauggaauuuaucgaauauuacaaagaggauuacuaggucggucgcaaguagguguaggaguguuucaagacgggguauuccauacuauguggcacguaacacgaggggcaguauuaauguaucaagguaaaagauuagagccaucaugggcuucaguuaagaaagauuuaauaaguuacggugguggauggcgcuuccagggaucauggaauaccggagaagaaguacagguaaucgcaguugagccaggcaagaacccuaaaaauguacaaacgaccccaggaacuuuuaagacucccgaaggcgagguaggugcaauugcccuagauuucaaaccagggacaagugguucaccaaucgugaaucgggaaggaaaaaucgucggacuauacggcaacgggguagugacaacaucaggcaccuacguuucggccauagcacaagcuaaagcgucucaagagggaccgcuaccugaaaucgaggacgagguauucaagaaacguaaucuuacuauuauggaucuacauccagggucugguaagacucguagauacuugccggcaauaguaagggaagcaauaaaaagaaaacuccggacacuaauauuagcuccaacaagaguaguagcaucggagauggccgaagcacugaaaggaaugccaauuagauaucagacuacggcugucaaaucggaacacacaggcagagaaauuguagaucuaaugugucaugcaacguucacgaugagacuauuaucuccuguacggguaccuaauuauaauaugauuaucauggacgaagcacauuuuacugacccugcaaguauugccgcaaggggauacauaagcacgaggguugguaugggugaagccgcggcuaucuucaugaccgccacucccccaggaaguguagaggcuuuuccacagucgaaugcuguaauacaggacgaagaacgggacaucccagaaagaaguuggaauaguggauaugacuggauaaccgauuucccggguaaaacagugugguuugugccuuccaucaaaagcggaaaugauauagcgaauugucuuagaaagaaugggaaacgaguaauacaauuaucacgcaaaaccuucgauacggaauaucagaaaaccaaaaauaaugacugggauuaugucgugaccaccgauauaagugaaaugggggccaacuuuagggcagauagaguaauugacccacgucgcugucucaaaccagucauauuaaaagauggccccgaaaggguaaucuuagccggacccaugcccguuacuguugcuagcgcugcacaaagaagaggcagaauuggaaggaaucaaaauaaggagggagaucaauauguauacaugggacagccccucaauaaugaugaggaucaugcgcauuggacagaagcuaaaauguuauuagauaauaucaauacuccggaagguauaaucccagcauuauuugaaccagaaagagaaaaauccgcugcgaucgauggagaauauaggcuaagaggggaagcaagaaaaaccuucgucgaacuuaugcgacgaggagaucugccaguaugguuaucguauaaaguagcaagugaaggauuccaauauagugacagaagaugguguuuugauggagaaagaaauaaucaaguacuggaagaaaacauggaugucgaaauauggacgaaagaaggugaacguaagaaacuuagaccaagauggcuugaugcccgaacauacucggauccucuagcgcucagagaguucaaagaauuugcggcaggaaggcgaucgguaucaggggaucuuauacuggaaauaggaaaacuuccucaacauuuaacuuuaagggcccaaaaugcacucgauaaccuugugaugcuccacaauagcgaacaaggcggaaaagcguauaggcaugccauggaggaauugccagauacaauagaaacccugauguuacuggcccuaauugccguauuaacgggugggguaacucuauucuuuuuauccggaaaaggcuugggaaaaacaucaauaggcuuauuguguguaacugcuagcuccgcguuacuauggauggcaagcguagaaccccacuggauugccgcuucuauaauauuagaauuuuuccuaauggugcucuuaauaccagaaccggacaggcaaagaacaccucaagauaaucaauuagcuuauguaguuauaggccuccuauuuaugaucuuaaccguagcagcuaaugaaaugggacuucucgaaacaacaaagaaagauuuagguauaggucacguagcggcggaaaaucaccaacaugcaaccaugcuagaugucgaccuacgccccgccagcgcuuggacccuguaugcuguagcaaccacaguaauaacuccaaugaugaggcacaccauagaaaacacuacggcaaauauauccuuaacagcaaucgcuaaucaggcggccauacuaauggguuuagauaaaggauggccaauaucaaaaauggauauugguguaccacuuuuggcacuggggugcuauagucaaguuaauccgcuuacguugaccgcagccguacuaauguuaguggcacauuacgcaauuaucggcccaggcuuacaagcgaaagcaacccgcgaagcucagaaaaggacagcagcuggcauuaugaaaaacccuacaguugauggaauuguugcuauugaucuggauccaguaguuuacgaugccaaguuugaaaaacagcuaggccagaucaugcucuugauccuuugcacaagucaaauccuccuuaugcgaaccacaugggcccuaugugaaucuauaacgcuggcaacugggccgcucaccacacucugggaagguaguccaggaaaguuuuggaacacgacaauugcaguuagcauggcuaacauauuuagagguucguaccuagcgggcgcuggauuggcauuuucacuaaugaaaaguuuagguggcggcaggcgaggaaccggggcacagggcgaaacauuaggagaaaaauggaaaagacaauugaaucaacuuaguaaaucugaguuuaauacauauaaaaggaguggaauaauggaaguagacaggagcgaagcuaaagagggcuugaagcguggcgaaacaacaaaacaugcgguauccagaggaacggcaaagcucagaugguuuguugaaagaaauuuggugaagccugaagggaagguuauugaccucgguugcggaagaggugguuggaguuauuauugcgcuggguugaagaaagucacagaauaugcaucggcgggguuagcaauaauaguuccgcuucccuuagacacuuacgggaggaaccgucuuaagauacauucaggaaaggacguauuuuucaugccuccagagaaaggcgauacacuacuuugugauauaggugagucgagucccaauccuacuauugaagaggguagaaccuuacgaguguuaaaaaugguggaaccuuggcucagaggcaaucaauuuugcauuaagauucuuaauccguauaugcccagcguaguugaggcacuagaacaaaugcaacgaaaacacggagguauguuaguaaggaaucccuuaucccgaaacucuacccaugaaauguauuggguaagcugugguacuggaaauauagucagugccguaaauaugacuucccggaugcucuuaaaccgauuuacaauggcucacaggaagccaacuuacgaaagagaugucgaccuaggagcagguacucgucacguugccguagaaccugaaguugcaaaccuggacauuauugggcaaagaauugaaaacaucaaaaaugagcauaaaucuacauggcauuaugaugaagacaacccauauaagacgugggcauaccacggaucuuaugaagucaaaccuucuggcucggcguccucaaugguuaacgggguuguaaggcuacugaccaaacccugggacguaauuccaauggugacacaaauagcaaugacugacaccacgccguucggacaacaacguguauuuaaagaaaaaguugacacgagaacuccacgcgcaaaacgaggaacaacgcaaauuauggaggucaccgccaaauggcuauggggauuccuaucucguaauaaaaagcccagaauauguacaagggaagaguuuacaagaaagguacgauccaaugccgcgauuggugccguauuuguagacgaaaaccaauggaacucugccaaagaagcgguagaagaugaaagguuuugggauuuaguccaucgcgagagagaacuccauaagcagggaaaaugcgcgacuugcguauauaacaugauggggaagcgcgagaagaaacuuggugaauuugguaaagcaaaagguagccgugccauaugguauaugugguuaggugcgcgguucuuagaguuugaagcauuaggauucaugaacgaggaucauugguuuucgcgugaaaauagucuaagcggaguggagggggaaggguugcacaaacugggauacauacugagagauauaucgaaaauaccaggugguaauauguaugcugaugauacugcuggaugggacacaaggaucacggaagacgaccuucaaaacgaggcaaagauaacugaaauaauggagccagagcaugcguuacucgcuacauccauuuucaaauugacguaccaaaacaagguuguacguguacagcgaccggcuaaaaauggaacuguuauggacguuauaucaaggagagaccaacgaggaucaggacaaguuggaacguaugguuuaaauacauuuacuaacauggagguacaguugauccgccaaauggagagcgaaggaaucuuuuuaccguccgaacuagaaacaccgaaucucgcugaacgaguacuagauugguuagaaaaacauggggcagaacggcucaagcgaauggcaauuucaggagacgacuguguugugaaaccaauugacgauagguucgccaccgcacugaccgcuuuaaaugacaugggaaagguacguaaagacauaccccagugggaacccagcaaaggauggaaugauuggcaacagguaccauuuuguucgcaucacuuucaccagcuaauuaugaaggauggaagggaaauagucguaccguguagaaaucaagacgaguuagucggaagggcacggguaucacaaggagcaggcuggucauugagagaaacugcuuguuugggcaaauccuaugcccaaauguggcaacucauguacuuucauagacgugacuuaagacucgccgcaaaugccauauguagugcugugcccguagacuggguuccaacaucaaggaccacaugguccauacacgcacaccaucaauggaugacaacugaagauauguugucaguauggaauagaguauggauugaggaaaauccuuggauggaagacaagacgcauguuuccucaugggaggaagucccauaccucggaaaacgagaggaccaauggugugggucauugauaggucucacugcccgagccaccugggccacgaauauucaagucgcaauaaaucagguucguagacuaauagguaacgaaaauuauuuagacuauaugacauccaugaaacguuuuaaaaaugaaucagacccagaaggugcguugugguga

SEQ ID NO: 21231 - RNA, 9879 nt, Artificial Sequence
  derived and/or modified CDS sequence (opt6) from DENV-1__GU131963__SS-prME
agcguaacuauguuauuaauguuacuucccacugcacuagcauuccacuuaacuacucguggaggagaaccacauaugauagugaguaaacaagaacgagguaaaucucuacuauuuaaaacgagugccggugugaauauguguacacuuauagcgauggaucuuggcgaacuaugcgaagauacaaugacauauaaauguccacaaauaacagaagcggaacccgacgacguugauugcuggugcaaugccacagauacauggguaacuuauggaacuuguucgcagacgggagaacaccggcgagauaaacgaagcguagcacucgcaccccacguuggacucggcuuagaaacuaggacugagacuuggaugucaucugaaggcgcuuggaaacagauacagagaguugaaacuugggcacuccgacauccugguuuuaccguuauagcauucuuccuagcacacgcaauagggacaucgaucacacagaaaggaauuauauuuauacuuuuaaugcuaguuaccccuucaauggcaaugagauguguaggaauagguaaccgagacuuugucgaaggacuguccggagcaacuugggucgacguaguacucgaacacgggaguugcguaaccacaauggcuaaaaauaaaccaacauuagauauugagcuguuaaaaacagaaguuacuaaccccgcaauuuugagaaaacuaugcauagaagcaaaaauaagcaacacuacuacagacucuagaugcccuacucagggcgaggcuacguuaguugaagaacaagacgcaaacuucguuuguagaagaacguuuguggaucgugguuggggaaaugguugugguuuguuuggaaaagguucucuacuaacuugugcaaaauucaaaugugugaccaaacuagaaggaaaaaucguucaauacgaaaaccucaaauauagcgucauaguaacugugcacacaggagaccaacaccaaguagguaacgagacaacugaacacgggacgaucgcaacaauuacaccccaagccccuacuucugaaauucaauuaacagacuauggcgcucuaacgcuugauuguucgccuagaacugggcucgacuucaaugaaaugguucuucuuacuaugaaagagaaaaguugguuagugcauaaacagugguuccuagauuuaccacuuccuuggacaaguggugcaaguacaagucaagaaacguggaaucggcaggaucuacuugucacuuuuaaaacagcacacgccaagaaacaagaaguugucgugcuagguucucaagagggugcgaugcauacggcauuaacaggugcuacagagauucaaacgucagggacaaccacuauauuugcaggacauuuaaaaugcagacuaaaaauggauaaauuaacgcuuaaagggacguccuaugucaugugcacaggcucauuuaaacuagagaaggagguugcagaaacacaacacggaacgguacucguucaagucaaguacgaaggcacugaugcacccugcaaaauccccuuuaguacgcaagaugaaaaagggguaacucaaaacggucgacugauuacagccaacccaaucguuacugauaaagagaagccgguuaauauugaaaccgaaccuccauuuggcgagucauauauaguuguaggggcuggugaaaaagcgcuuaaacuuaguugguuuaagaaaggauccucaauagggaaaauguuugaagccacggccaggggagcaagaagaauggccauauuaggagacacagcaugggauuuuggcagcaucggagguguuuucaccagcguagggaaacuuguccaucaagucuuugguacugcuuauggaguauuauuuucuggagugagcuggacuaugaaaauagggaucggaauauuacuaacauggcuuggauuaaauaguagaagcaccucucuaaguaugacuuguauugcaguugguaugguaacuuuguaucucgguguuauggugcaggcagauaguggcugcguaauuaauuggaaaggccgugaauugaagugugguagcggaauauuuguaaccaaugaagugcauacauggacagaacaauacaaguuccaggcagauucccccaagcgccucucagcggcaauagguaaagcaugggaggaaggggucugcggaauaagaucagcgaccagacuagagaauauuauguggaaacaaauuuccaaugaacuaaaccacauccuucuugagaaugauaugaaauucaccgucgugguaggagaugcgaauggaaucuuagcacagggcaagaaaaugauucgaccucaacccauggaacauaaauauagcuggaaaucguggggaaaggcgaaaaucauuggagcugauauacaaaacacgacuuuuauuauagacggacccgauaccccggaaugcccggacaaucaacgggcauggaacauaugggaaguugaagauuacgguuucgggauauuuacuacuaauauauggcugaaguuaagggauaguuauacacagaugugugaucacagacucaugucggcagcuauaaaagauaguaaagccguacaugcagacaugggauacuggauagaaagugaaaagaaugaaacguggaaacucgcaagggcaaguuuuaucgaaguaaagaccuguacauggccuaaaagucauacucucuggaguaauggagucuuagaaucggaaaugauaauaccuaaaauuuacggugguccaauaagucaacacaauuaccguccaggauauuuuacacaaacagccggaccauggcaucuugguaaauuagagcucgacuucgacuugugugaaggaacuacgguaguaguggaugaacacuguggaaacagaggaccgucucucaggaccacaacaguaacuggcaaaaucauccacgaguggugcuguagaucuuguacuuugccgccgcuaagguuuagaggagaggacgguuguugguacgggauggaaauccgaccuguuaaggaaaaagaagaaaaccuggugagaucuaugguaagcgccggcucaggggaaguugacagcuucucuuugggaauauuaugcguaagcauaaugauugaagaaguuaugagaagucguuggagcagaaaaaugcuuaugacaggaacacucgccguauuucuucuccuaguuaugggacaauugacuuggaacgaccuaauuagauuaugcauaauggucggggcaaacgcuucagauagaaugggcauggggacuacauaucuggcacucauggcaacauucaagaugcgaccgauguuugcaguuggacuauuauuucgcagacugaccucacgagaagugcuucuucuaacuaucggauugagcuuagucgcauccguagaacugccaaauucauuagaggaauuaggugauggguuagcuauggguauuaugaugcuaaaauuacuuacagaauuucaaccacaucaauuauggacgacgcuauugagucucacauuuauaaaaacuacuuuaucuuuagacuacgcguggaaaacaacugcaauggcucuaucaauuguaucucucuuuccucuguguuuaucaacuaccucacagaaaacuacuuggcuaccuguacuacuuggauccuucggauguaagccccuaacaauguuccugauaacugaaaauaaaauauggggccggaaaaguuggccuuuaaacgaaggcauaauggcaaucggcauagugucuauacuucuaaguucacucuuaaagaacgacgugccuuuggcagguccucucauugccggaggaauguuaauagcuuguuaugugauuucuggguccucagcagauuuaaguuuagaaaaagcagcugaaguguccugggagcaagaagcugaacauucaggcaccucacacaauauauuaguggagguacaagaugaugguacuaugaaaauuaaggaugaggaaagagaugauacguuaacaauuuuacuaaaggcuacuuuacuagcugucucaggugucuacccaaugucuauuccugcuacacuguucgugugguauuucuggcaaaagaagaaacaaagaucagggguccuaugggacacaccaucaccucccgaaguugaacgugcuguucuugacgauggaaucuacaggauucuacaaagaggguuacuuggacgaucccagguugguguugggguuuuucaagauggaguguuccauacaauguggcacguaacacggggagcaguguugauguaucaagguaaaagauuagaaccuucuugggcuucagugaaaaaggaccugauaucauacgggggaggauggagauuccaaggcaguuggaauaccggggaggagguucagguuauagcagucgaaccgggcaagaaucccaaaaacgugcagacgacaccagggacuuuuaaaacaccugaaggagaagucggugcgaucgcucuugacuucaaaccaggcaccucaggaagccccauuguuaauagagaggggaaaauuguaggucuauauggaaauggcguaguaaccaccucuggaacauauguuucagcgauagcgcaggcaaaagcgagucaggaggguccucuccccgaaauugaagacgaaguuuuuaagaaaagaaaucuuacaauaauggaucuacauccgggaaguggaaagacuagacgcuaucuaccagcaaucguacgagaagcuauaaaacgaaaauugagaacccugauuuuggcuccuacaagaguuguagcaucagaaauggcagaagcguugaagggaaugcccauucguuaucagacgacagcagucaaaagugaacacacgggcagagagaucguugaucuuaugugucaugccacuuucacaaugcgacuguuaucuccuguucgcguaccgaauuauaauaugauaauaauggacgaagcgcacuuuacagauccagcaucuauugcggcaagagguuauauuucuacucguguaggaaugggagaagcugccgcuauauuuaugaccgccacgccacccgguucaguagaagcguuuccgcaaucaaacgcagucauccaagacgaagaacgggacauacccgaaaggucuuggaauaguggguacgacuggauaacugauuucccagguaaaacaguaugguucguuccaucaauuaagucugggaaugauaucgcuaauugucuacggaaaaacgggaagaggguuauucaacuaagucgaaaaacuuuugauacggaauaucaaaagaccaagaauaaugauugggacuauguaguaaccacagacauuucugagaugggagcaaauuuucgagcugacagagugauugaucccagaagaugccugaaaccugucauucucaaggacgguccagaaagaguaauacuagcaggaccgaugccagucacgguagcaucagcagcacaacgaagaggucgcauuggaagaaaccaaaauaaagagggugaccaguacguuuauaugggucaaccauuaaacaacgacgaagaccaugcacacuggacggaggcaaaaauguuacuagacaauauuaauacaccagaagggaucaucccagcauuauucgaaccagagcgcgagaaauccgcagcuauagacggagaguauagacuaaggggagaagcucgcaaaacauuuguagaacugaugcgucgaggugauuuaccagucuggcugucguauaaggucgcuagcgaaggauuccaauauucugaucgaagguggugcuuugauggagaaagaaacaaucaaguacuugaggaaaauauggauguugaaaucuggaccaaagaaggagaacggaagaaauuacguccacgauggcuugaugccagaacuuauagcgauccacucgcauugagggaguucaaagaguucgcggcaggaaggaggagcgugucaggcgacuugaucuuagagauuggaaaguuaccacaacauuuaacccugcgagcccaaaacgcguuggacaaucucgugauguuacacaauucugaacaagggggaaaggcuuaucgucacgcaauggaagaauuaccggauacuauagaaacucugauguuauuagcccugauagcaguucucacgggcggcgucacauuauuuuuccuuucaggcaagggauuagguaaaacaucaauugggcugcuauguguuacagccaguucagcucuuuuauggauggcaucgguagaaccacacuggaucgcagcaaguaucauauuggaguucuuucuuaugguauuacuuauaccugaaccugaccgucaaagaacgccacaagauaaucaauuggcuuauguuguuauagggcuauuauucaugauacuaacaguugcagcuaaugaaauggguuuauuggagacaacuaagaaagaccuugguaucggacauguugccgcugaaaaucaucaacaugcaacuaugcuugauguagaucuaaggccugcuucugccuggacacuauacgcaguggcuacuacuguaauuacgccuaugaugcgacacacuauugagaauacuaccgcuaacaucucucugacugccauugccaaucaggcugccauucucaugggacuagauaaaggcuggccaauuuccaaaauggacauuggaguaccgcugcuggcucuaggaugcuauucccagguaaauccacugacccugacggcagcuguacuuauguugguugcucauuaugcuauaauuggcccugguuugcaagcgaaagcaaccagagaagcucaaaaacguacagccgcaggaauuaugaaaaaucccacaguugacggaauaguggcgaucgauuuggacccaguagucuaugaugcaaaauuugaaaaacaguugggacaaauaauguuauuaauccucuguacuucucagauacuuuugaugagaacaacaugggccuuaugugaauccauuacucucgcgacaggaccacugacaacacuuugggaagggucuccaggaaaauuuuggaacacgaccauagcgguaucuauggcaaauauauuuagaggaucauaccuagccggagccggguuagcguuuagccuuaugaaaucacuugguggcggacguagaggaaccggggcgcaaggcgaaacccuuggugagaaauggaaacgacagcuuaaucaacuuagcaaaucugaauuuaacacuuauaaacgaucagguauaauggaaguugauagaucggaagccaaagaaggacuuaaacgaggugagacgacaaaacacgcagugucgcgagguacagcuaaauuaaggugguuuguugagaggaacuugguaaaaccugaaggaaaggugaucgaccuaggaugcggacgcggcgguuggucuuacuacugugcgggccuaaagaaaguaaccgaaguaaaaggguacaccaaaggcggacccggacaugaagaaccuaucccgauggcaacauaugguuggaaccuaguaaaacuccauucaggaaaagacguguuuuucaugccgcccgaaaaaugcgauacacugcugugcgauauaggagagucaaguccuaauccaacgaucgaagaaggaagaacucucagaguacuuaaaauggucgaaccaugguuacguggcaaucaguucuguauuaaaauacuuaaucccuacaugccguccgucguagaagcccuggaacaaaugcaacgaaaacauggaggaaugcuuguaagaaauccuuuaucaagaaacucuacacacgaaauguacuggguaaguuguggcacagguaauauaguuucagcgguaaacaugacaagccgcauguugcuaaauagauucacgauggcccacaggaaaccaacauacgaaagggauguagaccucggagcagguacucgucacguagccgucgaaccagaaguagcgaacuuagauaucauaggacaaagaauugaaaauaucaaaaaugaacauaaaucgaccuggcauuacgaugaagauaauccuuauaagacaugggcauaccauggaagcuaugaaguuaaaccaagcggcucugcuucaucgaugguaaacgguguugugagacuauugacaaaacccugggaugugaucccuaugguaacucagaucgcaaugacagacacaacacccuuuggccaacaaagaguuuucaaggaaaaaguagacaccaggacuccuagggcuaaaagaggaacaacacaaauaauggaagucacagcaaaauggcuguggggcuuccugucuagaaacaaaaagccucggauauguaccagggaggaauuuacacgaaaagucagaucgaaugcagcaauaggggcaguauuugucgaugagaaucaguggaacucagccaaagaagcagucgaagaugaacgguucugggaucuuguccauagggaaagagaauugcacaaacaagguaagugugcuacaugugucuauaacaugaugggaaagcgcgagaagaaauugggcgaauuugguaaggcuaaagguucacgcgcaaucugguauaugugguuaggagcucguuucuuagaguucgaagcccuagguuuuaugaacgaagaccauugguucucccgcgagaauagccuaagcggaguagaaggggaaggguugcauaaguuagguuacauauuaagagauauaucaaaaaucccugguggaaauauguaugccgacgacacagccggaugggacacaagaauuaccgaggaugaucuacagaacgaggccaagauaacagagauuauggaaccugaacaugccuuacuagcaacgaguauuuuuaaacuaacauaccaaaauaaaguaguaagaguacaacgcccggcgaaaaauggaacaguaauggaugucauuucuaggagagaucaaaggggcaguggacaaguagguacauacggucuaaauacauucaccaauauggaagugcaacuuauaagacaaauggagagugaaggaauauuccuacccucugaguuagaaacgccaaauuuagccgaaagagugcucgacuggcuggaaaaacauggugccgaaagacugaagaggauggcgauaucgggcgacgauugcguugugaaaccuaucgaugauagguucgcgacagcucuaacagcacuuaacgauauggguaaaguucgaaaagacaucccgcaaugggagcccaguaaaggauggaacgacuggcaacaagugccauucugcucgcaucauuuccaccaauugauuaugaaagaugggcgugaaauuguagucccuugucggaaccaagacgaauugguaggucgggcuagaguaagucaaggugccgguuggaguuuaagggaaacugccugucucggaaaaucauaugcgcaaauguggcaacuaauguauuuccacagacgagauuugcgucuugcagccaacgcaauauguucugcagucccuguugauuggguuccuacaagccggaccacauggucuauacaugcacaccaccaguggaugacuacugaagacauguuaucgguuuggaacagaguuuggauugaagagaaccccuggauggaagauaagacacaaguaagcagcugggaagaggucccauacuuggguaaaagggaagaucaauggugugguucccuuauaggcuuaaccgcccgagcaacaugggcuaccaacauccaaguagcgauaaaucagguaaggcgcuuaauaggcaaugaaaacuauuuagauuacaugacuucaaugaaacguuucaaaaacgaaagugaucccgaaggagcucugugguaa

SEQ ID NO: 21232 - RNA, 9879 nt, Artificial Sequence
  derived and/or modified CDS sequence (opt6) from DENV-1__KF955442__SS-prME
agcguaacuaugcuuuuaaugcuguuaccuacugcacuugcauuccaucuaacuacacgcggaggcgaaccccauaugaucguauccaaacaagaacguggcaaaucucuuuuauuuaaaacgucagcggguguaaauaugugcacuuuaauagcaauggauuuaggggaacugugcgaagacacuaugacuuauaaaugcccacagaucacugaagccgaacccgacgauguagauugcugguguaacgcaacugacacauggguuacauauggaaccuguagucaaacgggugaacaucgaagagacaaaagaucaguagcccuagcuccacacguaggacuaggguuagaaacaaggacggaaacauggaugucaucagaaggagccuggaaacaaauacagaggguugaaacuugggcccuaagacaucccggauuuacuguaaucgcacuauucuuagcucacgcgauagggacaucuauuacucagaaaggaauaauuuuuauacuacuaauguuagucaccccuucaauggcaaugcguuguguaggcauaggaaaccgagacuuugucgaaggacugucuggcgcuacauggguagacguaguucucgaacaugggaguugugucaccacuauggccaaaaauaaacccacacuagauaucgaauugcuaaaaacagaaguaacaaacccagcaauauugcgcaaauuauguauugaagcaaaaaucaguaacaccacaacggauucaagauguccaacccaaggugaagcaacauugguagaagaacaggacgcgaauuuuguauguaggcguacauuuguagaucgagguugggguaacgguuguggucuauuugggaaagggucacucuuaacaugugcaaaguuuaaaugcgucacaaaguuggagggaaaaaucguucaauacgaaaacuuaaaauauucgguuauaguaacagugcauacuggugaucagcaccaaguagggaaugaaacaacagagcacgguacaaucgcaacuauaacaccacaagcaccgacaagugaaauccaacuaacagauuauggagcacuuacauuggauugcucuccuagaacagggcuagacuuuaaugaaaugguacuucuaacaaugaaggaaaaaucauggcuuguacacaaacagugguuccucgacuugcccuuaccauggacaucaggagcaucaacuucucaagagaccuggaaucgucaagaucuauuaguuacauuuaaaacggcacacgccaagaaacaagaggucguuguccuaggaagucaagaaggcgcgaugcauacugcucuuacaggugcuacagaaauacagaccagcggcacuacuaccauauuugcgggucacuugaagugcagacuaaaaauggauaaacuuacacuaaaaggaacaucauacgugauguguacaggaucauucaaacuagaaaaagagguagcagaaacccaacauggcacaguucuugugcaagucaaauaugaaggaaccgaugcaccaugcaagaucccauucucgacgcaagaugaaaaaggagucacucaaaauggacguuuaaucacagcgaacccaauagugacagauaaagaaaaaccgguuaauauagaaacagaaccuccauucggugaaaguuauauuguaguuggugccggagaaaaggcauugaaauuaaguugguucaagaaggguucaagcaucgguaagauguuugaggcaaccgcacggggagcaagacgaauggccauauuaggagacacggcuugggauuucgguucaauagguggaguguucaccagugugggcaaacuuguccaccaagucuucggaacagcguauggcguacuguuuagugguguuucauggacgaugaaaauuggcauugggauuuugcuaacauggcuaggccuaaauucccgcaguacaucauugaguaugacauguauagcuguuggaauggucaccuuguaucuaggaguuaugguacaagcggauucaggcuguguaaucaacuggaaaggcagagaauuaaaauguggcucaggcauauucgucacaaacgaaguacacacuuggaccgaacaguauaaguuucaagccgacucaccuaagcgguuaagcgccgcgauugguaaggcgugggaggaagguguaugcggaaucagaagugcuacuagauuggaaaauaucauguggaagcaaauaagcaaugaacuuaaccacauucuauuggaaaaugauaugaaauuuacagugguaguaggugaugcaaaugguauucuagcccaagguaagaaaaugauucgcccacagccaauggaacacaaauauaguuggaaaucauggggcaaagccaaaauaauaggugcagauauccaaaauaccacuuucaucauagaugguccugauacuccagaaugcccggauaaucagcgagcauggaacauaugggaaguagaagauuauggauuugguauuuuuacgacaaauaucuggcuaaaacuaagagauucuuacacucaaaugugugaccacaggcugaugucagcugcuaucaaggauucuaaggcagugcacgcugauaugggguacuggaucgaaagugagaaaaacgaaacuuggaagcuagcuagagcgagcuuuaucgaaguuaaaacguguaccuggccaaaaagucauacacuauggucuaauggagucuuggaaucugaaaugauaauaccgaagauauauggagguccaaucucccaacacaacuaucguccuggauauuucacgcaaacagcagggccauggcauuuaggaaaacuugaacuugauuuugacuugugugacggaaccacaguaguagucgaugaacauuguggaaaucgaggacccaguuugagaacgaccacgguaacuggaaaaaucauucaugagugguguugccgaucauguacauuaccuccuuuaagguucagaggagaggauggcuguugguacggaauggagauuagacccguaaaggagaaggaggaaaaccuagucagguccaugguaagugcugguucuggugaaguagauucguuuucauuggggauuuugugugcuucgauuaugauagaagaagucaugcgaaguagauggagcagaaaaaugcugaugacuggaacgcucgccguguuucugcuccucauaauggggcaacuaacguggaaugauuugauccgacuaugcauuaugguuggagcaaaugcaagcgaucgaaugggaauggggaccacuuauuuggcauuaauggccacauuuaagaugagaccaauguucgcaguuggacuguuguuccgaagauuaacgucgagagaagugcuauuauuaacaauuggccuuucguugguagcauccgucgaguuaccaaauucacucgaagaauugggugauggguuggcuaugggcauaaugaugcuuaaguuacugacugaauuucaaccucaucaacuguggacaacucuacuuucucuuacauuuauuaaaaccacauugaguuuagauuaugcuuggaagacaacugcaauggccuugucuaucguuagcuuauuuccauuaugccucucuacaacgucacaaaagaccacauggcuaccaguauugcucgguagcuucggauguaaaccacuaacuauguuccuuaucacugagaauaaaauaugggggcgaaagaguuggccauugaaugaagguaucauggcaaucggaauaguaaguauccuucuuagcucauugcugaaaaacgauguaccucucgcggggccuuugauagcugguggaauguuaauagcauguuacguuauauccgguucuucugcagaucuaucauuagaaaaagcagcagaaguaucuugggagcaagaagcagaacauucaggaacaucacacaauauauuaguagagguccaggaugaugguacaaugaagauuaaagaugaagaaagggaugauacgcugaccaucuuacucaaagcaacacuauuagcugugucuggaguguaucccaugucgauuccagcaacucuuuuuguaugguacuucuggcaaaagaagaagcaacgaaguggaguauuaugggauacgcccucaccaccugaaguggaacgggcaguacuagaugacgggauauacagaaucuuacagcgaggguugcucggcagaucucaaguaggaguuggcguguuccaagacggaguauuucauacgauguggcaugugacgaggggagccguacuuauguaccaagguaaacgacuagaacccucaugggcaucagucaagaaagaucuuauaagcuaugguggagguuggcguuuucagggaucguggaauacaggagaagaaguacaagucaucgcagucgagccugggaaaaauccuaaaaauguucaaacaacuccugggacuuuuaaaaccccagaaggugaaguaggagcaaucgcacuagacuuuaaacccggcacgucgggaucgcccauaguaaaccgagaagggaaaaucguagggcuauauggaaauggaguugugacuacaucagguacauaugucucagcaauagcucaagcaaaagcaucucaggaaggcccuuugccagaaauagaagaugaaguuuuuaagaaaaggaaucucacgauaauggaccugcauccuggauccggcaaaacgagacgauaucucccugcgaucguaagagaagcaauuaagaggaaauuacguacacucauuuuagcaccuacacgugucguggcuucugaaauggccgaagcauuaaaagguaugccuauccguuaucaaacuacugccgugaaaucagagcauacggggcgugaaauuguagaccucaugugccaugccacuuuuacuaugagacuguugucacccgucagagugccaaacuauaacaugauaauuauggaugaagcccacuucaccgaccccgcguccauugcagcuagaggcuacauuucuacuagggugggaaugggagaggcagcagcuauauuuaugacagcgacaccacccggguccguugaagccuucccccaaaguaaugcaguuauacaagacgaagaaagggacauuccggaaaggaguuggaacucuggcuaugacuggaucacugacuuuccugggaagaccguaugguuuguuccuucuaucaaaagcggaaacgauauugccaauugccuacggaaaaauggaaagagagucauucaacuuucaagaaaaaccuuugacacugaauaucagaaaacuaagaacaaugauugggauuacguaguuacuacagauauuucagaaaugggagcgaauuuuagagccgaccgcgucauagacccccguagauguuuaaaaccuguaauucucaaagauggaccagaaagggucauacuugccgguccuaugccuguaacugucgcaucggccgcacaaaggcgaggaaggauaggaagaaaccaaaauaaagaaggugaccaauacguauauaugggccaaccgcuuaauaaugacgaagaucaugcgcauuggacggaagcaaaaaugcuauuagacaacauuaauacuccugaagguauaauaccugcauuauuugagccagaacgugaaaagucagcagcuaucgauggagaauaccgcuuacgaggcgaagcuaggaaaacauucguagaguugaugagaagaggcgauuugcccguguggcugagcuacaaaguugcaagugaaggauuucaauauagcgauaggcgauggugcuucgacggugaacguaauaaucaagucuuagaagaaaauauggauguugaaauuuggaccaaggaaggugaaaggaagaaacucagacccagaugguuagacgcacguacuuauucagacccauuagcauuacgugaguucaaggaauuugcggccggcaggagaagcguuucuggggauuugauccuagaaauugguaaacuaccucaacaccuuacgcugcgagcacagaacgcauuagauaaucucguuaugcuccauaacucagaacaaggcgguaaggccuacaggcacgcgauggaagaauuacccgacacuaucgagacauuaauguugcuugccuuaauagcaguacucacuggaggggucacacuauucuuuuuaagugggaaagguuuaggaaagacaaguauaggccuguuguguguuaccgcaaguagcgcauuacucuggauggccagcguggaaccacacuggauugcugcuucgauaauacucgaguucuuucuuauggucuuauugauaccugaaccagacaggcagagaacaccacaagauaaucaacuugcauaugucguuauaggccuuuuauuuaugauauuaacuguggccgccaaugaaaugggacuccuagaaacuacaaagaaggaucuagggauaggacauguagcagcagagaaucaucaacaugcuacuaugcuugacguagaucuuagaccagcgagugcuuggacacuauaugcaguugcaacaacuguuauaacuccuaugaugcgacacacaauugaaaauacuaccgcaaauauaucacuaaccgcuaucgcgaaucaagcugcuauauuaaugggacucgauaaaggauggccaauuuccaagauggacauagggguuccccuacuagccuuaggcuguuauagccaagugaaccccuuaacauuaacugccgcaguuuuaauguuagucgcacauuaugcgauaauugguccuggucugcaagcgaaagcuacaagagaagcacaaaaacgaaccgcagcaggcauuaugaaaaauccaacuguagauggcauaguugcaauugaucuagauccagugguauaugacgcaaaguucgaaaaacaauuaggacaaaucaugcuuuuaauauuauguacgagucagauacuacuuaugcgaacuacuugggcacugugcgagagcauaacauuagcgacagguccacugaccacacuaugggagggaaguccaggaaaauuuuggaauaccacaauugcuguuucaauggcgaauaucuuccgugggagcuauuuagcaggggcaggauuggcguuuucauugaugaagucacuaggcgggggaagacgcgggacuggcgcacagggagagacucuuggugagaaauggaaacgucaacucaaccaacuaucuaaaucugaauuuaacacauauaaacgaagcgguaucauggaagucgacagaucagaagcaaaagagggacuuaaaaggggugaaacgacaaagcacgcuguaaguaggggaacagccaaacugcguugguuuguagaacggaaccuaguaaaacccgaagggaaagugauagaucucggcugugggcgugggggauggucauacuacugugcaggacuaaagaaggugacugagguaaaaggauauacaaagggagggccgggacacgaagaaccaaucccaauggcaaccuauggauggaaucugguaaaacuucacucgggaaaagauguauuuuucaugccacccgaaaaaugcgauacauuauuaugcgacauuggugaaaguucgccaaaccccacuauagaagaagggagaacauuacgaguucuaaaaaugguggaaccguggcuuaggggaaaucaauuuugcauaaaaauuuuaaauccguacaugccgucaguugucgagacuuuggaacaaaugcaaagaaagcaugggggaauguuagugaggaauccucucucuaggaacagcacacacgaaauguauugggucaguugcggcacaggaaauauuguaagugccguuaacaugacaucuagaaugcugcucaacagguucacaauggcacauagaaaaccuacguuugagcgagauguugauuugggcgccggcaccagacauguugcagucgaaccugaaguggccaaccucgauaucaucggacaaagaauugaaaauaucaaaaacgagcauaaaagcacguggcauuaugaugaggauaauccguauaaaacaugggcuuaccacgggucauacgagguaaaaccuucaggaucugcgaguaguaugguuaauggaguuguuagacugcuaacuaagccuugggacguaauacccaugguaacccaaauugcaaugacagacacgaccccauucggacaacagagaguuuucaaagagaaagucgauacccgcaccccuagagcgaaaagggguacuacacaaaucauggaagucacagcgaaguggcucuggggauuucuaucacgcaauaagaagccgagaauaugcacacgggaagaauuuacacguaaagucaggucaaaugcugcuaucggagcagucuucguggacgaaaaucaauggaauagcgccaaagaagccgucgaagaugagagauucugggauuuaguccauagagaacgugaacuacacaaacaaggaaaaugugcuacgugcguauacaacaugauggggaagcgugagaagaaacuuggagaguucggaaaagccaaaggauccagggcaauaugguauauguggcuuggagcuagauuuuuagaguucgaagcacucggauucaugaaugaagaccacugguuuaguagagaaaacucuuugagcggaguggaaggggagggacuacacaaacucggauauauauuaagggauauaaguaaaaucccaggugguaacauguacgcagacgauacugcgggcugggauacgagaauaacagaggacgacuuacaaaacgaagccaaaauuacugauaucauggaaccugagcaugcacugcuugcaaccagcauauucaagcugacuuaucaaaauaaaguaguaagaguccaacgaccagccaaaaauggaacggucauggauguaaucucuagacgagaucagcguggcucgggucaaguagggacauacggccuaaauacguuuacaaacauggagguacaacugauccgccaaauggaguccgaggguauauuccugccuagugaacuagagacuccuaaccucgcggaacgaguacuggauugguuggagaagcauggugcggaaaggcuaaaaaggauggcgauaaguggcgacgacuguguaguaaaaccuauagaugaucgauuugcgaccgccuuaacagcauuaaaugauaugggaaagguuagaaaagauaucccacagugggaaccauccaaaggauggaaugacuggcagcagguaccuuuuuguucucaucauuuucaucagcucauaaugaaagacggccgugagauaguaguaccuugcagaaaccaagaugaguuaguuggacgugcuagaguuagucagggagcgggcuggucgcuacgagagaccgcguguuuaggaaaaucuuaugcucaaauguggcaauugauguauuuucacagaagggaucugagauuggcugccaaugcgauuuguucugcaguacccguagauuggguaccuacaaguagaacaaccuggucuauacacgcgcaucaucaauggaugacuacggaagauauguuaagcguuuggaacagaguuuggauugaagagaaccccuggauggaagacaaaacucacguuagcucuugggaggagguacccuaucucggcaaacgcgaagaucaauggugugguagccuuaucggacuaaccgcaagagcuacuugggcuacgaacauccaagucgcaauaaaucaaguuagacgauuaauuggaaacgaaaauuauuuggauuacaugacgucgaugaagagauucaaaaacgaaagcgauccggagggagcucucugguaa

SEQ ID NO: 21233 - RNA, 9879 nt, Artificial Sequence
  derived and/or modified CDS sequence (opt6) from DENV-1__GU131965__SS-prME
ucugucacaaugcuucuuaugcuucuaccaaccgcauuagcuuuccauuugacgacccguggaggagaaccucauaugauaguauccaaacaagagagaggcaaaucucuccucuucaaaacaagugcuggcguaaauauguguacuuugauugcaauggaccucggggaauugugugaggauacuaugacauauaaauguccacaaauuacugaagcagaacccgacgauguagacuguuggugcaaugcuaccgauacguggguaacuuacggcaccuguucccaaacuggagaacacagaagagauaaacgaucgguugcauuagcaccacaugucggguugggccuugaaacccgaacagaaaccuggaugucaucugaaggggcauggaaacaaauacaaagaguagaaacuuggguacuccgacauccaggguucacgguuauugcguuauuuuuagcacaugccaucggaacaucaaucacgcaaaaaggcauaauauuuauacuacucaugcuuguuaccccauccauggcaaugagaugcguaggaauaggcaauagagacuuuguagaaggccuaaguggagcgacuuggguagauguuguccuagaacacgguuccugugucacaacaauggcuaaaaauaaaccgacauuggauauagaacuccucaaaacagaaguuacaaacccagcgauucuaagaaaauugugcaucgaagcgaaaauuagcaauaccacgaccgacuccaggugcccaacacaaggggaagccacguuaguugaagaacaagacgcaaacuucguaugcagaagaacauuuguugaucgagguuggggaaacggguguggauuauuugggaaaggauccuuguuaaccugugcaaaauuuaaauguguuaccaaauuagaaggaaaaauuguacaauacgagaacuuaaaauauucagucauugucacuguacauacaggcgaccaacaucaggucggcaacgaaacaacugaacacggaacgaucgcaacuauaacaccucaagcuccuacaucggaaauacaguuaacugauuauggugcauuaacguuagacugcaguccgcgcacugggcuugauuuuaaugaaaugguacuucuaacgaugaaagaaaaaucauggcuuguucauaaacaaugguuucuagacuuaccacuuccauggacaagcggugcauccacaucucaggagacauggaaucgacaagaccuauuagucaccuuuaaaacagcucaugccaagaaacaagaaguaguaguuuuaggcucacaagagggggcuaugcacaccgcccuuacaggagccacugaaauucaaaccucuggaaccacuacuaucuuugcuggccaccucaaaugucgacuaaaaauggauaaacucacauugaaagguaccaguuaugugauguguacgggaucauuuaaacuagaaaaagaggucgcagaaacccaacaugggacaguauuaguacaaguaaaauaugaaggaacagaugcgccaugcaaaauuccguuuuccacgcaagacgaaaagggcguuacucaaaacgguagguugauaaccgcgaauccuauaguaacugauaaagagaaaccuguaaacauagaaacagaaccaccauucggugaaucauauauaguaguaggagcuggggagaaagccuuaaaacuuucuugguuuaagaaagguucaucaauaggaaaaauguucgaggcuaccgcaagaggggcacgacguauggcaauauuaggagacaccgcuugggauuuuggaucuaucggaggaguuuuuacaucuguggggaaguuggugcaccaaguauuuggaacugcauauggaguuuuauuuucaggugugucauggacgaugaaaauaggaaucgggauucucuuaacuugguugggguuaaauucaagaaauacaucauuaaguaugacauguauagcaguagguaugguaacgcuguaccuugggguaauggugcaggcugauagcggcugugucauaaauuggaaagguagagaacuuaaauguggaucggggauauucguuacaaacgaaguacacacauggacagaacaauacaaguuucaagcagacucacccaaaagacucucagcagcuauagguaaagcgugggaagaaggaguaugcggaauacggagcgcaacgagacuagagaauaucauguggaaacaaauuuccaaugaguuaaaccauauucuuuuagagaaugauaugaaauuuacaguaguaguaggagaugcaaauggaauuuuagcacaagguaagaaaaugauaagaccucaaccaauggaacauaaauauaguuggaaaucauggggcaaagcaaaaaucaucggggccgauauacaaaauacaacauucauuauagauggaccugauaccccagaauguccagacaaucaaagggcauggaacauuugggaaguugaggauuacggcuucggaauauuuacaacaaacauuugguuaaaguuaagggauucuuacacucaaaugugugaccacagauugaugagcgcggcaaucaaagauagcaaagcgguccaugcggauauggguuacuggauugaauccgaaaagaacgaaacauggaaguuggcacgagcauccuucauagaagucaaaacuuguacuuggccaaaaucucauacccuauggucuaacggcgucuuggaauccgaaaugauaauaccgaaaauuuauggaggacccauaucgcaacacaauuauagaccuggcuauuucacucaaaccgcggguccauggcaccucggaaaacuugaacucgauuucgaccuaugugagggaacaacaguuguuguugaugaacauugugguaaccggggaccaagccuucguacuacaacagcaacugggaaaauaauacacgaaugguguugucggucaugcacacuaccgccacuaagauuuagaggcgaagauggauguugguauggaauggagauacguccuguaaaagaaaaggaggaaaauuuaguucgcaguaugguuucugcaggauccggugagguugacaguuuuagccugggcauucugugcgcaaguauaaugauagaagaagugaugcggagucgguggucgcgaaaaauguuaaugacuggaacgcuagcuguguuccuauugcuaguaaugggucaauuaacauggaaugaccuaauacgauuaugcauaaugguaggagcaaaugcgucagauagaauggguaugggcaccacauaucuugcacuaauggcgaccuuuaagaugcgaccaauguuugccgucggauugcuauuuagacguuuaaccaguagggaggugcuauuauuaacgaucggccugagccuaguugccaguguagaacuucccaacucacuugaagaacuaggugauggacuggcaauggguauaaugaugcuaaaacuauuaacugaguuucaaccacaucaacuuuggacaacccuauuaagccugacauuuaucaaaacaacuuugucccuagauuacgcuuggaagacaacggcuauggccuuaucgaucguuagucuuuuuccacuaugucuaucuacuacaucacagaaaacaacauggcuuccaguccucuuggguucuuucgggugcaaaccacuaacaauguuucuaauaacugaaaacaaaaucuggggucgcaaauccuggccguuaaaugaagggauaauggccauagguauagugagcauccuauuaucaucgcuucuuaaaaaugacguaccacuagcugggccacuaauagcaggagguaugcucauugcguguuacguuauuucagguucaagugccgaucugucuuuagagaaagcggcagaagucaguugggaacaggaagcggagcauucgggaacaagccacaacauccucgucgaaguacaagaugauggaacaaugaaaauuaaagaugaggagcgcgaugauacccuuacaauuuugcuuaaagcaacauuauuagcugucucaggugucuaccccaugaguaucccagccacguuguuuguuugguacuuuuggcagaagaagaaacagagauccgguguauuaugggauacaccaagcccacccgaaguagaacgagcaguguuggacgauggaauuuaccguauauugcaacgggguuuauugggaaggagucaaguagguguagguguauuucaggacggaguauuccauacuauguggcacgugacucguggggccguauuaauguaccaagguaaacggcuagaaccaaguugggccuccguuaaaaaggaucuuauaucauacggugguggauggagguuccaagggucuuggaacacaggugaagaaguacagguaauagcgguagaacccgggaaaaacccuaagaauguacagacaacaccaggaacauucaaaaccccugagggugaaguuggagccauagcacuagacuuuaagccggguaccagcgggaguccaauuguuaaccgggaaggaaaaauuguuggacuauacggaaaugguguuguaaccaccagcggaaccuaugugagugcuauagcgcaagcuaaagcaucacaagaaggaccucuucccgaaauugaagaugagguguucaagaaacgcaauuuaacaauaauggauuuacacccggguucaggaaaaacacgacgcuauuuaccugcaaucguaagggaagcaauaaaaaggaaauuaagaacacuaauuuuagcuccaacacgaguaguugcaagugaaauggccgaagcgcuaaaaggaaugccgauacgauaucaaacaacagcaguaaaaagcgaacauacugggcgggaaauuguagaucuuaugugucaugcaacguuuacgaugagguuacuaagcccuguaagagugccuaauuauaacaugaucauuauggaugaagcccacuuuacugauccagccagcauagcagcaagagguuauauaucuacgaggguugggaugggugaggcagcugccaucuuuaugacagcgaccccgccaggauccgucgaagcguuuccucaauccaaugcaguaauccaggaugaagaacgagacaucccggaaagaagcuggaacuccgguuacgacuggauuacugacuuucccgguaagacaguaugguuuguuccuucuaucaagagcggcaacgacaucgcaaacugucucaggaaaaacgggaaaagggugauacaacugagucgcaaaaccuucgacaccgaguaucagaaaaccaaaaauaaugauugggauuauguaguuacuacggauauaucggagaugggagcuaauuucagggcagaccgagucauagacccgagaaggugucucaagccgguaauauugaaagacgguccggaacguguaauacuagcggguccaaugcccguaacaguugcaagugcagcacaacgacguggaaggauuggacgaaaucagaauaaagaaggcgaucaauacguuuauaugggacaaccccugaauaaugaugaagaucacgcucacuggacagaagcaaagauguuauuggauaacaucaacacccccgagggcaucauaccggcgcucuuugaaccagagcgggaaaaaucagcagcaaucgauggagaauaucgauuacguggugaagcucguaaaacauucgucgaauuaaugagacgaggggaccuuccaguaugguuaucguauaaaguagcuucagagggauuucaguacuccgauagaagaugguguuuugauggagaaagaaauaaucagguuuuggaggaaaacauggauguagagauuuggacaaaagaaggugaaaggaagaaguuaagaccacgaugguuagaugcgagaacauacagugaccccuuagcgcuacgagaauuuaaggaauuugcagcaggaaggagaucgguuuccggugauuuaauacuugaaauagguaaacuaccucaacaucuaacacuccgagcacaaaaugcuuuagacaacuugguuaugcuacacaauucagaacaagguggaaaagcauaucgccaugcaauggaggaacugcccgacacuaucgaaacauuaauguugcuugcauuaauugcugucuuaacaggugggguuacauuauucuuuuuauccggcaaagggcuggguaaaacuagcauugggcuuuuaugcgucaccgcaucuagugcauuauuguggauggcaucuguagaaccucacuggauugcggccaguauaauauuagaguucuuucuuaugguacugcuaauaccugaacccgaucgacaacgcaccccgcaggauaaucaguuagcguaugugguuauaggucuauuauucaugauucugacagucgcagcaaaugaaaugggacuacuagaaacaacuaagaaagaucuuggaaucgggcauguugcugcggaaaaucaucaacaugcuaccauguuagauguggauuuacguccugcuagcgcauggacucuauacgcaguugcaacuacaguaauaacgccgaugaugcgacauaccaucgaaaacaccacagcaaacauuagccucacagcgauagcgaaccaagcagccauccuuauggguuuagacaagggauggcccauaaguaagauggacauaggaguaccgcuucuagcucuaggauguuacucgcagguaaacccucuaacauuaacugcugcaguguuaaugcuaguagcccauuacgccauaauaggaccugggcuccaggccaaggccacccgagaggcacaaaaacgcacggcugcaggaauuaugaagaacccaacuguggacgggauuguggcaauagaucuugacccuguaguuuacgaugcaaaguuugaaaaacagcucgggcaaauaauguuacuaauauuaugcacgagccaaauauuauuaaugagaacgacaugggcacuaugugaaucaauuacguuagccacaggaccgcuuacuacucuaugggaaggaaguccaggcaaauuuuggaacacaacgauagccguaagcauggcgaauauauuuagggguucuuacuuagcaggggccggucuggcguuuagucuaaugaaaucgcuaggggguggacgcagagguacgggagcccagggagaaacucuaggggagaaauggaaacgccaacucaaccaacuauccaaaucggaauuuaacacguauaagcguuccggcauaauggaagucgauagaucagaagcaaaagagggccucaaacguggagagacgacaaaacaugccguuucacggggaacugccaaacuucguugguuuguugaaagaaaucucguaaaaccagaaggaaaagugauugacuuaggaugcggucgagggggauggucauauuacugugccgggcuaaagaaagucaccgagguaaagggguauacuaaagguggcccaggccacgaggaaccgauaccaauggcaacauauggauggaacuuggucaaacuacauagcgguaaagauguuuucuuuaugcccccagaaaaaugugacacauuacuuugcgacaucggugaauccucgccaaauccaacaauagaggaaggucguacguuaagaguuuuaaaaaugguggaaccaugguugagaggaaaccaguucugcaucaagauucugaacccuuauaugccuucugucguagaaacccuugaacagaugcaaagaaaacacggagguaugcuaguuagaaauccauuaagcagaaacucuacucacgaaauguauuggguauccugugguaccggaaauauaguuucggccguaaacaugacaucgagaaugcuucuaaaccgcuuuacuauggcccacagaaaaccuacauacgaaagagacguggaucuaggagcagguaccagacacguagcaguggaaccagaggucgcaaaccucgauaucaucgggcaacgaauugaaaacauuaaaaaugaacacaaaagcacauggcauuacgaugaagauaauccauacaaaacgugggcuuaucaugggucauaugaaguuaaaccauccggauccgcuuccaguauggucaaugggguaguaaggcuacuaacgaaaccuugggauguaaucccgauggucacucagauugccaugacggauacaacaccauucggacagcagaggguuuuuaaagaaaagguugacacacgaacaccaagagcuaaaaggggaacaacacaaaucauggaaguuacugcaaaauggcucugggguuuccuaucaagaaauaagaaacccaggauuugcacuagagaagaguucaccagaaagguaagaucaaacgcugcgauaggugccguuuucguagaugaaaaucaauggaacagcgccaaggaagcgguagaagaugagcgauucugggacuuagugcaccgugaaagagaauuacacaaacaggguaaaugcgccacuuguguauauaacaugauggguaaaagagagaagaaauuaggagaguuugguaaagcaaaggguucaagggcgaucugguauauguggcucggagcucgcuuccuugaauuugaggcauugggguucaugaaugaagaccauugguuuagcagagagaauagucucucagguguugaaggggagggccuacauaaacucggcuacauauuacgagauaucagcaagauaccuggcgggaauauguaugcggacgauacagcggggugggacacgcgaauuacggaagacgaucuccaaaaugaggcaaaaauaacagagaucauggagccagaacacgcauuauuagccacgaguauauuuaaguugacauaucagaauaaaguaguuagaguacagaggccagccaaaaaugggacagugauggauguuauaucuagaagagaucaaagaggguccggacaaguugguaccuacggucuaaauacguuuacuaauauggaaguacaauuaauacgccaaauggaaagcgaaggcauauuucuaccaucugaauuggagacgccaaacuuagccgagaggguacuagacugguuagaaaaacacggggccgaacgacuaaaaagaauggcaauaucaggagaugacuguguuguaaaaccgauagaugauagguuugcuacugcccuuacagccuuaaacgauaugggcaagguacgaaaagauauaccucagugggaaccaucgaaaggauggaaugacuggcagcaaguuccguucuguucacaucauuuccaccagcucauaaugaaagauggaagagaaaucguagugccaugccgcaaccaagaugaacucgugggacgagcacgcguaucucaaggcgcaggauggagccuaagagaaaccgcaugcuuaggaaaaucauacgcucaaauguggcaacuaauguacuuucaucggagggaccuuaggcuagcagcuaacgcuauuugcucagccguuccaguagauugggugccaacuucaagaacaacauggaguauucaugcucaccaccaauggaugacuacagaagauaugcuaucaguuuggaaucgaguauggauugaggaaaacccauggauggaagacaaaacccacgugagcucaugggaagagguacccuaccucgggaaacgugaagaucaauggugugguagccuaauaggguuaacagcucgagcgacaugggcaacaaauauccaaguugcaauuaaucagguuagaagacuaauagguaaugagaauuaccuugauuauaugaccagcaugaaaagauuuaaaaaugaauccgaucccgaaggggcccugugguga

SEQ ID NO: 21234 - RNA, 9879 nt, Artificial Sequence
  derived and/or modified CDS sequence (opt6) from DENV-1__GU131966__SS-prME
ucuguuacaauguuauugauguuacucccgacagcacuugcauuucaucugacaacacgcgggggagagccacauaugauagucaguaaacaagaaagaggaaaaucccuccucuuuaaaaccucggccgguguuaacauguguaccuuaauugcaauggaccucggugaguuaugugaagacacuaugacuuacaaauguccgcaaauuacagaagcagaaccagacgauguugauuguugguguaaugcgacugauacauggguaacauacggaacauguagccaaacgggagagcauagacgcgacaaaagaucuguugcgcucgcgccucauguuggauuagggcuugaaacucguacugagacauggaugagcucugaaggugcguggaaacagauacagagaguugaaacgugggcauugcgucauccaggauuuacuguaauugcuuuguuucuugcacaugcaauagguacuagcauaacccagaaaggaauuauauuuauucuuuugaugcucgugacuccuaguauggcuaugcgcuguguugggauuggaaacagagacuuuguagaggggcuaucuggagcgacauggguggacguaguacuggaacaugguucuugcguuacgacuauggccaaaaauaaacccacccuugacauugagcuccuaaaaacggaaguaaccaacccagcgauucugcgaaaauuaugcauagaggccaaaauaagcaacacaacaacagacagucguugcccuacucaaggagaagccacacugguagaagaacaagaugcaaacuucgugugccgaagaacauuuguggauagaggauggggaaauggcuguggacucuucgggaaaggaaguuuacucacuugugcgaaauucaaaugcguaacaaaacuugagggcaaaauaguucaauacgaaaaucuuaaauauagcguaauaguuaccguacauacaggugaucaacaccagguuggcaaugagacaacagagcaugguacuauagcuacaauuacaccgcaggccccgacaucugaaauucaauugaccgacuauggggcuuugacauuggauuguaguccuagaaccggucuugauuuuaaugaaaugguacucuugacaaugaaagaaaaaucguggcuuguacacaaacaaugguuucuagaucuuccucucccauggacaucaggggcuucaacaucucaagaaacauggaauagacaagacuuauuaguaaccuuuaaaacggcucaugccaagaaacaagaaguaguuguauuaggcagccaagaaggugcuaugcauacggcuuuaacaggugcuacagagauucagacaucaggaacaacaacuauauuugcaggucacuuaaaauguagacuaaaaauggauaaauugacuuugaaggguaccucauauguaaugugcaccgguuccuuuaaacuagaaaaagaagucgcagaaacacagcauggaacuguacugguacaagucaaauaugaaggcacagaugcaccauguaaaauuccuuuuuccacccaagacgaaaagggugugacacaaaacggcagacuuaucacagcuaauccaaucguuacagacaaagaaaaaccuguaaauauagagaccgaacccccguuuggugagucauacaucguuguaggggcgggugagaaggcuuuaaaauuaaguugguuuaagaaagguagcucaauugguaagauguuugaggcaacagcuaggggugcacggcgaauggcuauacucggggauacagcgugggauuucggcaguauuggaggagucuuuaccucaguugggaagcucgugcaucaaguauuugggacagccuacggagucuuauuuucgggagugaguuggaccaugaagaucggaauagguauacuacugacuugguugggauuaaauucacgaagcacuucgcuaucuaugacaugcauagccguagguaugguuacacuauaucuagguguuaugguacaagcagauaguggaugugucauuaauuggaaaggucgcgagcuuaagugcggauccggcauuuuuguuacuaacgaaguacauacuuggaccgaacaauauaaauuccaggcagacaguccgaagcgucucucggcagcaaucggcaaggcuugggaagaaggaguaugcgguauaagaagcgcuacaagauuagagaauauaauguggaagcaaaucucaaacgaauuaaaucacauauuacuggaaaaugauaugaaauuuacaguuguaguuggugacgcgaauggaauauuagcacaagggaagaaaaugauacggccccaaccuauggaacacaaguacaguuggaaaucguggggaaaagcaaagauaauaggagcugauauucaaaacacaacuuuuauuauagauggccccgacacgcccgagugccccgauaaccaaagagcguggaacaucugggaaguagaagacuauggauuuggcauuuuuacaacuaacauauggcuaaaguugagagauaguuauacacaaaugugcgaucauagacuaaugucagcugccaucaaggauaguaaggcagugcacgcagauaugggauauuggauagaaucagagaagaaugaaacuuggaaauuagcgagagcgucauucauugaaguuaaaacauguacuuggccgaaaucacacacacuauggaguaaugggguacuagaaagcgagaugauaauaccaaagaucuauggaggaccuauaagucaacacaauuacagaccgggauacuucacucaaacggcaggaccguggcacuuagguaaauuagagcuugacuuugaccuaugcgagggaacgacaguugugguugacgaacauuguggcaacaggggcccaagucuacgaacuacgacaguuacagguaaaauuauucacgaguggugcuguagguccuguacacuaccucccuuacgauuuagaggagaagacggaugcugguauggcauggagauaaggccuguaaaagaaaaggaggaaaauuugguaaggagcaugguaucugcggguagcggugaaguugacucguuuucauuagguauauugugugccucuauuaugaucgaagaaguuaugcgaaguagguggagucguaaaaugcuuaugacuggaacucuagcuguuuuccuccuguuaauaaugggccaacuuacguggaaugauuugauaagacuaugcauaaugguaggagcgaaugccucggauagaauggggaugggaacaacauaucuggcacuaauggcaacauuuaaaaugcgcccaauguucgcagucggucugcuauuuagaaggcucacaaguagagaaguauuacuccuaaccauuggccucucucuuguggcaucgguggaacugccuaauucauuagaggaacuuggugaugggcuugcaaugggaaucaugaugcuaaaacuccuuacggaguuucaaccacaccaauuauggaccacacuguuaagucuaacauuuaucaagacuacauuaaguuuagauuaugcuuggaaaacuaccgcuauggcuuuaucuauagucucacucuuuccauuaugucucaguacuacuucucagaaaacaacauggcuaccaguucuguuaggcaguuucggguguaaaccauugacuauguuucuaaucacggaaaacaaaauaugggggcguaaguccuggccgcuaaaugaaggaaucauggcuauagguauagucucuauacuauuaucaagucuauuaaagaaugacgucccauuagcgggaccacuaauagcaggcggcauguuaauagcuuguuaugucauaaguggaucgucagcagaucuaagucuggaaaaagcagcagaagugucuugggaacaggaagcagagcauuccggaacaagccauaauauauuaguggaaguccaagacgaugggaccaugaaaauaaaagaugaggaacgggaugauacauuaacuauauuauuaaaagccacuuuacucgcaguuaguggaguauauccuaugucaauccccgcaacccuuuucguaugguauuuuuggcaaaagaagaaacaaaggagcggaguacuaugggacacucccucgccacccgaaguagaaagagcaguccuagacgaugggauuuaucguauacuccaaagagggcuccuagguaggucucaaguuggagucggcguauuucaagacggaguguuucauacaauguggcauguaacacgaggagccguguuaauguaucaaggaaaacguuuggaacccuccugggccagcgucaaaaaggaccuaauaucguacggcgggggauggcguuuccaaggaucuuggaacacuggugaagaaguacaagucauugccgucgaaccaggcaaaaaucccaaaaauguccagacaacgccaggaacauucaaaacaccagagggagaaguuggagcgauugcguuggacuuuaaaccggguacgucaggaucaccgauuguaaaucgggaaggaaagauaguagggcucuacggaaauggcguagugacaaccucaggaacauaugugagcgcgauagcgcaagcaaaagcgagucaagagggaccucuuccggaaauagaggaugaaguuuuuaagaaacgcaaucuaacgauuauggaccuucauccaggaucgggaaagacaagaagguaucuaccagcaauagugcgggaagcgauaaaacgaaaacuucgcacguuaauauuagccccaacgagagugguggcaucugagauggcagaggcucuaaaaggaaugccuauccgauaucaaacuaccgcgguuaaaagcgaacacacaggaagagaaauuguugaccuuaugugccaugccacauucacuaugagauuauuaagcccaguacguguacccaauuauaacaugauaaucauggaugaagcucauuuuacugacccggccaguaucgccgcaagaggauauauaaguacgagagucgggaugggugaggccgcagcaauauuuaugacugcuacaccaccaggaagugucgaagccuuuccacaauccaacgcagugauacaagacgaggaaagggauauaccagaaagaucuuggaauagcggguacgauuggauuacggacuuuccagguaaaaccguaugguucguucccagcaucaaaagugggaacgauauugccaauugccuuaggaagaauggaaagagaguaauccaacugucccggaagacguucgauacagaguaucagaaaaccaagaacaacgauugggacuacguaguaaccacagacauaucagaaaugggggcaaacuucagagccgaccggguuaucgauccaagacguugucuuaaaccaguaauucucaaggacgguccugaacgaguaauccucgcaggucccaugcccguuacgguagcuucggcagcacaacggaggggaagaauaggccguaaccagaacaaagaaggagaucaauacgucuauaugggacaaccgcuuaauaacgaugaagaucaugcacauuggaccgaagcuaagauguuauuagacaauaucaauacaccugaaggaauuauuccugccuuauuugaacccgaaagggagaaaucugcagcaauagauggcgaguauagguugagaggagaggcccgaaaaacguucguagaacugaugcgucguggagacuuaccuguauggcuuaguuacaaagucgcuucagaagguuuucaguauucagauagaagauggugcuucgacggugaaagaaacaaucaaguacuagaggagaauauggauguagaaauauggacaaaagaaggugaacgaaagaaauuaagaccacgauggcuggacgcuaggacuuacucggacccucuagccuugcgagaauuuaaagaauuugcagcgggaaggagaagugugucaggggaccucauuuuggaaauaggcaaacuaccacagcaucugacauugagagcucaaaacgcucuugacaaucuuguuaugcuccauaauagugaacaggguggaaaggcuuauagacacgcaauggaagaacuaccagauaccauugagacuuuaaugcuucuagcacuuauagcuguguuaacagguggcguuacauuauuuuuccuaucugguaaaggacuaggaaaaacaaguaucggauuacuauguguaacagcuucuucagcccuuuuguggauggcaucuguagaaccacauuggaucgcagcaucuauuauuuuggaguucuuucuaaugguauuguuaauaccagaaccagacagacagcgaacaccucaagacaaccaacuggcguaugucguaaucggacuccuuuuuaugauauugacuguugcugcaaaugaaaugggauuauuagaaacaacaaagaaggauuuaggaauuggucauguugcagcggaaaaucaucaacaugcuaccaugcuagacgucgaucuacguccagcaucagcuuggacucuuuacgcgguggcuaccaccguuauaacaccgaugaugcgccauacuauugaaaauacaacagcgaacauuucucugaccgcaauagcuaaucaagcagcuauacugaugggauuggacaaaggguggcccauaaguaaaauggacauuggcguuccuuuguuagcacugggaugcuauagucaagugaacccucuuacguuaacagcggcaguuuuaaugcugguggcgcacuaugcaaucauugggccgggguuacaagcgaaggcaacucgcgaagcacagaaaagaacagcggccggaaucaugaaaaaccccacaguagauggaauaguugccaucgauuuagacccaguuguauaugacgcgaaauuugaaaaacagcuaggccaaauaaugcuacuaauauuaugcacuucacaaauuuugcugaugcgaacgacaugggcauuaugcgaaucgauaacacuugcuacagggccacugacaacacucugggaagguagcccaggaaaauuuuggaauacgaccauugcaguaucaauggcuaauauauuuagagggucauaccuugcuggagcuggacucgccuucagcuugaugaagucacugggagguggaagacgaggaacuggggcacaaggagaaacccugggagaaaaauggaaaagacaacuaaaucaacuaucaaaaagugaguucaacacguacagaagaagcgguauaauggaaguagacagaagugaagcuaaagaaggucucaagagaggagaaacaacuaagcaugcugucucacguggaaccgcaaaauuacgaugguucguggagcgaaaccuagugaaaccagaagggaaaguaauugauuuagguuguggucgagguggauggucauacuacugcgcuggccuaaagaaagugacugaaguaaaagguuauaccaaagggggacccgggcacgaagaaccgauaccuauggcgacauacggauggaacuuggucaaguuacacagcgguaaagauguauuuuucaugccaccugagaagugcgauacccuauuaugcgacauaggcgaaagcucaccaaaucccaccauugaggaaggucggacuuugagaguccuuaaaaugguugagccgugguuaagaggaaaucaauuuugcauaaaaauuuuaaauccuuauaugcccagugugguagaaaccuuagaacaaaugcaacgcaagcauggcggaauguuaguucggaauccacuaagccgcaauaguacucacgagauguauugggucuccugugguacggggaauauuguuagugcaguuaauaugacuucccguauguuacuaaaucguuuuaccauggcacaucguaagccaacguucgagagggaugucgaucuuggagccggcacucgacacguagcgguagagcccgaaguggcgaaucuagauaucauaggacaacgcauugaaaauaucaaaaaugaacauaaaucaacguggcauuaugaugaagauaacccauacaaaacaugggcauaucauggcagcuaugaaguaaaaccaucaggaagugcuaguucaaugguaaauggggucguccguuuguuaaccaaaccuugggaugucauaccaaugguuacccaaauagcaaugaccgauacuacccccuuuggacaacaacggguauucaaggaaaaaguagauacaaggaccccucgggcaaaacguggaacaacccaaauaauggaaguuacugcuaaauggcuaugggguuuucuguccagaaauaaaaagccucgaauauguacaagagaagaauuuacaaggaagguucguucgaacgcggcaaucggcgcuguuuuuguagaugagaaccaauggaacucagcgaaagaagccguagaagaugaacgcuucugggauuuaguacaccgagaacgugaauugcauaaacaaggaaaaugcgcaacaugcguauauaauaugaugggaaaaagagaaaagaaauugggagaauuuggcaaagcaaaaggaucacgcgcgauuugguacaugugguugggugcuagauuccuugaguucgaagcauuggguuuuaugaaugaagaucauugguucagucgagagaauagcuugucaggaguugagggugagggucuccauaaacuaggcuacauacuucgagacauaucuaaaauaccagguggaaauauguaugcugaugacacagcagguugggacacacguauaacagaagaugauuugcagaacgaggcaaaaauaaccgauauaauggagccagaacaugcacuuuuagccacaucaauauuuaaacucacauaccaaaacaaaguaguacgcguacagcgaccagcuaagaauggcacaguuauggauguaauuuccagacgcgaccaaaggggcucuggccaaguagguacguacgguuuaaauaccuucacgaacauggaggugcagcuaauaaggcagauggaaagugaagguauauuuuuaccaagcgaguuagaaacuccuaauuuggcagaaagggugcuugacugguuagaaaaacacggagcagaacgacuaaaacgaauggcaauaagcggagaugauuguguugugaaaccuauugacgacagauuugcaacggcauuaacggcgcugaacgauauggguaaaguuagaaaagauaucccacaaugggagccgaguaaaggcuggaaugacuggcaacaaguaccuuucugcagccaucauuuccaucagcugauuaugaaggauggaagagagauuguuguacccugccggaaccaagaugaacuuguaggcagagcucgcguaucgcaaggcgcagguuggucguuacgggaaacugccugccuaggaaaaaguuacgcacaaauguggcaguugauguauuuucauagaagagauuuaagauuagccgcgaaugcuauaugcagugcaguaccugucgacuggguaccuacgucaagaacgacuugguccauacaugcucaucaucaauggaugacaacggaagacaugcuaaguguuuggaauaggguauggauugaagaaaauccauggauggaagauaaaacucauguuagcucgugggaggaagucccauaccuagguaaacgggaagaucaauggugcggcagccuaauaggacuaacagcucgugcgacuugggcaacaaacauacagguagcgauaaaucaggugcgccgacuaauaggcaacgaaaauuauuuggauuauaugacaucgaugaagagguuuaaaaacgagagcgacccggagggagccuuaugguaa

SEQ ID NO: 21235 - RNA, 9879 nt, Artificial Sequence
  derived and/or modified CDS sequence (opt6) from DENV-1__GQ868501__SS-prME
ucgguaacuaugcuuuuaauguugcuaccaacugcauuagcguuccaccugacgacaagagguggagaaccacacaugauaguaucgaaacaagaaagaggaaaaucgcuacuauuuaaaacaucugcugggguuaauaugugcacuuuaaucgcuauggacuuaggcgaauuaugcgaagauacuaugacauauaaauguccucaaauaaccgaggcggaaccagaugacguggacugcuggugcaacgcgacagacacuuggguaacguacggaacauguagccaaacuggugaacacagaagagauaaacguucggucgcacuagcaccacaugucggccugggucucgaaacuaggacagaaacauggaugaguagugagggcgcauggaaacaaauacaacgaguagaaacuugggcacuucgucacccagguuucacaguuauagcacuguuuuuagcucaugcuauaggaacaucaaucacucaaaaagguauaauauuuauuuuauugaugcuaguuacgcccucuauggcgaugcguuguguugguaucggaaauagagauuuugucgagggcuuaucaggagcgacauggguagaugucguguuggaacacggaaguugcguaacaacgauggccaaaaauaaaccuacacucgauaucgagcuacuuaaaaccgaaguaacaaauccagcaaucuugcguaaacuuuguauugaagcaaaaauuucaaauaccacaacugauucaaggugccccacucaaggcgaagcaaccuuaguagaagaacaagacgcaaacuucguguguagacgaacuuuuguagacagagguugggggaauggaugcggcuuguuuggaaaaggcagccuauuaacaugcgcaaaauuuaaauguguaacgaaauuagaagggaaaaucguacaauacgagaauuuaaaauacagcgucaucguuaccguacauacgggugaucaacaccaggucggaaaugaaaccaccgaacauggaacaaucgcuacaaucacaccucaagcacccacgucugaaauacaacuaaccgauuauggagcauuaacucuagacugcaguccuagaacaggucuagauuuuaacgaaaugguauuauugacuaugaaagagaaaaguuggcuuguacacaaacaaugguuucuagauuuacccuugcccuggacaaguggcgcaucuacaucucaagagacuuggaauagacaggaucuauuaguaaccuuuaaaaccgcucaugcuaagaaacaagaagucguaguacuaggaagccaagaaggagccaugcauaccgcuuugacaggcgcuacggaaauacaaacgaguggaacuacuacgauauucgcugggcaucuaaaaugcagguuaaaaauggacaaauuaacgcuaaaagguacaucauacguaaugugcaccgguucauucaaauuagagaaagaaguagcugagacgcaacauggaaccguguuggugcaaguuaaauaugaaggaacagaugcucccuguaaaauuccauucucuacacaggacgaaaaaggagucacucaaaaugggcggcugauuacggcaaacccaaucgucacugauaaagagaaaccaguaaacauagaaaccgaacccccguuuggugaaucauauauaguagugggugcaggagaaaaagcauuaaaauuaucuugguuuaagaaaggaaguucuauaggcaaaauguuugaagcgacugcacgaggugcccgaagaauggcuauuuuaggcgacaccgcaugggauuucggcucgauaggaggggucuucacaagugucggcaaauuaguccaccagguauucggaacagcauacggaguauuguucuccgggguauccuggacuaugaaaauuggaaucgguauuuuauuaaccugguuaggauugaauaguagaucaacuucccuuucgaugacaugcauagcggucgggauggugacgcuauacuuaggaguaaugguacaagcagauucgggaugcguaauaaauuggaaaggucgagaauuaaaaugcggaaguggaaucuuugucacaaaugaagugcauacauggacagaacaauauaaauuucaagcagacagucccaaaagauugagugcugcuauaggaaaggcuugggaagaaggcguauguggcauccguagcgccacaagauuggagaauauaauguggaaacaaauaaguaaugaguugaaucacauuuugcucgaaaaugauaugaaguucacagucguuguaggagacgcaaauggaauacuggcucaagguaagaaaaugauaagaccucagccuauggagcauaaauacaguuggaaaaguuggggcaaagccaaaaucauaggagcagauauacagaauacuacauucauuaucgacgggcccgauacuccugaaugcccagauaaucaacgugcguggaauauaugggagguggaggauuaugguuucggaauauucacgacuaacauauggcuuaagcuaagagauagcuauacacaaaugugcgaccacagacucaugucggcagcuauaaaagacuccaaagcgguccaugcagacaugggauacuggauagaaagugaaaagaaugaaacauggaaguuagcuagggccucguuuauugaagugaagacuuguacuuggccuaaaagccacacgcuguggucaaauggcgugcucgaauccgaaaugaucauacccaaaaucuauggaggccccauaagccaacauaacuaccguccgggguacuuuacacaaacugcggggccuuggcaucuuggcaaguuagaacuggacuuugacuuaugcgaagggacaacaguuguaguggaugaacauuguggaaaucgagguccaucacuaagaacaacaacuguuacaggaaaaauaauacaugaauggugcuguagaaguuguacacuuccaccucuaagauuucgaggggaggauggaugcugguacggcauggaaaucagaccaguuaaagaaaaggaggaaaauuuagucagguccauggucagcgcuggauccggagaaguugauucguuuucuuuagguauucucugugcgaguaucaugauagaagaaguuaugcgaagcagauggagcaggaaaauguuaaugaccggaaccuuagcaguauuucuacuacuaauuaugggccaauuaaccuggaacgaccuaauacgcuuaugcauaauggucggcgcaaacgcaagcgauaggaugggaaugggaacgacguacuuagcauuaauggcaacguuuaaaaugcgucccauguucgcaguagggcucuuguuccgccgucuaacaagucgugagguacuguugcuaacuauaggacucucacucguugcaagcguggaacuuccgaacucauuggaagaauuaggugaugguuuagccaugggaauaaugauguuaaaacuuuugacagaguuucagccacaccaacuauggaccacgcuucugaguuuaacuuuuauaaaaacaacguugucacuugacuacgccuggaaaaccacagccauggccuuaucaauaguaucucuauucccuuugugcuuaaguacaacaucucagaaaacaacauggcuaccuguccuauuaggaucuuucggauguaaaccacugacuauguuucuaauaaccgaaaaucagaucugggggcgcaagucuuggccgcuaaacgaaggaaucauggcgauaggaauaguuaguauccuguuaaguagccuguuaaagaacgacguaccacuagcaggaccacuaauugccggcggaaugcuaauagcaugcuacgugauaucuggaucuucugcagaccugucgcuagagaaaacugcagaaguaaguugggaacaagaggcugaacacucgggcacuagccacaauauccuaguagagguacaggacgauggaaccaugaagauuaaggacgaagaaagagacgauacauuaacuauccuucugaaagcaacguuacuggccgucucugguguguacccaaugucuauuccagcgaccuuauuuguaugguacuuuuggcagaagaagaaacagagauccggagucuuaugggauacacccucgccaccagaaguugaacgagcaguacuagaugauggcauauaucguauacuacaacgaggccuauugggucgaucucaagucggaguaggaguauuucaggaugguguauuucacacuauguggcacguuacaagaggagccgucuuaauguaccaaggaaaacguuuagagccgagcugggcaucuguaaagaaagauuuaauauccuaugggggcgguuggcguuuucaaggaaguuggaacaccggagaggaggugcaaguaaucgcgguugaaccgggcaaaaacccuaagaacguacaaacaacaccaggaaccuuuaagacaccagaaggugaaguaggcgcuauagcacuggauuucaagccugguacuucagguaguccaauagugaacagggaaggaaaaaucgucggacuauaugguaacgggguuguuacuacuucggguaccuaugucucugcaauugcacaagcuaaagccagucaagaagguccucuaccugaaauagaagaugaagucuucaaaaagaggaaucuuaccauuauggauuuacacccgggauccggaaaaacacgcagauaccuuccagcuauugugcgagaagccauaaagagaaaacuuagaacucuuauacuugccccuacacgagugguagcaucggaaauggcggaagcucuuaaagguaugccgauccgauaccagacuacagcagugaaaucugaacauacaggacgagaaauuguugaucuaaugugccacgcuacuuucacaaugagauuauuaagcccagucagaguaccaaauuauaauaugauuauuauggacgaagcgcauuuuaccgacccagcaucaauugcugcacgaggauauauaucaacccgaguaggaaugggagaagcagcugcgauauucaugacugcuacuccuccugguuccguggaagcauuuccacaaaguaaugccguuauucaggacgaagaacgcgacaucccugaacguucauggaacucagguuaugauuggauaacagauuucccuggcaagacaguaugguuuguaccauccauaaaaaguggcaacgauauugcaaacugcuugcgcaagaaugggaagcgcguuauacagcugucuagaaaaacuuuugacacugaauaucagaaaaccaaaaacaacgauugggacuacguugucacaacagauaucucggaaaugggagcaaauuuccgagcagauagagucauugacccgaggagauguuuaaaacccguuauucuuaaggauggaccagaacgaguaauauuagcuggacccaugccaguaacuguagcuagugcggcccagcgaagaggacgcauugggagaaaucaaaauaaagagggugaucaauacguguauaugggacaaccccuuaacaaugaugaagaucacgcgcauuggaccgaggccaagauguuguuggauaacauaaacacuccggaagguauaauaccagcccuuuuugagccugagagggaaaaaucugcugcgauagauggagaauauagauuaagaggagaagcccgaaaaacguucguugaacugaugcgacgaggugauuuaccaguuugguuaaguuacaaaguggccucagaaggauuucaauacagugauagacguuggugcuucgauggagaacguaacaaucagguacucgaagagaauauggacguagaaauauggaccaaagaaggugaacgcaagaaauuaagacccaggugguuagaugcgcguaccuacagugauccguuagcacuucgugaguucaaagaauuugcagccggccgaagaucagucaguggagaccuuauauuagaaauaggaaaacuaccgcaacauuugacguuaagagcacaaaacgccuuagacaaucuaguaauguuacauaauuccgaacaagggggaaaagcauauagacacgcgauggaagaacuuccugacaccauagaaacauuaaugcuuuuagccuuaaucgcgguguugacugggggaguuacuuuauucuuucuaaguggaaagggguuaggaaaaacgucuauugguuuacucugcguaacugccucgucagcacuacuuuggauggccaguguagaaccacacuggauagcagcuagcaucaucuuggaguucuuccugaugguucuucuaauaccagaaccagacaggcagaggacaccccaagauaaccaguuagcuuauguuguaaucggacuuuuauucaugauucuuacugucgcagcuaacgaaaugggccucuuagagacuaccaagaaagacuugggcauaggccacguggcugccgaaaaucaccagcaugcuacaauguuagacguggacuuacguccagcgagugcauggacacuguaugccguagcaacuacugucauuacuccuaugaugagacacacgauugaaaacacaacggcuaacauuucauugacagccaucgcgaaucaggcagcgauauuaaugggauuagauaaaggauggcccauuucuaagauggauauaggaguuccuuuauuagcacugggguguuauucacaagucaauccccuuacacuaacagcagcuguauuaaugcuuguagcccauuaugcgauuaucggaccuggacuacaagcuaaggcuaccagggaggcacaaaagcguacggcugcgggaauaaugaagaacccgacuguggauggaauaguggcuauagacuuagaucccgucguuuaugacgcuaaauuugaaaaacaacuuggacaaauuauguuacucauccuuuguacaucccagauauugcuuaugagaacaacgugggcccuaugcgaauccauuacguuagcaacuggaccgcugacuacauuaugggagggcucacccggaaaauuuuggaacaccacaauugcaguuagcauggcaaacauauuccggggaaguuaccucgcaggagcaggauuagcguuuucacuaaugaaaucuuuagggggcggccgacgagguacuggagcacaaggagagacuuugggugaaaaauggaaacgacaacuuaaucaguuaaguaagucagaauuuaacacauauaaaagaagcggaaucauggaagucgauagaucugaggcuaaagagggguuaaaaagaggugaaacaacuaaacacgccguuuccagaggaacugcuaaauugcgaugguucguggaacgaaaccucguaaaacccgaaggaaaaguuauagauuugggcugugggagaggcgggugguccuauuauugugcaggacuuaaaaagguaacugaagugaaagguuauacgaaaggugguccugggcaugaagaaccuauacucauggcgacauauggcuggaaccuuguugaauuacauucagggaaggauguuuucuuuaugccucccgaaaaaugugauacacuauuaugcgauauaggcgaauccaguccaaaccccacuaucgaggaagggagaaccuuaagagucuuaaaaaugguggagcccugguuaaggggaaaucaauuuuguauuaagauccuaaauccguauaugcccagcguagucgaaaccuuagaacagaugcaacguaaacauggaggaaugcucguuaggaauccucuaagcaggaacucgacacacgaaauguacuggguaucaugugggaccggaaacauaguaucugcagucaauaugaccaguagaauguuauuaaaucgguuuacaauggcucaccgaaaacccacguuugagcgagauguugacuuaggggcaggcacaaggcauguagccguagaacccgaaguagcgaacuuagacauaauaggacaaaggaucgagaauaucaagaacgagcauaaaaguacguggcauuaugaugaggauaauccauauaagacuugggccuaucauggaagcuacgaaguaaaaccuagcggaagugcaucuaguaugguuaauggugucgucagacuccuaacaaaaccaugggaugucauaccuauggucacacaaauagcaaugaccgacaccaccccauucggccaacaacggguauuuaaagaaaaaguggacaccagaacaccuagggcuaagaggggcacgacgcaaauaauggaggugacugcaaaauggcucuggggauuuuugaguagaaauaagaaacccagaaucugcacacgggaagaauuuacacgaaaaguuagaagcaaugccgccauuggagccguuuuugucgaugagaaucaguggaacuccgcuaaagaagccguagaagaugaacguuuuugggaccucguucauagagaacgugaguuacacaagcaagguaaaugcgcaacuugcguguacaauaugaugggcaagcgcgagaagaaacuuggugaauuuggaaaagcaaaaggcaguagagcaauaugguauaugugguugggggccagauuccuggaauuugaagcccuaggauuuaugaaugaagaucauugguuuuccagagaaaauucgcuuagcggaguagagggagaaggacuacacaaacuaggauauauccugagagacaucaguaaaauccccggcgggaacauguaugcugaugauaccgcagggugggacacccgcaucacugaagacgacuuacagaaugaagcaaagauaacggacauaauggaaccagaacacgcacuucucgcuacauccaucuuuaaacugacauaccagaauaaaguggugcgaguacaaagacccgccaaaaauggcacaguuauggauguuauuaguagacgagaccagcgaggaucaggucaaguugguacguacggacuaaacacguucaccaacauggagguacaauuaauuaggcaaauggaaucugaggggauuuucuuaccaucagaauuggaaacuccaaacuuagccgaaagaguacucgauuggcuugaaaaacauggagcggaacguuugaaaagaauggcuauuaguggagaugacuguguaguaaaaccaauagacgaucgguucgcaacagcucuuacagcguugaaugauaugggaaaagucagaaaagauauaccacagugggaaccaucuaagggauggaaugauuggcagcaaguucccuucuguagucaucauuuucaccaguugauaaugaaggauggacgagaaauaguaguaccaugccguaaccaggaugaguuaguagggcgagcacggguaucgcaaggagcuggauggucacugcgagaaacggcaugucugggaaagagcuaugcacagauguggcaacuaauguacuuucacagacgagacuugagguuggcggcaaaugcuaucuguucggcaguuccaguugauugggucccgacgaguagaacaacuuggaguauacaugcucaucaccaauggaugaccacugaagauauguugucaguguggaaucggguguggauagaagaaaacccauggauggaggauaaaacucaugugucaagcugggaggaaguucccuaucuggggaagcgagaagaccaauggugugggucguugaucgguuugacagcgagagcgacgugggcaaccaauauccaaguagcaauuaaucaagugagaagauugauuggcaaugaaaauuauuuagauuacaugacaaguaugaagagauuuaaaaacgaaagcgaucccgagggagcacuuugguag

SEQ ID NO: 21236 - RNA, 9879 nt, Artificial Sequence
  derived and/or modified CDS sequence (opt6) from DENV-1__HQ166035__SS-prME
agcgugacuauguuacuuaugcuucuucccacugcucuagcuuuccaccugacuacucgcgggggagaaccucauaugauugugaguaaacaagaacgagguaaaagucuauuauuuaaaacuagcgcuggggugaacaugugcacacuaauagcgauggauuuaggugaauuaugcgaagauacaaugacuuacaaaugcccucaaauaacagaagccgaaccagacgacguggauuguuggugcaaugcuacagauacguggguuacguaugguacgugcagucaaaccggugaacauaggagagacaaacgaucaguggcacuugcgccacacguaggcuuaggguuagaaacaagaacagaaacauggaugaguucggaaggagcguggaaacaaauacaaagaguugaaacaugggcacuaagacaucccggguucacaguuauagcucuauuucuugcccaugcaauagguacaaguauaacacagaaagggauuauauuuauauuauugaugcuuguaacuccaagcauggccaugcgcugcguugggaucggaaacagggacuuuguggaagguuuaucaggagcaacauggguagauguuguauuggaacacggaaguugcguuacgaccauggccaaaaauaaaccuacacuugacaucgaauuauuaaaaacggaagugacaaacccggcaauuuugcgaaaacucugcauagaggcaaaaaucucuaauacuacgacagauucucgauguccaacgcagggagaagcaacuuuagucgaagaacaagacgcaaauuuuguauguagaagaacauucgucgacagaggcuggggaaauggcuguggacucuuugguaaaggcagcuuacuaacaugcgcaaaauuuaaaugcguaacaaagcuggaaggaaaaauaguccaauaugaaaauuugaaauacucuguuauagucacaguacauacaggcgaucaacaucagguggguaaugaaacaaccgaacauggcacaauugcuacuauuacaccgcaagcaccuacaucugaaauaaggcuuacagauuauggagcauugaccuuagacuguagcccaaggacaggucucgacuucaaugaaaugguccuucucaccaugaaagagaaaaguugguugguacauaagcagugguucuuagaccuccccuuaccauggaccuccggagcuucgaccagccaagagacauggaauaggcaggaucuauuaguuacauuuaaaaccgcucacgcuaagaaacaggaaguugucgucuugggaucacaggaaggugcuaugcauacagcuuuaacaggagcaacugaaauacaaaccaguggaacaacuacaauuuucgcaggacacuuaaagugccgauugaaaauggauaaacucacguuaaaggguaccuccuacguuaugugcacuggcucuuuuaaauuagaaaaggagguugcugagacccaacacggcacaguccuaguacaaguuaaguacgagggaaccgaugccccaugcaaaaucccuuuuucgacccaagaugaaaaaggaguaacgcaaaacggucgauuaauuacugccaacccaauuguaacagacaaagagaaaccuguaaauauagaaacagagccaccuuuuggagaaucuuauauagucguaggcgcgggagaaaaagcacuaaaacucaguugguucaaaaagggaucaucgaucgguaagauguuugaggcuaccgcaaggggagcacggagaauggcaauauuaggagauacagcaugggacuuuggaaguauaggaggaguauuuacaaguguuggcaaguuaguacaucagguauucggaacugcguacggaguacucuucucuggcguaagcuggacgaugaagauagguauugggauucuacuaacaugguugggucuaaauagucgaaguaccagccuaagcaugacuuguauagccgugggaaugguaacguuguacuugggaguaaugguacaggccgacuccggguguguuauaaauuggaaaggaagagaacuaaaauguggaucagggauauuuguuacuaacgagguacauacauggacugagcaauauaaauuccaagcagauaguccaaaaagguugagugcagcaauaggaaaagcaugggaagaggguguuugugggaucaggucugcuacacgccuggaaaacauaauguggaaacaaauaucaaaugaacucaaccacauucuucuugaaaaugauaugaaauuuacaguaguaguaggcgaugcaaaugguauccucgcgcaagguaagaaaaugauucggccucaaccaauggaacacaaauauaguuggaagucaugggggaaggcaaagauaauuggggcugacauacagaauacaacuuucauaaucgacggaccugauacgccagaguguccagacaaccaacgagcuuggaauauuugggagguagaagauuaugguuuugggauauuuacaacaaauauuugguuaaaauugagggauucauacacucaaaugugugaucaucgauugaugagugcugcaauaaaagacucaaaagcuguucaugcggauauggguuacuggauagaaucagagaaaaaugagacguggaaauuagcccgagccuccuucauagaaguaaaaacauguacauggccaaaaagccacaccuuaugguccaaugguguucucgaauccgaaaugauuauuccaaaaauauacggaggucccauuagucaacauaauuauagaccgggguauuuuacccaaacagcugguccuuggcacuuagggaagcuagagcuagacuucgauuuaugugagggaacgacaguugucguagacgagcacugcgguaaucgcgggccguccuuacggacgaccacagucacaggaaaaauaauacaugaaugguguugucgaucuugcacauuaccaccauuaagauuucgaggugaggacgguugcugguacgguauggaaauaagacccguaaaagaaaaagaagaaaaucucguacguucaauggucuccgcgggauccggagaggucgauaguuucucauuagguauucuaugugugucgauuaugauagaagaaguuaugcguucucgguggagccggaaaauguugaugacaggaacguuagcagucuuucuucucuuaguaauggggcaacuaacguggaaugacuuaauucgccucugcauaaugguaggagcuaacgcuuccgaucguauggggaugggaacgacuuaccuagcacugauggcgacauucaaaaugcgaccaauguucgcaguuggucucuuguucaggagacugacaagucgagaaguuuuacuccugacuauaggacucucauuagucgcgagcguugagcuuccaaauuccuuggaagaacucggcgauggguuggccaugggaauaaugauguuaaaguuguuaacugaauuucaaccucaucaauuauggacaacccuauugucguugacauuuaucaaaacaacucucagucuugauuaugcauggaagacuacagcuauggcguugucuaucguuagcuuauucccucugugucuaaguacuacuucccagaaaacuacuugguuaccaguguuguuaggaucuuuuggauguaaaccauugacaauguucuugauuacagaaaacaaaauauggggucgcaaaaguuggccauugaaugagggaauuauggcaauagguauaguaucuauauugcucucuaguuuauuaaagaaugacguaccuuuagcgggacccuuaauagcuggaggaaugcuaauagcuugcuacguuaucagcgguucuagugcagauuuaagccuagagaaagcggcugagguuucgugggaacaagaagcugagcacagcggaaccucucacaauauauuagucgagguacaggaugacggcacuaugaagauuaaagacgaagaacgugaugacacucuaacuauacuauugaaagcuaccauguuggcuguaaguggcguauacccaaugagcauaccagccacaccguuuguaugguacuucuggcagaagaagaaacaaagaauuagaguacuaugggauacgcccucgccaccagagguggaaagagcagugcuugaugaugguauauacagaauacugcaaagaggccuuuugggcagaucacaagugggugucggcgucuuucaagacgguguuuuucauacaauguggcacguaacucgaggagcaguccugauguaucaaggaaaaagauuggaaccaucaugggcaagcguuaagaaagauuuaauaucauacgggggagguuggcguuuucaaggaucauggaauacaggagaagaaguucaaguuauugcaguugaaccuggcaaaaaucccaagaaugugcagacuacgccaggaacauuuaaaacaccggaaggagaaguaggagcaauagcgcuagauuucaaaccugggacaagcggcucgccgauaguuaacagggaagagaaaauaguaggacuuuauggaaaugggguuguaacaaccagcgguacauacguuucggcgauagcacaagcuaaagcaagccaggaaggaccguuaccagagauugaagacgaaguuuucaaaaagagaaacuuaacuauaauggaucuucacccuggcagcggcaaaacacguagauacuuaccagccauaguuagagaagcaauaaaaaggaaacuuaggacuuuaauacuagcaccuacuagagugguugccagugagauggcugaagcacuaaaagggaugccaauucgauaucaaacaacugcugugaaguccgagcauaccgguagagaaauagucgacuugaugugucacgcaacauuuacaaugagacuccuaagccccguuagaguuccgaacuauaacaugauaauaauggacgaagcacauuuuacugacccggcaaguauagcggccagaggguacauuucuacccggguaggaaugggugaagcagcagcuaucuuuaugacagccacgccucccggaaguguagaagccuucccacaaucuaaugccgucauacaggacgaagaaagagacauuccagaaaggagcuggaacucuggcuaugauuggauaacagacuucccaggcaaaaccguaugguuuguuccuucaauaaaaagcgguaaugauauagcaaauugccucaggaaaaauggaaaacguguaauccaguuaucucguaaaacguucgauacggaauaucagaaaacuaagaauaaugacugggacuauguagugacuacggauauaucagaaaugggagcuaauuuuagagcugaucgggugaucgauccacguaggugccuaaagcccguuauucucaaggauggcccggaacgaguuauucucgcugggccgaugccaguaacuguggcuucggccgcucaaagacgagguagaauaggucgcaaccaaaauaaggaaggcgaucaauauguauauauggggcaaccucugaauaacgaugaggaucacgcacacuggacagaagccaaaaugcuccuugauaauauaaauacuccagaagguauuauacccgcccuauucgaaccagaaagagaaaaauccgcagccauagauggggaauauagguuaaggggagaagcucgcaaaacguucguagaauuaaugcgccgcggggaccuaccuguuuggcuaucuuauaagguggccucagaaggauuccaauauucugaccgcagaugguguuuugauggugagcgaaauaaucaagugcucgaagagaauauggacguagaaaucuggacaaaggaaggagaaagaaagaaauuaagaccgagauggcuugaugcaaggaccuauucagauccccuugcauuaagagaguucaaagaauuugcagcagggagacgcucaguaucuggagauuuaauccuagaaauaggaaaacuaccacagcaucuaacacuacgagcacagaacgcauuagacaacuuaguaauguuacacaauucugagcaagggggcaaagcauacaggcaugccauggaagaauuaccugacacaauugagacuuugauguuacuagcccuaauagcuguuuuaacaggcggugucacgcuauucuuuuuauccggaaaaggguugggaaaaacaagcauaggucucuuaugugugacagcuucuucugcuuuacuauggauggcaagcgucgaaccacacuggauagcugcgagcauaauauuagaguucuuucucaugguauuauugaucccagagcccgaccggcaacgaacaccacaagauaaccaauuagcguauguuguaauaggauuacucuucaugauauuaacuguagcggccaacgaaaugggauuacuagaaacuaccaagaaagacuuaggcauuggucacguggccgcggagaaucaccagcaugcgacaauguuagaugucgaucugcgcccugcauccgcauggacauuauaugcaguagcuaccacuguaauaacgccaaugaugcggcauacaauagaaaauacgaccgcuaauauaagccucaccgcgauagccaaucaagcugcaauacuuauggguuuagacaagggauggccuauuuccaaaauggacaucggugugccauuacuagcuuuagguuguuacucacaaguaaauccuuugaccuugacagcugccguccuaaugcuaguagcacauuaugcaaucauaggucccggucuacaggcaaaagcaacccgggaagcucaaaaacggacugccgcuggcauaaugaaaaauccuacaguagauggaauuguugcuaucgacuuagacccaguaguuuacgaugcaaaguuugaaaaacaauuaggccagauaaugcuauugauauugugcaccucucagauuuuauuaaugcgaacaaccugggcgcuaugcgaaucuauaaccuuagcuacgggaccacuaacgacuuugugggaaggcucaccaggaaaauuuuggaauacaaccaucgcuguaaguauggccaacauauuucgcgguaguuaccuagccggcgcuggccuugcuuucucucugaugaagaguuuggguggaggaagacgcggaacgggagcgcaaggcgaaacacuuggagaaaaguggaagcgucaauugaaucaacuuucgaaaucagaauuuaacacauacaaacgaucggguauuauggagguggauagaagcgaagcaaaggaaggauuaaagagaggagagacaaccaagcaugccgucucacgagggaccgcaaaacugcgcugguucguugaacgcaaucucgugaaacccgaagggaaagugauagaucuuggauguggacguggugggugguccuauuacugugccggucucaagaaagucacugaaguaaaggguuacacaaaagggggaccgggacaugaagaaccaauacccauggcaacauauggguggaauuugguaaaauuacauuccggaaaagauguauuuuucaugccgccagagaaaugugacacccuuuugugugauauaggcgaaucaaguccaaauccaacuauugaagaagggcgaacgcuccguguucuaaaaaugguagaaccguggcuuaggggaaaccaauucuguauaaaaauacugaaucccuauaugcccucaguaguugaggcacuagaacaaaugcaaaggaaacauggagguauguugguucgaaaucccuuaagucgaaauucuacucaugaaauguauuggguaagcugcgguacuggaaauauaguuucugcgguuaauaugacgucaagaaugcuacucaaucgauuuaccauggcacauaggaagccaacauaugaacgugauguugaccucggggccggaacaagacacguggcuguagaacccgaaguagcaaaccuggacauuauaggucagagaauugaaaacauuaagaaugaacacaaauccacauggcauuaugacgaagacaauccauauaagacuugggccuaccauggaucuuacgaagucaaaccuagcggaucagcauccucaaugguuaacggugucguucgucuuuuaacaaaaccaugggacguuauaccaaugguaacacagauagcaaugacggauacuacaccauuuggacaacagagaguuuuuaaagaaaaaguugauacaaggacaccaagagcuaaacgagguacgacacaaaucauggagguaacggcgaaauggcucugggguuucuuaucgagaaauaagaaaccccggauauguacaagagaagaguuuacgcgcaaagugcgcaguaaugccgcgaucggugcaguauuuguugacgaaaaucaauggaacucagcaaaggaagccguggaagaugagagauucugggaucuggugcaccgagaaagagagcuucacaaacaaggaaaaugugcaaccugcguauauaauaugaugggcaaaagagagaagaaacuaggagaauuugggaaagcaaaggguagcagagcaauaugguacaugugguuaggagcacguuuucuagaguucgaagcguugggauucaugaaugaagaucauugguucaguagggaaaacucacuaucaggcguggagggagaaggguuacacaaacuaggcuauauacuacgagacaucuccaagaucccaggcgguaauauguacgcggaugacacagcagggugggacacuaggauaacagaagacgacuuacaaaacgaagcaaaaauuacugaaauaauggagccagaacaugcauuguuagcaacuuccauauuuaaacuaacuuaccaaaauaaagucgugagaguucaaagaccugccaagaaugggaccguaauggacguuauuagccgucgagaucagcgaggaucaggacaaguaggaaccuauggauugaacaccuuuaccaauauggagguucaacuaauaaggcagauggaaucagaaggaaucuuucuaccgagcgaauuggagacaccuaaccucgcugagagaguccuagauugguuagaaaagcacggugcggaaagauuaaagagaauggcaauaucaggagaugacugcgucguuaaacccauugaugauagauuugcgacagcucuaacagccuugaaugacaugggaaaaguucgaaaagauauuccacaaugggagccuucaaaaggauggaacgauuggcaacaggugccauuuuguucacaucauuuucaucaauuaauuaugaaagaugggcgagaaauaguagucccgugucgaaaucaagacgaauuaguaggacgcgcuagaguuucccagggggccggcuggucauugagagagacggcuugccugggaaaguccuacgcucagauguggcaauuaauguacuuccauagaagagauuugagauuggcugcuaaugcaaucuguagugcaguaccuguugacuggguucccacaucccgaacgacauggucaauacaugcacaccaccaauggaugacaacggaagauaugcuuucgguuuggaaucgagucuggauugaggaaaacccauggauggaagauaaaacucacgugaguucgugggaggagguccccuaccuaggaaaaagagaagaucaauggugcgguucauugauaggccuuacagcgcgagcuaccugggcaaccaauauucagguagcgauuaaccaaguucggagauugauaggcaaugaaaacuaucuugacuauaugacaucuaugaagcgcuuuaagaaugaaagcgacccggagggagccuugugguaa

SEQ ID NO: 21237 - RNA, 9879 nt, Artificial Sequence
  derived and/or modified CDS sequence (opt6) from DENV-1__GQ868502__SS-prME
aguguaacaauguuauuaaugcucuuacccacggcgcuggcguuucaccuaacaacgcgaggaggagaaccacauaugauugugucuaaacaagaaagaggcaaaucucuuuuauucaaaacaagugcugguguaaauauguguacauuaauugcuauggauuuaggggaacucugcgaagauacuaugacauauaaauguccacaaauaacugaagcugaaccggaugacguugauuguuggugcaaugcuaccgauacuugggugacauacgguaccuguagccaaacaggugaacacaggagagacaaaagaagcguagccuuggcuccucauguaggguuaggacuggagacacggaccgaaacguggaugucgucugaaggagccuggaaacagauacaacgaguggaaacgugggcacugaggcaucccggauucacuguuauagccuuauuucuugcccaugcuauugguaccucaauuacacaaaaagguacgauauuuauacuucuaaugcuagcuacaccgucaauggcaaugaggugcguugguauaggcaaccgugauuuuguagaaggguuaaguggugcaaccugggucgauguuguucuagaacauggcaguuguguuacaacuauggcuaaaaacaagccgaccuuggacauagaauuauuaaaaacggaagugacaaauccagcaauacugagaaaauuauguauugaagcuaagauaaguaacaccacuacggacuccaggugcccuacucaaggagaagcaacgcuaguugaagaacaagaugccaauuucguaugcagaagaacguucguagaccgaggaugggguaacgguugugggcucuuuggcaagggaagucucuugacaugugcuaaauucaaauguguaacaaaauuagaagguaagaccguucaguacgaaaaccucaaauauuccguuauaguuacgguucauacaggugaucaacaucaaguuggaaaugaaacaacugaacacggaacaauagcaacaauaaccccucaggcaccaacaucagagauucaauuaacagauuacggugcacugacuuuagacugcucaccuagaacaggccuugauuuuaacgagaugguuuuauugacuaugaaagaaaaaucaugguuggugcauaaacaaugguuucuugaucuuccauugccuuggacaucaggagcaucaaccagucaagagacuuggaauagacaagaccuauugguuacauuuaaaacugcacacgcuaaaaagcaggagguuguggugcuugggagccaagaaggcgcaaugcacaccgcacuaacaggagcaacagaaauacagaccucuggaaccacaacgauauuugcuggacauuuaaaaugucgacuaaaaauggacaaacuuacuuuaaaaggaacgucauacgucaugugcacagguaguuuuaaacuggaaaaagaaguagcugagacacaacacggaacuguguuaguacagguaaaguaugaagguacugacgccccuugcaagauuccuuucucaacccaagaugaaaaaggcguaacacaaaauggucgauuaaucacagcaaacccuauuguaacagacaaagagaagccuguuaacauagaaacugaaccacccuucggugaaucauauauugugguuggagcgggcgagaaggcacuaaaauugucaugguuuaagaaagggucuucuaucggaaaaauguucgaggccaccgcuagaggcgcgcgaagaauggcaauacucggcgauaccgcaugggauuucggaucaauuggcggagucuuuaccagcguagguaaauuaguccaccagguuuuuggcacugcauacggugugcuguucucuggagucucauggacaaugaaaauaggaauagguauucucuuaacauggcugggucugaauagucgaagcacaaguuugucaaugacauguauugcagugggaaugguuacacuauaucuuggagugaugguucaagccgacuccggaugcguuauaaauuggaaagggagagaacuaaaaugcggaaguggaauauuugucacgaaugaaguucauacuuggacagaacaauacaaguuccaagcugauucuccaaaacgauuguccgcggccauuggaaaagcaugggaagaaggagugugcggcauucgaucagcaacgagauuagaaaauauuauguggaagcaaauaucgaaugaguugaaucauauauugcuugagaacgauaugaaguuuaccguuguuguuggagaugcuaaugggauucuagcucaaggaaagaaaaugauuagaccccaaccaauggaacacaaauacaguuggaaaaguuggggaaaagcuaaaaucauuggagccgauauacaaaauacgacauuuauuauagauggcccugauacaccagaguguccugauaaccaaagggccuggaacauaugggaagucgaagauuauggauuugguauauucacaacuaauauauggcuaaaauuaagagauucuuauacacaaaugugugaucauagauugaugagcgcggcaauaaaggauucaaaagcaguacaugcagauaugggauauuggauagaaagugagaaaaacgaaacauggaaacuggcgagggcuucguuuauugaagucaaaacaugcacauggccaaaaagccauacuuuauggucaaaugguguacucgaaucugaaaugauaauuccaaaaauuuacggggguccaauuucucagcacaauuaccguccgggcuauuuuacgcagaccgccggaccauggcaccuuggcaaauuagagcuugauuuugauuuaugugaggguacuacagucguaguugacgaacauugugguaauagggguccaagccuacguacuacuacaguaacgggcaagauaauucaugaaugguguugcagaucaugcacauuaccaccacuaagauuccggggugaagacggaugcugguacggaauggaaauacgaccaguuaaagagaaagaagaaaaucuaguacguucaauggugagcgcgggcucgggagagguugauucauuuagccuugguauauuaugcgccagcauuaugauagaagaggugaugaggucuagauggagucguaaaauguuaaugaccggaacuuuggcgguuuuucucuuauuaguaaugggccagcucacguggaacgaccucauacgauuguguauuaugguaggugcgaacgcaucugauaggauggguaugggcacaacauauuuagcucuuauggccacguucaagaugcgaccuauguuugccgugggacuauuauucagaagacuaacgucacgggaagugcuauuauuaaccaucggguugucucucgucgccaguguagaacugccuaauagcuuagaagaauuaggagauggcuuagcaauggguaucaugaugcucaaacuucucaccgaguuucaaccacaccaauuauggacuacacuucuuaguuugacauucaucaaaaccacguuaucucuagauuaugccuggaaaacaacugcaauggccuuaucuauuguuucuuuauucccuuuaugccuuucaacaacuucccagaaaacuacgugguuaccaguucuuuugggcaguuucggauguaaaccacuuacaauguuucuaauuacugaaaauaaaauuuggggacguaaaucauggccauuaaacgagggaauaauggcgauagggauuguaucaauuuuauuaucaagucuacuuaaaaaugauguaccauuagcaggcccacuuaucgcuggugggauguuaauagcuuguuacguuauuagcggaucaucagcagacuugucacuagagaaagcugcugaaguaucaugggaacaagaagcagagcacucaggaacaucucacaacauuuuaguugaaguacaagaugaugguacaaugaaaaucaaggaugaggagagagaugauaccuuaacgauauuauugaaagcuacacuucuagcagugucaggcguauauccaaugaguauaccagcaaccuuauucguaugguacuucuggcaaaagaagaaacaaagauccggcguauugugggauacuccuucaccucccgaaguugaaagagcagucuuagacgaugguauauacagaauccuacaacgcggacuauuaggacguagccaaguaggaguuggaguuuuucaagacgguguuuuucauacgauguggcacgucacgagaggugcgguauugauguaucaaggaaaacgacuagaaccgagcugggcaaguguuaagaaagaucuaauuucuuacggaggaggcuggcgguuccaagguucauggaacacgggcgaagagguacaaguaaucgcaguagaacccggcaaaaauccgaaaaacguacaaacaacaccuggaaccuuuaaaacaccagaaggagaaguaggagcuauagcacuagacuucaaaccagggacuucgggaucaccaauagugaacagagagggaaaaaucgugggcuuauacgguaacgguguggucacaaccucggggacguaugugucggcuauugcucaagcaaaggcaucacaagaaggccccuuaccugagauagaagaugaaguauuuaagaaaaggaauuuaacuauaauggaccuucacccugggucagguaagacacgccgauaucuucccgcaaugguuagggaagccaucaagcgaaaauugaggacauuaauacuugcaccaaccagagucguggcauccgagauggcggaagcauugaaaggaaugcccaucagauaccagacaacagcugucaagucugaacacacaggccgugagauuguagaucuaaugugucaugcaaccuucacuaugagauuauugucuccuguaagagugccaaauuacaauaugauaaucauggacgaagcucauuucacugacccagcauccaucgcagccagaggauacauaucgacacgugucggaaugggagaagcagcagcgaucuuuaugacagcuacgccaccggguuccguagaagcguuuccacaaucuaacgcaguuauacaggaugaagaaagggauauaccggaacguucauggaacucaggauacgauuggauaacagacuucccagguaaaacaguaugguuuguacccucaauuaaaagugggaaugauaucgcuaauugucuccggaaaaauggaaaaagaguuauccaacuuuccaggaaaacauuugauacugaauaccagaaaaccaaaaauaaugauugggauuaugugguuaccaccgacauuagugagaugggugcgaacuuucgcgcagaucgagucaucgauccaaggcguugccuuaagccggucauucucaaagacggcccagagcgaguuauccuagccgguccaaugccgguaacagucgcuucugcagcgcaaagacgugggagaauuggaagaaaucaaaauaaagaaggcgaucaauauguauauaugggacagccacucaauaaugacgaagaucaugcucauuggacggaggcaaagaugcuuuuagacaauauuaauacaccagaaggaauaaucccagcguuguuugaaccagaaagagaaaaaucagccgcuauagacggggaguauagacuaaggggagaagcacgcaagaccuuuguagaacuaaugcgacgcggagacuuaccaguuugguugucauacaaagucgcaagcgaggguuuccaguauucggacagacguugguguuuugacggagaacgcaauaaucaaguucuagaggaaaacauggacguggaaaucuggacaaaagagggggaaaggaagaaauugcgcccaagauggcuagaugccaggacauacucggauccccuagccuuaagggaauuuaaagaauuugcugcuggcagacgaucagugucaggagaccuaaucuuggaaaucggaaaacuuccacaacaucucacgcuuagagcacaaaacgcucuggauaauuuagucauguuacauaauuccgagcagggagguaaagcauacagacaugcaauggaggaacuaccagacaccaucgaaacacugaugcuauuagcccugaucgcagugcucacugguggaguaacauuauucuuucucagugguaaaggucucggcaagacaaguaucggauuauuauguguaacugcgucgucagcacuauuauggauggcaucugucgagccgcauuggauugccgcguccaucauccuugaguucuuuuuaaugguauuacuuauuccugaaccugauagacaaagaaccccgcaagacaaccaacuagcguacguugugauuggucugcuauucaugauacuaacuguagcagcaaaugagaugggucuacuggaaacaacuaaaaaggaccuagggauaggucacguagcggcagaaaaucaccagcacgcgaccaugcuagauguagacuugcguccagcgucagcauggacucuauacgccguagcaacuaccguaauaacuccaaugaugcgccauacuaucgagaauaccacagcaaacauuucacucacggcaauagccaaccaagccgcgaucuuaaugggcuuagauaaaggguggccuauaucuaaaauggauauuggagugccucuuuuagcucucggauguuauucccaaguuaauccacucacauuaacugcugcuguacuaaugcuaguugcacauuaugcgauuauaggcccagggcugcaagcaaaagcgacacgugaggcccaaaagagaaccgcagcugguauaaugaagaauccuaccguugauggcaucguagcaauagauuuggauccugucgucuacgaugcuaaauuugaaaaacaacucggucaaauaaugcuacuuauauuaugcaccagucaaauccuuuuaaugcgaacuacuugggccuuaugcgagucgaucacccuugcaacagguccauuaacuacacuaugggaaggaagucccggaaaauucuggaauacaacuauagcaguaaguauggcuaauauuuuccgugggaguuaucuugccggagcaggucuugcauucucgcuuaugaagucauuaggcgguggaagaaggggcacuggagcacaaggagaaacauuaggcgaaaaauggaagagacaacuuaaucagcuuucaaaauccgaguucaauacauauaaacgcagugggaucauggaaguggauagaucagaagcaaaagaagggcuuaagcgaggcgagaccacaaagcaugcugucucucgcggaacugcaaaacuaaggugguuuguagagaggaauuugguaaaacccgagggaaaagucauugaucuggguuguggaagagguggauggucuuacuauugugcgggucuaaagaagguaacugaagugaaaggauauacaaaagggggucccgggcaugaagaaccaauucccauggcgaccuauggauggaauuuggugaaacugcacucaggaaaagauguauucuuuaugccaccagaaaaaugcgauacgcuuuuaugugauauaggcgaaaguagcccgaauccuacaauagaagaagguaggacauuaagagucuugaaaauggucgaaccuugguugcgaggaaaccaauuuuguaucaaaauauuaaauccuuacaugccaucaguaguagaaacauuggaacaaaugcagcguaaacacggagguaugcuaguaaggaaccccuuauccagaaauagcacacacgaaauguacugggucagcugugggacuggcaauauagucagugcagucaacaugacgucaagaauguuacucaaucguuuuacuauggcucauagaaagccaacauaugagcgugauguagaucuuggagcaggaacacggcacgucgcgguagaaccagaaguggcaaacuuagauauaauuggccagagaaucgaaaacaucaaaaaugaacauaaaagcaccuggcauuaugaugaagauaacccauauaaaacuugggcuuaccauggcaguuaugaagucaaaccuucggggagugcgaguaguaugguaaauggugucgugagacuacuaacaaaaccaugggacguaauuccaaugguaacucaaauugcuaugacugauacaacgcccuuuggacaacagcgaguauuuaaagaaaaaguugacacgaggacgcccagggcaaaaagaggaacaacgcaaauaauggaggugacggcuaagugguuauggggauuuuuaucuagaaacaaaaagccgcgcaucuguaccagagaggaauuuacuagaaaaguaagaucaaaugcagcaauuggagccgucuuugucgaugaaaaccaauggaacuccgcgaaggaagccguggaagacgaacgauuuugggaucuaguacauagagaacgugagcuucacaaacagggaaagugcgcaacguguguauacaauaugauggguaaacgagagaagaaacucggcgaguuuggcaaggcuaaagggagcagagcaauuugguauaugugguugggagcucguuucuuagaauuugaggcuuuaggauucaugaacgaagaccauugguucucgagagaaaauuccuuaagcggagucgaaggugaaggacuccauaaacucgguuacauuuuacgagauauaucaaaaauaccggguggaaacauguacgcugaugauaccgcaggaugggauaccagaauaacagaagaugacuugcagaacgaagccaaaaucacagagaucauggaaccagaacaugcacuuuuagcuacaaguauuuucaagcuaacauaucaaaauaagguuguacgcguucaacggccggcgaaaaacggaacugucauggauguuauaaguagaagagaucaacgcggcucuggccagguagggaccuacggacuuaacacauuuacaaacauggaaguccaauuaaucagacaaauggagagugaagggauauuuuuaccuuccgaacuggagacuccgaacuuagcugagaggguuuuggauugguuggaaaaacauggagccgaacgacuuaaaagaauggcaaucuccggugacgauugcgucguuaagcccauagaugauagguucgcuacagcauuaacagcauuaaaugacauggguaaaguccggaaagacaucccacaaugggaaccaagcaaaggauggaaugacuggcagcagguaccguuuugcagccaucauuuucaucaacuuauuaugaaagaugguagagaaauaguaguccccugucgcaaucaagaugaacugguugguagagcgcgugucagccaaggggcaggauggagccuucgagagacugcgugucuaggaaaaaguuacgcucaaauguggcaauuaauguauuuccaucggcgugaucucagacuagccgcuaaugcgauaugcagcgcaguaccagucgacugggugcccacaagccggacuacguggaguauucaugcccaucaucaguggaugacaacugaggacaugcuaagcguuuggaaucgaguuuggaucgaagaaaaucccuggauggaggacaaaacucacgugucuaguugggaagaagugccuuaccuagguaagcgagaggaucaaugguguggaucucugauuggauuaaccgcacgugccacuugggcaacaaacauacaaguugccauaaaucagguaagacguuuaauugguaacgaaaauuaccuugauuauaugacaaguaugaagagguuuaaaaacgaaucagacccagagggagcacucugguga

SEQ ID NO: 21238 - RNA, 9879 nt, Artificial Sequence
  derived and/or modified CDS sequence (opt6) from DENV-1__GQ868503__SS-prME
agcgugacuaugcuguugauguugcuaccgacagcacucgcguuucaucuaacuacacgaggaggggaaccacauaugauuguuucaaaacaagaaagggggaaaagucucuuauuuaaaacaucggcuggaguaaauauguguacccugauagcaauggacuugggagaacugugugaagacaccaugacuuacaaauguccgcaaauaacagaagcagaaccugaugauguugauugcugguguaaugcgacagauacauggguuacguauggaacauguucucagacaggagaacaucggagagauaaacgaucagucgcuuuagcaccccacguaggauuaggucuugaaacgcgaacugagacauggaugucgucggaaggggcauggaaacaaauacaaagaguagaaaccugggcauuaagacaccccgguuuuacaguaauagccuuauuucuugcucaugccauagggacaucuauaacccaaaaaggcauuauuuucauucuauugauguugguaacgccauccauggcaaugcgaugcgugggcauagguaaucgagacuucguagaaggacuaaguggugcuacuuggguggauguaguucuugaacacgggucuugugucaccacaauggcgaaaaacaaacccacccuugacauugaacucuuaaaaacagaaguaacgaauccggcaauacuaagaaaauugugcaucgaggcgaaaauaucaaauacuacaacugauucucgguguccaacccaaggugaagccacauuaguagaagaacaagacgcgaacuuugugugucgacgaaccuuuguagacagaggaugggguaauggcugcgguuuguucggcaaaggaucuuuguugacaugugccaaauuuaaauguguaacuaaacuagaggggaaaauuguacaauaugaaaaucugaaauacucaguuauuguaacaguucacacgggggaccagcaccaagucggaaaugaaaccacugagcauggcacgauugccaccauaacaccucaagcgccaacaagugagauucaacugacugacuauggagcuuuaacacucgauuguucaccucguacaggacuggacuucaacgaaaugguccucuuaacaaugaaagagaaauccuggcuuguacauaaacagugguuucuagacuuaccguuaccauggacaucuggcgcgucaaccagccaagagacauggaaucggcaggaucuccuaguaacauuuaaaacugcacacgccaagaaacaagaaguuguuguauuagggucacaggagggcgcgaugcauacugcauuaaccggagcgacggaaauacaaacuucaggcaccacaacaaucuucgcuggacaucugaaaugucgauuaaaaauggauaaacucacucuaaaagggacuagcuauguaaugugcacuggaucauuuaaauuggagaaagaagucgcugaaacucaacauggaaccguccuggugcaaguuaaauaugaaggaacugaugcacccugcaagauacccuuuaguacgcaaaaugaaaagggugucacacaaaauggucgcuuaaucacagcaaauccgauugucacagauaaagagaagcccguaaacauagagacagaaccuccauuuggcgaaagcuauauaguuguaggcgcuggagaaaaggcacugaaauuaaguugguuuaaaaagggcucuaguauuggaaagauguuugaagccacagcucgcggggcacgcagaauggcuauauuaggagauacagcuugggacuucggaaguauugguggaguauucacaagcguaggcaaacuugugcaucaaguguuuggcacugcguauggaguuuuauuuaguggcgucagcuggaccaugaagauaggaauagguauauuguuaacauggcuagggcucaauaguagaucuacgagcuuaaguaugacguguauugcaguaggcaugguaacacuguaucuuggcguaauggugcaagcagacagugggugcguuauaaacuggaaaggucgagaacugaaauguggaucggggauuuucguaacuaaugagguucacacauggacggaacaauacaaauuucaagccgacucgcccaagcgccuaucugcggcgauaggaaaagcgugggaagagggcguaugcggaauuagaucugccacaagauuagaaaacauaauguggaaacaaaucucuaaugaacuuaaucacauccuacuugaaaacgauaugaaauuuacuguagucgugggggacgcaaauggaauuuuagcccaaggcaagaaaaugaucaggccucaaccaauggaacauaaauacucauggaaauccugggguaaagcaaagauaauaggagcugacauacagaacacgacauucauaauagauggcccagauacacccgaauguccugacaaccaacgcgccuggaauauuugggaagucgaagacuacggauuuggcauuuuuacgacaaacauauggcuaaaacuucgggauucauacacucagaugugugaucaucgauugaugagcgcugcgauaaaagacagcaaagcaguacaugcggauaugggauacuggauugaaucagaaaagaacgagacauggaaacuagaacgggcuucauuuauagaaguuaaaacgugcaccuggccaaaaagucacacucuguggaguaacggaguacuagaaucagaaaugauaaucccaaagauauaugggggcccuauuucucaacacaacuacagaccaggauacuuuacacaaacagccggaccauggcacuuaggaaaacucgaacucgauuuugaucuaugcgaaggaacaacugucguugucgaugagcauugcggaaaucguggcccauccuugcguacgacaacaguaacuggaaaaauuauacaugaaugguguuguaggaguuguacucugccuccucugagauuuaggggagaagaugguuguugguauggcauggagauaagaccugucaaggaaaaggaagaaaaccugguaagaagcaugguaagugcgggcucaggagaaguagauucauuuagccuggguauacuuugugcuucaauaaugauagaagagguaaugcgaucuagguggucgcgaaaaauguuaaugacggggaccuuagcaguauuuuuacuauuaauaaugggacaguuaacauggaacgaucuaauuagacucugcaucaugguaggagcgaaugcaagugacagaaugggaaugggaacuacguaccucgcuuugauggcaacguuuaaaaugcggcccauguuugcaguaggauuacuuuuccggagacuaacaucuagagaaguauuauuauugaccauaggacuaucacuggucgcaucaguggaacuaccaaauucgcuagaagaacucggagauggucuggcgaugggcauaaugaugcuaaaacuucuuacggaauuucaaccucaucaacuauggacaacacuccucagcuuaacauuuauaaaaacuacucuaaguuuggacuaugccuggaaaacgacagcaauggcuuuaagcauaguuucccuauuuccauuaugccuuagcacaaccagccagaaaacuacauggcugccaguguuacuaggaucauuuggaugcaagccccugacaauguuucuuauuacugaaaacaaaaucuggggcaggaaguccuggccccuaaaugaaggcauuauggcgauuggaaucguaaguauacuacucaguagcuuacuuaaaaacgauguucccuuagcugggccauuaaucgccggugguaugcugauugcauguuacguaauaagcggcaguucagcagauuuaagccuggagaaagcagccgaagucaguugggagcaagaagccgagcauucuggaacaucacacaacaucuuaguagaaguacaagacgauggcacuaugaagauuaaagaugaggaacgagaugauacuuugacuauccuauugaaagcaacauuacuugcaguuucugggguauauccuaugucaauaccugcaacguuauuuguaugguacuuuuggcagaaaagaaaacaaagaucugguguuuuaugggacacgccuuccccgccggaagucgagcgagcagugcuagacgacggcauuuaucgcauacugcaacgagguuuacuagguaggucucaagucggaguagguguguuucaagauggaguauuucacacuauguggcauguuacccguggagcaguccuaauguaucaaggaaaacgccuagagccuaguugggcuagcgugaagaaagacuuaauuucauacggcgggggcuggagauuucaagguaguuggaacacaggcgaggagguacaaguuauugcaguagagccggggaaaaaccccaaaaacgugcagacuacuccaggaauauuuaaaacuccggagggugagguuggggcuauagcacuagauuuuaagcccgggacuagcggaucucccauaguaaauagagaaggaaaaaucgugggauuguauggcaaugggguuguaacgacaaguggcacauaugugucagcaaucgcucaagcaaaggcuucacaagagggcccauugcccgaaauugaagacgaaguauucaagaaacggaauuugaccaucauggaucuccacccagguagugggaagaccagaagguauuugccugcaauuguucgagaagcgauaaagcggaaacuaaggacguugaucuuggcaccaacaaggguuguagcuucagaaauggcugaagcauuaaaaggaaugcccauaagguaccagacuaccgccguuaaaagcgagcauacaggaagagaaauuguagaucuaaugugucaugcuacuuuuacuaugcgucuacucucacccguuagagugccuaacuacaauaugauaauaauggaugaagcgcauuucacagauccagcaucaauagcagcuagaggcuacauuucaacccgaguggguaugggggaggcagcggcuauuuuuaugacagcuacaccacccgggaguguugaggccuuuccacaaucaaacgccguuauccaagacgaagaacgagacauaccagaaagaucguggaacucugguuaugacuggauaacugacuuccccggaaagaccgugugguucguucccagcauaaaaagcgguaaugauauagcaaauuguuuaaggaaaaauggaaaaaggguuauccagcuaagccguaagacauuugauacagaauaucagaaaaccaaaaauaacgauugggauuacguaguuacaacagauauuagugaaaugggugcaaacuuuagagcagaccgcgugauagauccaaggagguguuuaaaacccguuauucuaaaagacggucccgagagaguaauacuggcaggcccuaugcccguaacaguagcuagugccgcacaaagaaggggccgcauagggagaaaucaaaacaaagagggagaccaauauguguacauggggcaaccuuuaaauaacgaugaggaccacgcacauuggacugaagcgaaaaugcuccuggauaacauaaauacaccugaaggcauaauuccugcucuuuucgaaccagaaagagagaaaagugcagcaaucgauggagaguauaggcugagaggggaggccagaaagacauucguagaauugaugcgaagaggagaucuaccaguauggcuguccuauaaaguugcaagcgaaggauuccaguacucagauaggagauggugcuucgauggugagaggaauaaucaaguuuuagaagagaacauggauguagaaauauggacuaaagaaggagagagaaagaaauuacguccaagaugguuagacgcgcgaacauacucagaccccuuagcauuacgugaauuuaaagaauuugccgcaggucgcagaucggucuccggggacuuaauacuugaaauaggaaaauuaccccaacacuugacauuacgcgcacaaaaugcauuagauaaucuuguaaugcuacauaacucugagcaaggggguaaagcauaccgucaugccauggaagaauuaccugauaccauagaaaccuugaugcuacucgccuugauagcaguccucacgggcgguguaacauuguucuuuuugucaggaaagggguuaggaaaaaccaguauuggauuguuaugcguaacugcaucuucagcauuauuauggauggcgagcgucgaaccccauuggauagcagcaucaauaauuuuagaauuuuucuuaaugguccuuuuaauacccgagccagaucgucaaagaacaccccaagauaaucaacuagccuauguugucauuggauuauuauucaugauacuaacagucgcagcaaaugagauggggcuacuugaaacuacuaagaaagacuugggaauaggucauguugcagccgaaaaccaucaacacgcaacuaugcuagacguagacuuaagaccagccagugccuggacuuuguaugcgguggcaaccacaguuauaacuccgaugaugcgucauaccauagagaauacaacugcaaacauuagucugacagcuauagcuaaccaggcggcuauucuaaugggguuagauaaaggcuggccgauuuccaaaauggacauaggugugccuuuacucgcgcugggauguuacucucaaguuaacccauuaacgcuaaccgcugcaguuuuaauguuaguugcacauuacgcuauuauagguccgggccuacaagcuaaagcaacaagagaagcacagaaaagaacggcugccgggaucaugaagaacccuacaguagauggcaucgucgcuauugaccuagacccgguugucuacgaugcaaaauuugaaaaacaacuuggacagauaaugcuccuaaucuuauguacgucgcaaauauuacugaugcgaacuacaugggcccucugugaguccauaacucuugccacgggacccuuaacuacauuaugggaagguucuccagguaaauucuggaacacaaccauagcaguaaguauggcgaacauauuuagaggaucauacuuagccggagcaggcuuagcauucucauuaaugaaaucucuagguggcggucgaagagguacaggugcgcagggagagacguuaggagaaaaauggaaacgacaguugaaucagcuaaguaaaucagaguucaauacauacaaaagaagugguauaauggagguagaucggagugaggcuaaagagggauuaaaacggggagagacgaccaaacaugcugucuccagaggaacggcgaagcugcggugguuuguagaaagaaaccuuguuaaaccggagggaaaaguaauagaucuagguuguggucgcggggguugguccuauuacugcgcuggucuuaagaaaguuacagaggugaaaggauauacaaaaggaggacccggucacgaagaaccgauaccaauggcuacauauggauggaaucugguaaagcuacauucuggaaaggacgucuucuuuaugccgccagaaaaaugugauacccucuugugugauauuggagagaguucgccuaauccaacaauagaggaaggccgaacacuuaggguacuaaaaaugguugaaccgugguuacgagguaaccaauucuguaucaaaauacuuaauccauauaugccaagugucguagaaacauuagaacaaaugcaaaggaagcauggaggaauguugguacguaacccauugagccgaaacucaacucaugagauguacuggguuaguugcggaacaggaaauaucguuagugcaguuaacaugacaagcagaaugcuacuuaauagguucacgauggcucaccgaaaacccacauucgaacgagacguagauuuaggugcugguacuaggcauguagcaguagagccugaggucgcaaacuuggacauaaucgggcaaagaauagaaaauaucaaaaaugaacauaaguccacauggcauuacgaugaggauaauccuuacaaaaccugggcauaccauggcucuuaugaaguaaaaccgucugggagugcaaguucaauggugaacggcguaguacgacuacuaaccaagccaugggauguaauaccaaugguaacacaaaucgcgaugacugauacaacaccuuuuggucagcaacgaguauucaaggaaaaaguugauaccagaacgccaagagcuaaaagaggcacuacacaaauaauggaagucacggcuaaauggcucuggggauuuuuaucccgaaauaagaaaccccggauuuguacgcgagaagaguucaccagaaagguucgguccaaugcugcuauuggagcgguuuuuguggacgaaaaucaauggaacucggcuaaggaagcggucgaagacgagagauuuugggacuuaguacaccgcgaacgagaguugcauaagcaggggaaaugugcuacuuguguuuacaauaugauggguaaaagagagaagaaacuaggcgaguuugggaaagcgaaagggaguagagccauaugguauaugugguuaggugcgagguuuuuagaguuugaggcguuagguuuuaugaacgaagaccauugguuuucccgagaaaacucgcucucggguguagaaggagaagguuugcauaagcuggguuauauauugcgcgacauaucaaaaauccccggagggaauauguaugccgaugauacugcaggaugggacacucgaauuacugaagacgaucuucagaaugaagccaaaauaacggauauuauggaaccugaacacgcacugcuagccacuucaauauucaaauuaacuuaccaaaauaaagugguaagaguacaacgcccggcgaaaaacgguacgguaauggacguaauuucaagacgugaccaaagaggaagcggccaggugggaacuuacgggcuaaauacauucacuaacauggagguccaauuaauaagacagauggaaucagaaggaauauuuuugccaagcgaacuugagacaccaaauuuagcagagcgagucuuagacugguuagaaaagcauggagcugaaagacuaaaaagaauggcuauuucaggugaugauugcguggugaaaccuaucgacgacagauuugcuaccgcucucacggcauugaaugauaugggcaagguacgcaaagacauuccccaaugggagccuucaaagggguggaacgacuggcaacaaguacccuucuguagucaucacuuccaccagcuuauuaugaaagacggacgagaaauagugguccccugcagaaaccaagaugaauuaguaggacgagcgcguguaagccaaggugcggguuggaguuuaagagagacagcauguuuagguaaaagcuaugcgcaaauguggcaacuuauguacuuucauagacgugacuugcgccuggcagcgaaugcuaucuguagugcagugcccguagacugggucccaacaagccguaccacguggucaauucacgcacaucaccaauggaugacuacugaagauauguuaaguguauggaauaggguauggauugaggaaaacccuuggauggaagauaaaacacacguguccucaugggaagaaguaccuuaucuugguaaaagggaagaccaaugguguggcucacucauaggacuaacagcaagagcaacaugggccacuaauauucagguagcaauaaaccaagucagaagguugauugguaacgaaaacuauuuagacuauaugacaaguaugaaacguuuuaaaaacgagucugauccagaaggagcucucugguaa

SEQ ID NO: 21239 - RNA, 9879 nt, Artificial Sequence
  derived and/or modified CDS sequence (opt6) from DENV-1__GQ868504__SS-prME
aguguaacuauguuauuaaugcuguuaccaaccgcauuagcuuuucacuugaccacucguggaggugaaccucacaugauagucucaaaacaagaacgaggaaaauccuuacuauucaaaaccuccgcaggcgucaauauguguacauuaauugcaauggaucucggggaacuuugugaagauacaaugacguacaaaugcccccaaauaacagaagcagaaccagacgauguagauuguuggugcaaugcgacggacacguggguuacauacgggacuugcucgcaaacuggcgaacauagaagagauaaaagaucaguagcacuugcaccucacguagggcuuggacuggaaacccgaacggaaacauggaugaguagugaaggugcguggaaacaaauucaacgaguagaaacaugggcguuaagacauccagguuuuacgguaauagcucuguuucuagcacaugcuauaggcacuuccauaacgcaaaaagguauaauauucauacugcuaaugcuagucaccccaaguauggcaaugcgauguguagguauagguaaucgagauuucguggaaggccuuaguggcgcaacauggguagacgugguauuggaacauggaucuuguguuaccacuauggccaaaaauaaacccacucuggauaucgaauuguuaaaaacggaaguaacuaauccagcaauccuccgaaaacuguguauugaagcaaaaauuucuaauaccacuacggauagccgcuguccuacucaaggugaagcaacccucgucgaagaacaagaugcaaacuucguaugccggagaacguuuguugaccguggaugggguaacggauguggacuguuuggaaaagguagcuugcuuaccugcgcuaaauuuaaaugcguuacaaaauuagaaggaaaaauuguacaauacgaaaacuugaaauacagcgucauuguuacgguacauacaggcgaccaacaccaaguaggaaaugaaacaacagaacacggcacaauagccacaauaacaccccaagcaccgacuagcgaaauucaguugacugauuacggggcacugacuuuagacugcagcccaagaacgggccuggacuuuaaugaaaugguauugcuuaccaugaaagagaaaaguuggcuaguucauaagcaaugguucuuagauuuaccccucccguggaccagcggagcaucaacaucucaagaaacauggaaccggcaagaccuauuaguuacguuuaagacugcacaugcaaagaaacaagaaguuguuguccuggguucucaagaaggcgcaaugcacacagcauugacuggagccacggaaauacaaaccagcggcacgacuacaauauuugcaggucaccuuaaauguagacugaaaauggacaaauuaacguuaaaaggcacuucuuauguaauguguacuggaucauucaaacuugagaaagaagucgcagaaacccaacaugguacaguccuuguacaaguuaaauacgagggaaccgaugcgccuuguaaaaucccauucucaacucaagacgagaaagggguaacacaaaacgggagacuaauuacagccaauccgauugugacagauaaggagaagcccguaaauauagaaacugaaccuccauuuggagaaaguuauauuguaguuggcgccggggaaaaggcuuuaaaacuuagcugguucaagaaagggucaaguauugguaaaauguuugaggcuacggcuagaggggcccgucguauggcaauauugggugauacugcgugggacuucggaucaauuggaggaguuuuuacauccguaggcaaacucguacaucaaguauuuggaacugcauaugguguucuguuuagugggguaagcuggacaaugaagauaggaauuggaauuuuauuaacauggcucggguuaaacagucggucaacaucccuaucuaugacauguauagcgguugguaugguuacguuauauuuaggcguuauggugcaagcagauucaggauguguuauuaacuggaaaggacgagaacuaaagugcgguucuggcaucuucguaaccaaugaagugcauacuuggacugagcaguacaaauuucaagccgacucuccaaaaagauugagcgcagcgauuggaaaagccugggaagaaggagucugugguauacguucagccacucgacuugaaaauauuauguggaaacagaucucgaacgagcuaaaucauauccuguuggaaaaugacaugaaguucacaguaguugugggugacgccaaugggauacuggcucaagguaaaaagaugauucggccacaaccuauggaacacaaauauucauggaaaucaugggguaaagcgaaaauuauaggagcggacauacaaaauacgacguuuauaauagacgguccggacacaccugaguguccagacaaucaaagagcauggaauauaugggaaguugaagacuauggcuucggcauuuuuaccacaaacauuuggcuaaaguuaagagauaguuauacacaaaugugcgaucaccgccugaugucagcagccauaaaagacucaaaggcugugcacgcagacaugggauacuggaucgaaucagagaaaaaugagacauggaaacuugcaagggccucuuuuaucgaaguaaaaaccugcacguggccaaagagucacacguuauggucgaaugguguucuagagucagaaaugauaauaccuaaaauauacggcggaccgauaucacaacauaacuacagacccgguuauuucacucaaacggcagguccauggcauuuagggaaauuagaacuagacuucgaucugugugaggguacaacaguaguggucgacgagcauuguggcaacagagggccaaguuugagaacaacaacagugaccgggaaaaucauacaugaguggugcuguaggucauguacguugcccccacuuagauuucguggagaggacgggugcugguacgguauggagauucguccgguaaaggaaaaagaagaaaaucuuguaagaucaaugguauccgcagguaguggugagguagauucauuuucauugggaauacucugcgucagcaucaugauagaagagguaaugaggagcagauggaguaggaagaugcuaaugacaggaacauuagccgucuuccuacuuuuaguuauggggcagcuuacauggaaugaccuaauaagauuauguauaaugguaggugccaacgcguccgacaggauggguaugggaacaacauaucuagcauugauggcaacauuuaaaaugagaccaauguuugccguaggauuguuguuccgacgucucaccucucgagagguuuuacugcuuacgaucggauuaucguugguugcuagcguagagcuaccuaauucauuggaagaacuaggggauggguuagcaaugggcauuaugaugcuaaaauuguugacagaauuucaaccgcaucaauuauggacuacacuauuaucguugacuuuuauuaaaacuacacuuucacuugacuacgcauggaaaacaacugcaauggcacuuucaauagugagccuuuucccacuaugcuuaagcacaacgagccagaaaacuacuuggcuuccgguucuguuaggcucauuuggauguaagccacuaacaauguucuugauaacggaaaacaagauauggggucgaaaaucguggcccuuaaaugaaggaauaauggcaauugguauagucaguauacuauuauccucacuucugaaaaacgauguaccacuagcagggccauuaauagccggugggauguuaauagccuguuaugugauaaguggcucgagugcagaucuaucgcuagaaaaagcugcagaggucucaugggaacaggaagcagaacacaguggaacaagccauaauauucuuguugagguucaggaugaugguacaaugaaaauuaaagacgaagagagggacgacacguuaacgauacuguuaaaagcuacacuacuagcaguaucugguguguacccgaugagcauaccagccacucuuuuuguaugguauuuuuggcagaagaagaaacaacgaagugguguccugugggauacaccaucaccgccagaaguugaacgugcagucuuagacgauggaaucuauagaauuuuacaaagaggcuuauuagggagaucucaaguaggaguggguguauuucaggauggcguauuucauacaauguggcaugucacaagaggagcaguccuuauguaucaggguaaacgauuagagccaagcugggcuucgguaaagaaagauuuaauaucauaugguggaggcuggagauuucaggggaguuggaacacuggugaagaaguacaaguaauugccguugagccaggcaaaaacccaaagaauguucagacaacccccggaacuuuuaaaaccccagaaggugaggugggugcaauugccuuagauuucaaaccagguacaucaggcucuccgauaguaaauagggaagguaaaauaguaggccuauacgguaauggaguaguaacaacaaguggcacauauguaagugcgauugcacaagcaaaagcaucucaagaagggccacucccugaaauugaagacgaaguauucaagaagcgaaaucuaacaauaauggaccuacauccaggaaguggaaaaacaagacgguaccucccagccauaguacgcgaagcaaucaaaagaaaauuacguacucuuauccucgcuccgacaagggucguagcgucugaaauggcagaagcauuaaaaggaaugccaauaagguaccagaccacggcuguaaaaggagagcauacaggucgugagauuguggaccuaaugugucacgcuaccuucacuaugagauugcuuagccccgugcguguuccaaauuacaacaugaucauaauggaugaagcgcacuucacggacccugcuucuauagcagccagaggcuauauaucaacgcgaguuggaaugggagaggccgccgcuauuuuuaugacagcgacaccuccagguucuguggaggcauucccccaaucgaaugcugucauacaagacgaagagagagacauaccggaacgaaguuggaacucugguuaugacuggaucacugauuuuccuggaaaaacaguaugguucgucccgucaauaaaaaguggcaacgacauagcuaauuguuuaaggaaaaaugggaagagagucauacaacuuagccguaaaaccuucgauacugaauaccagaaaacuaagaauaacgauugggacuacguaguaacuaccgauauuucugaaaugggagcuaauuuccgggcugaccgaguuaucgauccaagaaggugccugaagccagucauacugaaagacggaccagaaagagucauuuuagcgggacccaugccuguuacuguggcaucugccgcacagagaagggggcggauagggaggaaccaaaauaaggagggugaccaguauguuuacaugggucaaccauuaaacaaugacgaagaccacgcucauuggaccgaagcgaagaugcuucuugacaacaucaauacaccagaagggauaauaccagcguuguuugaaccggagagagagaaaagcgccgcaauagauggugaguaccggcuaagaggcgaagcacggaagaccuuuguagaacugaugcggaggggugauuugccaguaugguuaucauauaaaguagccuccgaaggauuucaauacccagaccgacgauggugcuuugacggagaacgaaacaaucagguccuagaagaaaacauggacguagaaaucuggacaaaagaaggagaaaggaagaaacuaagaccaagauggcuggaugcaagaacuuauagugauccacuagcuuuaagagaguucaaagaauuugccgccgguagaaggaguguaaguggcgaccucauuuuagaaaucgggaaacuuccucagcaucuuacacuacgagcgcaaaaugcauuagacaaucuagucauguuacacaauagugaacagggugguaaggcuuaccgucacgcaauggaagaauuaccggacacaauugaaacgcuuaugcuccuugcccuaauagccguccuuacugguggaguaacucuauucuucuugucgggaaagggauuagggaaaacaucaaucggucuauuaugugugaccgcuucaucugcacuccuuuggauggcaucgguagaaccgcauuggaucgcagcgagcauaauccuagaauuuuuccuaaugguuuuauugauuccagaaccagaucgucaaagaacaccccaagauaaucaacuggcauacguagucaucgguuuacucuuuaugaucuuaacaguugcagcaaacgagaugggccuguuagaaacuacaaagaaagauuugggaauuggacacgucgcugcagaaaaucaccaacaugccaccauguuagacguagaucugcgcccagcuucagccuggacacuauaugcuguagcuacaacggugaucacaccuaugaugcgccacacgaucgaaaacaccacagcaaauauaucucuaacggcaauagccaaccaagccgcuauauuaaugggucuagacaagggcuggccaauuucaaagauggauauaggggucccguuguuggcucuuggauguuacucacaaguaaauccccugacacuuacggcggcagugcuaauguuaguagcucacuaugcuaucauuggcccagguuuacaggcaaaagccacacgagaggcgcaaaaacggacggccgcaggaaucaugaaaaauccaacaguggauggcauugucgcaauagacuuggacccugugguauaugacgcaaaauuugaaaaacaacucgggcagaucaugcuuuuaauuuugugcacgucgcagauacuacuuaugagaacaaccugggcacuuugcgagaguauuacucucgcaacuggcccacuaacuacauuaugggagggguccccaggcaaauuuuggaacacaacaauagcgguuucaauggcaaauauauucagagguucguaucuagcuggcgcaggacuugcauucucccuaaugaaaagccuuggcggaggacgacgaggaacaggagcccaaggcgaaacacuaggcgaaaaguggaaaaggcaacuuaaucaauuguccaaaagugaguucaauacauacaaaagaucugggauaauggaagucgauagaucagaagcuaaagaaggacuaaaaagaggagaaacuacaaaacacgcagucucacgagguacagccaaguugcguugguuuguugaacguaaucuagucaaaccugaggguaaaguaauagauuuaggaugugguagaggcggauggagcuauuauugcgcugggcuaaagaaaguaacugaaguaaaaggauauacuaaagguggucccggacaugaggagcccauaccaauggcaaccuauggguggaaccucgugaaauuacauagugguaaggauguguucuuuaugccaccagaaaaaugugacacuuuauuaugugacauaggugaaucgagcccaaauccuacaaucgaagaaggaagaacauugcgaguacuaaaaaugguggaaccaugguuaagagguaaucaguuuuguauaaaaauacuaaacccguauaugcccucaguaguggaagcauuagaacagaugcagaggaaacauggcggcauguuaguaagaaauccacuaucaagaaauagcacucaugaaauguacuggguuucauguggcacagguaacaucgucagcgcaguaaauaugacaucgcggauguugcugaauagauucacaauggcucacagaaaaccgaccuacgaaagagauguggaucuaggugcaggaaccagacauguagccguugagccagaaguagcaaauuuggacauaauuggacagagaauagaaaauauuaaaaaugaacauaaaagcacauggcacuaugaugaagacaauccuuacaaaacaugggccuaccauggaaguuacgaagugaaaccuucugguucggcguccucaaugguuaauggcgucguacgucuuuuaacgaaaccuugggauguaauaccaauggucacucaaauagcgaugaccgauacuacaccauucggacaacagagaguauuuaaagagaaagucgacacaagaacgccgagagcaaaacgagguaccacacagauuauggaagucaccgccaaauggcuaugggguuuucuaagucgaaauaaaaagccaaggauauguacucgcgaggaguucacgagaaaaguaagaucuaaugcagccauaggagcaguauuugucgacgagaaucaauggaacucagcaaaagaggcaguugaagaugaacguuuuugggaucuuguacaccgggaaagagaguuacauaaacaaggaaaaugugcaacauguguauacaauaugauggguaaaagggagaagaaacuaggcgaauuugguaaagcaaagggcucuagagcaauaugguacauguggcuaggggcuagauuccuggaguucgaagcacucgguuuuaugaaugaagaucauugguuuucgcgagagaacagcuuauccgggguagagggggaagggcuacacaaacuagguuauauccugagggauauuucuaagaucccaggggguaauauguaugcagaugauacagcuggaugggauacgcggauuaccgaagacgaucugcagaaugaagcgaaaauaacagaaauaauggagcccgaacacgccuuacuagccacuagcauuuuuaaacucaccuaccaaaacaaaguugucaggguucaaaggccagcuaaaaaugguacagucauggacguaauaucuagaagggaucagcgcgguucagggcaagucggcacuuauggccuaaacacuuuuaccaauauggaaguacagcuaauacgacaaauggaaucagaagguauauuucuuccuagugaauuagaaacacccaaccuggcagaaagaguauuagauuggcucgaaaaacacggggcugaacgacucaagagaauggccaucucaggcgaugauugcguagugaagccaaucgacgaccgcuuugcuacagcuuuaaccgcgcucaacgacaugggaaagguaaggaaagacaucccacaaugggaacccaguaaaggguggaacgauuggcaacaagugccuuucuguucucaucauuuucaccaguuaauaaugaaagauggacgagaaauuguaguucccugccggaaccaagaugagcuaguaggcagagcuagggucucacaaggagccgguuggagccucagggaaaccgccugucugggaaagucauaugcacagauguggcaacugauguauuuccauagacgcgaucuaagacuugcggcaaacgcuaucugcuccgcggucccgguagauugggucccaacgucgcgcacaacauggaguauacaugcucaucaucaguggaugacaacagaggauauguuaaguguuuggaacaggguauggauugaggagaacccauggauggaagauaagacacauguaaguuccugggaagaagugccauaccucggaaaacgggaagaccaauggugugguagccucauagguuuaacagccagagcuacgugggcaacuaauauacaggucgcaauaaaucagguaagacgccuuauugguaacgaaaauuacuuggauuacaugacaucaaugaaacguuuuaaaaacgaaucagauccagaaggugcguuaugguag

SEQ ID NO: 21240 - RNA, 9879 nt, Artificial Sequence
  derived and/or modified CDS sequence (opt6) from DENV-1__GU131967__SS-prME
agugugacuaugcuucugauguuacugcccacugcauuagccuuucauuuaacaacgagagggggcgaaccgcauaugauagucucaaaacaagaacgaggcaaaucacugcuauucaaaacgucagcugggguuaauauguguacgcugauagccauggaucugggugaacucugcgaagacaccaugacguauaaaugcccccaaauaacugaggcagaaccggaugauguagacugcugguguaaugcaacggacacauggguuacuuauggaaccuguucacaaacuggagaacauaggagggacaaaagaaguguugcuuuagccccacauguaggauuaggauuagaaacucgaacagaaacauggaugucuucggaaggggcauggaaacaaauacaacguguagaaacaugggcccugagacacccaggauucacaguuauugcacuuuuccuggcccaugcgauaggaacaucaauaacucaaaaaggaaucauauuuauuuuacuaauguuagugacacccucuauggcaaugagaugcguagggauuggaaaccgugauuuuguggagggacuauccggagcaacuuggguugaugucguauuagaacaugguaguuguguaacgacuauggccaaaaauaaaccaacguuagacauagaacuucuaaaaacagaaguaaccaauccagcaaucuugcguaaauuaugcauagaagcaaaaauaaguaacacaacuacugacucacggugccccacacaaggggaagcgacccuaguggaagaacaagacgcgaacuucguuuguagacgaaccuuuguagacagaggcugggguaacggcugugggcuauucggaaaagguucauuacugacaugugcaaaauuuaaaugcguuacuaaauuggagggaaagauaguucaauaugagaaccugaaauauagcguuauuguaacugugcauacgggagaccaacaucaagucgguaacgaaacuacggaacauggaacuauagccacuauaacuccacaagcuccaacaucggagauucaacuaaccgauuacggugcucugacguuagacuguaguccccgaaccggucucgacuuuaacgaaaugguacuucuuacuaugaaagagaaaaguuggcuagugcauaaacaaugguuuuuagaccuuccuuugccuuggaccucgggagccaguacuucccaagaaaccuggaauagacaagaucuauuagugacauucaaaacggcccaugcgaagaaacaggaaguaguugucuuagggucccaggaaggugccaugcacacagcauugacaggcgcuacugaaauucagaccucugguacuaccaccaucuuugcaggccaucuaaaauguagauuaaaaauggacaaguugaccuuaaaaggaacgucauacgugauguguacaggaucguuuaaacuggagaaagaggucgccgaaacacaacauggaaccguuuuaguacaaguaaaguaugaagggacagaugcaccuugcaaaauacccuuuucaacccaggacgaaaaaggaguaacucaaaaugggagacuuauuacugcaaauccgaucguaacagauaaagaaaagccuguuaacauagaaacugaaccaccuuucggggagucguacaucguaguaggggcuggagaaaaagcauugaaacuuuccugguucaagaaaggauccaguauaggaaagauguucgaggcuacugcccgaggagcgcgcagaauggcaauuuugggagacacagcaugggacuuugguucuauaggugguguauuuacgucaguugguaaauugguucaucagguauucggaacagccuacggaguccuauucucugggguaucauggacaaugaaaauaggaauaggcauauuguugaccugguuagguuuaaauagcagaaguacaucgcuuaguaugacauguauagccguaggaauggucacucuauaccuagguguaauggugcaagcugauuccgguuguguaauuaacuggaaaggaagagaauuaaaaugcggaucaggcauuuucgucacuaaugagguacauacauggacggaacaauacaaauuucaagcggauucgccgaagcgauuaucggcggcgauagggaaagcaugggaagaaggugucugugggauucgaucagccacuagacuagagaacaucauguggaaacaaauuagcaaugaacugaaucauauacucuuggaaaaugauaugaaauuuacaguagucgucggagaugcuaacggaauacuugcacaggguaagaagaugauaagaccacaaccaauggagcacaaguacaguuggaaaaguuggggaaaagcuaaaauaauuggagccgauauacaaaauacaacuuuuaucauagacggcccugauacgccagaauguccagauaaucaacgugcuuggaacaucugggaaguagaggauuauggauuugguauauucacaacaaauauuugguugaaacuccgcgacucauauacucaaacaugcgaccaucgacuuaugucagcagcaauaaaagauucaaaagcagugcaugcagauauggguuauuggauagaaucggagaaaaaugaaacauggaaauuagcaagagcaucuuuuaucgaaguuaaaacguguacguggccaaaaagccacacuuuauggucuaaugggguuuuagaaucggagaugauaauaccaaaaauuuauggcggcccaauaagucaacauaacuaccgaccagguuauuuuacacaaacggcagggccguggcaccugggaaaacuagaauuagacuuugaucuaugcgaaggcacaacaguagucguagaugagcauuguggaaaucgagguccaucuuuaaggacgacaacaguaacuggcaagauaauacaugaauggugcugucgaucauguacuuugcccccgcuacgauuuagaggcgaagacggcugcugguacgguauggaaauacgaccgguuaaagaaaaagaagaaaauuuagugaggagcaugguaucagcuggaagcggugagguugauaguuucaguuuaggaauccuauguguuucuauuaugauagaggaaguuaugcgcagcagaugguccagaaaaauguuaaugacaggcacgcucgccguuuuucuacuucucguuaugggccaauuaacauggaacgaucuaauuaggcuuuguauuaugguaggcgcaaacgccagcgauagaauggggaugggcacaacguaccuugcccucauggcaacguucaaaaugagaccaauguuugcgguagggcuacuauuucgaaggcuaaccucacgagaaguccuccuacuuacaauuggauugucguugguagcuucaguagaauugcccaacucauuggaagaauuaggagauggccuugcaaugggcauaaugaugcuaaaauuacuaacggaauuucagccacaucaauuguggacaacacuccuuucuuuaacauuuaucaaaacaacacuaucauuagacuacgccuggaagacgacugcaauggcacucucaauugucagcuuauucccuuugugucuguccacuacaagucaaaagacuaccuggcuaccaguacuacuugggucauucggaugcaaaccuuuaacaauguuucuuauaacagaaaauaaaauauggggucgaaaaucuuggccgcuaaacgaagguaucauggcaaucgggaucguaaguauacuacuaagcucgcuccugaaaaaugaugugccacuagcagggccucucaucgccggaggaauguugauugcauguuacguuauuaguggcucauccgcagaucuaucacuagaaaaagcagcggaggugagcugggaacaagaagcagagcacucuggaacaucacauaauaucuuaguagaaguacaggacgauggaaccaugaaaauuaaagaugaggagcgagaugauaccuuaacaauccuauuaaaagcaacacuauuagcaguuaguggcguauauccaaugucaauaccagccacguuauucgugugguacuuuuggcagaagaagaaacaacguuccggagucuugugggacacaccuucaccucccgaaguagaacgagcuguccucgaugacgggauauaccguauccuacagagaggcuugcuggggaggucacagguugguguuggaguguuucaagauggagucuuucauacaauguggcauguuaccagaggcgcagugcugauguaucaaggaaaaagacuagaacccaguugggccagcguuaagaaagauuuaaucagcuauggaggggguuggagguuucaaggguccuggaacacgggagaagaaguacaaguuauagcuguagagccugguaaaaauccuaaaaauguacagacaacaccaggaacauuuaaaaccccagaaggcgaaguuggagccauagcacucgacuuuaaaccuggaaccagcggaaguccgauagugaaucgagaagguaaaaucguggggcuauauggcaacggaguaguaacgaccucuggcaccuaugucucugcaauugcacaagcaaaagcaucacaagaaggaccguuaccggaaauagaagaugagguauuuaagaaacggaaucuuaccaucauggaucugcacccaggcucuggaaaaacgagaagauaccuuccagcaauuguuagagaagcaaucaagagaaaauuaagaacgcuaauacuagcaccaacacgugugguugcgucugaaauggcggaggcuuuaaaaggaaugcccauuagauaucagacgacagcagucaaaucagagcauacagggcgugagauaguagacuugaugugucaugccacauucacaaugaggcuacuaucucccguacgcgugccgaauuauaacaugauaauuauggaugaagcgcauuucaccgauccugcuaguauagcggcaagagguuacauuaguacaagggucggaaugggagaggcagcagcaauauucaugacugcaacuccaccagguaguguggaagcauucccacaaucuaaugcugucauacaagacgaagaaagagauauuccagaacgaucauggaacucugguuaugacuggauaacagauuucccggguaaaacuguuugguucgugccaucuauuaaauccgguaacgauauagcgaacugcuuacgaaagaauggaaaaagaguaauacaguuauccagaaaaaccuuugauaccgaauaccagaaaacuaaaaauaacgacugggauuauguaguaacaacagauauuagcgagaugggugcuaacuuuagggcagacaggguaauagauccacgaagaugucuaaaaccugucauucucaaagauggcccagaacgggucauuuuagcagguccuaugcccguuacaguagcaagcgccgcucaaagaagagguagaaucggucgaaaucagaacaaggaaggagaucaauauguuuauauggggcagccccuaaauaaugaugaagaucaugcucacuggaccgaagcuaaaaugcugcuagacaauauuaacacaccggagggaauuauuccagcccuuuuugaaccugaacgggagaaaucugccgccauugacggagaauauaggcuuagaggugaagcuagaaagacauuugucgagcucaugagaagaggcgauuuaccuguuuggcuaucauauaaaguagcgucugaagguuuucaauauagcgacagaaggugguguuucgacggagaacguaauaaucaaguuuuagaagagaauauggauguugaaauuuggacuaaagaaggggagagaaagaaauugcgaccgcgguggcuugacgcgcgaaccuauucggauccucucgccuuacgggaauuuaaagaauuugcugcuggccgcaggucuguaucaggagacuuaauccuagagauuggcaaacuuccccaacauuuaacucuaagagcccaaaaugcuuuagauaauuuaguaaugcuacauaauucugaacaaggagggaaagcauauagacaugccauggaagaacuaccagauacaauagaaacauugaugcuucuugcacuuaucgcaguucuuacuggcggaguaacauuguucuuccucagugggaaaggacuugguaaaacaaguauuggauuauuauguguuacggcaaguucagcccuauuguggauggcaagcguggagccacauuggauugcggcuucaauuauucuugaguucuuucuaaugguauuguuaaucccugaaccugaucgccaaaggacuccccaagauaaccaguuagcuuauguugugauagguuugcuauuuaugauauuaacuguggcugccaacgaaaugggucuucucgaaacaacuaagaaagaucuugggauaggucacgucgcugccgaaaaucaucaacaugcgacaauguuagacguagacuuaagacccgccucugcauggacacuuuaugccguugcaacgaccguaauaacccccaugaugcgucauacaauagaaaacacuacugccaacauaagccuaaccgcuauagccaaccaagcagcaaucuugaugggauuggacaaagguuggccaaucaguaaaauggauauaggcguaccccuccuggcccuaggaugcuacagucaaguuaacccccuaacccucacggccgcagugcucaugcugguggcacauuacgcgauaauaggaccugguuugcaagcaaaagccacaagagaagcucagaaacggacagcggcugggaucaugaaaaauccuacggucgaugguauuguagcuauugaccuagaucccgugguguaugaugcaaaguuugaaaaacaguugggacaaaucaugcuacuuauuuuauguaccagucaaauucuuuugaugaggacgacaugggcucugugcgaaucuauaacacuugcaacuggaccauuaacaaccuuaugggagggaucacccgggaaauuuuggaacacuaccauagcuguguccauggcuaacauauucagagggucguauuuagcgggcgcuggauuagcauuuucacuaaugaaaucauugggaggugggagacgcggaacuggagcucaaggggaaacgcugggugagaaauggaaaagacagcuaaaccaacuguccaagucagaauuuaauacguauaagagaucaggaauaauggaaguagaucgaagcgaagccaaggagggucucaagcgaggugaaacaacaaaacaugcagugucgcgagguacugcaaaacuacguugguuuguugagcgaaaucuaguaaaaccagaaggaaaaguuauagaucuugguuguggucguggagguuggucguauuauugugcuggacuaaagaaagugacugaagucaagggauauaccaaaggagguccaggccauggcgaaccaauaccucucgccacauaugguuggaaccuaguuaagcuccauaguggaaaagauguauucuuuaugccuccagaaaaaugcgauacuuuguuaugcgauauaggcgaaaguaguccaaaucccacuauagaagaagggagaacacuuagaguuuuaaaaaugguagagccaugguuacgaggaaaucaauucuguauuaagauuuugaacccauauaugccaagcgugguagaagccuuagaacagaugcaacgaaaacauggagguaugcuaguacgcaaccccuugucaagaaauucgacacaugaaauguacuggguuucuuguggaacgggaaauaucgucucggccguaaauaugacuucaagaaugcucuuaaaucgauuuacaauggcccaucguaagccgacguacgagagagauguugaccuuggcgcagguacgcgacacguagcaguugagccggaaguagcaaaucuugauauuauaggucagcgaaucgaaaacaucaaaaacgagcacaaaaguacuuggcauuaugaugaagauaacccuuauaaaacgugggcuuaucacggaucauaugaaguuaaaccuucugguucugccucaucaauggugaaugggguaguuagauuacuuaccaaaccuugggauguaauaccgaugguuacgcaaauagcaaugacugauacuacaccguucggacaacaaaggguguucaaggaaaagguagauacaaggacucccagagcaaaacgagguacuacgcaaauuauggaaguaacagccaaauggcuauggggcuuuuuaucacgaaauaagaaaccucguauaugcacacgagaggaguucacaagaaaaguaagaucaaaugcggcuauaggcgcaguuuucguugaugagaaucaauggaacuccgcaaaagaagcaguggaagaugaaagauuuugggaccuuguccauagagaaagagaauuacauaagcaaggaaagugcgccacguguguuuauaauaugaugggaaagagagagaagaaacuuggagaguuugguaaagcaaaaggaucacgggcaaucugguauaugugguugggugcaagauuuuuagaguuugaagcccuuggguucaugaaugaggaucacugguuuucgcgugaaaauucuuuaagcgguguggaaggugaaggauuacauaaacuagguuauauccuaagggauauuaguaaaauuccagggggcaacauguacgcggaugauacagcgggaugggauacuagaaucaccgaagaugacuuacaaaaugaggcaaaaaucacagaaauaauggaaccagaacacgcuuuauuagccacuagcauauucaaacuaacuuaccaaaacaaaguagugagaguacaaaggccagccaaaaaugggacagucauggauguaauaagucgcagagaucagaggggaucgggucaaguagguacauauggcuugaauacauuuacgaauauggaaguccagcuaauuagacaaauggagagugaaggcauauuuuuaccgucagaacucgaaacaccaaaccuagcagagagaguccucgacuggcucgaaaaacauggagcagagagauugaagagaauggcgauaagcggggacgacuguguuguuaagccaaucgacgaccguuuugcaaccgcguuaaccgcauuaaaugauauggguaaaguaaggaaggacauuccucagugggaaccaaguaaagguuggaacgauuggcaacaaguuccguuuuguucacaccauuuucaucaauuaauaaugaaggauggacgagagauuguagugccuuguagaaaucaagaugaguugguuggacgcgcuagaguuucgcaaggugcaggauggucgcuuagagaaacagccugccuagguaaaucauacgcgcagauguggcagcuuauguauuuccacaggagagaucuacgucucgccgcuaaugcaauaugcagcgcuguuccaguugauuggguaccaaccucgaggacaacuuggucaauucaugcucaccaccaguggaugacgaccgaagacaugcuuaguguauggaauagaguauggauugaggagaauccauggauggaggacaaaacacacgugagcuccugggaggaaguuccauaccugggaaaacgagaagaccagugguguggaucccuaauuggcuuaacagcucgcgcaacuugggcuacaaauauacaaguagccauaaaccaaguaagacgacucaucggcaacgagaacuaucuugacuauaugacaucuaugaaaagauucaaaaaugaguccgauccagaaggcgcacuuugguaa

SEQ ID NO: 21241 - RNA, 9879 nt, Artificial Sequence
  derived and/or modified CDS sequence (opt6) from DENV-1__GU131968__SS-prME
ucaguuaccaugcuauuaauguuauugcccacugcgcuugcauuccaccuuaccacacgcggaggagaaccgcauaugauaguaucaaaacaagaaagaggaaaaagccuacuuuuuaaaaccagugcuggcgucaauauguguacuuuaauugcaauggacuuaggggaacuaugcgaagacacuaugacauauaaaugcccgcaaauaacugaagcugaaccugacgauguggauugcugguguaacgcaacugauacauggguaaccuacggaacuuguucccaaacgggagaacauaggagagacaaaaggaguguugcauuagcgccgcaugucgguuuaggucuagaaacccgaacagaaacauggauguccuccgaaggggcuuggaaacaaauacaaagggucgaaacaugggcgcuacgucacccuggauuuacagucauagcgcuauuucuagcacaugccauaggaacaaguauaacacaaaaaggcauaauuuuuauauuguugauguuaguaacacccuccauggccaugcguugcguaggaauagguaaccgugauuucguggaaggacuaucuggugcaacauggguagacguaguucucgaacacggauccuguguaacaacaauggcuaaaaauaaaccuacacuugauauugaauuacuuaaaacugaaguuaccaauccugcaauacuucguaagcuaugcauugaagcgaagauuaguaauacaacgacagauucacgaugcccaacucagggagaagccacacuuguggaagaacaagaugcuaacuuuguaugucgccgcaccuucguugauagagggugggguaacggauguggacuauucggaaaagggagcuuauugacaugugccaaauucaaauguguaacaaaacuggagggaaaaauaguacaguaugagaacuuaaaauauagcgucaucguaacaguucauaccggcgaccaacaccaaguaggaaacgaaaccacugaacauggaacuauagcuacaauaacaccgcaagcccccacaagugaaauucagcucaccgacuauggggcgcuaacgcucgacugcagcccucgaacaggguuggauuuuaaugaaaugguauuauugaccaugaaagaaaaaucaugguuaguccacaaacaaugguucuuagauuuaccuuuaccguggacgucuggggcaaguacaagucaagaaacguggaaccgucaggaucuauuagugacauuuaaaacagcucaugcgaagaaacaagaaguagucguauuaggaagucaagaaggagcaaugcacacggcauuaaccggcgcuacugaaauacaaacaagugggacuacaacuaucuuugcaggucauuugaaauguagacugaaaauggauaaacuaacauuaaaagguaccucauacguaaugugcacugguucguuuaaauuagaaaaagaaguugccgaaacucaacauggaacgguauuaguacaggucaaauacgaaggcacggaugcaccaugcaaaauucccuuuucaacccagaaugaaaaaggaguuacacagaauggaagacuaauaaccgccaaucccaucguaacagauaaagagaaaccaguaaacauagaaacugaaccucccuuuggggaaucauauauuguaguaggugcuggugaaaaggcguuaaaacuuucgugguucaaaaaggggagcucaauuggaaaaauguuugaggcaacggcacgaggcgcuaggagaauggcaauacuaggggacaccgcgugggauuucggcaguauuggggguguauucaccucugugggaaaauuagugcaccagguuuuugguacugcguacggaguguuauucucagguguuucguggacgaugaaaauugguauaggaaucuuauuaacuuggcucggacuaaauagccguagcacaucucuaaguaugacguguauugcaguggguaugguuacauuguauuuaggaguuaugguacaagcagauucuggcugcguuaucaacuggaaggggcgagaauuaaaguguggaagcgggaucuuuguuacuaaugagguacacacuuggacggaacaauauaaauuccaagcugauucgccgaaacgucugagcgcagcaaucgguaaagccugggaggaaggaguuugcggcauucguucggcuaccagauuagaaaauauaauguggaaacaaaucucgaacgaacuuaaucacauauuacuagaaaacgauaugaaauuuacaguuguaguaggcgacgcuaauggaauccuugcacaagggaaaaagaugauacguccucaaccuauggaacauaaauacucuuggaaaaguuggggaaaggcaaaaaucaucggugcagauauucagaauacuacauuuauuauugacggaccagauaccccagaguguccagauaaucaaagagcauggaauauaugggaagucgaagauuauggguuugguaucuuuacgacgaacauauggcugaaacuuagagacucuuauacucaaaugugugaccaucgcuuaaugucagcggcuauaaaagauaguaaagcugugcaugcugauaugggauacuggauagagagugagaaaaacgagacauggaaguuagaaagagcuaguuucauagaaguaaaaacguguaccuggccaaaaagucauacccuauggagcaauggaguccuagagucagagaugauaaucccgaagauauacggcggcccuauaucucaacauaacuauaggccuggauauuuuacacaaacagcaggaccauggcacuuagguaaauuagaauuagauuucgaucuuugugaaggaacaacaguaguaguggaugagcacugugguaaccguggcccaagucuaagaacgacuacagugacaggcaaaauuauacacgaaugguguugucgcagcuguacgcugcccccauuaagauuuagaggagaggacggguguugguauggcauggagauaagacccgucaaagaaaaagaggaaaauuuaguacgguccaugguaagugcggggucuggggaaguggauucauucaguuugggaauauuaugugcaaguaucaugauagaagaaguuaugagaucucgguggagucggaagaugcucaugacggggacucuagcuguguuuuugcuauugaucauggggcagcuuacuuggaaugaccuuauuagauugugcauaauggugggggcuaaugcaagugauagaauggguaugggaacuacauauuuagcccuuauggcuacuuucaaaaugcgaccgauguuugcgguugguuuacuuuuuagacgccucacuucucgggaagucuuauuauuaacuauuggauugagccuaguugcuucgguagaauuaccaaacagccuagaggaacuuggggauggauuagcaaugggaauaaugaugcugaaauuauugacagaguuucaaccacaccaguuguggacgacguuauuaucccugacauuuauuaaaacaacauuaucgcuggauuaugccuggaaaacgacggcaauggcgcuuucaauugucagucuauuuccacugugucucaguacuacgagccagaaaacaacuuggcuaccgguauuguugggaaguuuuggaugcaaaccucuuacuauguuccugauuacagaaaacaaaauauggggaagaaagaguuggccccuaaacgaagggauuauggcaauaggaauagucaguauauuacugucgagccuacucaaaaacgauguucccuuagcagguccacuaauugcgggugggaugcuuauagcauguuacguuauaucuggcaguucagcggacuuaucucuagaaaaagcggcagaaguaucaugggaacaagaagcugaacauuccggaacuagccauaauauucuaguggaaguucaagaugauggcaccaugaaaaucaaggacgaagaaagagacgacacucuuacaauauugcugaaagcaacuuuacuagcuguauccggaguauacccaaugucaauacccgcuacuuuauucguuugguacuuuuggcaaaaacgcaaacaaaggaguggcguauugugggacacuccuuccccaccugaaguggaaagggcgguacuggaugacggaauauauagaaucuuacaacguggucuguugggacguagucaaguaggaguaggaguuuuucaggacgguguguuccauacuauguggcauguaacacgaggugcuguauuaauguaccaagguaaacgauuagaacccagcugggcaagcgugaagaaagauuuaauuaguuaugguggaggguggcgguuucagggcaguuggaacacaggugaggaaguucaaguaaucgcgguugaaccugggaaaaacccuaaaaacguucagacaaccccagggacauuuaaaacuccugaaggcgaaguaggggcaauagcauuggauuucaaaccgggaacuucaggcucaccaauaguaaauagggaaggaaaaauuguaggguuauacgguaacggaguugucaccacuucagggacguauguuuccgccaucgcccaagcgaaggcuucgcaggaaggaccacuuccagagauugaagacgaaguauucaagaaacgaaauuugacaaucauggauuuacaucccggauccggaaagacucggcgauaccuccccgcaauuguucgagaagccauaaaaagaaaguugagaacacucauauuggcgccuacaagaguuguugcaagcgagauggcggaagcucugaaagguaugccaauaagauaucaaacuaccgcaguaaaaagcgaacacacuggucgggaaaucguugaucucaugugccacgcaacuuuuacuaugagacucuuaucucccguaagaguaccaaauuauaacaugauaauuauggaugaggcacauuuuacagauccagcaucuauugcugccagaggauauauaaguacacguguuggaaugggggaagcagccgcuauauucaugacagcgacaccgccaggaucuguagaggcuuuuccacaaucaaaugcgguaauacaggacgaagagagggauaucccugaaagaaguuggaacucaggcuaugacuggauaaccgauuuccccggaaagacagugugguuugugccuagcauaaaaagcgguaaugacauugcaaauugccuacguaagaauggcaaaagaguuauacaacuaucuagaaagacauucgauacggaauaucagaaaacgaagaauaaugauugggacuauguagucaccacagauauaucggaaaugggugcuaacuuuagggccgauagaguaaucgauccuagaaggugccuuaaaccaguaauauuaaaagacggucccgagagagucauauuagcuggacccaugccgguuacagucgcaucggcggcccaaaggcgugggcguaucggcagaaaucaaaacaaagaaggugaccaauauguauauaugggacaaccauuaaauaacgaugaggaucacgcucacuggacagaagcaaaaaugcuacuagacaauauuaauacaccggaaggcauuauaccagcucuauuugaaccagagcgagaaaaaucugcggcaauagacggagaauauagacucagaggcgaagccagaaagacguuuguagaauuaaugcggcgaggugaccuaccaguguggcucagcuacaaaguugcaagcgaaggauuucaauacucugacagaaggugguguuuugauggugagaggaauaaucaaguauuggaagagaauauggauguagaaauauggacaaaagaaggugagcgaaagaaacuacgcccuagauggcucgaugcuagaacauauucagauccacucgcucuaagggaguucaaagaguucgcugccggacggagaucggucagcggugacuuaauacuggaaauaggaaaauuaccacaacaccuaacacuacgugcacaaaaugcauuagauaauuugguuaugcuccauaauagcgaacaaggggguaaggcuuacagacacgcuauggaagaauuacccgacaccaucgaaacuuugaugcuccuggcgcuuauagccguguuaacggguggugucacauuguuuuuccugaguggaaaaggauuagguaaaacaagcauagggcuauuguguguuacagccagcucagcccugcuauggauggcuucuguagagccccacuggauagcagcaucgaucaucuuagaguucuuccuuaugguucuauuaauuccggaaccugaccgccagcgaacuccucaagacaaucagcuugcuuaugucguuauaggauuacucuuuaugauauugacaguagcagcgaaugagaugggauuauuagaaacgacuaagaaagauuuggguauagggcauguugcugcagaaaaucaucaacacgcaacuaugcuagaugucgaucuuagaccagccucagcguggacucuguaugcgguagcaacuacaguaauuacucccaugaugcgacauacaauagagaacacuacugccaacauuucccugacagcgaucgcgaaccaggcagcaauucugaugggacucgauaaaggguggccuauuucaaaaauggauaucggcguaccacucuuagcucuuggguguuacucacaggugaauccgcuaacucuuaccgcggcaguucucauguugguugcacauuacgcaauaauaggcccaggauugcaagcaaaggcuacacgugaagcacagaaaaggacugccgcugggauuaugaaaaauccgacaguugauggaauaguagcuauugauuuagauccgguuguauaugacgcuaaauuugaaaaacaacuuggacagauuauguuacucauacuuugcaccagccaaaucuuacucaugcgaacaacuugggcccuaugugaaucaauaacacuugccacaggaccgcuaacuacgcuaugggaaggaucccccgguaaguuuuggaauaccaccauagcaguuucaauggcaaauauauuccgaggaucguaccuggcuggugcggguuuagcuuucucuuuaaugaaaaguuuagggggaggacgaaggggaacaggcgcucaaggagagacccuaggagaaaaguggaaacgacaguuaaaccaauuaucuaagagugaguuuaacacauacaaacgaucugggauuauggaaguagauagauccgaggcgaaagaagggcuaaaaagaggugaaacaacuaaacaugcuguaaguagaggaaccgccaaacuucguugguucguugaaagaaaucuaguaaaaccugaagguaaagugauagaccucggaugugguaggggaggguggucguauuacugugcaggucuaaagaaaguuacagaaguuaaaggauauacgaaaggagggccgggacacgaagaaccuauaccaauggcaacuuacgguuggaacuuagucaaauuacacucugguaaagauguguuuuucaugccuccggaaaaaugugauacauuauugugcgacauaggugaaaguucuccaaauccaaccauagaggaaggaaggacacugagaguacuuaaaaugguugaacccugguuacgcggaaaucaauuuugcaucaaaauauuaaauccauacaugccgucuguaguugaaacguuagaacaaaugcaacgcaaacauggaggaauguuaguacgaaauccauuaucuagaaauucaacacacgaaauguauuggguaaguugugguacaggaaauauaguaucagcaguuaauaugacuuccagaaugcuuuuaaaucgguucacaauggcacaccgaaaaccuacauuugaaagagacgucgauuugggugcagguacccgacauguugcgguagaaccugaaguagcaaauuuagacaucaucggucaacggauugagaacauuaaaaaugagcauaaaucgacuuggcacuacgaugaagacaauccuuauaaaaccugggccuaccacgggaguuacgaaguaaaaccgaguggaagcgcaucaagcauggugaauggugugguccgccuacuaaccaaaccaugggaugucauaccaauggugacgcaaauugccaugaccgacaccacaccauucgggcaacagcguguauucaaggaaaagguggauaccagaacaccgagagcgaaaagagggacaacgcaaauaauggaagugacugcgaaguggcuuuggggcuuuuugucuagaaauaagaaaccaagaauuugcaccagagaagaguucacacguaagguccguucaaaugcugcgauaggugcuguauuuguagaugaaaaccaguggaacucagcaaaagaggcgguugaagacgaacgguucugggaucuaguccacagggaacgagaauuacauaaacagggaaaaugugcgacaugugucuauaacaugaugggaaagagggagaagaaacugggagaguucggaaaagcaaaaggcucacgcgcaauuugguacauguggcuaggggcaagguuccuugaguucgaggcuuuggguuuuaugaacgaggaccacugguuuucacgagaaaauucucucucaggaguagaaggagaaggucuacauaaauugggcuauauucuacgggacaucaguaagauaccagggggaaacauguaugcggaugauacagcugggugggauacuagaauaacugaagaugacuugcagaacgaggcaaaaauaacugauauaauggagccggaacacgcccuacuagcgacuuccauauucaaacuuacuuaccaaaacaaagucguacgcgugcaaagaccugcaaagaauggcacagucauggaugucauuagcagacgagaucaacgggguucugggcagguagggacauauggacucaacacuuucacuaauauggaaguccaauuaauucgucaaauggagucagaaggaauauuucuaccuucugaguuagagacucccaaccuagcugaacgcguacucgauugguuagaaaaacacggugcggaaagacuaaagagaauggccaucucaggagaugauugugugguuaaaccaauagacgauagauucgcuacagcccugacugcacucaacgacaugggaaaaguucgcaaggauauaccacaaugggaaccaaguaaaggauggaacgauuggcaacaaguuccauuuugcagucaucacuuccaccaacugauaaugaaagaugguagagaaauagucgucccaugccgaaaucaggaugagcugguagggagggccaggguuucacagggagcagguugguccuuaagggaaaccgcuugccuaggaaaaagcuacgcccaaauguggcaacucauguacuuccauaggagagauuuaagguuagcugcuaacgccauauguagugcuguucccguagauuggguaccgacuucuagaacaacuuggucaauacaugcgcaucaucaauggaugacaacagaagacaugcuuucaguguggaauagaguauggauugaagaaaauccuuggauggaggacaaaacccacguaucgucuugggaagagguaccauaucuuggaaaacgagaggaccaauggugcggaucguugaucggauuaacagcacgcgccacaugggcaacuaauauucaaguugcaauaaaucaaguucgacgauugauaggaaaugaaaauuaucucgauuauaugacgucaaugaaacgauuuaagaacgaaucugauccugaaggugcauugugguaa

SEQ ID NO: 21242 - RNA, 9879 nt, Artificial Sequence
  derived and/or modified CDS sequence (opt6) from DENV-1__GQ868506__SS-prME
aguguaacgauguuauuaauguuauuaccaacagcccucgcuuuccauuuaacuacccgugguggggaaccucauaugauaguaucaaaacaagaaaggggaaaaucgcuccucuuuaaaacuucagccggaguaaacauguguacacucauagcuauggauuugggggaacucugugaagauaccaugacuuauaaauguccgcaaauaacugaagcugaaccggaugauguagauugcugguguaaugcuacagauacguggguaacauauggaacguguagccaaacaggagaacauagaagagauaaaagaagcguugcacuugccccucauguagggcugggacuagaaacccgcacagagaccuggaugucgagugaaggagcauggaaacaaauccaacgcguagaaacgugggcuuuaagacacccgggauucacuguaauagcauucuuucucgcccacgcgauaggaacaaguauuacccaaaaagggauaaucuuuauucucuuaaugcucguaacaccuucaauggcgaugcgcugcgugggaauagguaacagagauuucguugaaggucuaaguggagccacauggguagauguuguacuugaacaugguucuugcguaacgacuauggcuaaaaauaaaccaacacucgauaucgaauuacucaaaaccgagguuacaaacccggcuauauuaagaaaacucuguauagaggcaaaaauuagcaauacuacaacugauucacgauguccuacacaaggugaagcuacccuuguggaagaacaagaugcuaauuuuguaugccgccgaacauuuguagacagagguugggguaacggauguggacuauucgguaaaggaagccuacuaacgugugccaaauucaagugugucacgaaauuagagggaaaaauaguccaauaugagaaucuuaaauauucaguuauuguaaccguacauacuggagaucaacaucaaguagguaaugaaacaacggaacauggaacgaucgcuacaauaacaccccaggcuccaaccagugaaauacagcuaacagacuauggagcacuaacucuggauuguuccccgcgaaccggguuagacuucaacgaaaugguacuacuaacaaugaaggaaaagucuuggcuaguucauaaacaaugguuucuagaccucccuuuaccuuggacaucuggagcaaguaccucccaggaaacauggaaucgccaggauuuauuaguuaccuucaaaacugcacaugcuaagaaacaagaaguuguaguacuaggaucacaagagggagccaugcacacagcccuuacgggagccacagaaauccaaacgucaggaacaacaacuaucuucgcgggacacuugaagugcagacuuaaaauggauaagcugacgcucaaaggaacaucuuacguuauguguacggggucauucaagcuagaaaaagaggucgcggaaacucagcacggaacugucuuaguucaggugaaauaugagggaacggaugcucccuguaaaauaccguuuaguacacaagaugaaaaaggggucacgcaaaacgggagacuaauaaccgcgaauccuauaguuacagauaaggaaaagcccguuaacauagaaacagagccaccguucggagaaagcuauauaguaguuggagccggugagaaggcucuaaagcugucaugguuuaagaaagguuccucaaucgguaaaauguuugaagcaacggcaagaggugcgagacgaauggcuauccuuggugauacugcaugggauuucgguagcaucgguggaguguuuacaucuguugguaaauuaguucaccaagucuucggaacugcguaugguguauuauucucgggagucucguggaccaugaaaauaggaauaggcauucucuuaacguggcuaggacuuaacucacgaucuacuucuuugucaaugaccugcauagcaguuggcaugguuacauuauaccuuggugugaugguacaggccgauucuggauguguuauuaauuggaagggcagagaauuaaaaugcggcucugggauuuucguuacgaacgaaguccacaccuggacagaacaauacaaguuucaggcagauuccccgaaaagacugucugcagcuauagggaaggcaugggaagaagguguuuguggaauuagaucagcaacaagacuagaaaacaucauguggaaacaaauuuccaaugagcuaaaccacauauuacucgagaaugacaugaaauucacuguagucguuggagacgccaacggcauucucgcacagggcaagaaaaugaucagaccacagccaauggaacacaaauauucuuggaaaaguuggggaaaagcgaaaauaauuggggcggauauccaaaauacuacguucauuauagaugguccagauacaccagagugcccugauaaucagagagcguggaauauaugggaaguagaagauuacggcuucgguaucuucacaacgaauaucugguugaaauuacgugauaguuacacacaaaugugugaccaucgucuaaugucugccgcaauaaaagauaguaaggcagugcaugccgauaugggguauuggauugaaagcgagaaaaacgagacuuggaaguuagcaagagcuucuuuuauagaagugaagacaugcacuuggccaaaaagccauacccucuggaguaacggcguacuugaaagcgaaaugauaauaccgaagauauacgguggaccaauuucccaacacaacuaccgaccugguuacuucacucaaacagccgguccauggcaucuaggaaaauuagaauuagauuuugaccucugugaaggcacgacaguaguaguugaugaacacuguggcaaucguggcccuaguuuaagaacaacuacagugacuggaaaaaucauacaugaaugguguugccgauccuguacauugccgccuuuaagguucagaggugaagauggauguugguacggaauggaaauacggcccguaaaagaaaaggaagaaaacuuaguccgaucaauggugucugcaggcaguggugaaguagacagcuucucauuaggcauucuaugugucucaauuaugauagaggaaguaaugagguccagguggagcagaaagaugcucaugacagggacauuagcaguuuucuuguuguuggucaugggacagcuaacauggaacgaccuuauaagguuaugcauaaugguuggugcgaacgcaucagaccgcauggggauggguacaacauacuuagcacuuauggccacauuuaaaaugagaccgauguucgcgguaggauugcuuuuuagacgacucacaaguagagaaguuuuauuacuuacuauuggacuaucccuaguagcuagcguagaacuuccaaauucauuagaagaauugggggacggcuuagcaauggggaucaugauguuaaaacucuuaacagaauuucagccccaucaauuauggacaacucuguuaucacuaaccuucaucaaaacaacacuaucccuugacuaugcuuggaaaacaacggccauggcccuauccauaguaucguuauucccccuaugucuuucaacaacuagccagaagacaacauggcuaccuguacuauugggcucuuuuggaugcaagccccugacuauguuuuugauaacugaaaauaaaauuuggggaagaaaaucuuggccacuaaacgagggaauaauggcaauagggauagucucuauacuucugucgucacuauuaaagaacgauguaccacuggcaggaccacuaaucgcgggagguaugcuaaucgcuuguuauguuauaucgggaucuucugccgaucuaagucuggaaaaagcggcagaaguaucuugggaacaagaagcggagcacagcgguacaucccauaauauauuaguagaaguucaggacgauggcacuaugaaaauuaaggaugaagaaagagacgacacacuaacaauccuuuugaaagcgacuuuacuugccguaagcggaguguauccuaugaguauccccgcaacuuuauuuguaugguauuuuuggcagaagaagaaacaacguucugggguuuuaugggauacgccaagucccccagaagucgaaagggccguacuagacgaugggauauaucgaauuuuacaaaggggcuuacuuggaagaucgcaaguugguguugguguauuucaggacggaguauuccauacuauguggcauguaacacggggagcuguacuaauguaucaagguaaacgacuagaaccgaguugggcgagcgugaagaaagauuugauuucguacggugguggcuggagauuucaagggaguuggaacaccggagaagaaguacaaguuauagcuguagaaccggggaaaaaucccaaaaacgugcaaacaacuccagggaccuucaaaacccccgaaggagaaguaggggcaauagcuuuagacuucaaaccagguacauccggcucacccauaguuaaccgagaaggcaagauagucggccuauacggaaauggaguaguaaccacaaguggaaccuauguaucggcaauagcacaagcaaaagcgagucaagaaggcccucuaccagaaauugaggaugaaguauuuaagaaaagaaauuuaacuauaauggaucuccaccccggcucaggaaagaccagacgcuaucuaccggcuauugugcgugaagcuauaaaacgaaaauuaaggaccuugauccuagcuccuacaagaguaguagcuucagaaauggcagaagcauugaaagguaugccuaucagguaucaaacuaccgcaguaaagucagagcacacgggaagagagauugucgauuuaaugugucaugcaacuuuuaccaugcgacucuuaucucccgguaggguacccaauuauaauaugauaauaauggaugaagcgcacuuuacagacccagcaucuauagcggcacgaggcuauauuucaacucggguagguaugggagaagcagccgcaauauucaugacggccacaccaccgggaagcguugaggcguuuccacagucgaaugcagugauccaagaugaagaaagagacauuccagaaaggaguuggaacucagguuacgacuggauaaccgacuuuccuggaaagacagucugguucgugccaucuaucaaauccggaaacgauauugcaaauuguuuaaggaagaaugggaaaaggguuauacaauuaagcaggaagacguucgauacugaauaucagaaaacgaagaauaaugauugggauuacgugguaacgacagauauaucggaaaugggggcuaauuuuagggcggaucgaguaauagauccccguagaugccugaaaccaguaauucuaaaagacgggccagaaaggguaaucuuagcagguccgaugccgguuacuguagcuucggcagcccaaagacggggcagaauuggucgcaaccagaauaaagaaggagaucaauauguauauaugggucaaccucuaaauaaugaugaagaucaugcacauuggacagaagcaaaaaugcuccuagauaauauaaauaccccagaaggcauaauaccagcucuauuugaaccggagagggagaaaagugccgcuauugauggugaauacagacuacgaggugaagcucgaaaaacguuuguagaguuaaugagaagaggggacuuaccuguauggcuauccuauaaaguggcaucagaaggauuccaguauucagacagaagauggugcuucgacggugaacguaauaaucaaguacuagaagagaacauggacguagaaauauggacaaaagaaggagaaaggaagaaauuacgucccagauggcuggaugccagaacuuauucugauccgcuggcacucagagaauuuaaagaauuugcagcaggacgaagaagcguaucgggagaccuaauucuugaaauuggcaaauugccacagcaucuaacucuaagagcucagaacgcucuagacaaccucguaaugcuacauaauucagaacaaggaggaaaggcuuacagacaugccauggaagaacuuccugauacgauagaaacccuuauguuauuagcacucauagcggugcucacaggaggcgucacguuauucuuuuugucaggaaaagguuugggcaagacuucgauaggauuauuauguguaacugcgagcagugcucuccucuggauggcaucaguugagccucauuggauagcagcuagcauuauuuuggaauuuuuccucaugguucucuugaucccagaaccugauaggcagagaacaccgcaagauaaccaacucgccuacguaguuauaggcuuauuauuuaugauuuuaaccguagcagcaaaugaaaugggacuucuagaaacaacuaaaaaggaccucgggauuggacauguugcggcggaaaaucaccaacaugcaacuauguuagacguagaucugcgcccagcgagugcauggacauuauacgcgguggcuacgacgguaauuacccccaugaugagacacaccauugagaacacuacugcaaauauuucuuugacagcuauagccaaccaagccgccaucuuaauggguuuggacaagggcuggccaauaucuaagauggauauugggguuccacuacuggcauugggaugcuauucucagguuaacccgcugacauuaacagcagcggugcuaaugcuaguugcacauuaugcaauaauagggccgggacuucaagcaaaagcaacuagagaagcucagaaaaggaccgcagcugguaucaugaaaaauccaacaguugacgguaucguggcaauugauuuggacccuguaguauaugacgcuaaauucgagaaacaguuaggacaaaucauguuacugauucuaugcaccagccaaauauuacugaugagaacaacuugggcacucugugaaucaauuacauuagcuacaggcccucuuacuacacuaugggagggaaguccuggcaaauuuuggaauacaacaauagcuguaucaauggcuaacaucuucaggggaucguauuuggcuggcgcuggucucgcauuuagccugaugaaaagccuaggagggggacgaaggggaacaggcgcacagggagaaacuuuaggugaaaaauggaaaaggcagcuuaaucaacuaaguaagucggaauuuaauacauauaaaagaagcgguauuauggaaguugaccguucagaagcaaaggaggguuuaaaacgcggugaaacuacaaaacaugcaguguccagaggcacagcaaaacuccguugguuuguugagcguaauuuaguaaaacccgaaggaaaagugauagacuuagguuguggacgaggaggauggaguuacuacugcgcaggacucaagaaaguaacagaggucaaaggauauaccaaagggggcccaggacacgaagaaccaauccccauggcaacuuacgguuggaaccuaguaaaguuacacucaggcaaagauguguucuuuaugccacccgaaaaaugugauacccuucuuugugauauuggugaaaguucacccaacccgacuauugaagaaggaaggaccuugcgaguuuugaagauggucgaaccuugguuacguggcaaccaauuuuguauaaaaauacucaacccguauaugccaaguguuguugaagcccuugaacaaaugcaaagaaaacaugggggaauguuagugagaaacccauuauccaggaacucgacucaugaaauguauuggguaucgugugguaccgguaauaucguuagugcgguaaacaugaccucacgaaugcucuuaaauagauuuacgauggcacacaggaaaccgacuuaugaaagagacguugaccugggggcaggaacaagacacguugcggucgaaccggaaguagcgaacuuagauauaauugggcaacggaucgagaacaucaaaaacgaacauaaaagcacauggcauuacgaugaggauaaucccuauaaaacuugggcguaucauggaucauaugaaguaaaaccaucaggaagugcaucaucgaugguaaauggaguaguaagauuacugacuaaaccuugggaugucauuccaaugguaacacaaaucgcuaugacugauacaacgccauuugggcagcaacgaguuuuuaaagaaaaggucgauacgagaacuccccgugccaaacgaggaacaacacaaauaauggaaguuacugcaaaauggcuuuggggguuucuuagcagaaauaagaaacccagaauuuguacuagagaggaguucacaaggaagguacguaguaaugcagcuauaggagcaguauuuguagacgaaaaucaguggaacagcgcuaaagaagcagucgaggacgagcguuuuugggaucuggugcacagagaaagagaacugcauaaacaaggaaagugugcaacgugcguauauaacaugauggguaaacgcgaaaagaaacucggggaguuuggaaaggcgaaaggcucaagagcaauaugguauauguggcuaggagcgagguuccuggaauuugaagcccuagguuucaugaaugaggaucacugguucaguagagaaaacucguugagcgggguagagggugagggcuugcacaaguugggauacauacuucgggacauaagcaaaauuccaggcggcaauauguaugcagaugacacugcuggaugggacacccgaauaacugaggaugaucuacaaaaugaagccaaaaucacggaaauaauggaaccagaacacgcauuauuggccaccuccauuuuuaaacugacguaccaaaauaagguuguuaggguucagagaccggccaagaauggcacaguuauggacguaauuucuagaagagaucagagaggaucgggacagguaggaacauacggacuaaacacauucacuaauauggaaguucaauuaauuagacaaauggaaagugaaggcauauuuuuaccuucugagcucgaaacaccuaaucuagcugaacgaguucuagauugguuagaaaaacacggagccgagcgucuuaaacgaauggccauuagcggugaugauuguguaguaaaaccaaucgacgaccgcuucgcaaccgcucucacagcuuuaaaugacauggguaaaguuagaaaagauauuccccaaugggaaccaucuaaaggauggaacgacuggcaacaaguaccuuucuguucucaucacuuucaccaacuaauaaugaaagauggaagggaaauuguuguuccaugccgaaaucaagaugagcuuguuggucgcgcaagaguaagucaaggugcuggguggagucuucgagaaaccgcuugucucgguaaaucuuaugcgcagauguggcaacuaauguacuuucaccgcagagauuuacgccucgcugcuaaugcuaucuguucggcaguuccugucgacuggguaccgacaucccgaacaacuuggucuauacacgcucaucaucaguggaugaccacggaagauaugcuauccguguggaauaggguauggauugaagaaaauccauggauggaggauaaaacccauguuucuaguugggaagaaguacccuacuuagguaaacgggaagaucaauggugcggaucauuaauugggcugacagcaagagcgaccugggcuacaaauauacaaguugcaauaaaccaaguuagacgccuuaucggaaaugaaaauuauuuggauuauaugacgucuaugaaaagauucaagaacgaaucagacccugaaggagcguuaugguaa

SEQ ID NO: 21243 - RNA, 9879 nt, Artificial Sequence
  derived and/or modified CDS sequence (opt6) from DENV-1__GQ868507__SS-prME
ucugugacaauguuauuaauguuacugcccacggcacuugccuuucauuugacgacgcgaggcggugaaccucauaugauagucuccaaacaagaaagagguaaaucauuacucuuuaaaacaucugcuggggucaauauguguacauugauagccauggauuuaggggaacuuugugaagauacaaugacauauaaaugcccucagauaacagaagcagaaccagaugauguugacuguuggugcaaugcaacugauacaugggugaccuauggaacauguucacaaaccggagagcacagacgcgauaaaagaaguguagcauuggcuccucauguaggguuaggcuuggagacccguaccgaaacauggauguccagugagggugcauggaaacaaauacagagaguagaaaccugggcacucagacaccccggcuuuacaguaauagcuuuauuccucgcacacgcaauaggcacgucaauaacucaaaaaggaauaauuuucauccuauugauguuggucacaccgaguauggcaaugagaugcgucggaauaggcaaucgcgacuuugucgaaggccuaucaggggcuacauggguagauguugucuuagaacaugguaguuguguuacaacaauggccaaaaauaaaccaacucuagauauugaauuauuaaaaacggagguuacaaacccagccauccuucgaaaauuauguauagaagccaaaauaucuaauacaacaacggacucacggugcccaacucaaggagaagcuacauuagucgaagaacaagacgcaaauuuuguuugucgaagaacguucguugauagaggauggggaaauggauguggccuauuuggaaaaggaucacugcucacuugcgcuaaauucaaauguguuaccaaacuagaaggcaaaaucguacaauacgaaaaucuaaaauauucuguaauaguuacaguacacacaggggaccaacaccaaguagguaacgaaacaacugagcaugguaccauagcaacuauaacuccgcaagcaccuacuucugaaauucaacuaaccgauuauggugcucuuacauuagacuguagcccacggacaggacuggauuucaacgagaugguucuccuaacuaugaaagaaaaaucuugguugguucauaaacaaugguuucuggauuuaccauuaccauggaccagcggcgcaucgacaucucaagaaacauggaauagacaagacuuauugguaacguucaaaaccgcacaugccaagaaacaggaaguuguuguccuaggaagucaagagggcgcaaugcauacagcuuuaaccggagcgacugagauucagacuagcgguacuacaacuauuuuugcgggccaccucaaaugucgcuuaaaaauggauaaauugacauugaagggcacgaguuauguuauguguacugggaguuuuaaauuagaaaaggaaguagccgagacgcaacacgguacugugcuuguacaggugaaguaugaagguacggacgcaccauguaaaauacccuucucaacacaggacgagaagggcguaacgcagaauggacgguugaucacagcuaauccaauuguuacggauaaggagaagccuguuaauauagaaacagagcccccuuuuggugagucguauaucguugugggugcaggagaaaaagccuuaaaacuauccugguucaagaaaggaucuucuauagguaaaauguuugaagccacugccagaggagcaaggagaauggcaauauugggagauacugcuugggauuucgggagcauaggcggcguauucacaucgguagggaaacuuguccaucaaguauuuggcacugcauauggcguucuauuuaguggaguuucguggacaaugaagauuggaauaggaauauuacuuacuugguugggacuaaauucacgcucaacaagccucagcaugacaugcaucgcuguagguaugguaaccuuguauuugggcguaaugguacaggcagauagcggguguguaauaaacuggaaagggagggaacuaaaaugcggaagugguaucuuugugacaaacgagguacauacguggacugagcaauauaaauuccaggcagacucuccaaaaagguugucagcggcuaucgggaaagccugggaagagggaguaugugggauuagaucagcaacaagguuggaaaacauaauguggaaacaaauaucgaaugaacuaaaccacauauuguuagaaaaugauaugaaauucacaguaguagugggugacgcuaauggcauacuugcacaaggaaagaaaaugaucaggccacagccuauggaacacaaauauuccuggaaaagcuggggcaaagcuaaaauaaucggugccgacauacaaaauacaacuuucauuauagacgguccugauacaccugaaugcccagauaaucaacgggcguggaauauaugggaaguggaagauuauggguuuggaaucuucacgaccaacauuugguugaaacuucgugauucauauacgcaaaugugcgaucauagacuuaugagcgcagcuaucaaagauucuaaagcaguacacgcugauauggguuauuggauagagagugagaaaaaugaaacguggaaacuagcaagagcgaguuucauugaagugaagacauguacguggccaaaaagucauacauuauggucaaauggaguucuagaaagcgaaaugauaauaccgaagauauacgggggcccaaucagccagcauaauuaucggccagguuauuucacacagacagcgggaccuuggcaccugggcaaacuagaacuugacuucgauuugugcgaaggaacuacaguaguuguggaugagcacugugguaauagaggaccgucacuaagaacgacaacgguaacggggaaaaucauacaugagugguguuguagaaguuguacuuugccaccccuaagauuuagaggagaagacggguguugguauggaauggaaauaaggccuguaaaagaaaaagaggaaaacuuaguuagauccaugguaagcgccggaaguggagaagucgacuccuuuucauuagguauccuaugcgcaucuauaaugauugaggagguuaugcguagucguuggagucgaaaaauguuaaugacagguacgcuagcagucuucuuacuuuugguaaugggacaauuaacguggaaugacuuaauacgauuauguauaaugguaggagcaaaugcaagugaccggaugggaaugggcacaacuuaucuagcacugauggcuacauuuaaaaugcgccccauguuugcuguuggguuauuauucaggcgguuaacaagucgugaaguacugcuauuaacaauuggcuuaagccuaguugcaucgguagaguugccaaauagucuugaagaacucggugaugguuuagcgaugggcauuaugaugcuaaaacugcuuacggaauuucaaccacaccaauuauggauaacuuuacucuccuugaccuuuauaaaaaccaccuugaguuuagauuacgcguggaaaacgacagccauggcacugucgauaguaucacuuuuuccguuaugcuuaaguacuacaagucagaaaacuacuuggcugccgguauuacucggcuccuuugguugcaaaccauugacaauguuccuuauaacggaaaacaaaauauggggacgcaaaagcuggccauuaaacgaaggaauaauggcuauugggauaguaucaauauuacuuucaucucucuugaaaaacgauguaccauuagcagguccucuaauugcgggcgggaugcuaauagcauguuauguuauaagcgggucauccgccgauuuaaguuuggagaaagcggcggaaguguccugggagcaagaggcugaacacucuggcaccagucacaacaucuugguagaaguacaggaugacggcacaaugaagauuaaagaugaggaaagagaugacacacuuacaauucuuuugaaagccacgcuauuagcagucaguggugucuacccaaugaguauaccggcaacucucuuugugugguauuuuuggcagaaaaagaaacaacgcaguggaguccuuugggauacacccucaccuccagaagucgagcgagcugugcuagaugauggaaucuaccggauacuacaaagaggauuauuaggaagaucgcagguuggaguaggaguauuccaagauggaguuuuucauacuauguggcauguaaccagaggugccgugcuuauguaucaagguaaacgccuagagcccagcugggcgagcgucaagaaagauuuaauaagcuacgggggagguuggagguuucaagguucauggaauacuggcgaggaaguacagguaauagcagucgaacccggcaaaaacccuaaaaauguucaaacgaugccuggaacauucaaaacuccagaaggagaagugggugcgauugccuuagacuucaaaccuggaaccagcggaagcccaauaguaaaucgcgaaggaaaaauagucggccuauaugguaacggcgugguaaccacgucugguacauacguuucugcuauagcacaagcaaaggcaagccaagaagggccgcugccagaaauugaagaugaggucuucaaaaagcgcaaccucacuauaauggaucuucauccagggucuggaaaaacucgcagguauuuaccagccaugguaagggaagcuaucaagcgaaaauugagaacauuaauacuagcacccacaagggucgucgcauccgaaauggcggaagcucuaaaagguaugccaauucgcuaccaaacaacagcuguuaaaagugaacauacuggucgcgaaaucguagaucugaugugucaugcuacuuuuacaaugagacuccuauccccuguuagaguaccaaacuacaacaugaucaucauggacgaagcacacuucacugacccagcuucaauugccgcucgaggauacauuucgacucgcguuggaaugggcgaagcagcugcaauuuuuaugacggcaaccccaccaggaucuguagaggccuuuccacagucaaaugcaguaauacaagaugaagagagagauaucccggaacguucuuggaacuccggguaugacuggaucacugauuuuccgggaaaaacgguaugguucgucccuucgauaaagaguggcaaugauaucgcaaacugcuugaggaaaaauggaaaaaggguaauacaacucucacgaaaaacuuuugacacggaguaucagaaaacuaagaacaacgauugggacuacguuguuacgacagauauauccgagaugggagcaaauuuccgcgccgacagggugauagacccgagacgaugccucaaaccaguaauacugaaagacggccccgaaagaguaauucucgcaggaccgaugcccguaacuguugcuagugcagcacagaggagggguaggauagguagaaaucaaaauaaagaaggugaucaauacgucuacauggggcaaccccugaauaaugacgaagaucaugcccacuggacagaagcuaaaauguuacuugauaauauaaauacuccagaaggaauuauuccggcccuauucgagccugagcgagagaaaagugcagcaauagacggggaauauagacugcgaggggaagcacggaagacuuuuguugaauugaugagacgaggagauuuaccuguuugguuaucauacaagguagcuuccgaaggauuucaauacucagaucgacgaugguguuuugacggugaaagaaacaaccaaguguuagaggaaaauauggauguugaaaucuggacaaaagaaggagagaggaagaaacuucguccgcgaugguuagaugcucguacguacucggauccacuugcauuacgugaauuuaaggaauuugcugcagguagaagaaguguuagcggugaucuuauacuagaaauagggaaacugccacaacaccuuacccuacgagcucagaaugcucuagauaaccucguuaugcuucacaacagcgagcaaggagggaaagcauauagacaugcgauggaagaacuaccagacaccauagagaccuuaaugcuauuagcucuaauagcugugcugacaggaggggucacacuauucuuuuuaagcgggaaaggauuaggaaagacgaguaucggauuguuaugugucacugcuaguuccgccuuacuuuggauggcaucuguggaaccccacuggauagcagcuucuauaauauuagaguucuuuuuaauggugcuauuaauaccugaaccggaucgccaaagaacaccucaggauaaccaacuggcauauguaguuaucggucuacuauucaugaucuuaacaguagcagcuaacgaaaugggacucuuagaaacaacuaagaaagauuuggguaucggccacguagcggcugaaaaucaccaacacgcaaccauguuagauguagacuuaagaccagccagcgcauggacgcuauaugcagucgcuacgacaguaauaacgccaaugaugcgacacacaauagaaaauacuaccgcgaacauauccuuaaccgccauugccaaucaagcugcaauacugaugggucuagacaaaggauggccaaucucaaaaauggauaucggaguuccucuguuagcauuaggauguuauucacaaguaaauccccugacauuaacagcagcaguguuaaugcucguagcucacuaugcaauaauugguccaggauuacaagcuaaagcuaccagagaagcccagaaaagaaccgcagcaggaauaaugaaaaauccaacuguugaugggauaguggcgauugauuuggaccccgugguuuacgacgcuaaauuugagaaacaguugggccagauaauguuacuaauauugugcacuucacaaauacuuuugaugcgaaccacaugggcacuuugugaaucuauuacucuugcaacaggaccccuaacaacucuuugggaagguucuccuggcaaguuuuggaauacgacuaucgcggucuccauggcaaacauuuuucgugguucauacuuagcaggggcuggcuuagcauuuucgcuaaugaaaagucucggaggugggcgaaggggaacgggugcucaaggggaaacccuuggugaaaaauggaagagacaacuuaaccaauuaucaaaaagugaguucaacacauacaagcgcagugguauaauggagguugauagaagcgaggccaaagaaggucuaaaacguggggaaaccacaaaacaugcaguuucacgugggacggcaaaacucagaugguucguggaacgcaaccuuguaaaaccugaggguaagguaauugaucuaggcuguggucgagggggcuggucauacuacugugcuggucucaagaaaguaacagaaguuaagggauauacuaaaggugguccgggucacgaggaaccaauaccaauggcgaccuacggauggaauuuaguuaaacuaccuagcggaaaggaugucuucuuuaugccgccagaaaaaugcgauacgcuacuaugcgauaucggugaaucgagcccaaacccaacgauugaagaaggucgaacguuaagaguguuaaaaaugguugaacccuggcugagaggaaaccaauuuugcauuaaaauuuuaaacccuuauaugccaaguguagucgaaacguuagaacaaaugcaaagaaaacaugggggcaugcucguccgaaacccacuuucacgaaacucaacccacgaaauguacuggguuaguugcgguacuggcaauaucguaagugcagucaauaugacaagucgaauguuauuaaacagauuuacuauggcucaccggaaaccaaccuaugaacgugacguagaucuaggggcaggcacaagacaugucgcugucgagccggagguagcuaaucuugauauuauaggacaaagaauagaaaauaucaaaaacgaacacaaaucaacauggcauuacgaugaagauaaucccuauaaaacaugggcauaccacgggucauacgaaguuaaaccaaguggaucagcuucgaguaugguuaauggugucguacggcucuugacgaaaccuugggauguaauaccaaugguuacucaaauagcaaugacugauacaacgccauuuggucaacaaagagucuuuaaagaaaaaguagauacaagaacacccagggccaaacgggguacuacacagauaauggaaguaaccgcgaaauggcuauggggauucuugucacgcaauaagaaaccgcgaauaugcacuagagaagaauuuacaagaaaaguuaggagcaaugcugcuaucggugcgguauuuguagaugaaaaccaauggaacagcgcgaaggaagccguugaggaugaaagauucugggaucuaguucauagggaaagagagcuacauaaacaagguaagugugcgacauguguauauaacaugauggguaaaagggagaaaaagcuaggagaauuugguaaagcuaaaggaagucgagcaauuugguauauguggcuuggagcgagauuuuuagaauuugaggcuuuaggauucaugaaugaagaucauugguucucacgggaaaauagucuaucugguguagaaggggaaggauuacauaaauuagguuacauccuacgggauauuagcaagauaccugggggcaacauguaugcagaugauacagccggcugggauacacgaauuacagaggaugaccugcagaaugaagcaaaaaucacagaaauaauggagccagaacaugcguuacuagccacaaguauauucaaauuaacguaucaaaacaaaguuguaagggugcaaagaccugcaaagaacggaacaguaauggaugucauaucgagaagagaucaaagggggaguggacagguagguacuuacgggcucaauacguuuacaaauauggaaguccaauuaauccgccaaauggagucugaaggaaucuuuuugccuucagagcuugaaacaccgaauuuggcagaaagaguuuuagauugguuggaaaaacauggagccgagagauuaaagagaauggcaauuaguggugacgauugcgucguuaagccuauagaugaucgguucgcaacggcauuaacggcauuaaaugauaugggcaaaguucgaaaagacauuccucaaugggaaccaucuaaaggguggaacgauuggcaacaagucccauuuugcagccaucacuuucaucaauugauaaugaaagacggccgagaaauagucgugccauguagaaaccaagacgaguuaguggguagagcucgcguaagucaaggggcaggguggagcuugagagaaacugccugcuuggguaagucguaugcucagauguggcagcugauguacuuccaccggcgcgauuuacgucuagccgccaaugcuaucuguucagccgugccaguggacuggguaccaaccagucgaacgacuuggucaauccacgcacaucaccaauggaugacuacugaagacauguuauccguauggaauagaguguggauagaggaaaacccauggauggaagauaaaacucauguuagcucuugggaagaaguuccguacuuaggaaagagagaggaccaauggugugguucuuuaaucggcuuaacggcacgagcaacaugggcaaccaacauucagguagcaaucaaucaaguacgccgucuaaucgggaacgaaaacuauuuagacuauaugacuagcaugaaaagauuuaaaaaugaaucggaccccgaaggugcuuugugguag

SEQ ID NO: 21244 - RNA, 9879 nt, Artificial Sequence
  derived and/or modified CDS sequence (opt6) from DENV-1__GQ868508__SS-prME
ucgguuacuauguuacuaauguuguuaccaacagcacuagcauuccauuuaacgacucgagguggugaaccacauaugauaguaucgaaacaagaacguggaaaaucgcuguuauuuaaaacaucggcgggcguaaacaugugcacucuaauugcuauggaucuaggcgaacugugugaggacacaaugaccuacaaauguccucaaauuaccgaggcugagccugaugauguagauuguugguguaaugcaacugauacuugggugacguacgggacaugcucucaaacaggugaacaccgacgagacaaacgaucuguugcucuagcaccacaugucgggcucggauuggaaacaagaacggagacauggaugaguagcgagggggcauggaaacaaauacagaggguagaaacaugggcgcuacgccauccuggauuuacugugauagcacuauuccuggcgcaugcgauaggaacaucgauuacucagaaaggaaucauauucauuuuauugaugcugguaacaccgucaauggcaaugagaugugugggaauuggcaacagagacuucgucgaaggucuaaguggcgcaacaugggucgauguuguccuagaacauggaucaugcgugacaacaauggcuaaaaauaaaccaacacuagauauugaauugcugaaaacagaaguaacaaaucccgcaauauugagaaaacuauguaucgaagcuaaaauuagcaauacaacaaccgauaguagauguccuacccaaggggaggcuacgcuugucgaagaacaagacgcaaauuuugucugucgacggacauuuguagauaggggauggggcaauggaugcggauuguuugggaaagggagcuuauuaacaugugcaaaauuuaaauguguaaccaaguuggaaggaaaaauaguucaauacgaaaacuugaaauacucgguaauaguuacgguucacacuggugaccaacaucagguggguaaugaaacuacugagcacggaaccauugcaacaauuacaccucaagccccgaccagcgagauucaauuaaccgauuacggagcccuaacacuagacuguucaccaagaaccggacuggacuucaaugaaaugguuuuauugacuaugaaggaaaagaguugguugguacacaaacaaugguuucuugaucugccucuccccuggacgucaggagcaucgacgucacaggagacguggaaucgacaagaccuauuagucacuuuuaaaacggcacaugcuaagaaacaagaggucguuguguuaggcagucaggaaggcgcaaugcauacggcacuuacaggcgcaacagaaauacaaacaagugggacgacaaccauuuuugcaggccaucuuaaaugccgauugaaaauggacaaacuaaccuuaaaaggaacuucuuauguaaugugcaccggaaguuuuaagcuagaaaaagaaguagcagaaacacaacauggaacugucuuggugcagguaaaauaugagggaacagacgcaccauguaagauuccuuucagcacacaagaugaaaaaggaguaacucaaaaugguaggcuaauaacggcuaauccaauaguuacagacaaggaaaaaccuguaaacauagaaacagaaccucccuuuggcgaaagcuauauuguaguaggggcgggagaaaaggcuuugaaacuaaguugguucaaaaagggaucaucaauuggaaagauguucgaagccacggcucguggggcuagacguauggcaauauuaggcgauacagcaugggacuuugguucuauugguggcguauuuacaagcgucggaaaauugguccaucaaguuuucgguaccgcguauggagucuuguuuaguggcguuaguuggacaaugaaaauuggaauaggaauccuucuaacguggcugggguugaauagucgaucgacguccuuaucaaugacaugcaucgcuguggguaugguaacucucuaucuaggggucaugguucaagcagacaguggaugcguaauuaauuggaagggccgcgaacucaagugcggcucaggcauuuucguaacgaaugaggugcauacauggacugagcaauauaaguuucaggcagauucuccaaaacgacuaagugccgcuauuggcaaggcuugggaagaaggaguuugcgggauucguucggccacaagacuugagaauauaauguggaaacaaauaaguaaugaacuaaaucacauauuacuagaaaacgacaugaaauucacggucguaguaggggacgcuaauggcauucuagcacaaggcaagaaaaugauucgaccucaaccuauggaacauaaauacucauggaaguccugggguaaggcuaaaauaauaggcgcugauauccaaaacaccacguucaucauagauggaccagauacaccagaauguccggauaaccaaagagcauggaacauaugggaaguugaagauuauggcuuuggaauauucacgacgaauauuugguuaaaacuacgcgacagcuauacacaaaugugcgaccacagauugaugagcgcagcaauuaaggauucaaaagcugugcacgcagacaugggauacuggauugaaucagagaaaaaugaaacuuggaaacuggcaagagcauccuucauagaaguaaagacaugcacauggcccaaaucacauacccuauggucgaacggaguauuagaaucugaaaugauaauuccaaaaauuuacggagggccaauuucccaacacaauuaucgucccggauacuuuacacagacugccggcccauggcauuuagggaaguuggaacuagacuuugauuuaugcgaagggacaacaguugucguggaugaacacugugguaaccgcggaccgucuuuaagaaccaccacaguaacggggaaaaucauacacgaguggugcugcagguccugcacucugccuccauuaagauuccggggugaagauggauguugguauggaauggaaauaagaccuguaaaagaaaaagaagaaaaucuggucaggucaauggucagugcaggguccggugaaguagacagcuuuucgcuagguauacuaugugcuucaauuaugauugaggaagugaugcguagucgguggucgcgaaaaauguuaaugacuggaaccuuagcgguuuuucuauuauuaguuaugggacaacuuacauggaaugauuugaucagauuaugcaucaugguaggcgcaaacgcuucugaccgcauggggaugggcacgacauauuuagcgcuaauggcaacauuuaaaaugcguccaauguucgccgucggacuguuguuucguagacuuaccuccagggaaguucuucuauugacgauuggauuaagucucgucgcaaguguagaguugccgaacucacuagaagaauuaggagacggauuagcuauggguauuaugaugcuaaaauuauugacggaguuccaaccacaccagcuauggaucacuuuguuaagucugacguuuauaaaaacgacacuaucacuagacuaugcguggaaaacaaccgcaauggcucuaucuaucguaucguuauucccacugugcuuaucgacaacgagucagaaaacgacaugguuaccagucuuacucgguagcuuuggauguaaaccacuuacaauguuucuaaucacagaaaauaaaauauggggucgaaaauccuggccacugaacgagggaauaauggcaaucggaauaguaagcauacuucuaaguagucuacucaaaaaugauguaccguuggcaggaccccuuauagccgguggcauguuaaucgcauguuacguaauaaguggaucuagugcagacuuaagccuagaaaaagcagcugaagugagcugggaacaagaagcagaacauucuggaacgagucauaauauacuuguagaaguucaagaugaugguaccaugaaaauaaaagaugaggagagagaugauacacucacaauuuuauuaaaagcuacguuacuggcagucucaggaguauauccuaugucaaucccugcaacucuauucguaugguacuuuuggcagaaaaagaaacaacgaaguggaguuuuaugggacacacccagucccccggagguagaaagagcuguucuugaugacggcauauauaggauuuuacagaggggccuucuaggacgaucacaaguggguguaggcguuuuccaggaugggguuuuccacacaauguggcacgugaccagaggugcagugcucauguaccaagguaaacgacuagaacccagcugggcaaguguuaaaaaggacuugauuucuuacggaggagguuggagauuccaggggaguuggaauacgggagaagaaguacagguaauagcgguagaacccgggaaaaaccccaaaaauguucaaacaaugccuggcacuuucaaaacaccugaaggagaaguaggagcgauugcauuagacuucaaaccuggaacuucgggaucaccuauagucaauagagaagguaaaaucgucggucuuuauggaaauggugucgucaccacgagcggcacuuacguuagugcuaucgcccaagcaaaggcuucgcaagaaggucccuugccagagauagaagacgaaguauucaagaaaaggaaccucacuauaauggaccuacacccgggaagcgguaaaacacguagauaccuaccagcuaugguuagagaggcgauaaaaagaaaacuacgaacacuaauccuggcaccaacacgaguaguagccagcgaaauggcugaggcuuuaaaagggaugccaauaagguaccaaacaacggcaguaaaaagugaacacacgggucgagaaauaguagaccuuaugugucaugcgacguuuacuaugagguuacuuucaccuguaaggguaccaaauuauaauaugauuaucauggacgaagcacacuuuacagauccggcgaguauugcagcacguggguauauuuccacacgcguuggaaugggggaagcagcugcuaucuucaugacugcuacuccucccgguucaguggaggcuuuuccacagucgaaugcaguuauacaagaugaagaacgagauauuccggaaagguccuggaauagugguuaugacuggauaacagauuuuccaggaaaaacagugugguuuguaccaucgauuaaaucagguaaugauaucgcaaauugcuuacguaaaaauggaaaaagaguaauccaacuaucgcggaaaaccuucgacacugaauaucagaaaacuaaaaacaaugauugggauuacguggugacaacugauauaucagaaaugggggcuaauuuuagggcagacagaguaauugauccacgaagaugucucaaaccagucauauugaaagaugguccagagcgaguaauacucgccgggccuaugccugugaccguagcuagcgcagcccaaagaagaggaagaaucggucggaaccaaaacaaagagggagaccaauacgucuauauggggcagccauuaaauaaugaugaagaucaugcgcauuggaccgaagcuaaaaugcuacuagauaacauuaauacuccugagggaaucauacccgcccuauuugagccagaaagagaaaaaucagcugcuauugauggugaauaucgauuaagaggagaggcaaggaaaacauuuguugaguugaugaggagaggagauuuacccguaugguuaucauacaaaguugcaucagaagguuuucaauacagugaccgacgcuggugcuucgauggggaaagaaacaaucagguacuagaagaaaauauggacguagaaauauggacaaaggaaggugaaaggaagaaacucaggccuagauggcucgaugcaagaacauauucagacccucuagcguuaagggaauuuaaagaguuugcagcaggaagaagguccgucuccggugaccuaauacucgagauugguaaauuaccucagcaucucacccugagggcucaaaaugcgcuggacaaucuaguaaugcuacauaauagugaacagggcgguaaggcguauaggcaugcuauggaagaacuaccugacacuauagaaaccuuaauguuacuggccuuaauagcaguucugacaggugguguuacauuauuuuucuuaucagguaagggauuaggaaaaacauccaucggcuuacuauguguaacggcauccucggccuugcuuuggauggcaucaguagaaccucauuggauagcugcaucaauaauuuuagaguucuuuuugaugguuuuacuaauaccagaacccgaucgccagaggacaccccaagauaaccaauuagcuuauguuguaauaggguuacuuuuuaugaucuuaacggucgcugcaaaugaaaugggauugcuugaaacaaccaagaaagaucugggaauaggccaugucgcagcagaaaaucaccaacaugcuacaaugcuagauguagaccuaagaccggcuagugcuuggacacuguaugcaguagcaacgacaguaaucacaccuaugaugcggcacaccauugaaaauaccacugcgaauauaagucuaacggcaauugcaaaucaggcugccauauuaaugggccuugacaagggcuggccuaucaguaaaauggauauaggaguacccuuauuggcccuaggauguuacucgcaagugaauccuuugacucuaaccgcggcaguacuuaugcugguagcacacuaugccauuauaggucccggacuucaagcaaaagcaacaagagaagcgcagaaaaggacagcagccggaaucaugaaaaacccaacaguugacgguauaguggcgauagaucuagauccaguagucuaugaugcaaaguucgagaagcagcuagggcaaaucaugcuccuaauuuugugcacuucucagauccuucuuaugagaacaacaugggcuuugugcgaaucuauaacauuagcgaccgguccucugacuacguuaugggaagguucaccggggaaauucuggaacacuacuauagcagucaguauggcaaacauauuccggggaucauauuuagcuggagcagguuuagcauuuucuuuaaugaaaucguuaggugguggcagaagggggacuggagcacaaggagaaacucuaggagaaaaauggaaaagacaauugaaccaacucucgaaaagcgaguucaauacuuacaaacgaucaggaauaauggaaguagaucgaucugaagcgaaggaaggcuuaaaacggggagaaacgacuaaacaugcaguaucaagagguacagcaaaacuuagaugguuuguugaaaggaaucuagugaaaccugaagguaaaguaaucgauuuaggcuguggacgcggaggauggucguauuacugcgcaggauugaagaaaguaacggaaguuaaaggcuacacuaaggguggucccggccacgaagaacccauacccauggcaacuuaugguuggaauuuggugaagcuacauagcggcaaagacguguucuuuaugccaccagagaagugugauacccuauuaugugacaucggagaaucgucaccaaaucccacgauagaagaaggacgaacuuuacgaguccugaaaaugguagagccaugguuacgggguaaucaauucugcaucaaaauauugaacccauacaugccgaguguuguagagacucuggagcaaaugcagcggaaacacgguggaaugcuuguuagaaacccccuaucacgcaacaguacgcaugagauguacuggguaagcuguggcacagguaacauugucucggcaguuaauaugacgagcaggaugcuauuaaacagguuuacaauggcacaucgaaaaccuacauaugaaagagacguagauuuaggagcaggaacgcgucauguagcuguagagccugaaguagccaauuuggauaucauaggccagcgcauagagaauauuaaaaacgaacacaaaucgacguggcauuaugaugaagauaauccuuauaaaacaugggcauaucauggaucauaugagguaaaaccaaguggaucagccaguucuauggugaauggagugguacgacuacuaacaaagccaugggacguaauuccuaugguaacgcagauagcgaugacagacacaacgccuuuuggccaacagaggguauuuaaagaaaaaguugauacuagaacuccacgagccaagcggggaacuacacagaucauggaagugacagcgaaauggcuuuggggauuuuugaguagaaauaagaaaccacggauuuguacaagagaggaauuuacuagaaaaguaagaaguaacgcugcaauuggagcuguuuuuguagacgaaaaccaauggaacucagcuaaagaagcgguggaagaugagcguuuuugggauuuaguucauagagaaagggaguuacauaagcaaggaaagugcgcgaccuguguauauaauaugaugggcaagagagagaagaaauuaggugaauuuggcaaagcaaaaggcaguagagcaauaugguauauguggcugggagcuagauuccuugaguuugaagcacuaggauuuaugaacgaagaccauugguucagccgugaaaacucuuuaaguggaguugaaggagaggggcugcacaaacuuggauauauacuuagggauauaucaaaaauuccgggaggaaacauguaugcugaugacacugcgggaugggacacuaggauaacagaagacgauuuacaaaaugaggccaaaauuacagaaauuauggaaccagaacaugcguuauuagcuacaucgauauuuaaguuaacguaccaaaacaaagugguacgcguucaaaggccggccaaaaacgggacaguuauggaugucaucucaaggagagaucagcgaggauccggacaaguugguacuuauggacuaaauacguucaccaauauggaagugcagcuuauuagacaaauggaaagcgaaggaauauuuuuaccgagugaacuggaaaccccgaaccucgcugaaagaguacuggacuggcuagagaagcauggagcugaaagauuaaaaagaauggcaauauccggagacgauugcgugguaaagccuauugacgaucgguuugcaaccgcauuaacugcguuaaaugacauggguaagguaagaaaagauauaccgcagugggaaccaagcaaaggguggaacgacuggcaacaagucccguuuugcucucaccacuuccaucaacugaucaugaaagacggaagagaaauaguaguucccugcagaaaccaagaugaauuaguggggagagccagggucucccaaggagcaggauggaguuuaagagagacugcaugcuuagggaaguccuacgcgcaaauguggcaauugauguauuuccauagacgcgaccuaaggcucgcagcuaacgcgauauguagugccguaccaguagauuggguccccaccagcagaacuacauggaguauacacgcacaucaucaguggaugaccacugaagauaugcugaguguguggaaucgcguguggauagaagaaaauccuuggauggaagauaaaacacauguuaguucaugggaggaaguacccuaccuggguaaacgugaagaccaauggugcggcucacucauaggguuaacagcucgugcgacaugggccacuaacauucaaguggcaauaaaucagguuagaagacuaaucgggaacgaaaauuauuuagauuacaugacuucuaugaaacgguuuaagaaugaauccgauccugaaggugcccuuugguaa

SEQ ID NO: 21245 - RNA, 9879 nt, Artificial Sequence
  derived and/or modified CDS sequence (opt6) from DENV-1__GQ868509__SS-prME
ucaguaacuauguuguugaugcuauugccaacagcgcuugcauuucauuuaacgacacgcggaggagaaccacauaugauuguaucaaaacaagaaaggggaaaaucauuacucuuuaaaacgucagccgguguaaacauguguacauugauagcuauggaccugggugaacugugugaagauacaaugacuuauaaaugcccacaaauaaccgaagcugaaccagaugacguggauugcuggugcaaugcgacugauacuuggguuacauauggaacauguucacagacuggagaacauaggcgagauaaaagaucaguagcucuugcgccccacguaggacucggacuggaaacacgcaccgaaacuuggauguccagugaaggugcuuggaagcaaauacaaaggguugaaacgugggcucuacgacauccuggauucacugucauugcacuauuuuuagcacaugcaaucggaacgucuauuacccagaaagguauaauauucauuuuacugaugcucguuacaccauccauggcaaugagaugcgugggaauuggaaauagagacuucgucgaaggacuuucgggagcgacuuggguagaugucguacuggaacacggaaguugcguaaccacuauggccaaaaacaaaccaaccuuggauauugaacuacuaaaaacggaaguaacaaauccagcaauuuuacgaaaacugugcaucgaggcgaaaauaucaaauacaacaacugacucaagaugcccuacacaaggugaagcgacuuuaguagaggaacaagacgcaaacuucguauguagacggacuuucguugaucgcggcugggggaauggguguggguuauuuggaaaagguagcuuauuaaccugugcaaaauuuaaaugcguaacuaaacuggaggguaaaauaguccaauaugaaaauuuaaaauacaguguaauaguaaccguacauacaggugaucaacaucaaguaggaaaugaaacuaccgaacaugggaccauugccacaauuacaccucaagcaccaacuucagaaauccaacucacugacuauggcgcauuaacacucgauugcagcccaagaaccggauuagacuucaacgaaaugguacuuuuaacaaugaaagagaaaagcugguugguacauaaacaaugguuccuagaucuaccguuacccuggaccagcggugcaaguacuagccaagagacauggaacagacaagaucucuuaguaaccuucaaaacagcgcaugccaagaaacaagaaguugucguacuuggcucacaagagggagcgaugcauacagcuuugacuggggccacagaaauacagaugaguggcacuacuacaauauucgcuggacaucucaaaugccgguuaaaaauggauaaacuaacacucaaaggcacgucauauguaaugugcaccggcucuuuuaaauuagaaaaagagguugccgaaacgcaacauggaacaguuuuaguccaaguaaaauaugaggguacggaugcacccuguaaaauccccuucagcacucaagacgaaaaaggagucacucaaaaugggagacuuaucaccgcaaauccaauagugacagauaaagagaaaccagucaauauugaaaccgaaccgccauuuggugaaucguacauagucguuggugcuggagaaaaggcacuaaaguuaagcugguuuaagaaaggaucuaguaucgggaagauguucgaagcaacugcccggggcgcgagacgaauggcuauauuaggagacacugcuugggacuucgggucaauaggugguguuuucacuucagugggaaaacucgugcaccaaguauucgguacggcauauggaguauuauuuucagggguauccuggaccaugaaaaucggaauugggauuuuacuaacauggcucggccugaauagccguucuaccucguugagcaugacauguauagcaguggggaugguuacgcucuauuuaggaguaaugguucaagcugacucugguugcguaauaaacuggaaaggcagagagcuaaaaugugguucgggaauauuuguaacaaacgaagugcauacauggaccgaacaauauaaauuccaggcugauucgcccaagaggcugucggccgccauaggcaaagcgugggaagagggaguaugcgggauaaggucagugacccgacuagaaaauauaauguggaaacaaauuagcaaugaauuaaaucacauauuauuggaaaacgacaugaaguucaccguaguggugggagacgcuaacgguauuuuagcucaaggaaagaaaaugauucgaccucaaccgauggaacacaaauacucguggaaaaguugggggaaagcuaaaauaauaggagcugacauucaaaacacaacuuuuauaauagauggaccagacacacccgagugcccagacaaucaacgcgcauggaacauaugggagguugaagacuacggcuuugguauauucacuacuaauauuugguugaaguuaagagacagcuauacgcagaugugugaccacagacucaugucagcagcaauaaaagauucaaaagcuguucaugcagauauggguuauuggauugaauccgagaaaaaugaaaccuggaaacuugcacgugcaucguucauagaagucaaaacauguacuuggccuaaaucccauacacuauggucaaauggugucuuagaaagcgagaugaucauucccaagaucuauggaggacccauuagccagcauaacuaccgaccagguuauuucacacaaacagcaggaccauggcacuuagggaaacuagaacucgauuuugacuugugugagggaacgacaguaguugucgaugaacacugugggaauagaggcccaucacuacgaacaacaacgguaacagggaaaauuauccaugaauggugcuguaggagcuguaccuuaccgccauuacgcuuuaggggagaagacggaugcugguacgguauggaaauaaggccggucaaggaaaaagaggagaaccugguuagaucaaugguaucagcaggauccggcgaaguagauaguuucucacuugguauacuaugugcuaguaucaugaucgaggaagucaugcguaguagaugguccagaaagaugcuaaugacaggaacacuggcaguguuucuauuacuuauuaugggccaauugacauggaacgaucuaauaagauuauguauaaugguaggagcaaacgcuucggauaggaugggaaugggaacuacguaccucgcucugauggccacauuuaagaugcgacccauguuugccguaggguuauuauuuaggagguuaacgaguagagaaguauuacuauugacaauaggucuuagcuugguugcuaguguugaacugccaaauucacuggaagaacuaggcgauggucuagcaaugggcauaaugauguuaaaacuuuuaacagaauuucaaccucaucaauuauggacaacgcuucuaucauuaacuuuuauaaaaacuacauuaucucuggacuaugcuuggaaaacuaccgcaauggcauuaaguauaguaagucuauucccuuuauguuugagcacaacaagucagaaaacgacguggcuacccguccugcuggguaguuuuggcugcaaaccccucacaauguucuuaaucacugaaaacaaaauauggggaaggaaaagcuggccccuuaaugaagguauuauggccauugguaucgucagcauacuauuaucaucacuccuuaaaaaugacgucccacucgcggguccguugauugcugguggcaugcucauugcguguuacguaauuucgggaagcucugcagauuuaucacuugaaaaggccgcugaagucaguugggaacaagaggccgagcacagcgguaccucacacaauauacuuguagaaguacaagacgauggaacuaugaagauaaaagacgaagaaagagaugacacacugacaaucuugcuaaaagcuacacuauuggcagugucaggugucuacccuaugaguauaccugcuacacuauuucuuugguauuuuuggcagaagaagaaacaaagaucugguguacuuugggacaccccuucuccaccagagguagaaagagcgguuuuagaugauggaauuuauagaauacuacagcgggggcugcucggaaggagucaaguaggaguaggugucuuucaagacggaguauuucacacuauguggcaugugacgagaggggcuguauugauguaucagggaaagagacuagaaccgaguugggccucggugaagaaagaccucauaucguaugguggugguuggagguuucagggcucuuggaacacaggagaagagguucaaguuauagccguagaaccugguaagaaucccaaaaacguacaaaccacaccagggacuuuuaaaacaccagaaggggagguaggagcuaucgcauuggauuuuaaaccaggcacgucaggcucuccaauaguaaaucgugaaggaaagauagugggcuuauaugggaacggcgucgucacaaccaguggaacauacguaucggcaauagcacaagcgaaagcaagucaagaagguccacuaccagagauagaagaugaaguuuuuaaaaagcgcaaucuuacgauaauggaucuacauccagguucaggcaaaacaagacgauauuuacccgcaauaguuagggaggcaauaaaacgcaaacuacgcacacuaauccuagcgccaacaagaguugucgcaagcgaaauggcugaagcacucaaggggaugccgauacgauaucaaacaacagcaguuaaaagcgaacacacgggacgugaaauugucgaucuuaugugccacgccacauuuaccaugcgcuuacuuucuccaguaaggguuccuaauuacaacaugauuauuauggacgaagcacacuuuacagacccggcuagcaucgcugcgagaggcuacauaagcacgcgaguuggaaugggcgaagcugcugccauuuucaugacggccacaccuccuggcucgguagaggcuuuuccacagagcaaugcggugauacaggacgaagaaagagauaucccugaacgcagcuggaacagcggguaugacuggauuacagauuuuccuggcaagacuguuugguucguaccuagcauuaaaaguggaaaugacauagcuaauugcuuaaggaaaaacgguaagaggguaauccaguuaagucguaagacguucgacacagaguaucagaaaacuaaaaauaaugacugggacuaugucgucaccacagauauuucugaaaugggugcaaauuuucgcgcggauagagucaucgacccaagaaggugucuaaaaccagugauacuuaaggaugggccagaaagaguuauuuuagcgggaccaaugccaguuacaguagcgucagcagcgcaacggagaggcagaauagguaggaaccagaauaaggaaggggaccaauacguuuauaugggacagccucuaaacaaugaugaagaucaugcucauuggaccgaagcuaaaauguugcuugauaacaucaauacaccagagggaauaauaccugcucuauuugaaccagaacgugaaaaaucagcugcuauagacggagaguauagacuacgaggggaagccagaaaaacauuuguagaauugaugcggcgaggugaucugccgguauggcucucauacaaaguugcauccgagggauuccaauauucggaccgucgauggugcuucgacggagaaagaaauaaucaggugcuugaagaaaauauggacguagaaaucuggacuaaagaaggcgaacggaagaaacuuagaccacgauggcuugaugcacggaccuauucugacccauuggcgcuuagagaguucaaagaguucgcugccggaagaagaucgguaucuggcgauuugauacuggagauuggaaaauugccacaacaucuuacgcuacgugcacaaaaugcacucgacaaccuaguaauguuacauaacagugagcaagggggaaaagcauaucgacaugccauggaagaguuaccagauacaauugagacuuuaauguuguuggcuuugaucgcaguacugacaggaggugucaccuuauucuuccuuucggggaaaggguuagguaagacgaguauugguuugcucuguguuacagccucuucagcuuuauuauggauggcaaguguagaaccacacuggauagcugcuagcauaauccucgaguucuuucuaaugguacuuuugauaccugagcccgauagacagagaaccccgcaagauaaccaguuagcauacgugguuaucggacuacuauucaugauacugacuguugcagcaaaugagauggguuugcuggaaacaaccaagaaagaucuugguauaggucauguagccgcugaaaaccaccaacaugccaccaugcuagauguagaccuucggcccgcuagugcguggacucuauaugcgguugcaaccacagugaucacaccaaugaugcggcauacgauugagaauacaacagcaaacauuucauugacugcaauagcaaaucaggcugcaauucuaaugggcuuagauaagggguggccgaucaguaaaauggauauaggcguaccuuuauuggcacuaggauguuacucacagguuaacccacuaacgcuaacugcugcaguguuaaugcuuguggcgcauuacgcuaucauuggaccaggcuugcaggcaaaagcuacccgagaagcucaaaaacgaacugcugcagggauuaugaaaaacccaacagucgaugggauuguagccauagaucucgaucccguuguauacgaugcaaaauucgaaaaacagcucggacagaucauguuauugauauuaugcacaagucaaauccuccuaaugcgaacaacuugggcuuugugcgagagcauuacacuggcuacagggccauuaacaacauugugggagggaucaccuggaaaauuuuggaauacgacaauugcagugagcauggcuaauauuuuccgaggcucauacuuggcgggagcggggcuugcuuucagucuaaugaaaaguuuaggggguggccgacguggaacaggugcgcaaggagagaccuuaggcgagaaauggaaaagacaacuaaaccaauuaucaaagagugaauuuaauacauacaaaagaucaggaauuauggaggucgacagauccgaagcgaaagaagggcugaagagaggagaaacaaccaagcacgcagucucuaggggaacagcaaaacugagaugguuuguagaaaggaaccuuguuaaaccagaaggcaaaguaaucgaucuagggugugguagaggaggauggucauauuauugugcaggacucaagaaaguuacugaggucaaagguuauacgaaagggggaccaggucaugaagaaccgauucccauggcuacuuauggguggaaucuaguaaagcugcauagugguaaagauguauucuuuaugccgccagagaaaugugauacacuucuaugugacauaggagaaagcucaccaaacccgaccauagaggaggguagaacgcucaggguauuaaagauggucgaaccauggcugagaggaaaucaauuuugcaucaaaauuuuaaaucccuacaugccaaguguaguggagacccuggaacaaaugcaaagaaaacacggaggcauguugguaagaaauccucucucaagaaauuccacgcacgaaauguacugggugaguuguggaacgggaaacauagugucagccguaaauaugacgucuagaaugcucuugaaucgauuuacaauggcucaucgaaagccuacguuugaacgggacguagacuuaggugcaggcacucggcacguagcagucgaaccugaaguagcaaauuuggauauaauuggacaaagaaucgaaaauaucaaaaaugaacauaagaguacauggcauuaugaugaggacaacccuuauaaaacaugggcguaccauggaucuuaugaaguaaaacccuccggaucagcaucgagcaugguaaacggcguuguucgcuugcuaacaaaaccaugggauguaauuccaaugguaacucaaauagcaaugaccgauacuacucccuuuggccaacagcgugucuuuaaagaaaagguagauacacgaacgccacgggcuaaaagaggaacuacgcagauaauggaaguaacagcgaagugguuaugggguuucuuaucaagaaauaagaaaccaagaauauguacaagagaagaauuuacacgcaaaguuagaaguaacgcugcuauaggugcagucuuuguugacgaaaaucaauggaauagcgcuaaggaagcgguagaggaugaaagauuuugggaccuuguucaucgagaacgagagcuucacaaacaggggaaaugugcaacaugcguauacaauaugauggggaaacgcgagaagaaacuaggggaguucgguaaggcgaaaggaucacgagcaaucugguauaugugguuaggagcaagauucuuagaauuugaagccuuggguuucaugaacgaagaucacugguucucgagagaaaauucauuaagugguguugaaggugaaggacuacauaaacugggauacauauuacgggacauaucaaaaaucccuggaggaaacauguaugcugacgauaccgccggaugggauacaagaauuacggaagaugaucuacagaacgaagcaaagauaacagacauaauggagccggaacaugcuuuguuggccacgagcauauucaaacuuacuuaucagaauaaaguaguacggguccaaagaccggcuaagaacgggacaguaauggauguaauaucaagaagagaucagagagguaguggacaaguagggacguacggacuaaacacauuuacaaacauggaaguucaauuaauaagacagauggaaucugagggaauauuccuuccuuccgaauuagaaacgccaaauuuagcugaacggguacuagacugguuggaaaagcacggagcggaacgcuugaaacgaauggcaauaagcggugacgauugcguagucaaaccuauagaugaccgauuugcaacagcccucaccgcacuaaaugauauggguaaaguuagaaaagauauaccacagugggaacccaguaaggguuggaacgauuggcagcaaguuccuuucugcagccaccauuuucaucaguuaauaaugaaggauggucgugaaauugucguaccguguagaaaucaggacgagcuaguaggcagagcuagggucagucaaggagccgguuggaguuuacgggagacagccugcuuaggaaaauccuaugcccaaauguggcaacugauguacuuucauaggagggacuuaagacuagcggccaacgcaaucuguucugcugugccugucgacuggguuccaaccucacggacaacauggaguauacacgcacaucaucaauggaugacaacagaagauaugcuguccguauggaaccgggucuggauugaagagaauccauggauggaagacaagacacauguuucuaguugggaagaaguucccuaccuaggaaagcgagaagaucaauggugugguucucuaauugggcuaacggcucgugccaccugggccacaaacauccagguagcuaucaaucaaguucggagauugauagggaaugagaauuacuuagauuauaugacaaguaugaagagguuuaaaaaugagucagauccugagggugcguuaugguaa

SEQ ID NO: 21246 - RNA, 9879 nt, Artificial Sequence
  derived and/or modified CDS sequence (opt6) from DENV-1__GQ868510__SS-prME
ucaguaacuaugcuguugaugcuauugccaacagcacuagcauuucauuuaacaacucggggaggagaaccacauaugauaguaucuaaacaagaacguggcaaaucauuacuuuucaaaacaucugcuggaguuaauauguguacguuaauagcuauggaccuaggagaauuaugugaagauacaaugacuuauaaauguccacaaauaacugaagcagaaccugacgaugucgauuguugguguaacgccacggauacaugggugaccuacggaacaugcucucaaacagguggucauagaagagaaaaacgcucgguagccuuagcuccacauguaggguuagguuuagaaacacgcacggaaacauggaugucaagcgaaggcgcguggaaacaaauacaacggguugaaacaugggcgcugaggcauccuggcuucacuguuauagcuuuguucuuagcacaugcaaucggaacaaguauaacacaaaaaggcaucauuuucauacuauuaaugcuuguuacgccaucgauggcaaugcgauguguaggaauaggaaaccgagauuucguggaagguuuaucuggggcaacuuggguggaugucguauuggaacacggcagcuguguuacuacuauggcuaaaaauaaaccaacguuggauaucgaacuauuaaaaaccgaagucaccaauccugcaauacuaaggaaauuaugcaucgaagcaaaaauaagcaauacaacgacagacucucgauguccgacgcaaggugaagcaacuuugguugaagaacaagacgcaaauuucgugugucgcagaaccuuuguugauagaggauggggcaauggguguggguuauuuggcaaaggaagccuucugacaugugcgaaauucaaaugcguaacuaaacuagaagguaaaaucguucaauaugagaauuuaaaauauagugucauuguaaccguccauacuggagaucaacaucaaguaggaaaugaaacaaccgaacacggcacuauagcaacaauuacuccacaagcaccaacgagcgaaauacaauugacggauuauggagcucuaacacuugauuguagcccucgaaccggacuagacuuuaaugaaaugguguugcuuaccaugaaggagaaaagcuggcuaguccauaagcaaugguuuuuagaccuacccuuaccuuggacaucuggggcgaguacaagucaagaaaccuggaaucgucaagauuugcuuguuacauucaaaacugcacacgcuaagaaacaagagguaguaguuuuagggucccaggaaggggccaugcauacagcuuuaacgggggcaacggaaauccaaacuuccggcacgacgacuauauuugccggccauuuaaaaugccgcuugaaaauggacaaacugacacuaaaaggaacgucuuauguuaugugcacaggaucuuucaaacuagaaaaagagguugcagaaacgcaacacggcacagucuugguucaaguaaaauaugaaggaacugacgcaccgugcaaaauaccauuuuccacgcaggaugagaaaggcguaacacaaaauggucgauuaauuacagccaauccuaucguaaccgauaaagaaaaaccgguuaacauagagacggaacccccauucggagagucauauaucguaguaggugcuggagaaaaagcucuaaaauuaagcugguucaagaaagggucuucaauagguaaaauguucgaagcuacggcucgcggagcuagacguauggcgauucuaggcgauacagcaugggauuuugguucaauaggcggcgucuuuacaaguguaggaaaacuuguacaucaggucuucggaaccgcauauggcgucuuauuuagcggugugagcuggaccaugaagauugggaucggcauucuacuaacauggcuuggacuaaacagccgcagcacaucccucucuaugacuuguauagcgguaggaaugguaacguuguaucucgguguuauggugcaggcugacucaggaugugucaucaacuggaaggggcgagaacuuaaguguggcuccgguauauuuguaacgaacgaaguacacaccuggacugagcaguacaaauuccaagcggauucucccaaaagacuuucugcagcuauagguaaggcuugggaagagggaguaugcggaauacgauccgcuacacgauuagaaaauaucauguggaaacaaauaagcaaugaauugaaccauauacuauuagagaacgauaugaaauucacaguaguugucggcgacgcaaacggcauuuuagcacaaggcaagaaaaugauaaggccacaaccuauggaacauaaauacagcuggaaauccuggggaaaggcaaagauaauaggagccgauauacaaaauacuaccuuuauaauugauggaccagauaccccugaaugcccagauauucaaagagcuuggaauaucugggagguggaagacuaugguuuugguauuuucacgacuaacauaugguuaaagcuaagagauucguauacccaaaugugugaccauagacuaaugucugcugcgauuaaggacaguaaagcaguucacgccgauaugggauauuggauugaaagugaaaagaaugaaacauggaaacuggcaagggcuucguucauagaaguuaagaccugcacuuggccaaaaucacauacgcuuuggucgaauggcguucuugaaagugagaugauaauuccuaaaauuuauggaggcccaaucagccaacauaacuauaggccgggauacuucacgcaaacggcuggucccuggcauuuaggaaaauuggaauuggauuucgaucuaugcgaagguacgaccguugucgucgacgaacacugcggaaaucgggguccuagcuuacgaaccacgacaguuacaggcaaaauuauccaugaaugguguuguagaaguuguacauuaccgccauuaagguuccguggggaggauggaugcugguacggcauggaaauuagaccaguuaaggaaaaagaagaaaauuuaguaaggaguaugguaucugcagguucuggagaggucgacaguuuuagcuuaggcauccuaugugcuucaauaaugauugaagaaguaaugagaagucgauggucucguaaaauguuaaugacagguacauuggcaguguuucuauuauuaauaaugggccaauuaacauggaaagacuuaauaagauuauguaucaugguaggagcuaaugcgucagacagaauggguauggggacaacguaccuggcacuuauggccacauuuaaaaugagaccaauguucgccgucgggcuguuauuccguagauuaacaaguagggagguacugcuauuaaccauaggacuaucucugguugcuaguguagaauuaccuaacagucuagaagaauugggagauggacuagcaaugggaauaaugaugcucaaauuauugacggaguuccagccucaucaauuauggacgaccuugcucagcuugacuuuuauuaaaacaacacugagucucgacuaugcuuggaagacgacggcaauggcucuuucuauaguuucccucuucccuuugugccuaaguaccacaucacaaaagaccacuugguugccagugcuucuuggcucucuagguuguaaaccacucaccauguuucuaauaacggagaauaaaauaugggggcguaagagcuggccucugaaugaagggauaauggcaauaggcauuguuaguauacuauugaguucuuugcucaaaaacgacguuccacuagcaggcccucucauagccggugguaugcucauugccuguuaugucauuagugguuccuccgccgacuugucccuggaaaaagccgcagaagugagcugggaacaggaggccgagcauuccggaacaagucacaauauccuaguagagguacaggacgaugguacuaugaaaauuaaagaugaagaacgugacgacacacuaaccauacuguuaaaagcgacuuuauuagcaguaaguggaguauacccaaugaguauuccugccacuuuauuugucugguacuucuggcaaaagaagaaacaaagaucagggguucucugggauacaccaucaccaccagagguagagagagcuguguuagaugaugguauuuacagaauacuacaaagagguuuauuagggcgaucacaaguuggggucgggguuuuucaagacgguguauuccauacaauguggcauguaacucgaggagccguguugauguaccaaggaaagagauuggaaccuuccugggcuaguguuaagaaagauuuaauauccuauggagggggauggagguuucaaggcaguuggaauaccggggaggaagugcaaguaaucgcaguugagcccgggaaaaaccccaaaaauguacaaacaacuccgggaacauucaaaacgccagagggagaaguuggagcaauagcauuagacuuuaaaccuggcacaucagguucgcccauugucaauagagaagggaagauugucggacuuuacggcaaugggguaguaacaacgagugguacuuauguaagugcaauagcacaagcaaaagccucacaggagggaccauuacccgaaaucgaagaugaaguauuuaagaaacgcaaucuaacaauaauggaccuucacccaggaagcgggaaaacaagacguuauuugcccgcaauaguaagagaggcuauaaaacgaaaacuuaggaccuugaucuuagccccuacacgagucguagcuucagaaauggccgaagcauugaaaggaaugcccauuagauaucaaacaacugcaguaaagucggaacacacugguagggaaauaguugacuuaaugugccaugcaaccuuuacuaugagguuacuuucaccagugcgaguccccaacuauaauaugaucauaauggaugaggcacauuuuacggauccagcaucgaucgcagcuagaggauauauaaguacaagaguuggaaugggagaggcagcagcgauauuuaugacagcgacaccaccggguucagucgaagcauucccacaguccaacgcuguuauccaagacgaagaaagagauauaccggagcgaaguuggaacagcggauacgauuggauuacagacuuuccuggcaaaacagugugguuuguuccaagcauaaaauccgguaaugauauugcaaauuguuuaaggaaaaauggaaaaagaguaauucaguugucgagaaaaacauucgauacugaauaccagaaaaccaaaaauaacgacugggauuacgugguaacuacagauauaagcgaaaugggcgcaaacuucagagcugauagagugaucgauccuagacguugccuaaagccgguuauacuuaaagauggaccagagagaguaauacuagcaggaccuaugccagugacagucgcuuccgccgcucagagacgagguaggauagggaggaaccagaauaaagaaggagaucaguauguuuauaugggacaacccuuaaacaaugacgaagaucacgcacacuggacugaggcuaaaaugcuucuggauaauauuaauaccccagagggaauuaucccagcguuauuugaacccgaacgugagaaaagcgcugccauugauggagaauaucgcuuacgaggagaagcccgaaaaaccuuuguggaacuaaugcgacgaggagaccugcccguuugguuaucauacaagguagcgagugaaggguuucaauacucugauagacguuggugcuuugacggugaaagaaacaaucaagucuuggaagaaaacauggaugucgaaauuuggacgaaagaaggcgaacgaaagaaacuacgaccaagauggcuugaugcaagaacguacagcgaucccuuggcauugcgagaauuuaaagaguucgccgccgggaggagaucggucucuggugaucuaauauuagaaauaggaaaacuaccacaacauuuaacguugcgcgcacaaaacgcacuagauaauuuaguaauguuacauaacucugaacaaggaggaaaggcuuaucgucaugcaauggaagaauuaccggacacaauagagacauuaauguuguuagcgcuaaucgcaguucuaacuggcggcguaacauuauucuuucuaaguggaaaaggauuaggaaaaacaaguauagguuugcuaugugucacagcaaguucagcacuauuguggauggcgucgguagaaccacacuggauugcggcaucuaucauucuugaguuuuucuuaaugguguugcuaauaccagaacccgauagacaacggacaccacaggacaaccaacucgcuuacgucguaauaggacuuuuauuuaugauucuaaccguugcagcuaacgaaaugggacuauuggaaacaaccaagaaagauuuaggcaucggucaugucgccgcggaaaaucaccaacacgcuaccauguuagacguagaucuacgaccagcaagcgccuggacauuauaugcgguugcaaccacugucauuacuccuaugaugaggcauacuauugaaaacacaacagcaaacauuucauuaacugcaauagcuaaucaggccgcaaucuuaaugggucuagacaaaggauggccaauuaguaaaauggauauaggcguaccucuauuagcauuggggugcuacucacaagugaacccucucacacugaccgcggcuguauuaauguuaguggcccacuacgcuauaaucggaccaggccuccaggcuaaagcaacacgggaggcccaaaaacggacggcugcagguaucaugaaaaauccaacugucgacggcauuguagcaauugauuuggauccuguuguuuaugacgcgaaauuugaaaaacaacuaggccagaucaugcuuuuaauacuaugcaccucucaaauauuacuuaugaggaccaccugggccuuaugugaaucaauaacccuagcaaccgguccacuuacaacacuaugggaagguucgccggguaaauuuuggaauacaacgauagcaguaucaauggccaauaucuuccgcggaucguacuuagcaggagccgguuuggcauucucauuaaugaaaucucucgguggugggagacgaggaacgggugcgcagggcgagacuuugggggagaaauggaaacggcaacugaaccaguuaaguaaaucugaguuuaauacauacaaacgguccgguauaauggaaguugauagaagugaggcuaaagagggacugaaacggggagaaacaacuaaacacgcaguaucacgaggaacagcuaagcugcggugguucguugaacgaaaucuagucaaaccagaagguaaagugaucgaucucggaugcggccgcggugguuggaguuacuauugcgcgggacugaagaaagugacagaaguaaaaggcuacacaaaaggggguccaggacaugaagaaccgaucccuauggccacguauggauggaacuuaguuaaacuacacagcgggaaggauguguucuuuaugccgccugagaaaugcgauacacucuugugcgauauaggcgaaagcucgccaaacccaacuauugaagaaggacgcacauuacggguauuaaagauggucgaaccaugguugagaggaaaucaguuuuguauuaagauauugaauccauauaugccguccguaguugaaacuuuagaacaaaugcagagaaaacauggaggaauguuaguuagaaauccgcuaucacggaauaguacacacgaaauguauugggucucaugcggaacggguaauauuguaucugcaguuaauaugacaucaagaauguuauuaaaucgauucacaauggcucaucgcaaaccaacuuaugaaagggacguugaucuuggugcuggaaccaggcauguggcgguagaaccagaaguagcaaaccuugauauaaucgggcaacgaauugaaaauaucaaaaaugagcacaagucaacauggcauuaugacgaagauaauccauacaaaacuugggcauaccaugggagcuacgaaguuaagccaucugggucugcaucgucaauggugaacggcguaguccggcuauuaacaaaaccaugggacguuauaccuaugguuacacagaucgcuaugacagacaccacgccauuuggccagcagagaguguuuaaagaaaagguugauaccagaacaccaagagcaaaacgaggaaccacccaaauaauggagguaacagcaaaguggcuuuggggcuuucuaagccggaauaagaaaccucgaaucuguaccagggaagaguucacgagaaaggugcgauccaaugcggcuauaggugcuguguucguagacgaaaaccaauggaacagugccaaagaggcaguugaagaugaacgguuuugggaucucguccacagggaacgagagcuacacaagcaaggaaaaugugcgacguguguauacaacaugaugggaaaacgugagaagaaacuaggagaguucggcaaagcgaaaggaucucgcgcuauuugguauaugugguuaggagcgagguucuuagaauuugaagcucugggauuuaugaaugaagaccacugguucucaagagaaaacucccuuucagguguagagggugaaggauuacauaaauuaggauacauuuugagggacauaaguaaaaucccuggcggcaauauguacgcagacgauacggcuggcugggauaccagaauuacagaggaugauuugcaaaaugaagccaagauaacagacauaauggagccagaacaugcacuccuagcaaccucaauauucaaacuuacguaccaaaauaaaguggucaggguacagcguccagcgaaaaauggaacuguuauggauguaauaagcagaagggaccaacgcggcuccgggcaaguggguacuuacgguuuaaauacauuuaccaacauggaaguacaguuaauacggcaaauggagagcgaagguauauuucuaccaagugaauuagaaacgccuaauuuggcagaaagagucuuagauugguuaggaaaacacggcgccgaacgccuuaaacgaauggccauuagcggagaugauugcguuguuaaaccaauugacgauagauuugcaacagcucugacugcucuuaaugauaugggaaaaguuagaaaagauauuccucaaugggaaccauccaaaggcuggaaugacuggcagcaaguaccuuuuuguucacaucauuuucaucaacuaaucaugaaggauggaagagagauaguugugccaugcagaaaccaggacgaacuuguuggaagggcgaggguaucccaaggugcaggcuggucccucagagaaacagcgugcuugggaaaaucauaugcgcaaauguggcaacugauguacuuucaucguagggaucucagacuagcagcaaacgcaauaugcucugcagucccuguagauuggguuccaacgucucggacaacaugguccauccacgcucaucaccaauggaugacaaccgaagauaugcugaguguuuggaauagaguuuggauugaggaaaacccauggauggaagauaaaacacauguuagcuccugggaggaaguaccauaucuuggaaaacgggaggaucagugguguggaucauuaauagggcuuacagcgcgagccacaugggcaacuaauauccaaguugcgauaaaccaaguaagaagauuaauuggaaaugaaaauuaucuugauuacaugacauccaugaaacgguucaagaaugaaagcgauccugagggggcacugugguaa

SEQ ID NO: 21247 - RNA, 9879 nt, Artificial Sequence
  derived and/or modified CDS sequence (opt6) from DENV-1__GQ868511__SS-prME
ucaguaacuauguuacuaauguuguuacccacagcccuggcuuuccaccugaccacacguggaggagaaccacauaugauaguaucuaaacaagaaagaggaaaaucacuacuuuuuaaaacuucagcaggagucaacauguguacgcuuauagccauggacuugggugaauugugugaagauacaaugacuuauaaauguccacaaauuacagaagcugaaccugacgaugucgauuguuggugcaaugcuacugacacuuggguaaccuaugggacauguagccaaacaggagaacacaggagagacaaacgcucugucgcgcuagcgccucaugugggacuaggacuugaaacaaggacugaaacauggaugagcucggaaggugccuggaaacaaauacaaaggguggaaacuugggcgcugagacacccaggauucacgguaauagcacuuuucuuagcccaugcuaucggaacauccaucacacagaaagggauuauauuuauacuauugauguuaguuacaccaaguauggcuaugcgaugcguuggcauagggaaccgcgacuuuguagaaggcuugagcggugcuacauggguagauguaguauuggaacauggaucguguguaacaacuauggcuaaaaauaaaccaaccuuagacauagaacuauugaaaaccgaaguaacgaauccugcuauccugaggaaacuauguauagaagcgaaaauuucaaacacgacuacagauagucgcugcccaacgcagggcgaagcaacucuugucgaagaacaagacgcgaacuuuguuugcaggagaacguuuguugauagaggaugggggaauggauguggauuguuuggaaagggaucccuucucacaugcgcaaaauuuaaauguguuacuaaacuugaaggaaaaauagugcaauacgaaaacuugaaguauagcguaauaguuacagugcauacgggcgaccaacaucagguugguaaugaaacaaccgaacacgguacuauagcuacuauuaccccacaagcaccaacuucagaaauccaacuaacugauuacggcgcacuaacucuggauugcaguccgcguacugguuuagauuucaacgagauggugcugcucacaaugaaagagaaguccuggcuaguccacaagcaaugguuccuagaucucccuuuaccuuggacuucgggugcuucaacgucccaagaaacuuggaaucggcaggauuugcuaguuacauuuaagacggcacaugcuaagaaacaggaaguaguaguacuagguucccaagagggagcaaugcauacugcuuuaacaggggcuacugaaauacaaacuagcggaacuacuacuaucuuugcgggacaccuaacaugucgacuaaaaauggauaaguuaacgcugaaagguacuucuuacguuauguguacaggaucauucaaguuagaaaaagaaguagcagagacacaacauggcacuguauuagugcaaguaaaauacgagggaacggaugcgccgugcaaaauuccuuucagcacucaagacgaaaaaggugucacccagaauggccgauuaauuacagcaaauccuaucgugacggauaaggaaaaaccaguaaacaucgaaacggaaccaccguucggagaaaguuauauaguagucggugccggggagaaagcacugaaauuaucgugguuuaagaaaggcagcuccauuggaaagauguucgaagcaacagccagaggugcgcgucgcauggcgauucuuggcgacacugccugggacuuuggaucaaucggcgguguuuucacaagcguagguaaacucguacaucaaguauuugguacugcguacggcguauuauuuucagguguuucauggaccaugaagauuggcauaggaauacuacuuacaugguuaggguuaaacaguagaaguacaucccuaucuaugacaugcauagcugucggcaugguuacacuuuaccuaggagugaugguacaagcagauucaggcuguguaauaaauuggaaaggacgcgaacuaaagugcgggaguggaauauucguaacaaaugaaguacauacauggacagaacaguauaaauuccaagcagacucaccaaaacgucugagugcggcaauaggcaaggcuugggaagaggguguauguggcaucagauccgcgacccgauuggaaaacaucauguggaaacaaaucaguaaugaacuaaaucauauucucuuggaaaacgacaugaaguuuaccgugguaguaggagaugcuaauggaauauuggcacaaggcaagaaaaugauaaggccccaaccuauggaacauaaguacucauggaaaucuuggggaaaagcaaaaaucauaggagcugacauacaaaauacgacguuuauaaucgaugggccagacacaccagaauguccagacaaccagagagccuggaacauuugggaagucgaagauuauggguuuggaaucuuuacuacaaacauuugguuaaaauuaagggacaguuacacacaaaugugugaucaucgacuuaugucagcugcgauaaaagauucuaaagccguucaugcagacaugggcuauuggauugagucggagaaaaaugaaacauggaaguuggcucgagcaucguuuaucgaaguaaaaacuuguacauggccuaaaagucacacauuguggucaaauggagugcuugaaucagaaaugauaauuccgaaaaucuacggcgggccgauaagccagcauaauuaucgaccgggcuauuuuacucaaacugcagggccauggcaucuaggcaaauuagaacuagauuucgacuugugugaaggaaccacgguaguaguugacgaacacugcgggaacaggggaccaagucuacgcacgacaaccguaacaggaaaaauaauucaugaauggugcugcagauccuguacauugccuccacuacgauuucgaggggaagacggauguugguauggaauggaaauaaggccuguaaaagaaaaggaagaaaauuuaguaagaaguaugguguccgcaggcucaggcgagguagacaguuuuucguuaggcauacugugcgcgaguauuaugauagaagaggugaugagaucacgguggagucgcaagaugcuuaugacaggaacacuugccgucuuuuuacuccuuguuaugggacaacuaacauggaaugaucuaauacgcuuauguauuaugguaggagcaaaugcauccgaucguauggggaugggaacuacguacuuggcccuuauggccacauuuaaaaugcggccuauguucgcugucggguugcuguuucguagacuaaccagcagggaagucuugcuucuaacgaucggauugucgcugguugcgucaguagagcucccaaacagcuuagaagaauuaggagauggccuagcaauggguaucaugaugcucaaacuauugacugaguuccagccgcaucaauuguggacaacuuuauuaagccuuacuuuuaucaaaacuacuuugucguuagauuacgcuuggaaaaccacagcaauggcacuaucgauugugaguuuauuucccuuauguuuaucgacuacaagucagaaaacaacaugguuaccugugcuguuagguucauuuggaugcaaaccauugacaauguuucucauuaccgaaaauaaaauuuggggacggaaauccuggccccuaaacgaggguaucauggcgauaggaaucguaucgaucuuauuaucaaguuuacucaaaaaugacgucccauuggcuggaccauuaauugccggaggaaugcucauagccugcuaugugauaagcgguaguucugcagaucuuucauuagaaaaagcagcggaggugagcugggaacaagaagcagaacauagcgguaccagccauaauauuuuaguagaaguucaagacgacggaaccaugaagauuaaagaugaagaacgagacgauacacucacaauauuacuaaaggcgacccuucuagcuguaagcgggguguacccgaugaguauacccgcaacucuguucguaugguauuuuuggcagaaaaagaaacaacgcucaggugucuugugggauaccccaucuccuccugagguugaaagagcaguucuggaugacggaauauauagaauccugcaaagaggauuauuaggaagaucucaggucgguguggguguauuccaggaugguguauuccauacaauguggcauguaacgcgaggagcaguuuuaauguaccaagguaaacgacuugaaccaagcugggcgaguguuaagaaagaucuaauuucguacggaggcgguuggagauuccagggaucguggaacacaggagaggaaguucaggugauagccguugaaccaggcaagaauccaaagaauguucaaacaaccccagggacguucaaaaccccugagggagaagugggggccaucgcacuagacuucaaaccgggcacuuccggaagucccaucgugaaucgggaaggaaaaauugugggacuguaugguaaugguguaguuacgacauccggaacuuaugucucugcuauagcgcaagcuaaagccucacaggaaggaccuuuacccgaaauagaggaugaaguauuuaaaaagcguaaucugacaauaauggauuuacauccaggaaguggaaaaacaaggagguaucucccagcaauugucagggaagcuaucaagaagaaauuacggacacucauucuagcuccgacacgagugguugccucagaaauggcugaagcauuaaagggaaugccgauaagauaucaaaccacagccgugaaaucagaacacacuggaagagaaauaguagaucuaaugugucaugcgacauuuacuaugcgcuuauugaguccagucagagugccuaauuacaauaugauuaucauggaugaagcacauuuuacagaccccgcaucgauugccgcacgugguuauauaaguacaagaguaggaaugggagaagccgcagccauauuuaugacagcaacaccgccaggcucaguugaggcauuuccacaaaguaacgcagugauacaagacgaagaacgagauauuccagaaagguccuggaauagcggcuaugauuggaucacggauuuuccuggaaaaacaguuugguuugugccaucgauaaagagugguaaugauauagcuaacugucuuagaaagaaugguaaaagggucauucaacugucccggaagacauuugauacagaauaucagaaaaccaaaaauaaugacugggacuacguuguuacuacggauauaucggaaaugggugcuaauuuucgcgcugaucgaguaaucgauccaagacgaugucugaaaccaguaauacuaaaagauggaccggaaagagucauccuugcaggcccaaugcccguaacaguugcaagugcugcucagaggagagguagaauugggcgaaaucagaauaaagagggagaucaauauguauauaugggucaacccuuaaauaacgaugaagaucacgcucacuggacagaagcgaaaaugcuacuagacaauauaaacacaccagaaggaauaaucccggcuuuauuugaaccugagcgggagaagagugcggcuauugacggcgaguauagacuacgaggcgaggcgagaaaaacuuucgucgaauugaugcgacgaggagaccuuccaguaugguuaaguuauaaaguugcuucagagggauuucaguacucggaucgaagguggugcuucgauggagaaaggaauaaucaaguccuugaggaaaacauggacguagaaauuuggacgaaagaaggagaacgaaagaaauugcguccuagaugguuagaugcaagaacauauagugacccauuagcgcuacgagaauuuaaggaauuugccgcaggacgucgaucaguaaguggcgauuuaauucuugaaaucgguaaauuaccgcaacaucuaacccuacgcgcucagaaugcccucgauaauuugguuaugcuccacaacucggaacaagguggcaaggcuuaucgacaugcaauggaggaguuaccagacacgauagaaacccuaauguugcuugcccuuauagcuguauuaaccgguggcguaacuuuauucuuucuuagugguaagggacucgguaaaacuucuauagggcuccuuuguguuaccgcuucuagugcccuauuguggauggcaucaguugaaccgcacuggauagcagcuaguauuauccuugaauuuuucuugauggugcuacuaauccccgaaccagaucgacagagaaccccgcaagacaaccaacuggcauaugucgugaucggcuuauuauucaugauacugacgguagccgccaacgaaaugggacuccuugagaccacgaaaaaggaucuggguauaggucacguagcagcggagaaucaucagcacgcgacaaugcucgacguagacuuaagaccggcaagugcguggacucuauaugcaguggcaacuacaguaauaacuccuaugaugagacauacgauagaaaacacaacggccaacauuucacuaacggcaauugcgaaccaagcugcgauacuuauggggcuagacaaaggauggccuauaucuaagauggacauaggaguaccuuuacuugcguuagguuguuacagucaagucaauccuuuaacuuuaacggcggcaguccuaaugcuaguggcccauuaugcaauaauuggcccaggucugcaggcaaaagccacccgagaggcacaaaaacgaacagcggcaggaauaaugaagaacccgacaguagaugguauaguugcaauugauuuagaccccguaguguaugaugccaaauuugaaaagcaauuaggccagauuaugcuauuaauacuuuguacgagucaaauauuacugaugcgaacuacuugggcguugugcgaaucuauaacgcuagcaacuggcccuuuaacuaccuuaugggaaggcucaccuggaaaauucuggaauacaaccaucgccguuucaauggcaaauauauuuagggggagcuaccuagcgggugcgggauuagcauuuagccucaugaaaagccucgguggcggccgcagaggaacaggcgcacagggugaaacccucggagaaaaauggaaacgacaauuaaaccaauuaagcaaaagugaauuuaacgcauacaaacggagcgguaucauggagguggacagaagugaggcuaaggagggauugaaacgaggggaaacuacgaagcaugcggucucgcgaggaaccgcuaaauuaagaugguucgucgaaagaaauuuaguuaaaccagagggcaaagucaucgaucugggaugcggacgcggugggugguccuauuauugugccggccuaaagaaagugaccgagguaaaaggcuauacuaaaggaggcccaggacaugaagaaccuauccccauggcaacuuaugguuggaaucucguuaaguugcauuccgguaaagacguauuuuucaugccuccagaaaagugugacacauuacucugcgacaucggugagaguucaccaaacccuacgauagaagaggguagaacauuaagaguguuaaaaaugguggagccauggcuuaggggcaaccaauucuguaucaaaauauuaaacccguacaugccaucuguuguugaaacacuagaacagaugcaaagaaaacacggcgggaugcuagucagaaauccucugucgagaaauucaacccacgaaauguauuggguuucauguggcacagggaacaucguaucagcaguaaauaugacaagccgaaugcugcuaaauagguuuacuauggcacaucgaaagccaacauaugaaagggacguagacuuaggggcagggacuagacauguagccguugaacccgaagucgcaaaucuggauaucauaggccaaagaauugaaaauaucaaaaaugagcauaaaucgacauggcauuaugaugaagacaauccguauaaaacaugggcguaucaugggucuuacgagguaaagccuagugguucggcaucaaguauggugaauggcgugguccgacuacuuacaaagcccugggaugucaucccaauggugacacagauagcuaugacugauacaacgccauuuggucaacaacguguuuuuaaggaaaaagucgacacaagaacuccccgggccaagcgagggacaacccaaauaauggaagugaccgcaaagugguuaugggguuuucuaucucggaauaagaaaccgagaauuuguacccgagaagaguucacuagaaaaguacgaaguaacgccgcaauaggugcuguguuugucgacgaaaaccaauggaacucagcuaaggaagcugucgaagaugaaucuuuuugggaccugguacauaaagaacgagaguugcauaaacaaggaaaaugcgcaacuugcguuuauaauaugaugggaaaacgggagaagaaauugggagaguucgggaaagcuaaagguucacgagcaauaugguauaugugguuaggcgcacguuuccuagaguucgaggcuuuggguuucaugaacgaagaucacugguucucgagagaaaacuccuuaucaggcguggaaggcgaaggguuacacaaacuugguuacauauuacgugauaucagcaagauaccagggggcaauauguacgcagacgauacugcuggaugggauacgcguauaacugaagaugaucuacaaaacgaggcaaaaauaacagaaaucauggaacccgaacacgcacuacucgcaacaucaauuuucaaauugaccuaucaaaauaaagugguuaggguucaaagaccugccaaaaaugguacaguaauggacguuauaucucgacgagaccaaagagggucgggccagguaggaaccuacggacuaaauaccuucacaaacaugggaguacaacuaauucgacagauggaaagugaaggaauauuucuccccagcgaauuagaaacaccgaaucuagcagaaagaguucuugauugguuagaaaaacacggagccgagagauugaaaagaauggcaauaucaggcgaugauugcguuguaaagcccauugaugacagauucgcaaccgcauugacagcauuaaacgacauggguaaaguacgcaaagacaucccccaaugggaaccgucaaaaggauggaaugacuggcagcagguaccguucuguucacaucauuuccaccaacuaauaaugaaagacggcagggagauuguuguuccuugccggaaccaagacgaguuaguaggcagagcacgugucucgcagggagcgggguggaguuuaagggaaacugcuugccuuggaaagucguaugcucaaauguggcagcuaauguacuuccauagacgugauuuaagacuugcagccaacgcgaucuguuccgccguaccaguagacuggguuccaacuucgcguacaacuuggucgauacaugcacaccaccaauggaugacgacagaagauaugcuuaguguguggaaucgagucuggauugaagagaacccguggauggaggauaaaacucauguauccagcugggaggaaguaccuuaucuaggaaagcgagaggaccaauggugcggaaguuuaauaggcuugaccgcaagagccacaugggcuacaaacauacagguugcgauaaaccagguccgaagacucauaggaaaugagaauuauuuagauuacaugacaucuaugaaaagauuuaaaaaugaaucggauccugaaggagcucuaugguga

SEQ ID NO: 21248 - RNA, 9879 nt, Artificial Sequence
  derived and/or modified CDS sequence (opt6) from DENV-1__GQ868512__SS-prME
ucagugacuaugcuauugauguuacuaccgaccgcgcuagcguuucacuuaacuacgagggguggggaaccacauaugauaguaagcaaacaagaaaggggaaaaagccuacuauuuaaaaccagugcuggggugaauauguguaccuuaauagcaauggaucuaggugaacuaugugaagacacuaugacuuacaaaugcccacagauaaccgaagcugaacccgaugauguugauugcugguguaaugcaacagacaccuggguaacauacggaacguguucacagacaggagaacauaggagggacaaaagaucaguagcauuggcuccacauguuggacuaggcuuagaaacgagaacggaaaccuggaugucuucugaaggcgcauggaaacagauucaaagaguagaaacaugggcauuacgucacccggguuuuacgguaauagcuuuguuccuagcacaugcuauugguacgagcaucacacaaaaagguaucauuuucauccuccucaugcuuguuacuccaucgauggcaaugcgauguguagguauagguaauagagauuucguagaaggacuaucaggcgcaacguggguugaugucguucuagaacauggcucuugugucaccacaauggccaaaaacaaaccaacuuuagauauugaacucuugaaaacagagguaacuaauccagcaauauuacguaaacuaugcauugaagcaaaaauaucaaauacuacaacugacagccgguguccaacucaaggcgaagcaacauuaguagaagaacaagacgcuaacuucgucugucgacgaaccuucguagacagaggaugggggaaugguuguggacuuuucggaaaagguucuuuguuaacaugugccaaauucaaaugugucacuaaacuggaaggaaaaauaguccaauaugagaaucugaaauauucaguaauagucacaguucauacuggagaccaacaucaggucggaaaugaaacgacagaacaugguacuauugcaacaauuacaccacaagcaccaaccagugaaauccaacuuacagacuauggggccuuaacauuagauuguucgccccgaacaggccuggauuucaacgagaugguuuugcucacaaugaaagagaaaucauggcuaguucacaaacaaugguuccuagauuuaccuuuacccuggacuucuggggcaaguacaagucaggaaacauggaauagacaagaucuccuuguaacguucaaaaccgcacaugccaagaaacaagaaguuguuguacuaggaagccaagagggugcaaugcacaccgcacuaacaggggcgaccgaaauccagaccucaggcaccacuacuauauucgcaggccaccuaaaaugcaggcuaaaaauggacaaauuaacucuaaaaggaacaaguuacguaauguguacuggaucauucaaacuggagaaagaaguagcugaaacccaacacggaacuguacuggugcaaguaaaauacgaaggcacagacgcaccauguaagauuccguucagcacucaggacgaaaaaggaguaacucaaaaugguagauuaauuacagcgaaccccaucguuaccgacaaggagaaacccguaaacaucgaaacugaacccccuuuuggggaaucuuauauagugguaggagcuggugagaaagcauugaagcuaaguugguuuaagaaaggaucaucaauagguaaaauguucgaagccacagcucguggggcuaggcgcauggccauauugggugacacugcaugggacuuuggcucaauaggagguguauuuacaaguguugguaaauugguacaucaaguguucgggaccgcuuauggggucuuguucaguggagucucguggacaaugaaaauagggauagggauauuacuuacauggcuuggacuaaauucacgaucaaccucuuugucaaugacauguaucgcgguagguauggugacgcuauacuuaggcguaaugguacaagccgacagcgguugcguaauuaauuggaaaggaagagagcuaaaguguggauccggaauauuugucacaaaugaaguccauaccuggaccgaacaguacaaguuccaagccgauagcccaaagagacugucugcagcgauuggcaaagcaugggaagaggggguaugugggauacguagcgcaaccagacuugagaauauaauguggaaacaaauuagcaaugaacuuaaucacaucuuauuggagaaugacaugaaauuuacuguggucguaggugaugcaaacggcauucuagcccaaggcaagaaaaugauuagaccacaaccaauggagcauaaauauucguggaagucguggggcaaagcuaaaauaauaggcgcagacauucaaaauaccaccuuuauaauagauggucccgauacaccggaauguccugacaaccagcgggccuggaauaucugggaaguagaggauuacgguuuugggauauuuacaacaaacauaugguugaagcuccgggauagcuauacacaaaugugcgaccacagauuaaugucugcagcaaucaaagacucaaaagcuguacacgcugauauggguuauuggauugaaucggagaaaaaugaaacauggaaauuagcgagagccaguuucaucgaaguuaagacauguaccuggccgaaaagccauacguuauggucaaauggagucuuagaaagcgagaugauaauccccaaaauauauggaggaccaauaagucaacauaauuauagaccgggcuauuuuacacaaaccgcgggaccauggcacuuggguaaguuagaacuugauuucgaucuaugugagggaacaacagucguaguugacgaacauugcggaaauagaggcccaucgcugagaaccacgacaguaacuggaaaaauaauacacgaauggugcugcaggaguuguacgcucccgccacuaagauucagaggggaagauggauguugguacggaauggagauuagaccaguaaaagaaaaggaagagaaucuugugcgcucaaugguaagugcagguucaggagaaguggauaguuuuagccuugguauacuuugcgugucgauaaugauagaagaggucaugcggagucgauggucuagaaaaaugcuaaugacgggaacauuagcagucuuccuacuacuuguaaugggacaacucaccuggaacgaucucauuaggcuuuguauuaugguuggagcaaacgcuucggaccgaaugggcaugggaacaacuuauuuagcguuaauggcuacauuuaagaugagacccauguuugcuguagggcugcuauucagaagauuaacaagcagagaagugcugcuauuaacuauaggcuuaucuuuaguugccaguguugaacucccuaauagucuugaagaacuaggggauggccuagcaaugggaauaaugaugcuuaaacugcucacagaguuccaaccgcaucaauuguggacaacgcuuuugaguuuaacuuucauaaaaacuacauugagucuugauuaugcauggaagaccacagcaauggcucuauccauaguaucacuuuucccucuaugccuuucaacuacgucccagaaaacuaccugguuaccuguacugcuggguucuuuuggguguaaaccacucacaauguuccuaauaacagaaaacaagauuugggggaggaaaaguuggcccuugaacgaaggcauuauggccauuggcauagucucuauacuauugucaucccuacuuaagaaugauguaccguuagcagggccguuaauugcaggcggaaugcuuauagccuguuauguaauauccggaucuucggcugauuuaagucuagaaaaggccgcagaagugaguugggaacaagaagcugaacauagugggacuucgcauaacauauuaguugaaguacaagaugacggaacaaugaaaauuaaagacgaggaaagagacgauacgcucacaauauuacucaaggcgacacuacuagcagucucagggguuuacccuaugaguauuccugcuacuuuauucgucugguacuuuuggcagaagaagaaacagagaagugguguguugugggacacacccaguccaccagaaguugaacgcgcagucuuagacgacgguauuuaucguauacuacaaagaggguuguuaggccgaucacaagucgggguagggguguuucaagauggggucuuccacacgauguggcacgugacgcgaggugccguccuaauguaccaggguaagcgacucgaaccaaguugggcuagcgucaagaaagaucuaauuaguuaugguggaggauggagauuucaaggcaguuggaacacgggugaagaaguucagguuauugcgguagaaccugguaaaaaucccaaaaacguacaaacaacaccuggaacauucaaaaccccggaaggagaaguaggagcgaucgcucucgauuucaaaccuggaacaaguggaucuccaaucguuaaucgugaggggaaaauuguaggauuauauggaaaugguguaguuacaacgaguggaacauauguuucagcuauagcucaagcaaaggcgucucaagaagguccacuaccagaaauagaagaugagguuuucaaaaagcgaaaucuuacaauuauggaccuucaucccgguagugggaagacucgaagguaucuuccugcgauaguucgggaggcuauuaaaagaaaguuaaggacacucauccucgccccaacuagaguaguggcuagugaaauggcggaagcguuaaaggguaugccgauacgcuaucagacaacugccgucaaaucagagcauacagggcgugaaauuguggaucuaaugugccacgccacauucacgaugcgacuccucucaccaguaaggguaccgaacuauaacaugauaauaauggaugaggcacauuucacggauccugcaucaauugcugccagaggcuauauuaguaccagaguaggcaugggagaagccgcagcaauuuuuaugacugcaacgccucccgggucuguggaagcauuuccccaaucaaacgcagugauacaagaugaggagagagacauucccgagaggagcuggaacagcggcuacgauuggauuaccgacuuuccgggaaagacagugugguucguaccuucgauuaagucaggaaacgacauugcuaacugcuuaaggaaaaacggcaaaaggguaauucaacugaguagaaaaacauuugauaccgaguaccagaaaacuaaaaauaaugauugggacuauguaguuacaacagauauuagcgaaaugggcgcuaauuucagagcagaucgggugauagaccccagaagaugucuaaaaccagugauauuaaaagauggcccagaaagaguuauacuagccggaccuaugccagucacagucgcgucagcagcacaaagacgcggucgaauaggcagaaaccaaaacaaagaaggugaccaguauguuuauaugggccaaccguuaaacaacgaugaggaccaugcucacuggacagaggccaaaaugcuacuggacaauauaaauacacccgaagggauaauaccagcccucuucgaaccugaacgagaaaaaucugcggcaauugauggggaauaucgccuacgaggagaagcaaggaaaacauuugucgaacucaugagaagaggagaccugccugugugguuaucauauaaaguagcaucugaagguuuucaauauucggauagaagaugguguuuugacggagaaaggaacaaccaagucuuagaagaaaauauggauguagaaauauggacaaaagaaggugagcguaagaaauuaagaccuagaugguuagacgcaagaacguacuccgacccacuugcccuaagagaauuuaaggaguucgcagcaggccgaagaucaguuucaggagauuuaauauuagaaauugguaaguugccacagcauuuaacacugagagcccaaaaugcgcuagacaaucucguuauguuacacaacagcgaacaagguggcaaagccuaccgacaugcuauggaagaauuaccugauacaauugaaacauuaauguuauuggcuuuaauagcugugcuuacugguggaguaacauuauuuuuccuuagcggcaaaggacugggaaaaacuucaauugguuuacugugugucacggcgaguagcgccuuauuauggauggcuucuguggagccacacuggauugcggcaucuauaauuuuagaguucuuuuugauggugcugcucauaccagaaccagauagacagagaacaccacaagauaaccaauuagcauacguuguaauaggccuccuauucaugauuuuaacggucgcggcuaaugagaugggucuuuuggaaacuacuaagaaagaucuuggaauugggcacguagcugcagaaaaccaccaacaugcuaccauguuggauguugacuuacggccagcaagugccuggacgcucuacgcggucgcgacgacaguaaucacaccaaugaugcgacacacaauagaaaacacaaccgcaaauauuagucuuacugccauagcuaaucaagcugccauacuuaugggacuagacaagggcuggccaauaucgaaaauggauaucggaguaccucuauuagcccucggcugcuauagucaagugaauccucugacccugacagcagcgguacuuauguuaguagcucauuacgcaauaauaggaccgggauuacaagcaaaggcaacuagggaagcucagaagcgaacagcugcaggaauaaugaaaaauccgacgguagauggaaucguggcgauagauuuggauccaguugucuaugaugcuaaauucgagaaacagcuaggacaaauaaugcuguuaauauuguguacgucccaaauacuguuaaugaggacaacgugggcuuugugcgaaagcauaacguuagccacgggacccuuaacaacgcuuugggaaggcagcccagguaaguucuggaauaccacaauagcggucaguauggcaaauauuuuccggggaucauaucucgcgggagcgggucuagcguuuagcuugaugaagaguuuaggcggugguagaagaggaacaggggcccaaggugaaacauuaggcgaaaaauggaaacggcaauugaaccagcuaagcaaaucagaauuuaacacuuauaaacgcucuggcauuauggaaguagacaggucggaggcaaaagaaggguuaaaacggggagaaacgaccaagcaugcgguaucaagagguacagcuaagcuaagaugguucguagagagaaauuuaguaaaaccagaagguaaagucauugaucuaggaugcggacggggaggauggucguacuacugcgcaggauugaagaaagugacugaagucaagggauauacaaaaggcggcccgggacacgaagaaccgauaccaauggcuacguauggauggaauuuaguaaaauuacauagcggaaaggauguauucuuuaugccaccugaaaaaugcgauaccuugcuaugcgauauaggggagucuucaccaaauccuacgauagaagagggaagaacacuuagaguacuuaagaugguggaaccaugguuaagaggaaaccaguuuugcauaaaaauucuuaauccauauaugccaucuguaguggaagcucuagagcaaaugcagagaaagcacggcggaauguuagucagaaauccucuaagccguaacucaacucaugagauguacugggucaguuguggaacagggaacauaguaagugcggugaacaugaccaguagaauguuauuaaaccgcuuuacuauggcacauaggaaaccgacuuaugaacgcgacguugaucuaggugcaggaacgcgccauguugccguagaaccagagguugcgaauuuagacauuauaggacaacguauagaaaacauuaagaaugagcacaaaagcacauggcauuaugacgaggacaauccauacaagacgugggcauaucauggcucauacgaagugaaaccgagcggcucagcuagcucaaugguuaaugguguaguacguuuauuaacaaaaccaugggaugucauacccauggugacccaaauagcuaugaccgacacaacucccuuuggacaacaacggguguucaaagagaagguagacacaagaaccccaagagcgaaaagagguaccacacaaauuauggaaguaacagcaaaauggcucuggggauucuugagcagaaacaagaaaccucggauuugcacuagagaagaguucacgaggaaaguucggucgaacgcggccaucggagcgguguuuguugaugaaaaccaauggaauagcgcaaaagaagcgguggaagaugaaagauucugggaccugguucaucgagaacgugaacuacauaaacagggaaaaugugccacauguguguacaauaugaugggaaaaagagaaaagaaacugggugaauuuggaaaagcaaaaggaagucgagcuaucugguauauguggcuaggagcuagauuccuagaauuugaggcacuagguuucaugaacgaggaccauugguuuagcagagaaaacucccuaaguggaguagaaggggagggacuacauaaguuaggcuacauacuccgggacaucucuaagauuccuggaggcaauauguacgccgacgauacagcagggugggauacgaggauaacagaggaugaccuccagaacgaagcuaaaauaacagaaauaauggaaccagaacacgccuuguuagcaacuagcauuuuuaaguuaacguaccaaaacaaaguuguaagaguccagcggcccgcuaaaaaugguacagucauggaugugauaucgagaagagaccagcgcggauccggacagguuggaaccuauggucuuaauacguucacuaacauggaaguucaauuaauacgucaaauggaaagcgaagguauuuuccucccgucggaauuggagacaccaaaucucgcggaacggguacuugauugguuagaaaaacauggggcugaacgacuuaagaggauggccaucucgggugaugauugcguaguaaaaccaauagacgaucgguuugcuacggccuuaacagcccuuaaugauauggguaagguaagaaaagacaucccucaaugggagccgucgaaaggcuggaaugauuggcaacagguaccauucuguagucaccauuuucaucaauuaauaaugaaagacggaagagaaauugucguccccugcagaaaccaggacgaacuuguaggucgugccagagugucacaaggagcaggcuggucguuaagagaaacagccugcuuaggcaaauccuaugcccaaauguggcaauuaauguauuuccacagacgagaucucagacuggcagcuaaugccauauguagcgcagucccuguggacuggguacccacuucuagaacaacauggucgauacaugcccaccaucaauggaugacaaccgaagacaugcuuagcguuuggaacagagucuggauugaagaaaacccuuggauggaggauaagacgcacguaucuaguugggaggaaguaccauacuuagggaaaagagaagaccaauggugcggcuccuugauuggacuaaccgcuagagcaacgugggcaacuaacauucaaguggcgauaaaucaaguuagaagacuuaucggcaacgagaacuauuuggauuacaugacaaguaugaaacgguuuaaaaacgaaucggauccagaaggcgcacucugguaa

SEQ ID NO: 21249 - RNA, 9879 nt, Artificial Sequence
  derived and/or modified CDS sequence (opt6) from DENV-1__GU131970__SS-prME
agcguuacuauguuauuaauguuguugcccacagcucuugccuuucaucuuacgacgcguggaggagagccacauaugauaguuaguaaacaagaaagaggaaaaucguuacuauuuaaaacauccgcgggaguaaauaugugcacacucauagccauggauuuaggcgaacuaugugaagauacaaugacauacaaauguccgcagauaacagaagcugaaccugaugauguugacugcugguguaacgcaacugauacaugggugacguacggaacaugcagucagacaggcgaacaucgacgggagaaacgaagcguagcacuugcuccucauguuggucuaggacuugaaacgagaacagaaacuuggaugaguucagaaggcgcauggaaacaaauccaaagaguggaaacgugggcauuacgacacccgggcuucacaguaaucgcauuguuucuugcucacgcgaucggcacuucaauaacgcaaaaaggcauaaucuuuauuuuauuaaugcuaguaacaccuucaauggcuaugagauguguagggaucggaaauagagauuuuguugaaggacucucaggcgcuacaugggucgacguaguacuggagcauggcaguuguguaacgacaauggcuaaaaacaaaccaaccuuggacauagaacuacuaaaaacggaggugacuaacccugcaauccuaaggaaacucuguauagaagcaaaaauuagcaauacuacgacagauucaagauguccaacccaaggggaagcaacccuagucgaagaacaggaugcaaauuucguaugucgaagaacauucguagauagaggaugggguaacgguugcgguuuguucgggaaaggaucacuuuuaacaugugcuaaauuuaaaugugucaccaaauuggaagguaaaaucgugcaauacgagaaucuuaaauauucaguuaucguaacgguucacacgggugaccaacaucagguggguaacgaaacaacugaacauggcacaauugcuacaaucacuccucaggcuccaacaucagaaauucaguuaaccgacuacggagcacuaacauuagauugcaguccacgaacgggguuggacuucaacgaaaugguucuuuugacuaugaaagaaaaaucuugguuaguccauaaacagugguuccuggaucucccacuuccauggacaaguggagcgucaacgucgcaggaaacauggaaucgacaggaccuuuuaguuacauuuaaaacagcccaugcgaagaaacaggaaguuguggugcuaggaucacaagaaggagcuaugcacacagccuuaacaggagcuaccgagauucagacaaguggaacgaccacuaucuuugcgggccaucuaaaaugccgacucaaaauggauaaauuaacauugaaagguacaucuuauguuaugugcacagguaguuuuaaauuagagaaagaaguugcagaaacgcagcaugggacaguauugguucaaguaaaguaugagggaacagaugcuccauguaaaauccccuuuagcacacaagacgaaaaaggaguaacccaaaauggucgguuaauaacagccaauccaauuguuacugauaaggagaagccgguaaacaucgaaacugaaccaccuuuuggagaauccuacaucgugguuggugccggcgagaaagcccucaaauuaucuugguuuaagaaagguaguaguauaggcaaaauguuugaggcuacggcgcgcggagcuagacgcauggcgauacuuggggacacugcgugggauuuugguagcaucggcggaguauuuacuucaguaggcaaauugguccaucaagucuuuggaacagcauaugguguauuauuuucaggugugucguggacaaugaaaauaggcauaggaauauuacuaacuugguuagguuuaaauuccagaaguacaagucuuucuaugaccuguauugcaguugggaugguaacuuuguaccucggaguuaugguacaagcagauaguggcugugucauuaauuggaagggucgggaauuaaagugcgguagcgguauauuuguaacaaacgagguacauacauggacagaacaauauaaauuucaagcagacucuccgaaaagauuaucagcugcaauaggaaaagcgugggaagaggggguaugugguauuagaucggcuacgagauuggaaaauaucauguggaaacaaauaagcaaugaauuaaaccauauacuacuagaaaacgacaugaaauuuacgguaguggucggagaugcaaacggaauacuugcacaggggaagaaaacuauaagaccgcagccaauggaacauaaauauuccuggaaaucguggggaaaagcuaaaauuauaggagcggauauccaaaauaccacauucauuauugacggaccagacacaccagaauguccggauaaucagcgagcuuggaauaucugggaaguagaggauuauggguuuggaauauuuacgacaaauauuugguuaaagcugagagacuccuauacucaaaugugcgaucaucgacugaugucggccgccauaaaggacagcaaggcgguacaugcggauaugggcuauuggauagaaagcgagaaaaaugagacuuggaaguuagcccgagccucuuucauagagguaaaaacgugcacauggccaaaaagccacacacuuuggucaaacggugugcuugaaucagaaaugauuaucccaaaaauauauggcggucccaucucacagcauaacuauagacccgguuacuuuacucaaacggcgggacccuggcaccuaggaaaacuugaauuagauuuugauuuaugcgaaggcaccacagugguaguggacgaacauugcggaaacaggggaccuucuuugagaacuacaacaguaacagguaaaaucauacacgagugguguugcagauccuguacccuaccaccacugcgcuuuaggggagaggauggauguugguauggaauggaaauaaggccggugaaagaaaaagaagaaaaucuuguacgaaguaugguaucugccgggagcggugaaguagauucauucucucuugguauauuaugcguaucaauuaugauagaggaagucaugagauccagauggucaagaaaaauguugaugacaggcacacucgcuguauuuuuauuauuaauaaugggucaauuaacguggaaggaccugauucgucuaugcauuaugguaggcgccaacgcuucagauaggauggggaugggcacuacauaccuagcauuaauggcaacuuucaagaugcgaccuauguucgccgucggauuacuguuccgacggcuaacgucucgugaaguucuauuauugacuauuggacuaucucuaguagcguccguagaauugccaaacucuuuagaagaacuaggagauggacucgcgauggggauuaugauguuaaaguuacuaacggaauuucauccacaccaacuuuggacgacauugcuaagccucacuuuuaucaaaacaacgcuuucacuagauuacgcuuggaagacuacagcaauggcguuaagcauagugucgcuuuucccgcugugccuuagcacaacuucccagaaaacuacauggcuuccaguauuacuugguucauuugggugcaaaccuuuaacaauguucuugauaacugaaaauaaaauauggggcagaaagucuuggcccuuaaacgaaggaauaauggcuauaggaaucguaagcauauuacuuucaucacuacuuaagaaugaugucccauuggccggcccguuaauugcgggagguaugcuuauagcuuguuaugugaucucgggaucaagugcagauuuaucccuagaaaaagcagcagaaguaaguugggaacaagaagcggagcacuccggaaccucacauaauauuuuaguugaggugcaagaugauggcacaaugaaaauaaaagacgaggagagagaugauacauuaacgauacuauuaaaagcgacauuauuggcugugaguggaguuuacccaaugucaauaccugccacacucuuuguuugguauuuuuggcagaagaagaaacaacggucggguguacucugggacacacccucaccgcccgaagucgaaagggcgguccuagacgauggaauauauagaauauugcagaggggacugcuuggaagaucucaggucggcgucggaguuuuucaagauggaguuuuccacacaauguggcaugucaccaggggagcaguuuuaauguaucaaggaaaaagauuggagccuucgugggccucaguaaagaaagacuuaaucaguuacggcggcggauggcgauuucaaggaucuuggaauacaggugaagaagugcaggucauagcagucgaaccugguaaaaaucccaaaaauguacaaaccacgccagguacauucaaaacgccagaaggagaagugggcgcgauugcacuggauuuuaaacccggaacuagcgguaguccuaucgucaacagagaaggcaagauagucgggcuauacggaaauggaguuguaaccacgucuggaacauacgugucagcaauugcacaagcaaaagcaagucaagaaggaccuuuaccggaaaucgaagaugaaguauuuaagaagagaaaucugacaaucauggauuuacaucccggaucaggaaaaacuagacgguaucugccggcuauaguacgcgaggcaaucaaacgaaagcuacgaacguuaauuuuagcgccuacuagaguuguugcgagcgagauggcugaagcucucaaaggcaugccaauuagauaccagacgacagcagucaaaucugagcacacagguagagaaaucguagaucuaaugugccacgcaacauuuacuaugagguugcugaguccaguaagaguaccaaauuauaauaugauaauaauggacgaagcucauuuuacggaucccgcuuccauugcugcgaggggauauauuuccacacguguugguaugggagaagcggcagccauuuuuaugacagcgacuccaccuggaucaguugaagcguucccgcaaucgaaugcaguaauucaagaugaagaaagggauaucccugagaggucauggaacucugguuaugauuggaucacagauuuccccggaaaaacagugugguucgugccauccauaaagagcgggaaugauauagcuaacugucuaaggaaaaacggcaaaagaguuauacaauuaucacgaaagacauucgauacagaauaccagaagaccaaaaacaaugacugggauuaugugguaaccacagauauaucagaaaugggagcuaauuuucgagcggacagggucaucgauccacgacguugcuuaaaaccaguaauauuaaaagacggacccgaacgagugauauuagccgggccaaugccuguuacaguggcaagugcagcacaaagaagaggacgaauaggacgaaaucagaauaaagaaggugaccaguauguauacauggggcaaccccuuaacaacgacgaagaucaugcccacuggaccgaggcuaaaauguuauuagauaacauaaauacuccggaagguauuauccccgcgcucuuugaaccagagagagagaaaagcgcugccaucgauggugaguauagacuccggggagaggcacguaaaacauuuguagaacuaaugcgaagaggagauuugccaguauggcuaucauacaaaguugcaucagaaggauuccaguauucagauagaagauggugcuuugacggagaaagaaacaaucagguacuagaagaaaauauggaugucgaaauauggaccaaagagggcgaaaggaagaaacuaaggccccgguggcuagaugcaaggaccuauagcgacccguuagcauuaagggaauuuaaagaauuugccgcaggacgccgcuccgucuccggggacuuaauccucgaaauuggcaaacuaccucaacacuuaacguuaagggcacaaaacgcauuagauaaccuaguuauguugcacaauucagagcaaggcggaaaagcauaucgccaugcuauggaagaauugccggacacaauagaaacacuuaugcuguuagcacuuauugcuguuuuaacagggggaguuacgcuguucuuuuugaguggaaaaggcuugggcaaaacgagcauuggacuacuaugugucacagccucauccgcacuauuauggauggcaucaguggagccucauuggauagcagcgagcauuauacuagaguucuuuuuaaugguuuuauuaauaccggaaccagaccgucaaaggacuccucaggauaaucaguuggccuauguaguuauaggauuacuuuucaugauauuaacaguagcugccaacgaaauggggcuuuuagaaaccacuaagaaagaucucggaauaggccacguagcagccgaaaaucaucaacacgccacgauguuagacguagaucuacgaccugcaagcgcauggacucuuuaugccguugcgacgacugucauaacgcccaugaugcgacacacaauagaaaauacuacagcaaauauaaguuuaacagcaauugcaaaucaagcagcaauccugaugggauuggauaaaggguggcccaucucaaaaauggacauaggaguuccacuacucgcguuagggugcuauucccaggucaauccacuuacacuaacggcagcuguuuuaaugcuaguagcacacuacgcaauaauaggacccggauugcaagccaaagccacucgcgaagcucagaagcguacagccgcaggaauaaugaaaaauccuacaguagauggaauagucgcaauugauuuagacccuguaguuuacgaugcaaaauuugagaagcagcuaggacagauaauguuacuaauauuguguaccucucaaauccuucuuaugagaacaacgugggcguuaugugaguccauaacguuagcuacuggcccgcugacaacuuuaugggaagggagcccugguaaauuuuggaacacuacuauagcuguaaguauggcuaauauauuucgaggaaguuaccuagcaggagcaggcuuggcauuuucauuaaugaaaagccuuggaggcgguaggagagggaccggugcacaaggggagacacuaggugaaaaguggaaacgacaauuaaaucaacuaucaaaaucagaguuuaauacauacaaaagaagcgggauuauggaagucgacagaucugaagcuaaagaagguuuaaaaagaggagaaaccacuaaacacgcagugagccggggcacagcaaaacugaggugguuuguugaacguaacuuaguaaagccagagggcaaagucauagaucuagggugcgggcggggaggauggucguacuauugugcaggccugaaaaagguaaccgaaguaaaaggauacacaaaaggcggaccaggacacgaagaaccaauaccgauggcgacauacggcuggaaccuaguuaaacuucauucgggcaaagauguauucuuuaugccacccgaaaaaugugacacccuauuaugcgacauaggggaaaguaguccgaaccccacaauugaagagggccguacacucagaguauuaaagauggucgagccguggcuccggggaaaccaguuuuguauuaaaauauugaauccauacaugccgucgguaguagaaaccuuagaacaaaugcagcgcaagcacggaggaaugcuuguuaggaacccacucucaagaaauucaacucacgaaauguauugggugaguugcggaacagguaacauuguaagugcagugaauaugacaucacgaaugcuacuaaaucgguuuacaauggcgcaccgaaagccuacauaugagagggacguugaccuaggcgcugguacacgucacgucgcgguugaaccggaaguggcaaaucuugauauaaucggucaacgcaucgaaaauauuaagaacgaacacaagucaacuuggcacuacgacgaggacaacccauauaaaacaugggcguaucacggaucauacgaaguaaaaccaucuggcucagcaagcucuaugguuaacggcguaguacgcuuacuuacaaaaccuugggacgucauaccuaugguuacucaaauagcgaugaccgacacgacgccauucggacaacagcguguuuuuaaggaaaagguugauacacgaaccccuagagcuaaaagaggaaccacgcagauuauggaggucacagcgaaauggcuauggggguuucuaucucgcaacaagaaaccaagaaucugcaccagagaagaauuuacucgcaaaguuagaucuaacgcugcaauuggcgcaguauucgucgacgaaaaccaauggaacucugcaaaagaagcgguugaagacgaacguuucugggauuuaguccauagagagagggaacuacauaagcaagggaagugugcgaccugcguauauaauaugaugggaaaaagagaaaagaaacucggagaauuugguaaagcaaaagguagucgggccauaugguauauguggcuaggagcgagguuccuggaguucgaagcgcugggauucaugaaugaagaucacugguuuaguagagaaaauagcuuaucaggaguggaaggugaaggguugcauaaauugggauauaucuugcgcgacauaucaaaaauaccuggugguaauauguaugcugacgauaccgcgggcugggacacaagaauaacggaagaugaucuucagaaugaagcaaaaauaacagacauaauggaaccugaacaugcacuacucgcgacaucaaucuucaaacucacauaucaaaauaagguaguacgugugcaaagacccgcuaaaaaugggacggugauggacgucauaagucgaagggaucagcgugguucaggacaaguaggaacguacgggcuuaauacauucaccaacauggaaguccagcuuauaagacaaauggaaucggaaggaauuuuccugccaagugaauuagagacacccaacuuagcagaaagggucuuagauugguuagaaaaacacggugcagaaagauuaaaacgaauggccauuuccggcgacgauuguguaguaaagccaauagaugacagauuugcaaccgcucuuacugcgcucaacgauaugggaaaaguaaggaaagacaucccucagugggagccuuccaagggauggaacgacuggcaacaaguaccuuuuugcucgcaucacuuccaccaauugauaaugaaagauggccgagaaauagugguuccauguaggaaccaagacgaacugguaggucgcgcucgcgugagccagggugcgggguggaguuugaaagagacagcauguuuagggaaaaguuaugcgcaaauguggcaauugauguacuuccauagaagagaccuacgacucgcagcaaaugcgaucuguuccgccguaccaguagauuggguaccgacaagcaggaccacuuggaguauacaugcacaccaucaauggaugacaacugaagauauguuaucuguauggaaccgaguuuggaucgaagagaacccuuggauggaagauaaaacacacguuaguucaugggaagagguaccuuaccuaggcaaaagagaggaccaauggugcgguucacuaauugguuuaacagcuagggcaacgugggcgacaaauauacaaguggccauuaaucaaguucgacgucucauaggaaacgaaaacuaucuugauuauaugacaucaaugaaacguuuuaaaaaugagucugauccugaaggagcucugugguaa

SEQ ID NO: 21250 - RNA, 9879 nt, Artificial Sequence
  derived and/or modified CDS sequence (opt6) from DENV-1__KF955427__SS-prME
ucugugacuauguuacuuaugcuauugccaacagcgcuagcauuucacuugacuacucgaggcggagaaccacauaugauagugucuaaacaagaaagaggaaaaucuuuauuguuuaaaacaucugcaggaguaaauauguguacuuuaauagcgauggaccuaggugaauuaugcgaagauacuaugaccuacaaaugcccucaaaucacagaggcggaaccagaugauguagacugcuggugcaaugcaacugauaccuggguaacauauggaacauguucacagacgggugaacauagaagagacaaacgaagcguagcguuggcaccacacgugggccuaggguuggaaacuagaacggaaacauggauguccucggaaggagcuuggaaacaaauacaaagaguugagacaugggcacuacgacauccaggcuucaccguaauagcucuauuccuagcacacgcaauagguaccucgauuacacagaaagguauuauauucauacuauugaugcugguuacaccaucgauggcgaugcgaugcguaggaauugguaacagagauuuuguagaggguuuaagcggagcaacauggguagauguuguacuagaacauggaaguugcguuacaaccauggccaaaaauaaaccaacgcuggauauagaacuucuuaaaacugagguaacaaacccagcuauuuuacguaaauuauguauugaagcaaaaauaucaaacacaacaacagauucacgaugucccacucaaggugaagcuacccuaguagaagaacaagaugcaaacuucgucuguagacguacauuuguugaucgcggaugggguaauggguguggauuauucggaaaagggucuuuauuaacaugcgcaaaauuuaaaugcguuacaaaauuagaggguaaaauuguucaguaugagaaucuuaaauauagcgugauaguaacaguucacacaggcgaucagcaccagguggguaacgaaacuaccgaacauggaaccauagcaacaauaacaccucaagcuccaacaucagaaauccaauugacugauuauggagcauugacuuuagacugcaguccaagaacaggacuagacuuuaaugaaauggugcuucugaccaugaaagaaaaaucauggcuuguacacaaacagugguuccuagauuugccacuaccauggacgaguggagcuucaacuucgcaagagacauggaaucgucaagacuugcuuguaacauucaagacagcgcacgcaaagaagcaagagguaguuguccuagggucacaagaaggugcaaugcauacugcuuggacuggugcgacggaaauccaaacgucagguacaacuacaauauucgcgggacaucucaaauggagauuaaaaauggauaaacuaaccuuaaaggggacgucauaugugauguguaccggaucauucaaacuugaaaaggagguugcugaaacucaacauggaacaggauuagugcaaguaaaauaugaaggaacagaugcucccugcaaaauaccuuuuagcgcucaagaugaaaaaggaguuacucaaaaugggagauuaauuacugcuaaccccauugucacugacaaagaaaaacccguaaauauagaaacggagccaccauuuggugaaaguuauauagucguuggggccggugaaaaggcacuuaaguuguccugguuuaagaaaggaaguucgauagggaaaauguucgaggcaacggcuagaggggcccgaaggauggccauuuuaggcgacacugcgugggauuucggaagcauugguggaguguucacaaguguuggcaaauuaguacaccaaguauucgguacugccuauggaguacuauuuucuggugucucauggaccaugaagauaggcauagggauacuacuaacauggcuaggauuaaauagccguucaacaaguuugucaaugacgugcauagccguaggaauggugacguuguaccugggaguuaugguacaagcugauagugguugugucauaaacuggaagggucgagaauuaaaaugcggcucaggaauauucgucacgaacgagguucauaccuggacugagcaauauaaauuccaagcggauucaccaaaaaggcucagcgcugcaauaggaaaggcaugggaggaaggcgucuguggcauuagaucagcaacacggcuagaaaacaucauguggaaacagauaaguaaugaauuaaaccacauauuguuagaaaacgauaugaaauuuacaguaguaguaggagaugcuaacgguauucuugcucaggguaagaagaugauucgcccacagccuauggaacacaaauauaguuggaaauccuggggaaaagcuaagauaauaggcgcugacauacaaaauacaacauucauuaucgacggucccgauaccccagaguguccagauaaucaaagagcguggaacauaugggaggucgaagacuauggcuucgguauuuuuacaacaaauaucugguuaaaacuccgggauucauauacccagaugugcgaccacagacuaaugucagcggcuauuaaggauucaaaagccgugcaugccgacaugggauauuggaucgaaagugaaaagaacgaaacguggaaacuugccagagccaguuuuauugagguuaaaacaugcacuuggccuaagucgcacacucuuuggucgaauggcguccuagagagugaaaugaucauaccgaaaauuuacggaggaccuauaagucaacauaacuaucgaccggguuacuuuacgcagacugcugggccauggcaucuugggaaguuagaacuugacuucgaucuuugcgaaggaacgacaguaguuguugacgagcauugugguaauagaggcccuagccuaaggacaacaacagugacuggaaaaauuauacacgaauggugcugucggucauguacucuaccaccauuacgguuucgcggugaggacgguuguugguacggaauggagauucgaccuguaaaggaaaaggaagaaaaucuuguaagaagcaugguuuccgcaggaucaggugagguagauaguuuuucuuuagggauucuaugugcgucgauaaugauagaggagguaaugcguucuagguggucgaggaagaugcuaaugacuggaacguuagcgguauuccuucuccucgucaugggccaauugacuuggaaugaccugauucgauugugcauuaugguaggagccaacgcaucagacagaaugggcaugggaacaacguaccuggcauugauggcuacauucaaaaugcgaccaauguuugcaguuggucuauuauuuaggcgacuuacaucaagagaaguuuuguuguuaaccauaggucuuagcuugguagcaucaguugaauuaccaaauucacuugaggaacucggagacggacuagccaugggaauaaugaugcugaaacuucuuacggaauuucaaccacaucaguuauggacgaccuuauuaaguuugacauucauuaagacgacucugagucuugauuaugcauggaagacgacggcaauggcuuugucuaucgucucgcuauucccguuauguuugucgacuacuucccaaaagaccacuuggcuuccaguauuacuuggcucauuuggaugcaaaccuuuaacuauguuucuuauuacagaaaauaaaauuuggggaagaaaguccuggccucucaaugaaggaauuauggcgaucgguauaguguccauauuacuaucgucauuauuaaagaacgaugucccacuacccgauccgcuuaucgccggugguauuuugauagcgugcuacguuaucucaggcaguucagcggacuuaagccuugaaaaagcggcugaaaugucaugggagcaggaagcggagcauucaggaacgagucauaacauucuuguggagguucaagacgacggaccaaugaaaauaaaagaugaagaacgcgaugacacacucacuauauuguuaaaggcaacucugcucgccguauccgguguuuacccgaugucaauuccaggcacauuguucguaugguacuuuuggcagaagaagaaacaaagaucagggguauuaugggauacacccucuccaccuaaagucgaaagggcuguauuggaugacggaauauacagaauccuccaacgaggacuccuaggucgcucgcaaguagguguaggcguguuccaagauggaguguuucauacaauguggcauguaacaaggggagcuguguuaauguaccaaggcaaaagacuggaaccuaguugggcaucggucaagaaagauuuaauuaguuaugggggaggauggagauuucaaggcucauggaauacaggugaagaaguucaaguuauagcgguggaaccuggaaagaauccuaagaacguccaaacaacacccggaacauuuaaaacgcccgaaggugaggugggggcaauagcauuagauuucaaaccagguacaaguggaagcccaauaguaaaccgagaaggaaaaauuguaggacuauaugggaacgguguaguuacuacaaguggaacguacguuucggcuauugcucaagcaaaagcaagucaggaggguccuuuaccugaaauagaggacgaagucuuuaagaaaagaaaucuaacgauaauggaccuucauccggguucggguaaaacccgcagauaccuaccagcuauugugagagaagcaaucaagagaaaauuacgaacccuaauacuugcgccaacaagaguuguagcgagcgagauggccgaagcucugaagggaaugcccauccgcuaccaaaccacagcagugaaaucggaacauacaggccgagaaauaguagaucuuaugugucacgcaacuuucacgaugcgacugcucagccccguacgggucccaaacuacaacaugauuauaauggaugaggcccauuuuacggauccagccaguauugcggcgagaggauauauaucaaccagaguugguaugggcgaagcugcggcgauauuuaugacagcgacuccuccaggcucuguugaggcuuuuccucaaaguaacgcaguuauccaggaugaagaacgagauaucccggaacguaguuggaauagugguuaugauuggauuacagauuucccugguaaaacaguaugguucguuccuaguauaaaaucaggaaaugacauugcuaacugucuccggaagaaugguaagagagugauccaguuaaguaggaaaacuuuugacacggaguaucagaaaaccaaaaauaaugauugggauuacguaguaaccacugauauuucugaaaugggagcgaacuuccgagcagaccgaguaauagauccaaggcgauguuuaaagccagugauucuaaaagauggaccugagagggugauacuugcaggcccaaugccuguaacaguggcuucugccgcccaacggcgaggaaggauuggaagaaaucaaaauaaggaaggagaucaauacguauauaugggacaaccauuaaacaacgaugaagaucacgcgcacuggacagaagcuaaaauguuacuugacaacaucaauacuccagaggguauuauaccggcauuguuugagcccgaaagagagaaaucggccgcaauagauggugaauaucgauuaaggggugaagcaagaaagaccuucgucgaacugaugcgaagaggugaucucccuguauggcuaucguacaaagucgccucggaaggguuucaauauagcgauagaagauggugcuucgauggagaaagaaacaaucaaguauuagaagaaaauauggaugucgaaauauggacaaaagagggcgaaaggaagaaauugcguccuaggugguuggaugcaagaacguacucagacccacuugcauuacgcgaguuuaaagaauuugcagccggccguagaaguauuucaggagacuuaauacuugagauaggaaaacuaccgcaacaucuaacacugagagcucaaaaugcauuggacaaccuagugauguuacauaauucugagcaaggugguaaagcguacaggcaugcgauggaagaacuaccggacacgauagaaacauuaaugcucuuagcucuuauugcaguauuaaccgguggaguuacauuauucuuuuuaucaggaaaagguuuaggaaaaacauccauuggguuacuaugcguaacagccaguagugcacuauuauggauggcuucagucgagccacacuggauagcagcaaguauaauccuagaguucuucuuaaugguucuacuaauuccugaaccagaucgucaaagaacaccccaagauaaucaguuagcguauguugugauaggauuauuguuuaugauauugacagucgcagcuaacgaaaugggcuuauuggaaacgacuaagaaagacuuaggaauaggacacguagcugcggaaaaucaucaacaugccacaaugcuagauguagaucuuagaccugcaagugcauggacauuauaugcagucgccacgacaguuaucacaccaaugaugaggcacacaaucgagaacacaaccgcaaauauaucauuaacggcaaucgcaaaccaagcagcaauccuuaugggauuagauaagggauggccuauaucaaaaauggacauugguguaccuuugcuagcucuagggugcuacucucaagucaacccuuugacccugaccgcagcagucuuaaugcucguagcacauuaugcaauaaucggaccgggacuacaggcaaaagccacacgcgaggcacagaaaagaacugcugcaggaauaaugaaaaauccaacaguugacgguauagucgcuauagauuuggauccgguugucuaugacgcaaaauuugaaaaacaacuagggcagauaauguuguuaaucuuguguacaucacaaauacugcucaugagaacaacaugggcacuaugugaaucaaucacacuugcgaccggcccauugacaacuuuaugggaaggaucgccugggaaguuuuggaauacuacuauugccguuagcauggccaauaucuuucggggaucuuauuuagccggggcagggcuagcguuuucgcuuaugaaaagccuaggcggagggagaagagguacaggcgcccagggcgaaacucuaggugaaaaauggaaacgacaacucaaucaauuaagcaaaagugaguucaauacauacaaacgaaguggaauuauggaaguagacagaagcgaggcgaaagaaggacuaaaacgaggggaaacaacaaagcacgccgugagcagaggcaccgcgaaguuacgaugguuuguugagagaaacuuggugaaaccagaagggaaaguaauagacuuagguuguggucgcgguggauggaguuacuauugugcuggacucaagaaagugacggaaguaaagggauauacaaaaggagguccaggacaugaggagccuauaccaauggccacguacggauggaaucugguuaaauuacacaguggcaaagauguguucuuuaugccgcccgaaaaaugugauacuuuacuuugugacauuggugagaguagccccaauccaacaaucgaggaaggacguacauugaggguguuaaagaugguagaaccguggcucagaggcaaucaauuuuguauuaaaauccugaaucccuauaugccuucugucgucgagacuuuagagcaaaugcaaagaaaacaugguggaauguugguaagaaauccauuaaguagaaacucgacacacgaaauguauuggguuucaugcgggacagggaauauaguaagugcaguaaauaugaccucacgcauguuauuaaacagauuuaccauggcacauagaaaaccaacguaugagcgggaugucgacuugggagcaggaacacgucacguggcuguggaacccgagguagcaaauuuagauauaauuggacaacgaaucgagaacauaaagaacgaacacaaaagcaccuggcacuaugacgaggacaauccuuacaagacaugggccuaucaugguaguuaugaaguuaagccgucagguagcgcaucaucaaugguuaacgggguuguaagauuacuaacuaaaccaugggauguaauaccgaugguuacgcagaucgcaaugaccgauacgacaccauuuggucagcaaaggguuuuuaaggaaaaaguagauacccguacaccgagagcaaaaagaggaacuacucaaauuauggaagucacagcuaaguggcuauggggauuuuugaguagaaacaagaaaccccgcauuuguacgcgagaagaauuuacaagaaaaguucgaaguaaugcugcaauuggggcuguauucguagaugaaaaccaauggaacucagcuaaagaagcaguggaagaugaaagauucugggaucuuguacauagggaaagagaauuacauaaacaaggcaaaugcgcaacguguguauauaauaugaugggaaaacgagagaagaaacuuggugaguuuggaaaagccaaagguaguagggcgauaugguauauguggcuaggagcaagguuucuagaauuugaagcccugggguucaugaacgaagaucacugguucucuagagaaaauagucuuucagguguagagggagaaggauugcauaaacuuggcuauauuuuacgagauauuucaaaaauuccugguggcaauauguaugcagacgacaccgcgggaugggacaccaggauaacugaagaugaccuucaaaacgaagccaaaauaacugaaaucauggaaccggaacacgcacuccucgcuaccucaauuuucaaauugacauaucaaaacaaagugguaagaguacaaagaccagccaaaaacggcacuguaauggaugugauaaguagacgcgaccaacgagguagcggacagguaggcacuuacggacuaaauacguucacaaauauggagguacagcucauaaggcagauggaaagugagggcauauucuuaccaucagaacuugaaacgccaaacuuggcagaaagggucuuggacugguuagaaaaacauggugcagaaagauuaaaacggauggcgauaaguggggaugauuguguaguaaaaccaaucgacgauagauuugcaacugcauuaacagcgcuuaacgauauggguaagguaagaaaggauauaccucaaugggagccaagcaaaggauggaacgauuggcaacagguaccauuuuguucucaccacuuucaucagcugauaaugaaagauggacgagaaauaguggugccuuguagaaaucaagaugaacugguaggcagagcaagaguaagucaaggcgccggauggucacugcgugaaacugcauguuuagggaaaagcuaugcgcaaauguggcaacuuauguauuuccaccguagggacuugcguuuagccgcgaacgccauauguagugcugugccuguagauuggguccccacgucucgaacaacguggucaauacaugcucaucaccaauggaugacaaccgaggacauguugucaguuuggaacagagucuggauugaagagaauccuuggauggaagacaaaacgcaugucagcagcugggaagaaguuccuuacuuagguaaaagagaagaucaauggugugguagucugauuggucugacggcaagggcaacaugggcgacaaacauacaaguagcuaucaaucaagucaggagauugaucggaaaugaaaauuaucucgauuacaugacuucgaugaaacgcuucaaaaaugaaagcgauccagaaggggcuuuaugguaa

SEQ ID NO: 21251 - RNA, 9879 nt, Artificial Sequence
  derived and/or modified CDS sequence (opt6) from DENV-1__GQ868513__SS-prME
uccguuacuaugcuucucaugcugcugcccacugcuuuagcuuuccauuugacuacuagagguggagaaccccacaugauaguaucaaaacaagaacgcgggaaaucuuuacuauucaaaacaucugcuggggugaauauguguacauuaauugcuauggaucuuggagaacuaugugaagauacaaugaccuacaaaugcccccaaauaacugaagcagaacccgacgacguugacugcugguguaacgcuacagacacauggguaaccuauggcacgugcucacaaacaggugagcauagacgggauaaacgcagcguagcacuggcaccacauguaggacuagguuuagaaaccagaaccgagaccuggauguccucagaaggagcauggaaacaaauacaacgaguagagacuugggcacuucgacauccaggauucaccguaauagcuuuguuuuuagcgcaugcaauaggcacgucaauaacccaaaaaggaauuauauuuauccuacuuaugcuaguuacuccaucgauggccaugagguguguagguauuggaaaucgugacuucguagagggacuaaguggagcgacguggguugauguuguacucgaacauggaucuuguguaacuacuauggcgaaaaacaaaccaacauuagauauagaauuacuuaaaacggaaguaaccaacccugcgauauuacgaaaacuauguauagaagcgaaaaucucaaauacaacuacggacucacgguguccuacccagggcgaggccacacuuguggaagaacaggaugccaacuuuguuuguagacggacuuuuguagauagagggugggguaauggauguggguuauucgggaaaggcucucuacuaacuugugcaaaauuuaaaugcgugacaaaauuggaaggcaaaauuguucaguaugaaaaucuuaaauauucaguuaucguuacaguucauaccggcgaucaacaccaagucggaaacgaaacaacagagcacggaacaauugcuacaauaacaccacaggcaccuacaagugaaauccaacuaacugacuauggcgcauuaacguuggacuguucaccaagaacaggucuagacuucaaugaaaugguucuacuuacuaugaaagagaaaucuuggcuuguacauaaacaaugguuuuuagaucuuccccuucccuggacauccggagcaucaacaagucaggagaccuggaaucggcaagaccuauuaguuacguucaaaacagcucacgcaaagaaacaagaaguuguaguacuagggucacaagagggagccaugccaaccgcguuaacaggagcaacagagauacaaacaagugggaccacaacuauauucgcuggucaucuaaaauguagguuaaaaauggauaaguuaacguuaaaagguaccagcuauguaauguguacaggaucauucaaacuagaaaaggagguagccgaaacucaacaugguacaguucugguacagguuaaauacgaaggaacagaugcgccauguaaaauuccuuuuucaacccaagaugaaaaaggaguuacacagaauggacgucuaaucacagcaaacccuauaguuacagauaaagaaaaaccaguaaacauagagacugagccgccuuucggcgaaucauauaucguaguaggugcgggagaaaaagcauuaaaguugucaugguucaagaaaggcucaaguauagguaaaauguucgaagcuacagcccguggagcuagaagaauggcaaucuugggagauacagccugggacuuuggaucaauaggagggguauuuacguccguuggcaaacugguucaucaagucuuuggaacagcuuacgguguacuuuuuaguggaguuucuuggacuaugaagauaggaauuggcauucucuugacgugguugggacuaaauucccgcaguacgucucuuucuaugacuuguauagcagucgguaugguaacucuauaccuggguguuaugguccaagccgauuccggauguguaauuaacuggaaaggacgggaauuaaaguguggcucaggaauauucguuaccaaugaaguccacacauggacagaacaauacaaauuccaagcggacucaccaaaacgccucagcgcagcaaucgguaaagcaugggaagaaggcguauguggaauccgaagcgcuaccagacuggaaaauauaauguggaaacagauuagcaaugaauuaaaccauauuuuguuagagaacgauaugaaguuuacugucguggugggugacgcaaaugguauacucgcccaagguaagaaaaugauaagaccgcaacccauggaacauaaguacucauggaaaucauggggaaaggccaaaauuauaggggcagauauacaaaauacuacauucauuauagacggcccugauacaccagaaugccccgauaaccaaagagccuggaauaucugggagguagaagacuacggauucggaauuuucacgacaaacauaugguugaaauuaagggauucauauacacagaugugcgaucacaggcuaaugucagcagcgauuaaagacagcaaggcaguucacgcggacauggguuauuggauagaaucggaaaagaaugaaacguggaaacuagcuagagcuuccuucaucgaagucaaaacuuguaccuggccaaagucucauacuuuguggucaaacgggguuuuagaaucggaaaugauaauacccaaaauauacggaggaccuauaucacagcauaauuauagaccgggauacuucacucaaacagcggguccauggcauuuaggaaaauuagaacuugacuuugaucuuugugaaggaacgacuguaguuguggacgaacauugcggaaauagggggccuagccuacgcacaacaacugugacaggcaagaucauccaugaauggugcugucgcucuuguacacucccaccgcuuagauuccgaggcgaagauggauguugguaugguauggaaauacgccccguaaaagaaaaggaggaaaauuuaguuaggucaaugguaucugcuggauccggagaagucgauucauuuucgcuuggaauacuuugcgcaaguauuaugauugaagaaguuaugcguucaagauggucacgaaaaaugcuuaugaccgguacauuagcuguuuucuuacuacuggugaugggccaauuaacauggaacgacuugauuagguuauguauaaugguaggugcuaacgcaucugaccgaaugggaauggggacaacauacuuagcauuaauggcuacguucaaaaugagaccaauguuugccguaggguuauuauuucgcagacuaacaucacgagaaguguuauuacuaacgaucggauugucucuaguagcgucaguagaacuucccaacuccuuagaggaauuaggagauggccuugcaaugggaauaaugauguugaagcugcugacugaguuucaaccccaccaacuauggaucacuuuguugucacugaccuucaucaaaacuacauuaucguuagacuaugccuggaagacuaccgccauggcccuaagcauaguuagccuauucccuuugugcuuaagcaccacaagucaaaagacuacaugguuaccaguauuauuaggaucauuuggcugcaagccgcuaacgauguuucuaauaaccgaaaauaaaauauggggcagaaaaucuuggccguuaaacgagggaauaauggcaaucggaauuguuucuaucuuguuaaguucacuccucaaaaaugaugugccacuggcaggacccuuaauagcaggaggcauguuaauagcaugcuacgugauaagugguagcucggcagauuuauccuuagagaaagcggcugaaguuagcugggaacaagaggcugagcauucugggacgucccauaacauauuaguagaaguucaagaugaugguacuaugaagauuaaagaugaagaacgugacgauacacuaacuauacugcucaaagccacauugcuagcuguuagcggaguguaucccaugagcauuccugccacauuauucguaugguauuuuuggcagaagaagaaacaaagaucaggaguauugugggacacaccgucaccaccugaagucgaacgcgcagucuuagacgauggaauauacagaauacuucaaagaggauuauuaggucgaagucaaguuggaguaggcguuuuucaagauggaguauuucauacaauguggcacguuacgcgaggagcggucuuaauguaccaagguaagcgccuugagccaucuugggcaaguguuaagaaagauuuaaucagcuauggaggcggauggagauuucaaggaucguggaauaccggugaggaaguacaaguuauagccguagaaccggguaaaaaucccaaaaauguacagacgaugccugguaccuucaagacgccugagggugaggugggcgcgauugcucuggacuuuaaaccugggacgucuggaucuccaaucgucaauagagaagguaaaauaguggguuuguaugguaacgggguuguuaccacuagcgguacguacguuagugcaaucgcgcaagcgaaagcaagucaggaaggaccgcucccugagauagaagacgaaguguucaagaaacguaaccuaaccauaauggaucuucaccccggaucggguaaaaccagacgcuaccuaccagcgauggucagggaagcaauuaaaaggaaauuaagaacgcuaauuuuagcgcccacuagggucguagcuucugaaauggcagaagcgcuaaaaggaaugccgauuagguaucaaacaacagcagucaaaagugaacauacgggaagagagauuguagaccuaaugugccacgcaacuuuuaccaugcgucuacuuuccccgguaagaguaccuaacuacaacaugauuauaauggaugaagcgcauuuuacugauccugcuucaauagccgcgaggggcuauauuucaacaagaguugguaugggugaggcugcugcaauauuuaugacagcgacaccuccaggaucaguggaagcauuuccucaauccaaugcagugauucaagacgaagagagagauaucccggagcgaaguuggaacucgggcuaugauuggaucacugauuucccagguaaaaccguuugguuugugcccuccaucaaaucuggaaaugauaucgcuaauugccuaaggaaaaauggcaaacgcguaauacaauuaagcaggaaaacauucgacacagaguaccagaaaaccaaaaauaaugacugggauuacgugguaacgacagacauauccgaaaugggagcaaauuuuagagcagaucgaguaauugacccccgacggugccuuaaaccagucauacuuaaggauggaccugaacgugugauccucgcgggaccaaugccgguaaccguagcuucagcggcccaaagacguggaagaauuggaagaaaucaaaacaaagaaggagaucaauacguguacauggggcaaccauugaauaaugaugaggaucaugcccauuggacagaagccaaaaugcuucuggauaauauaaauacuccagaaggaauaauaccagcauuguuugaaccagaacgugaaaaguccgcagcaauagauggagaauacagacuuagaggagaagcuaggaaaacuuuuguugaacuaaugcgacgaggugaccuaccugucuggcuaucauauaaaguugccagcgaaggcuuccaauacucugaucggcguugguguuucgauggcgagagaaacaaucaagugcuugaagagaauauggauguggaaauauggacuaaggagggggaaaggaagaaacugcgcccuagaugguuagacgcucgcacauacucugauccguuggcacuucgagaauuuaaagaguuugcugcuggacgucguucaguuucuggggaucugauacuagaaauuggaaaguuaccucagcaucuaaccuuaagagcucaaaaugcauuggacaauuuaguaauguuacacaauagugaacaaggggguaaggccuaucgucacgcgauggaggaacuuccggauacuaucgaaacauuaaugcuauuagcucugauugcaguacuuacuggaggagucacacuauuuuuccuaagugguaaaggucucggcaaaacgucuauaggauuauuaugcguaacagcaucuagcgcacuguuauggauggcgagugucgaaccacacuggauagccgccuccauuaucuuagaauuuuuccuaaugguacuuuugauacccgaaccagauagacagcgcacgccacaagauaaucaguuggcuuauguuguuauuggauuguuguuuaugauacuuacugucgcagcuaacgaaaugggacuauuagaaacaacaaagaaagacuuaggcauaggacauguagcggcagaaaaccaccaacacgcuacgaugcuagauguggauuugcgcccagccucagcauggacacucuaugcagucgcuacgacgguuauaacacccaugaugagacauaccaucgaaaacaccacagcaaauauauccuuaacggcaauagcaaaucaggcagcuauauuaauggggcuagacaaaggcuggccuauaucaaagauggacauaggcgucccucuucuagcauuaggauguuacucucaggucaaucccuuaacauuaacugccgcggucuuaauguuaguagcacacuaugcuauuauuggcccuggcuuacaagcaaaagcgacucgcgaagcgcaaaagagaacagcagcagguauaaugaaaaacccgacgguagacggaauaguagcaauugaccucgacccaguuguguaugacgccaaauuugaaaaacaacuaggacaaauaaugcuuuuaauuuugugcacuucucaaauccugcucaugcguacaacuugggcccugugcgaauccauaacuuuagccacugggccuuuaacuacacuuugggagggaucuccagguaaauuuuggaauacgaccauugcaguaucaauggcaaacauauucagggguucuuacuuagcaggggcaggauuagcuuucuccuuaaugaaaucauuaggaggagggagacgggggacaggagcucaaggagaaacauuaggagaaaaguggaaacgucaacuuaaucaacugaguaaaucagaguucaauacauacaaacgaucaggaauuauggagguugauaggucagaagcuaaagaagguuuaaaaagaggggagacaacgaaacaugccguaucucgggggacggcaaagcugagaugguuuguagaaagaaaucucguuaaacccgaaggaaaaguaauagaucucgggugcgguagaggggguuggucauauuauugugcaggucuaaagaaaguaaccgaaguaaaagguuauacuaaaggaggcccuggccaugaagaacccaucccuauggcaacauauggguggaauuuagugaaguuacauucgggaaaggauguauuuuucaugccacccgaaaaaugugauacacuucuaugugauauaggagagucuuccccuaacccuacaaucgaggagggaagaacauuacgaguuuugaagaugguagaaccuuggcugagagggaaccaauucuguauuaagauauugaauccauacaugccgaguguaguugaaacacuugaacaaaugcaaaggaaacacgguggcaugcuagugcgaaauccacuaucacggaacagcacacaugaaauguauuggguaucgugugguacagguaacauuguaucugcagucaauaugacaaguagaaugcuacucaauagguucacaauggcacaccgaaaacccacuuacgaacgcgauguugaucuaggagccggcacaagacacguagcaguggaaccggaaguagcaaauuuggauauuauuggucaaagaauagagaauauuaaaaaugaacauaaauccacauggcauuaugaugaagauaacccauacaagacuugggccuaucaugggucauacgagguaaaaccgaguggaagugccuccaguauggugaauggugucgugcgucuacucacuaaacccugggauguuauaccuaugguuacacaaauagcaaugaccgauacuacaccguucggacaacaacgaguauuuaaagaaaaggucgacacaagaacacccagagcaaagcgaggcacaacacagauuauggaaguaacagcuaaauggcuauggggguuucuaucuagaaacaagaaacccagaauuugcacacgagaagaauuuacccgaaagguaaggagcaaugcugcuauuggagcaguuuuuguagaugaaaaccaauggaacagcgcaaaggaagcgguagaggacgaaagguuuugggaccugguacaccgagaaagagaacuacacaagcaggguaaaugcgcuaccuguguuuacaacaugaugggaaagcgcgagaagaaauuaggagaguucgguaaagcuaaggguagucgagcaauaugguacaugugguuaggcgcuagauuucuagaauuugaagcacuaggauuuaugaaugaggaccauugguuuaguagagaaaauagccuaagcggaguugaaggcgaaggacuacauaagcuaggauauauccuccgugacauaucaaagaucccaggugguaacauguacgcugaugauacggcagggugggauacacguauaacugaagaugaccuucaaaacgaggcaaaaauaacagaaauaauggaaccagaacaugcccuacuugcgaccucuauauuuaaauugacauaucaaaauaaaguaguaagggugcagcggccggcuaaaaauggaacugucauggacguaauaucaaggagggaccaacgagguagcggucaagucgguacguauggccuaaauacauuuacuaacauggaaguacaacugauuaggcagauggagucugaaggaauauuuuuaccuagugaguuagaaaccccgaaccuagccgaacguguucuggauugguuagaaaaacacggggcugaaagauuaaaaagaauggccaucagcggagacgacugcgucgucaagccgauugaugauagguuugcuacugcuuugaccgcacuaaaugacaugggaaaaguaagaaaagauauuccucaaugggaaccuucaaaaggcuggaacgacuggcaacaaguuccguucuguucgcaucacuuucaucaauuaaucaugaaagauggucgagagauugugguuccaugucggaaucaagacgaacucguaggccgggcgcgugucucacagggggccggauggagcuuaagagaaacggccugucucgguaaaagcuaugcgcagauguggcaacuuauguacuuucaucgaagagaucuuaggcuggcggcaaaugcaauaugcagugccguuccggucgauugggucccaacaagucgcacuacauggucuauacacgcacaucaucaauggaugaccacagaggacauguuaagcguuuggaacaggguauggauugaagaaaauccuuggauggaagacaagacacauguuagcucgugggaagaaguaccauaccuaggaaaacgagaagaucaauggugugggucccucauugggcuaaccgcaagggcuacaugggcaacaaacauccaagucgcaauuaaucagguuaggcgucugauagggaacgagaauuauuuggacuacaugacaucuaugaagcgcuuuaaaaacgaaagcgacccagaaggggcucuaugguag

SEQ ID NO: 21252 - RNA, 9879 nt, Artificial Sequence
  derived and/or modified CDS sequence (opt6) from DENV-1__GU131973__SS-prME
agugugacgaugcucuugauguuacuaccgacggcuuuggcauuucauuuaacaacaagaggaggagaaccccauaugauuguaucgaaacaagaacgcgguaaaaguuuacuauucaaaacaagcgcgggaguaaauauguguacguuaaucgcaauggaucugggagaacuuugugaagacacgaugaccuacaaauguccacaaauaacugaagcggaaccagaugacguggacugcugguguaaugcuacugacacuugggucacguauggaacauguucgcaaacuggggaacaucgaagggauaaaagauccgucgcguuggcaccgcauguaggauuaggucuugaaacuagaacugaaacauggaugagcucagaaggagcauggaaacaaauacaacgaguagaaacgugggcauuacgacauccaggguucacugucauagcacuuuuucuugcacaugcaauaggcacaucgauaacgcaaaaaggcauaaucuuuauuuuacuaauguuaguuacuccaucaauggcaaugagaugcgugggcauuggaaaucgagauuuugucgaaggcuuaaguggggcaacauggguugaugugguacuggaacaugguaguuguguaacuacgauggcgaaaaauaagccaacacuagauaucgaauuauugaaaacugaagucacaaauccugcaauacuaagaaaauuaugcauagaagcaaaaauuucuaauacaacaacggauagucgguguccaacacaaggagaagcuacguugguugaagaacaagaugcgaauuuuguauguagaaggacguucguagauagaggcuggggaaaugguugcggacuguucggaaaagguuccuuguugaccugugcaaaauuuaaaugugucacgaaacuggaggggaaaaucguacaguaugaaaacuugaaauauucuguuauagugacuguacacacaggagaucagcaucagguaggaaacgagacuacagagcauggcacaauugcaacgauaaccccacaagcgccaacaucagaaauccaauugacugauuauggggcccuaacuuuggauugcagcccaagaacgggccuagacuuuaaugagaugguacuacuuaccaugaaagaaaaaucgugguuaguucauaagcagugguucuuggaucugccacuaccauggacgaguggagccaguaccucacaagaaacguggaauagacaagacuugcucguuaccuuuaaaacugcacaugccaagaaacaggaaguaguuguacuaggaucgcaagaaggagcgaugcauaccgcauugacgggagcaacagaaauccagacaagugggacaacgacuauuuuugccggucaucuaaaauguagauuaaaaauggauaaauuaacacuaaaggguacgucauauguaauguguaccgguucauucaaauuagagaaagagguugcagaaacacaacacgguaccguauugguucaggucaaauacgaaggaacugacgcaccgugcaaaaucccauucucaacacaagacgagaaagggguaacacaaaacggaagauuaauaacugcaaauccaaucguuacugauaaagaaaaaccgguaaacauugaaacugaaccgccauuuggagaaucauacauuguuguuggggccggggaaaaagcauuaaaacucaguugguuuaagaaaggaucuaguauagggaaaauguuugaagcaaccgcaagaggcgcacgacgaauggcgauuuuaggagacacagcaugggauuucgguucgauuggagggguuuucacauccguuggaaaauuagugcaccaaguuuuugguacagcauauggaguuuuauucucugguguaucguggacuaugaaaauaggcauaggaauacuauuaaccugguugggauuaaauucaaggagcacaagccucaguaugacauguauugcuguugggauggugacccuuuauuuaggagucaugguacaggcggacucuggcugcguuauuaauuggaagggaagagaauuaaaguguggaaguggaauauuugugacaaacgagguacacacauggacagaacaauauaaguuucaagcugauaguccuaaacgauugucagcugcaauaggcaaggcuugggaagagggcguuugcgguauuagaagugcuacaagacuggagaacauaauguggaaacaaauaucaaaugaauuaaaccauauccuuuuagaaaaugauaugaaauucacuguaguugugggagacgccaauggaauauuagcacaagguaagaagaugauaagaccacaaccgauggaacauaaauauaguuggaaguccugggguaaagcuaaaauuauuggugcugauauacaaaacacuacuuucauuauagacgggccagauacaccggaaugccccgauaaccaaagagcguggaauauaugggagguugaagacuauggguucgggauauucacuacaaauauaugguuaaaauuaagagacagcuauacucaaaugugugaccauaggcucaugagcgcugcaaucaaagacaguaaagcaguacaugcagacauggguuauuggauugaaagcgaaaagaaugaaacuuggaaacuugcuagagcaaguuucauagaagucaaaaccuguacuuggccaaaaagucauacacuauggaguaacgguguuuuggagucagaaaugauuauuccaaagaucuacgggggaccaauaagccaacacaauuaucguccagguuauuucacgcaaaccgcaggaccauggcaccuagguaaacuggaauuagauuuugauuugugugaaggaaccacuguuguaguagacgaacauugcgguaauagagggccuucauugcgcacaacgacuguaacuggaaaaauuauccacgaaugguguuguaggucauguacucugccgccuuugcguuucagaggcgaagacggguguugguauggcauggagauaaggcccguaaaagaaaaggaggaaaauuugguacggaguaugguaagcgccggaucuggcgaaguagacucauucucacuggggauacuuugcgucagcauaaugauagaggaagucaugcgcucucguuggagucgcaagaugcuaaugaccggcacuuuggcuguguuucuuuuacuuguaaugggucaauuaacauggaacgauuugauaaggcucugcaucaugguaggagccaaugcgagugaucgaauggguaugggaacuacuuaucucgcucuaauggcaacuuucaaaaugagaccaauguuugcgguuggcuuguuauuucgcagauuaacgaguagagaaguuuuacugcuaacaauugguuugucacucguagcaaguguugaacuaccaaauucauuagaagaacuaggagauggauuagcgauggguauaaugauguuaaaacuucucacugaauuucaaccccaccaauuauggacaacuuugcucaguuugacauuuauaaaaaccacacugucauuggauuacgccuggaaaacuacugcaauggcccuaaguauuguaucccucuuuccacugugcuuaaguaccacgucacagaaaacuacuuggcugccgguauuacucggcagcuuuggcuguaagccgcuaaccauguucuuaaucacagaaaacaaaaucuggggucgaaaaucuuggccauuaaacgaagguauaauggcaauaggaauaguaagcauauuacuauccagucuucugaaaaacgacguaccauuagcuggcccccuuauugcgggcgguaugcucauagcgugcuaugucauaucaggaucuucugcggaccuuagucuggagaaagcagcagaaguaucaugggagcaagaagcagaacauagcgguacaagucauaacaucuuggucgagguucaagacgauggcacgaugaagauaaaagaugaagagagagaugacacacugacaauuuuacuaaaagcaaccuuacucgcuguuagcgguguuuacccuaugaguauuccggccacacuuuucguuugguauuuuuggcagaagaagaaacaacgaucagguguucuaugggauacaccuucgccuccugaagucgaacgagcuguacuagaugacggcauauauaggauccugcagcgugggcuacugggucguucacaaguagguguaggaguauuccaggauggaguauuucacaccauguggcauguaacgcguggggcggugcucauguaucaaggcaaacguuuagagccuucuugggcaagcgucaagaaagaccuuauaucauauggcgguggauggcgguuccagggaucauggaacaccggggaggaaguccaagucauugcuguagaaccggguaaaaacccgaaaaauguucaaacaaccccagguacguucaaaacgccggaaggagaaguuggagcgauugcauuggauuucaaacccggaacgucagguaguccaauagucaauagagagggaaaaauaguuggcuuauaugguaacggcguuguaacaacaucagggacauauguaucugcgauagcacaggcaaaagcaagccaagaagguccacuaccugaaauagaggacgaaguauucaaaaagaggaaccuuacgaucauggauuuacacccgggaucggguaaaacucggagauauuuaccugcaauuguacgagaagcaaucaaacggaaaaugagaacacuaauacuagcaccuacaagaguuguggcgagugaaauggcugaagccuugaaggguaugccaauucgauaucaaacaacugccgugaaaagcgaacauacaggaagggagauaguggaucucaugugucacgcuacguuuacuaugcggcuuuuaaguccaguuagagugccaaauuauaacaugaucauuauggaugaggcacauuucacagauccagcauccauagcagcgagaggguacauaucaaccagaguagggaugggagaagcagcugcuauuuucaugacagcuacuccuccgggaucuguagaagccuuuccgcaaucaaacgcggucauacaagacgaagaacgagacauuccugaacggucauggaacucuggauacgacuggauuacagauuucccaggaaaaacgguaugguuuguaccaucuauaaagucagggaacgauauagcuaauugcuugcguaaaaaugguaagcguguaauucaauuaucaagaaaaaccuuugauacagaauaucagaaaacgaaaaauaacgauugggauuacguagucacaacugacauuucugagaugggggcgaauuuuagagcagacagagucauugauccaaggcgauguuugaagccuguuauacuaaaagauggaccggaaagaguaaucuuggcuggacccaugcccgugacuguagcgucggcagcccaaagacgagguaggauagggagaaaucaaaauaaggaaggggaccaguauguauauaugggucaaccauugaauaaugacgaagaucaugcacacuggaccgaagcuaaaauguuauuagacaauauaaacaccccagaaggaauaauuccagcgcuauuugagccagaaagagaaaagucugccgcuaucgauggagaguauagguuaagaggggaagcaagaaaaacauucguagaauuaaugaggcguggugauuugccagucuggcuaaguuauaagguggcuagugaagguuuccaauauagugauagacgcugguguuuugacggagagcggaauaaucaaguauuagaagaaaauauggauguagaaaucuggacuaaggagggggaaaggaagaaacuacgaccuagauggcuugaugcuaggaccuauucugacccucuagcccucagagaauuuaaggaguuugccgccgguagaagaucaguuaguggagaccuaauucuugagauaggcaaacuaccucaacaucuaacacuaagagcccaaaaugccuuagauaaccugguaauguuacacaauagcgaacaagguggcaaggcguacagacaugcaauggaagaauugccggauacaauagaaacacugaugcuauuggcgcuaauagcagugcuuacaggcggagucacucuuuucuuuuuauccggcaaaggacuaggaaaaaccucaauaggacuacucugcguuacugcuucgucggcacuauuguggauggcgucggucgaaccucauuggauagcugcuuccauuauacuagaauuuuucuuaaugguauuauuaauuccagaaccggacagacagcgcacuccacaggacaaucaacuggcauauguaguaauaggccuuuuauuuaugauucuaacagucgccgccaaugaaaugggacuacuugaaacuacuaagaaagauuuagguauagggcauguggcagccgagaaucaucaacacgcuacuauguuagauguggacuuaagaccggcaagugcauggacccuguacgcaguagcaacuaccguaauuacccccaugaugagacauacuauagagaauacaacagcaaauauaagccuuacggcuauugcuaaccaagcugcaauauugaugggcuuagauaaagguuggcccauaucuaaaauggacauugggguuccccucuuagcucugggcuguuauucucaggucaacccacugacacuaacagcagcuguucuaauguugguugcccacuacgccauaauagguccgggacuacaagcgaaagcaacacgugaagcgcagaaaaggacagcagcugguauaaugaaaaaucccacaguggauggcauuguugcaaucgaccuagacccugucguuuaugacgcaaaguuugaaaaacaauuagggcaaaucauguuacuaauacucuguacgucgcaaauuuuacucaugaggacaacuugggcccuaugcgaaagcauuacccuagccacgggucccuuaacuacacucugggaaggcaguccuggcaaguuuuggaacacgacaauugcaguaaguauggccaauauauuuagggggucauaucuagcgggggcaggacucgcauucucccuuaugaaaagucuuggcggcgggcguaggggaacuggcgcucagggggaaacccuaggcgaaaaguggaagcggcaguuaaaucaauuaagcaaaucagaguucaauacuuacaaaagaucagguaucauggaaguggauaggucggaagcaaaggaagguuuaaagagaggugaaacuacaaaacaugccguaaguagaggaacggcaaaacuacgaugguucguagagagaaaccugguaaaaccggaggguaaaguaauagaccuuggauguggcagaggcgguuggucauauuauugcgccgggcugaagaaaguaacagagguaaagggauacacuaaaggugguccaggacaugaagaacccauaccuauggcaacauauggauggaaccuaguaaaacuacauucagggaaagacguuuucuuuaugccaccugaaaaaugcgauacuuuacuaugcgauaucggugaaucuuccccgaauccgacgauugaggaaggacgcaccuuacgaguucuaaagaugguugaaccauggcuucgcggaaaucaauuuugcauaaaaauacuaaaccccuacaugccuagcguaguugaagcguuagagcaaaugcaacgaaagcacggggguaugcucgugagaaacccauuaucaaggaacucgacacacgaaauguauugggucucgugcggaacuggaaauauuguaucggcaguuaacaugacaagcaggauguuguuaaaucgcuuuacaauggcgcaucgaaagcccacauaugaaagagacguugacuuaggagcuggaaccagacacguagcagucgaaccugaagucgcuaacuuagacauaauugggcaaagaauugaaaauaucaaaaacgaacacaaaagcacguggcacuaugacgaagauaauccauauaaaacuugggcguaccauggcaguuaugaaguaaagccauccgguucggcaucaucgaugguuaauggggucguuaggcuccuaacuaaaccuugggacguuauaccgauggugacacaaaucgcaaugacugauacuacgccuuuuggacaacaacgggucuuuaaagaaaaaguugauacacguacaccacgcgccaagcgcgguacuacccaaauaauggaaguaaccgcuaaauggcuaugggguuuccucucuagaaauaagaaacccagaauuugcacgagagaagaauuuacgagaaaaguucgaagcaaugcagcaaucggagcgguauuugucgaugaaaaucaauggaacucagcaaaagaagcaguugaagacgaaagauuuugggaucuagugcaccgagaaagggaacuacauaagcaaggaaaaugcgcgacuuguguuuauaauaugauggguaaaagagagaagaaauugggggaauuugggaaagcaaaaggaucuagagcaauaugguauaugugguuaggagcacgguuuuuagaguucgaggcguuaggguuuaugaacgaagaccauugguucucaagggaaaacagccuauccgguguagaaggugaagggcuacacaaauuaggauauauauuaagagacaucagcaaaauuccuggaggaaacauguacgccgacgauacagccggaugggauacgcgaaucacagaggacgaccugcagaacgaggcaaaaauaacggaaauaauggagccagagcaugcccuccuagcaacaucaaucuuuaaauuaacauaccaaaauaaagugguacgaguccaaagaccagcuaaaaacggcacaguaauggaugucaucagucgacgcgaccagcgaggaaguggacaaguuggcaccuauggucucaauacuuuuacaaauauggagguacagcugauacggcaaauggaaagugaaggcauauuuuugcccagcgagcuagaaacaccaaacuuagcggagagagugcuagauuggcuagaaaagcauggagccgaaaggcuaaagagaauggcaaucucgggugaugauugcguuguaaaaccaauagaugauagauuugcuacugcgcuaaccgcacucaaugacaugggaaagguaagaaaagauaucccccaaugggagccuucaaaaggguggaaugauuggcagcaggucccuuuuugcucacaccacuuucaccaauuaauaaugaaagacggaagggaaauaguuguuccauguagaaaucaagacgaacuggugggcagagcucggguaucacaaggagccggauggagucuccgggaaacugcuuguuuagguaagaguuaugcucaaauguggcaacuuauguauuuucacaggagagaucucagauuagcggcaaaugccauuugcucggcagugccuguugauuggguaccgacaagcagaacuacuuggucgauacaugcucaucaucaauggaugacuacugaggauaugcugagcguauggaaccgcguguggauugaggagaauccuuggauggaagauaaaacacacgucucgagcugggaggaaguaccauaucuagguaaaagagaagaccaauggugugguuccuuaauaggauuaacagccagagcaaccugggcuacuaauauacaaguagcuauaaaucaaguuagaagauuaauaggcaacgaaaauuaucuagauuauaugacaucaaugaagcgguucaaaaaugaaucagauccugaaggugcacugugguaa

SEQ ID NO: 21253 - RNA, 9879 nt, Artificial Sequence
  derived and/or modified CDS sequence (opt6) from DENV-1__GQ868517__SS-prME
ucgguuacgaugcucuugaugcuccuccccacugcacuagcuuuccaucuaaccacccguggaggagaaccucacaugauugugucuaaacaagagagggguaaaucauuacuauucaaaacaagcgcuggggugaauauguguacgcucaucgcaauggaucuuggagagcuaugugaagauacuaugacauauaaauguccgcaaauuacugaagcagaaccggaugauguagauuguugguguaacgcaacugacacuugggugacauauggaacauguucucaaacaggggagcacagaagagauaaaagauccguugcauuagcuccucacguaggacugggcuuggagacuagaacggagacauggauguccucugaaggggcauggaaacaaauccaacgcguggagaccugggcgcuacgucacccaggauuuacagucauagcacuauucuuagcucaugcaauagguaccucgauuacucaaaaagggauaaucuuuauucuacuaauguugguuacaccaucaauggcaaugagguguguaggaauugguaacagagauuuuguugaaggauugaguggugcgacauggguggacguggugcuagaacacgguaguugugugacaacaauggcgaaaaacaaacccaccuuggacauagaacuccucaaaacagaaguuacaaauccagcgauacucagaaaacuuugcauagaagcuaaaauaaguaacacaaccaccgauucuagaugcccaacacaaggggaagccacauuagucgaagaacaagaugcaaacuucguuugucgacgaacuuucguugaccgaggguggggaaauggaugcggacuauuugggaaaggcucucuacuuacuugcgccaaauuuaaaugcgugacaaaacuugaagggaaaauaguacaauaugaaaaucuaaaauacucugucauagucacgguucauacaggagaccagcaucaaguuggaaaugaaacuacugaacacgggacaauugccacaauaacuccacaagcaccaacuucagagauucaacucacggacuacggugccuugacauuagacugcucaccgagaacaggccuagacuucaaugagaugguauuacuaacaaugaaagagaaaucguggcuugugcauaaacaaugguuccuagacuuaccgcugccuuggaccuccggggcaucaacaucacaagaaacauggaauagacaagaucugcuaguaacauuuaaaacugcccacgccaagaaacaggaaguuguuguauuagguucacaagaaggagcaaugcacaccgcacuaaccggagcaacugaaauccaaacgucaggaacaacgaccauauucgcaggacaucuaaagugucggcuaaaaauggauaaguugacauuaaaaggaacaucuuacguaauguguacaggcaguuuuaaacuagaaaaagaaguggcggaaacucagcacggaacaguauuaguacaaguaaaauaugagggaacugaugcgccuuguaaaauucccuuccuaacucaggacgaaaaagggguaacacaaaauggucguuuaauaacugcaaaucccauuguaacagauaaggaaaaacccguaaacauagaaacagaaccuccauuuggagaaaguuacauaguaguaggagcuggugaaaaggcacuaaagcucucuugguucaagaaagguucgaguauagggaaaauguuugaagcaacggcucgaggggcacgacggauggccauacuaggcgacacagcaugggauuucgggagcauugguggagucuuuacaaguguaggaaagcuaguccaucaaguauuuggaacagcguacgguguacuguucucggguguaucuuggacgaugaaaauagggauaggcauccuuuuaacauggcuaggauugaauaguagauccacuucucuguccaugacauguauugcaguaggcauggugacucuuuaccuaggcgucaugguacaagcagacaguggaugugucauaaauuggaagggacgcgaauugaaaugcggcucggggauuuucgugacuaaugagguacauacauggacagagcaguauaaauuucaagcagacucuccaaaacgcuuaucagcagcaaucgguaaagccugggaagaagguguaugcggcauucggucggccacucguuuagagaacauaauguggaaacaaauaaguaaugaacuaaaccauaucuuguuagagaaugacaugaaguuuacaguaguaguaggcgacgcaaauggaauacuugcgcaagguaagaaaaugaucagaccgcaacccauggagcacaaauacaguuggaaaaguuggggaaaggcaaagauaauaggugcagacauccaaaauaccacguucaucauugacgggccggacacgccggaauguccagauaaccaacgagccuggaauauuugggagguagaggauuauggauuuggcauauuuacuacgaacauuugguugaaacuuagagacaguuauacacaaaugugcgaucauaggcuaaugucugcugccauaaaagauaguaaagcuguacacgcagacaugggauauuggauugaaucggagaaaaaugagacauggaaauuagcaagagccagcuuuauugaagugaaaaccuguacauggccaaaaagucauacauuauggucgaauggugugcuugaguccgaaaugauuauaccgaaaaucuaugguggucccauaucccaacacaacuacagaccgggauacuuuacacaaacagcuggaccuuggcaucuuggcaagcuagagcucgauuuugacuugugcgaagguacuacuguaguagucgacgaacauugcgggaacagggggccaucacuccgcacgacuacaguaacaggaaaaauuauacaugaaugguguugcagaucauguacucuaccuccauuacgguuuagaggggaggacggcugcugguacgggauggaaauaagaccaguaaaagagaaagaagaaaaucucguacgaucaaugguaucagcagggagcggugaaguugauucuuuuucauugggaauuuuaugcgcaaguauaaugauugaagagguaaugagaucacgauggagcagaaaaaugcuaaugacagggacacuagcaguauucuuauuauuaauuaugggucagcugacauggaacgauuugauaagacuaugcauaauggucggagcgaacgcuagugaucguaugggaaugggcaccacauacuuggcgcuuauggcgaccuuuaaaaugagaccuauguucgcgguaggacuuuuguucagacgacugaccucuagagaaguccuccuguugacaaucggauuaucuuuggucgcuucaguugaauuaccaaauucgcuagaggaacugggggacgguuuggcaaugggaaucaugaugcuaaaacuguuaacagaauuucaaccccaccagcuauggacgacacuucuuucucuaacuuuuauuaaaaccacccuaagccuagauuaugcuuggaaaacaacggcaaugguauuaaguauuguaucucuauucccucuaugcuugucaacaacuagccagaaaacuacauggcuaccaguccuuuuggguuccuucggaugcaaaccgcucacaauguuucuuaucacagaaaacaagauuuggggaagaaaauccuggccguuaaaugaaggaauaauggcaauaggcauaguaucuauauuacuuaguucucuauugaaaaaugaugugccccuagcagggccguuaauugcaggaggcauguuaauagcauguuauguaauauccggaucgucggccgaucuaagccuagagaaagccgcggaagucaguugggagcaagaagcugagcauuccggaacaagucauaauauucucguagaaguacaggaugacggaaccaugaagauuaaagaugaagaaagagacgacacacuaaccaucuuauugaaggcuacauuguuagcugugucagguguauauccaaugucuauucccgcuacguuguucgucugguacuucuggcagaaaaagaaacagagaucaggcguuuuaugggauacaccgagcccaccagaaguagaacgcgcgguacucgaugaugggaucuauagaauacugcaaagaggauuacuuggaaggucccaaguaggaguaggcguuuuccaggaugguguuuuucauacaauguggcacguaacccggggugcaguauuaauguaccagggcaaaagguuagaaccgaguugggccaguguaaagaaagacuugauuucauacgguggagguuggagauuucaagguaguuggaauacaggugaggagguccaaguaauagccgucgaacccggcaaaaaccccaaaaacguacaaaccacaccagguacauuuaaaacuccagaaggggaagucggugcaauagcauuagacuuuaaaccuggaacuucagggagucccauuguuaaccgagaaggaaaaauaguuggauuguacgggaauggaguuguuacgacauccggaacguauguuuccgcaaucgcccaagcgaaagcaucacaagagggaccguugccugagauugaggaugaaguauuuaagaaacggaaucuaacaaucauggaucuccacccagguucugggaagacucgaagguauuuaccggcuauuguaagagaagcaauaaaacgaaagcuaaggacuuugauucuggcuccaaccagaguuguggccucagaaauggcagaagcccuaaagggaaugccaauaagauaucaaaccaccgcagucaagagcgagcauacggguagagaaaucguugaucuaaugugucaugcaacauucacuaugagauuacucucaccuguuagggugccuaacuauaauaugauaauuauggacgaagcucauuucaccgauccggccucuauugcagcuaggggcuauaucucuaccagaguagggaugggugaagcagcggcaauuuuuaugacggcaacgccaccggguucuguagaagcguuuccucaaucaaaugcaguuauucaagaugaagaaagagauauacccgaaagauccuggaacucgggauaugauuggaucacugacuuucccggaaaaacaguuugguucgucccaucgauaaagucagguaaugauauugccaauuguuuacgaaagaauggaaagaggguuauacaacuaaguagaaagacauuugauacugaauaccagaaaacuaaaaauaaugauugggacuacguaguaacgacagauauaagugaaaugggagcaaauuuccgcgcugaccgagucaucgauccccgacguugccuuaagccaguaauauugaaagauggaccagaaagggugauacuagcaggacccaugccuguaacuguagcuagugcagcgcaacggagaggaagaauuggaagaaaucaaaauaaggagggcgaccaauauguauacauggggcaaccauugaauaacgacgaagaucaugcacauuggacggaagcuaaaauguuacuagauaauaucaacacuccagaagggauaauaccagcccuauuugaacccgagcgagaaaagagcgccgcaauagacggugaauauagauugagaggugaagcgagaaaaacguuuguggaauugaugaggagaggugaccuaccuguuugguuauccuauaaaguggcaucggaagguuuccaguacucugaucgucgauggugcuuugacggugaaaggaauaaucaaguauuggaggaaaauauggauguagaaauuuggacuaaagaaggagagagaaagaaacuuagaccgagauggcucgacgcacgaaccuacuccgacccauuagcauuaagggaguucaaagaguuugcugcaggacggcguaguguuucgggagaucuaauacuugaaauaggaaaguuaccucaacauuugacguuaagagcacaaaaugcuuuggauaaucuugugauguugcacaauagugagcaaggcggaaaggcuuaccgucacgcaauggaggaauugcccgacacaauagaaacauugaugcuguuagcguuaauagcgguucuaacaggagguguaacauuauucuuucucuccggaaaaggauuagguaaaacgucaauagguuuauuaugcguaaccgccucaagcgcccucuuguggauggccuccguagagccacauuggauagcugcuucaauuauacucgaguuuuuccuaaugguccuauuaauaccugaaccggauagacaaagaacuccucaagacaaucaauuagcauaugucguuauuggucuuuuauucaugauucuuaccguggcagccaaugaaaugggccugcuugaaaccacgaagaaagaccuagguauuggacauguagcggcagaaaaucaccaacacgcaacaauguuagacguagaucuucguccagcguccgcauggacucuauaugcagucgcgacuacaguaauuacccccaugaugcgucauacuauugaaaauacaacugcgaauaucucacuuaccgcaauugcgaaucaggcggccaucuuaaugggucuagauaaaggcuggcccauaucaaaaauggauauuggcguuccauugcuagcauuagguuguuauucgcaaguuaauccauuaacauuaacugcggcaguuuuaauguuagucgcccauuacgcaauuauaggcccaggacuacaagcuaaagcuacgagagaagcacagaaacgaacagcugccgguauaaugaagaauccaacgguagacggcauaguagcuauagauuuagacccaguaguauacgacgcuaaauucgagaagcaacuagggcaaauaaugcuauuaauccuuuguacaucccaaauauuauuaaugagaacuaccugggcgcucugcgaaaguauaacucuugcuacgggaccguugacgaccuuaugggaaggaaguccugguaaguucuggaauacaacuauagccguuucgauggcuaauauuuuucguggaucauauuuagcgggcgcuggccuagcauucucccugaugaaaucgcugggcggggguaggagaggaacgggcgcccaaggagaaacauugggagagaaguggaaacgccaacugaaucaguuaucgaaaucugaauuuaacacauacaaaagaucuggaauaauggaaguagauagguccgaagccaaagagggccugaaaaggggugaaacaacuaaacacgcggucagccggggcaccgcaaaauugagaugguuuguagaaagaaauuuaguuaaaccggaaggaaaaguuauugaucucggguguggaagaggaggcugguccuauuauugcgcuggucucaagaaggugacagaaguaaagggguacacaaaagguggcccaggccaugaggaaccuauaccgauggcaacuuauggguggaaucugguaaagcuacauaguggaaaagauguauucuuuaugccaccagagaaaugugauacauuacucugugauaucggcgagaguucaccaaauccaacaaucgaagaagggagaacacuccguguccuaaaaaugguggaaccaugguugcgcgguaaccaguucuguaucaaaauauugaacccauacaugccuucaguaguugagacacuagaacagaugcaacgaaaacacggaggaaugcugguuagaaauccauuaaguagaaauucuacucaugaaauguauugggucagcuguggcaccggcaauauuguaagugcgguaaauaugacauccagaaugcuacuaaauagauuuacaauggcgcaucgaaaaccgacauucgagagggauguagaccugggggcugggaccaggcaugucgcuguagaaccugaagucgcaaaucuggauaucauaggucagcguauagaaaacauuaaaaacgaacauaaaucgacuuggcacuaugaugaagauaauccauacaagacaugggcauaccacgggucuuacgagguaaaaccaucaggaucugccucuagcauggugaacgggguaguuagacuauuaacaaaaccgugggauguuauaccaaugguaacucagaucgcgaugacggauacaaccccguuuggucaacagcgggucuucaaagaaaagguugauacaagaacuccacgugcuaaaaggggaacgacgcaaauaauggagguaacagcaaaaugguuguggggcuuuuuaaguagaaauaaaaagccccgaauuugcacucgagaagaauuuacuagaaaagucagaagcaaugcugcaauuggugccguuuucguggaugaaaaucaguggaacucagcuaaagaggcgguagaagacgaaagauuuugggauuuaguucauagggaaagagaauuacauaaacaaggaaaaugugcaacauguguauauaauaugauggguaaacgugagaagaaacuuggugaguuugguaaggcgaaagggucuagggccauaugguauauguggcuaggagcaagauuccuugaguucgaagcucucggauucaugaaugaggaucauugguucucacgcgaaaauucauugucugggguagagggugagggccugcauaaacuugguuauauauuaagagacauaucaaaaauucccggaggcaacauguacgcugacgauacagcugguugggauaccagaauaacagaggacgaucuacaaaaugaagcaaaaaucacagauauuauggaaccagaacaugcacuucucgccacaaguauauucaaacuuacuuaucagaauaagguagugcgcguccaacgaccagcgaagaacggcaccguuauggauguuauaagcagacgggaucaaagaggaucuggucaggucggaacuuacggacugaacacuuuuacaaauauggaaguacaauuaauaaggcagauggaaucagaagggauuuuccuuccaucagaacuagaaaccccaaaccucgcugaacgaguacuagauuggcuugaaaaacauggcgccgaacggcucaagcgaauggcgauaaguggggaugacugcgucguaaagccaauagaugaucgauucgccacagcacuuacugcucucaacgacauggggaaaguaagaaaagauauaccacaaugggaaccaucuaaaggcuggaacgauuggcaacaaguaccuuucuguagccaccauuuccaccaacucaucaugaaagaugggcgugaaaucgugguaccuuguaggaaucaagaugaauuaguuggccgagcccgaguuagucaaggcgcaggauggucacugcgcgaaacagcaugccuuggaaagucauaugcacagauguggcaguuaauguauuuucaucgaagagaccuuagacuugcugcgaacgccauuugcucggcgguaccaguggauugggugccuaccucacgaacgacauggucaauucaugcucaucaccaauggaugacaacggaagacauguuaucuguauggaacaggguauggauugaagaaaauccguggauggaagauaagacacacguaucgaguugggaagaaguaccauaucuagguaaacgcgaagaucaauggugcgguucucuaauaggguugacagcuagagcuacuugggcaaccaauauucaaguagcaaucaaccagguaaggagauuaauaggaaacgagaauuauuuagauuacaugacuucuaugaagagauucaaaaaugaauccgauccagaaggcgcuuugugguaa

SEQ ID NO: 21254 - RNA, 9879 nt, Artificial Sequence
  derived and/or modified CDS sequence (opt6) from DENV-1__GU131976__SS-prME
uccguaacuauguuacuuaugcuccuaccgaccgcacuggcauuccauuuaacaaccagagggggagaaccccauaugauagugucuaaacaagaaagaggaaaaucacuacuauucaaaacgagcgcagggguaaauauguguacuuuaaucgcgauggauuugggugaacuaugcgaagacacuaugacuuacaaauguccgcaaauaacggaagcagaaccggacgacguggacugcuggugcaaugcaaccgacacuuggguaaccuaugguacauguucucaaacuggggaacaucggagggacaaacgauccgucgcacuugcuccccauguaggacuaggacucgaaacaaggacagaaacuuggaugucaagugaaggagcauggaaacaaauacagagaguagaaacuugggcgcuccgccacccaggauuuaccgugauugcacucuuccuugcucaugcaaucgguacuucgaucacacagaaaggaauuaucuuuauccuacugaugcuugugacuccaagcauggcaaugcgguguguugguauuggcaacagagacuucguugaaggguuaaguggagcuacguggguagauguaguacuagaacauggcaguugcguaacuaccauggccaaaaauaaaccaacucuagauauagaguuacuuaaaaccgagguaacaaauccagcuauauuacgaaaacucuguauagaggcaaaaauaagcaauacgacaaccgauucuagaugcccuacucagggcgaagcaacuuuaguagaagaacaagacgcaaacuuuguguguagacggacuuuuguugaccgcgguuggggaaauggaugcggucucuuugggaaagggagccuauuaacgugcgccaaauuuaaauguguuacuaaauuggaagggaaaauaguacaguaugagaaucucaaguauucgguuauaguaacaguacacacaggcgaucaacaccaaguaggaaaugagacgaccgaacacgguacuauagcaacaauuacaccccaagcucccaccucggaaauccaacugacagauuacggcgcauuaacauuagauuguaguccaagaacagggcucgauuucaaugaaaugguauugcucacaaugaaggagaaaaguuggcuggugcacaaacaaugguuuuuggaucucccauuaccguggacaucaggagcaucgaccucccaggaaacauggaaccgacaggaccuacugguuacauuuaaaacggcacaugcaaagaaacaagaagucguuguacuaggaucacaggaaggugcuaugcauacggcccuaacaggugcaaccgaaauacaaacuucagguaccaccacaaucuucgcgggucaccuuaagugucgcuugaaaauggauaaacucacgcuaaaagggacaucguacguaaugugcacugguagcuuuaaacuugaaaaggaagucgcugagacacaacacggcacaguauuaguccaagucaaauaugagggcacugaugccccuuguaaaauaccauucucaacacaagaugaaaaaggagucacacaaaauggacgucuaauuacagcaaaccccauugucacugacaaagaaaaaccaguaaauauagaaacugagccuccuuuuggggaaaguuauauaguagucggagcgggcgagaaagcgcucaaauugaguugguuuaaaaagggaagcaguauaggaaaaauguuugaagcaaccgcaagaggcgcacguagaauggcaauacuaggugauaccgcuugggacuuuggcaguauuggaggcguauucacauccgugggaaaacucguucaucagguauucggaacagccuacgguguacuauuuagcggaguuucauggacaaugaaaauaggaauaggaauauugcucacuugguuaggcuuaaauucacggucuacaucacugucaaugacaugcauagcagugggaaugguaacauuauauuuaggugugaugguucaagccgauucagggugcguuauuaacuggaaaggaagagagcuuaaauguggcucaggcauauuuguuacuaaugaaguccacacauggacggagcaauauaaguuccaagcggauucaccuaaacgauuaagugcugccauaggaaaagcaugggaagaaggcguuugcgguauucguucagcgacacgccuggaaaacauuauguggaaacaaauaucaaacgagcucaaccacauacuacuagaaaaugacaugaaauuuacaguaguagucggagacgcuaacggcauauuagcccaaggcaagaaaaugauaagaccacaaccaauggaacacaaauauucauggaaaucauggggaaaggcuaaaauuaucggagccgacauacaaaauacaacauucauaauugacgguccggauacaccggaaugcccggauaaccagagagcauggaacaucugggaaguagaagauuaugguuuuggcauuuuuacaacgaacauuugguuaaaacucagagauucauacacgcaaaugugcgaucaccgcuugaugagugcggcgauaaaagauaguaaagcgguacaugcagacaugggauauuggauugaaucggagaaaaaugaaaccuggaaacucgcuagagcuucuuuuauagagguuaaaacauguacguggccgaaaucucauacacuauggaguaaugggguuuuagagagugaaaugauaauacccaaaauauacggagggccuauaucccaacauaauuacagaccuggauacuucacacagaccgcagguccauggcaucuagguaaauuggaacuagacuucgauuuaugcgaaggaacgacgguaguaguagacgaacauuguggaaauagggguccuucguuaagaacaaccacagucacggguaaaauaauucaugaaugguguugucguaguuguacauuacccccgcugagauuccguggugaggacggaugcugguacgguauggaaauuagaccagucaaagaaaaagaggagaauuuggucagaucgaugguaucagccggaucaggagaaguugacuccuuuucuuugggcauauuaugugcaucuuuaaugaucgaagaaguaaugaggaguagauggucaagaaaaauguuaaugacgggaacgcucgcuguguucuuauuacuaaucaugggacagcuaacauggaaugaccugauucguuuauguauaaugguuggagcuaaugcaagugaucgcaugggcaugggaaccacauaccuggcacuaauggccacuuuuaaaaugcgaccaauguuugcaguuggacuacuuuucagacgccucacaagucgugaggugcuucuguuaacaaucggauuaucuuuaguagcaaguguagaacuuccaaacucuuuagaagaguuaggagacggacuugccaugggaauaaugauguugaaacuauugacagaguuucaaccacaccaacuauggacgaccuuacucucacuaaccuucauuaaaacuaccuugagccucgauuacgcuuggaagacgacggccauggcauuaucaaucguuagcuuauuuccauugugucugagcacaacuagccagaagacgacgugguugccaguguuauuagguucuuuuggauguaaaccgcuuacuauguuccuuauaacagaaaacaaaauuuggggacguaaaaguuggccuuugaacgaaggcaucauggcaauuggaauagugaguauauuguuaagcucauuacuuaaaaacgaugugccauuggcuggaccgcuuauagcaggaggcauguugaucgcuuguuacguuauuagcgggucuuccgcggaucuaucacuggaaaaagcugcugaaguaaguugggagcaagaagcagaacauucaggaacaagccauaacauauugguugaaguacaggaugauggaaccaugaaaauuaaagaugaagaaagagacgacacucuuacaauauugcuuaaagcgacacuauuggccgucucugggguauacccaauguccauacccgcgacacuauucgugugguauuucuggcagaagaagaaacaaagaucugguguccucugggacaccccauccccuccugaggucgagagagcuguuuuagacgauggaauauaucgcauucuucaaagaggguuguuggguagaucacaaguuggcgugggcgucuuucaagauggaguuuuucacacuauguggcacguuacuagaggcgcugugcuuauguaucaaggcaaacgacuagaaccaucaugggcaagcgucaagaaggaccuaauaaguuacggcggaggauggagauuucaagggucuuggaacacaggagaagaagugcaagugaucgcugucgagccggggaaaaacccgaagaaugugcaaacaacaccuggcacguucaaaaccccugaaggagagguaggugcgauagcauuggauuucaaaccugguacaucaggcucacccauagucaauagagaaggaaaaaucgucggauuguacggaaacggcgucgucacaacaagcggcacauauguaucugcaaucgcgcaagccaaagcuagucaagaaggaccguuaccagaaauagaggaugaaguuuucaagaaaagaaauuugacaauuauggaucugcaccccgguucagguaaaacacgucgguaccuucccgcuauaguacgagaagccauaaaacguaaauuacgcacccucauccuugcaccuacaagggugguagcuucagaaauggcagaggcacuaaaggguaugccaauacguuaccaaaccacagcuguaaaaagcgagcauaccggaagagaaauuguugacuugaugugccaugcuaccuucacaaugcgauuauugaguccaguaagaguuccaaauuacaauaugauaauuauggacgaagcucauuucacggacccugcaagcauugccgcucgaggauauauaaguacaagaguaggcaugggugaggccgcugcuauuuucaugacugcuacacccccagggucuguggaggcuuuuccccaaucuaaugcagugauacaggacgaggagcgagauauucccgaacgaucauggaacagcggauaugacuggauaacggauuuuccagggaaaacagugugguuuguacccucaauaaaauccgggaaugauauagcaaacugucucaggaaaaauggcaaacgagucauacaacuaucaagaaagacuuuugauacagaauaucagaaaacuaaaaauaacgacugggacuacgugguaacaacggauauuucugagaugggagccaauuucagagcagauaggguaauagacccgcguaggugccuuaaaccagugauauugaaagacggaccagaaagagugauccuggcgggucccaugccagugacuguagcauccgcagcucaacgacgugguagaauagggagaaaccaaaacaaagaaggagaccaauauguuuacaugggacagccuuugaauaacgacgaagaucacgcgcacuggacagaagcgaaaaugcuacuugacaauaucaauacucccgaagggauaauuccagccuuauuugagccagaacgagaaaaaucagcugcgauagacggggaguauagacuaaggggagaagcccguaaaaccuucguugaacucaugcgaagaggggacuuaccggucugguuaucuuauaaaguugcuuccgagggauuucaauacagcgaucgccguugguguuuugacggugagcggaauaaucaggugcuagaagaaaauauggacguggaaauuuggaccaaagagggcgaacggaagaaauuacgaccacgguggcuagaugcucgcacguacucggacccauuggcacuaagagaauuuaaggaauuugcggccggucgacgauccguaagcggugaccugauauuagaaaucgguaagcuaccccaacacuuaacacuuaaggcucagaacgcacucgauaaccuaguaaugcuacacaacucugaacagggaggaaaagcauauaggcacgcaauggaagaacuaccagacacaauagaaacacuaauguuacuugcacuuauagcaguccugacgggaggugucacacuauucuuuuugagugggaaaggacuuggaaaaacaaguauaggguuguuaugugugaccgcgucuuccgcguuguuauggauggcuucuguggaaccucauuggauagcugcuucaaucauucuugaguucuuucuuaugguucugcuaauuccagaaccugauagacaaagaacuccgcaagacaaucaacuagccuacguaguuauagguuuacuuuuuaugauuuuaacagucgcggcaaacgaaaugggacucuuagaaaccacaaagaaagauuuagguauagggcacguagcugccgaaaaccaucaacacgcgaccauguuagauguagauuugagacccgcauccgcauggacacuauaugcuguagcaacaaccguaauuacuccaaugaugcggcauacgaucgaaaacacuacugcuaauauaucguuaaccgcaauagcgaaccaggcugcaauucucaugggacuagauaaaggauggccaauaagcaagauggacauaggugugccauugcuugccuuagguugcuauucccaaguuaauccccuaacacuaacugcugcuguauugaugcugguagcacacuaugccauaauugguccgggcuuacaagcuaaagcuaccagggaagcacagaaacgaaccgcggcgggcaucaugaaaaauccuacgguagauggaauaguagcaauagacuuggauccuguggucuacgaugcuaaauuugaaaaacaauugggacagauaauguuauuaauacuauguaccagccaaauucucuuaaugagaacuacgugggcccuaugugaaucaauaacacuagcaacagguccucuuacaacauugugggaaggcucaccgggaaaauucuggaacaccacaauagccguauccauggcuaacaucuucagaggaagcuacuuggcuggagccgguuuagcguuuucccuaaugaaaagucuagguggcggaagaagagguacgggcgcccaaggugaaacacuuggugaaaaguggaaaagacaguugaaucaauuaucuaagagcgaauuuaauacuuauaagagaucaggaauuauggaaguagacagauccgaggcuaaagagggacuaaaacggggagagacuaccaaacaugcaguaucacgggguacugcaaaacuaaggugguucguugagaggaaccuaguuaagccagagggaaaaguaaucgaccuugguugcgguaggggaggcuggaguuacuacugugcaggguugaaaaagguaacagaaguaaagggguacaccaaagggggaccaggucaugaagaaccaauaccaauggcaaccuaugguuggaauuuaguuaaacuacacuccgguaaagauguauuuuucaugccacccgagaagugcgacacauuauuaugcgauaucggugaaaguaguccgaauccgacaauugaagaagggcgcaccuuacgaguucuaaaaaugguggagcccuggcuuagaggcaaucaauuuuguaucaaaaucuugaaccccuauaugccuagcgugguugagacauuagagcaaaugcagagaaaacaugggggcaugcucguuagaaacccccuaucgcgaaacaguacgcacgaaauguacuggguaucgugugguaccggcaacauaguuagcgcaguaaauaugacgucuaggaugcugcuuaacagguucacgauggcacaucgaaaaccuacauuugaacgagacguagaccuuggcgcaggaacacgacacguagcaguugaaccugagguugcaaaucuugacauaaucggacaaagaauagaaaauaucaaaaaugaacacaaaagcacauggcacuaugaugaagauaacccauacaaaacgugggcauaucacggaucauaugaaguuaagcccagugggucugccagcucuaugguaaacggcguaguaaggcuauugacgaagccaugggacgucauuccaaugguaacucagauagcaaugaccgacacaaccccauucggccaacaacgaguuuuuaaagaaaaagucgacacuagaacucccagagccaagagggggacaacucaaauaauggagguaacagcaaaaugguuauggggauuuuuaucacgcaauaagaaaccaagaauauguacacgagaagaauuuacaagaaaaguuagaagcaaugcugcuaucggugcgguauucguagaugaaaaucaauggaacagcgccaaagaagcagucgaagaugaaagguuuugggaucuagugcaucgcgagagggaacuccauaaacaaggaaagugugcuacaugcguuuacaauaugauggguaaacgcgagaagaaacuaggcgaauuuggaaaggcaaagggaucacgugcaaucugguauaugugguuaggcgcaagauuccuagaguucgaagcgcuaggguucaugaaugaggaucauugguuuagucgagagaacucauuaucaggcguagaaggagaaggucuucauaaacugggcuacauuuuacgagacauuuccaaaaucccaggcggcaauauguacgcugacgacacagcggguugggacacaaggaucacagaagaugacuugcaaaacgaggccaagaucacagauauuauggaaccugaacaugcgcuguuagcaacaucaauauucaaacuaacuuaccaaaauaaaguaguuaggguccaaagaccagccaaaaaugguacaguaauggauguuauauccagaagagaccaaagaggcucaggacaaguaggcacuuauggacuuaacaccuucacaaauauggaaguccaacuaaucagacagauggaaucugagggcauauuuuuaccgucagaauuagagaccccuaaucuggcagagcgaguguuagauugguuggagaaacaugggacagagcgauugaaaagaauggcaaucucaggggaugauugcguuguuaaaccuauagaugacagauucgcuacugcucuaacagcucuaaaugauaugggcaaaguucggaaagauauaccucagugggaaccaucuaaaggauggaacgauuggcagcaaguccccuuuuguagucaccacuuucaucaacuaauaaugaaagacggacgagaaauaguaguuccuuguagaaaucaggacgaguuggugggucgggcuagagucagccaaggcgcagguuggagucuucgggaaacugcaugucuaggaaagucauaugcgcaaauguggcaauuaauguauuuccacaggcgugaccugcgauuagcugcaaaugccaucuguucagcaguaccuguagacuggguuccuacaucaagaacgacauggagcauacacgcccaucaccaauggaugacuacagaagauaugcucucaguauggaauagaguauggauagaggagaacccguggauggaagauaaaacacauguuucaucuugggaagagguaccauaucuagguaaacgugaagaccaauggugugguagucuaauagggcuuacagcgcgagccacaugggcuaccaacauucaaguugcaauuaaucaagugcgacgccuaauugguaacgaaaauuauuuagauuacaugaccaguaugaagagauuuaaaaacgagagugacccagaaggagcuuuaugguaa

SEQ ID NO: 21255 - RNA, 9879 nt, Artificial Sequence
  derived and/or modified CDS sequence (opt6) from DENV-1__GQ868518__SS-prME
ucaguaaccauguuauugaugcuuuuaccgacagcacuugcauuucaccugaccacacgcggaggagaaccacauaugauagucucuaaacaagaaagagguaaaagccuucuauucaaaacgucugcgggaguaaauaugugcaccuuaaucgcaauggacuugggagaacugugugaagacacgaugaccuauaaauguccccaaauaacagaagcggaaccagacgacguagauugcugguguaaugcaacagacacauggguaaccuauggcacaugcucucaaacgggagaacaccgacgugacaaacgaagcguagcccuggcaccacacguugguuuaggacuugaaacacgaacugaaaccuggaugucaagcgaaggagcauggaaacaaauccaacgggucgaaacaugggcucugcggcacccaggcuuuacagugaucgcacuuuuccuggcacacgcaauaggaacuucaauuacacaaaaaggaauuaucuucauauuacuaaugcucguaacaccaucgauggcaaugcguugcguggggauagggaaccgugauuucguugaaggucuuucaggagcaacuugggucgaugugguauuggaacacggaucauguguaacaacuauggccaaaaauaaaccaacacuugacauagaacuuuuaaaaacagaaguuacgaauccugcaauacuacggaaauuaugcauugaagccaaaauaucaaacacaacaacggauucacgaugcccaacucagggagaagccacauuaguggaagaacaagacgccaauuucguuugucgaagaacauucguggaccguggcugggguaaugguuguggguuauucgggaaaggcucucuauugacaugcgcuaaauucaaauguguuacaaaacuagaagggaaaauuguacaauacgaaaacuuaaaauacucaguaaucguuacaguucacacaggggaucaacaucaaguaggaaaugagacaacagaacauggaacaauagcaacgaucacgccgcaggcacccacuucggagauacaacuaacugauuacggagcucuaacacuagauugcagcccccguacuggcuuagauuuuaacgaaauggugcugcuaaccaugaaagaaaaauccuggcuaguacacaaacaaugguuccucgaccucccuuugccauggacaaguggcgcgucgacaagucaagaaacguggaaccgacaggacuugcuggucacauucaaaacugcgcaugcuaagaaacaagagguaguaguauuaggcagccaagagggugcaaugcacacagcauugacaggugcgaccgagauccaaaccucugguacuacuacuaucuucgcaggucacuuaaaaugucgacuuaaaauggauaaacuuacauuaaaaggaacuucauacgucauguguacagguagcuucaaacuagaaaaagagguggcugaaacacagcauggaacgguucuaguccaggucaaauaugaaggcacagacgcgcccugcaaaauaccuuuuucaacacaagaugagaaaggaguaacucaaaacggaagauuaauaacugcaaauccgauagugacugacaaagaaaaacccguuaauauagaaacagaaccacccuuuggugaaucuuacauaguagucggggccggcgagaaagcccucaaacucagcugguucaagaagggauccucaauuggaaagauguuugaagcgacagcgcgaggugcacggaggauggccaucuuaggcgauacagcaugggauuuuggcagcauuggagguguuuucacgucuguugguaagcuaguacaucaaguuuuuggaaccgcauacgggguuuuauuuucaggcguaucuuggaccaugaagauaggaauaggaauauuacugacauggcuaggacucaacucucguaguacauccuuaucaaugacuugcauugcaguggggauggucacacuguaccuggggguuaugguacaagcagauucaggaugugugauuaauuggaagggaagggagcuuaaaugcgggucagggauauuugugacgaacgaaguccauaccuggacagaacaauauaaauuccaagcagacagcccaaaaaggcuaucagcagcuauagguaaggcuugggaagaaggaguaugcgguauaaggucagcgacucggcuagaaaauaucauguggaaacaaauaucaaaugaauugaaucacauacuuuuagaaaaugacaugaaguuuacuguuguaguuggagaugcuaaugguauauuagcucaagguaagaaaaugauacgaccucaaccaauggagcauaaauauaguuggaaaaguuggggcaaagccaagauaauaggagcagauauucagaauaccacguuuaucauagauggacccgauacgccugaaugcccagauaaucagcgcgcauggaacauuugggaaguagaggauuacggcuucggaauauucacuacuaacauaugguugaagcuaagagacucauauacccagaugugcgaucaucgguuaaugucggcagcgauuaaggauuccaaggcaguacaugcagacaugggauauuggauagaaucugagaaaaacgagacauggaaacuugcucgggcgucguuuaucgaaguaaagacauguaccuggccgaaaagucauacacuuuggucaaacgggguacuugagucagaaaugauaauaccgaaaauauauggugguccuauaagucaacacaauuacaggcccggguauuuuacccagaccgcagggccuuggcauuuggguaaacuagaguuagauuuugaucucugugaggguacgacugugguuguagacgaacacugugguaaucggggcccaagccuccguaccacaacaguuacugguaaaauaauucacgaaugguguugcaggaguuguacucuaccuccgcuuagguucagaggcgaagaugggugcugguacggaauggaaauaaggccaguaaaggagaaagaagagaaucugguacgcucaauggucagcgcugguagcggugaaguggauaguuucucacugggcauacuaugcgcgucaaucaugauagaagaaguaaugagaagccgauggucacgcaaaauguuaaugacagguacuuuagcagucuuccuguuauuaguuaugggacaacuaacuuggaacgauuugauuagguuaugcauaaugguaggcgcaaacgcaucagaucgaaugggaaugggaaccacuuaucuagcccuaauggcaacuuuuaaaaugcgccccauguucgcaguaggacuacuauuuagaaggcuaacauccagagaaguguuacucuuaacaauaggccuuucacucguggcuucaguagaauugcccaauucacucgaagaacuuggagacggucuugcaaugggaaucaugaugcuaaaacuucucacagaauuucaaccccaccaacuauggacuacauuauugucgcucacauuuauaaagaccacccuuagcuuggacuaugccuggaaaacaaccgcaauggcacugucgaucguaucccuauucccguuaugcuuaagcacaaccucacaaaagaccacuugguugccaguauuacuaggauccuuuggauguaaaccgcuaacgauguuccugaucaccgaaaacaaaauauggggcagaaagaguuggccccucaacgaagguaucauggcuauugguaucguuaguauucuauuguccagccuacugaagaaugauguuccucuagcaggaccccugauagccggaggaaugcugauagccugcuaugucauaagcgguucaagcgcugaucuaucacuagaaaaggcggcagaaguauccugggaacaagaagcggaacauuccggcccaucacauaauauauuaguggaaguacaagaugauggaacaaugaagauuaaggaugaggaaagggacgacacacuaaccauucuguuaaaagcgacauuacuagcagucuccgggguauacccuaugaguauccccgcaacauuauucgugugguauuucuggcaaaagaagaaacagcguagcggaguauuaugggacacaccuaguccaccggaaguugagagggcugucuuagacgauggaauauacagaauacuucaaagaggccuauuagguagaagucaggugggagugggagucuuucaagaugguguauuccacacgauguggcauguuaccaggggugccguucuaauguaccaaggcaaaagauuagaaccaagcugggcaucuguuaagaaagacuugaucucauauggugguggguggcgauuccgaggaucauggaauacaggugaggaggugcaagucaucgcuguugaaccugguaagaaccccaagaacguccagacaaccccagguacauuuaaaacgccagagggagaagucggggccauugcuuuagauuucaaacccgguacaucuggaucaccaauuguaaauagagagggaaagauaguuggauuauacgggaacggaguagugacaacuucggggaccuauguaucugcaauugcgcaagcuaaagccagccaagaagguccauuaccugagauugaagacgaaguuuuuaagaaaaggaauuuaacuauaauggauuuacacccagguagcggaaaaacuaggagauauuuaccagccauaguccgagaagccauuaaaagaaaacuaagaacuuugauccuagcaccaacaagaguaguugcaucugaaauggcugaagcguuaaaagggaugcccauucgauaccagacaacugcugucaaaagugaacacacagguagagagaucguagauuugaugugccaugcaaccuucacuaugcgcuugcuaucgccugugcgaguccccaauuacaauaugauuauuauggaugaagcacacuucaccgaccccgcauccauugcggccagaggcuauauaagcacgcgaguaggaaugggcgaagcggcagcgauuuucaugacagccacacccccgggcucaguggaggcuuuuccucagucaaacgccguaauccaagaugaagaaagagauauuccggaacguucuuggaacucuggauacgauuggauaacugauuuuccuggaaagacugugugguuugugccuaguauuaaaaguggcaaugauauugcuaacuguuugcgaaagaauggaaaaagaguuauacaacuauccaggaagacguucgacacagaguaccagaaaacgaagaacaacgauugggacuacgucguaacaacagauaucagugagaugggcgcuaacuuuagggcagaccgagucauugacccccguagaugcuuaaaaccuguuauucuuaaggacggccccgagagaguaauucuagccggcccgaugccagugacaguagcgucagccgcacaacggcggggcagaaucgggcguaaccaaaauaaagaaggcgaucaauauguauauauggggcaaccucugaacaacgacgaagaccacgcacacuggaccgaggccaaaaugcuacuagacaauauaaacacaccagaaggcauaauacccgcacuauuugaaccagaaagagagaaaucagcggcuauagauggugaguaccggcuacgcggagaagcgcguaaaacguuuguugaauugaugagaagaggcgaucuuccggugugguuaucguacaagguagcgagcgaagguuuccaguacuccgacagacgauggugcuucgacggggaacgaaauaaccaaguacuagaagaaaauauggacguugaaauauggacaaaagaaggagaacguaagaaacugcguccccgauggcuagaugcaagaacguacagugauccacuugccuugcgugaauuuaaagaguucgccgcugggcggagaucaguauccggagaucugauuuuagaaauugggaaacuuccacaacauuugacaagccgagcgcaaaaugcguuggauaauuuaguaauguuacauaauagcgaacagggcggcaaagcauaucgacaugcgauggaagaauuaccugauacuauugaaacuuugauguuacuugccuuaauugcaguuuuaacagggggugugacauuguucuuuuuauccgggaaaggccucggaaagacaagcauaggccuauuauguguuacagcuucaagugcauuguuguggauggccagcguggaaccccacuggauagcugcguccauuauuuuagaauuuuuccuuauggugcuucuaauaccugaaccggaccgccagaggacgccccaagauaaccaguuagccuacguagugauaggauuacuauucaugauacuaacuguggcugccaaugaaaugggauuacuagagacaaccaagaaagaucuaggaauaggacacguggccgccgaaaaccaucaacacgcaacgaugcucgauguggauuugaggccagcgucugcauggacauuauaugcagucgccaccacugugauuacuccaaugaugaggcauacaauugaaaacacuaccgcuaacauaaguuugacggcgauugcuaaccaggccgccauccuaaugggacuugauaaaggguggccuauaagcaaaauggauaucgguguaccauuauuagcauuagguuguuauucucaaguaaaccccuuaacacugacggcagcgguacuaauguuaguagcacauuaugcgaucauaggaccggguuuacaggcaaaagcaacgcgggaagcccaaaaacgaacugccgcagguaucaugaaaaacccaacggucgauggcaucguagcaaucgacuuagaccccguuguuuacgaugcuaaguucgaaaaacagcugggucagauuauguuauuaauccuauguaccagccaaauacuucuuaugcgcacaacuugggcgcucugcgaaucuauuacauuagcuacagggccuuuaacaacgcuuugggaggggaguccaggaaaauuuuggaacacuacgauugcaguaagcauggcaaauaucuuuaggggaucauaccucgcaggggcggggcuggcguuuuccuuaaugaagaguuuaggaggaggaagacgaggaacaggagcucaaggugaaacauugggagaaaaauggaaacgacaauuaaaucaauuaagcaaaagcgaauuuaacacuuauaagagaucuggaauaauggagguugaucgaucagaagcaaaggaagguuuaaaacgaggugaaaccacaaaacaugcuguuaguaggggaacggcuaaacuaaggugguuuguagaacgaaaucuaguaaagcccgagggcaagguuauagauuuaggauguggucgagguggauggucauauuacugugcugguuuaaagaaaguaacugagguaaaaggauauaccaaaggagguccgggacaugaggaaccgauaccgauggccacauauggauggaacuuggucaaacuucauaguggcaaagacguguucuuuaugcccccagaaaaaugcgauacccuccuaugcgacauuggugaaaguaguccuaaucccacaauagaagaaggccgaacucugaggguucuuaaaaugguggaaccauggcucagaggaaaucaauucuguauaaaaauuuugaauccauauaugccuucuguuguagagacguuagaacaaaugcaaaggaaacacggagguauguuaguaagaaauccuuugaguaggaacaguacacacgagauguauuggguaucgugugguacuggaaauauugucagugccgucaacaugacaagcaggauguuauuaaaccguuucacgauggcacaucgaaaaccaacauaugaaagagacguggaucuuggagcaggaacuaggcauguugcugucgagccagaaguugcaaacuuggauauaauaggacagaggauugagaauaucaaaaaugagcacaaaaguacuuggcauuacgacgaagacaacccauauaaaaccugggcauaucacgggucguacgagguaaaaccgaguggaagugcaucgagcauggugaauggcguugugcgccucuuaaccaaaccgugggaugugauaccgauggucacgcaaauagcuaugacggacacgaccccuuucggccaacaaagagucuuuaaagaaaaaguagacacuagaacaccuagagcaaagagaggaaccacgcaaauaauggaaguaacugcaaaauggcuuugggguuuucuuucuaggaauaagaaaccuagaauauguacaagagaagaguucacuagaaaagucagaucaaacgcugcgauuggagcaguauuugucgacgagaaucaguggaauagugcuaaggaagcaguagaagacgaacgauuuugggaucugguacacagggagcgugaacugcacaaacaagguaagugugcaacuugugucuauaauaugaugggaaagagagagaagaaauuaggugaguuuggaaaagcgaaaggaucuagggcaaucugguauaugugguuaggugcccguuucuuagaguucgaagcucucggguucaugaacgaagaucauugguuuagucgugaaaauuccuuaagcggggucgaaggugagggacuacauaaacuagguuauauuuugcgcgacauuucaaagauuccagggggcaauauguacgcugaugauacagcaggaugggauacaaggauaacugaggaugacuuacagaaugaagcaaagauaacagaaauaauggaacccgagcacgccuugcuagcuacgagcaucuuuaaacucacauaccaaaacaaaguugucagaguacaacgaccugcgaaaaacgguacaguaauggacguaauuagccgccgcgaccaacggggaucuggacagguagggaccuauggcuugaauacuuuuacaaauauggaaguacaacuaauccgacagauggaaucggaaggcauauuuuugccgagcgaauuggaaacuccaaaucuugcggaaagaguauuagacuggcuugaaaagcauggagccgaacgacugaaaagaauggcuauaucaggugacgacugcguuguaaaaccaaucgaugacagauucgccacagcuuuaacagcacugaaugacauggguaaaguaaggaaagacauuccgcagugggaaccaaguaaaggguggaacgacuggcaacaagucccauucugcagccaccauuuucaccaacuaauaaugaaagauggucgcgaaaucguagugccuugccguaaucaggaugaauuagucggacgagcgagggugagccaaggagcaggauggucgcuccgagaaacugcgugucucggaaaaucauaugcacaaauguggcaguuaauguauuuucaucggagagauuuaagguuggccgcaaacgcaauuuguucggcagugcccguggacugggugccuacgucaagaacuacuuggucaauucaugcacaccaccaauggaugacaaccgaagauauguuaucaguauggaauaggguauggauagaagagaaucccuggauggaggacaagacacaugugagcucgugggaagaaguaccauaucuaggaaaaagagaagaccaguggugcgggagcuuaauuggauuaacagcaagagcaacaugggcaacgaauauacaaguugccaucaaucaaguacguagacuaaucggaaaugagaauuacuuagauuauaugacuucuaugaaaagauuuaaaaaugaaagcgacccggaaggagcccucugguaa

SEQ ID NO: 21256 - RNA, 9879 nt, Artificial Sequence
  derived and/or modified CDS sequence (opt6) from DENV-1__GQ868519__SS-prME
agcguuacuauguugcuaaugcuucugcccacugcauuagcguuccacuuaacaacaaggggaggugaaccucacaugauugugucuaaacaagaacgugggaaaagucuucuguuuaaaacuucggcuggaguaaacauguguacacugauagcaauggaccuuggugaacuaugcgaagauacaaugacauauaaauguccgcaaauaacggaagcggaacccgacgauguagauuguuggugcaacgcgacagauacguggguaacguauggaacguguucacaaacuggagaacacagacgagacaaaagaucuguugcucucgcuccacauguaggauuaggauuagaaacacgaacugaaacguggaugagcagugaaggagcauggaaacaaauucaacgaguagaaacuugggcgcugagacauccaggauuuacgguaauagcucucuuucuagcacaugcaauuggaacgucgauaacgcaaaaaggaauaauauuuauuuugcugaugcuagugaccccuucuauggcgaugaggugcguugguauugggaaccgagacuuuguagaaggacucucaggugcaacauggguagauguaguacuugaacacgguucuugcgucacaacgauggccaaaaauaaaccuacucucgacauagaauugcuuaaaacugaagucacaaacccagcaaucuuaagaaaauuguguauagaagcuaaaauaagcaacacuaccacagauagcagauguccgacgcaaggcgaagcaacuuuaguagaagaacaagacgcuaauuuuguguguagaagaacguuugucgauagagguugggguaauggaugcggucuauucggaaaagguucgcuccuaacgugcgcuaaauucaaauguguaacaaaacuagaaggcaaaauaguccaauaugagaaucucaaauauagcguaauugucacugugcauacuggagaucaacaccaagucggcaaugaaacaacagagcauggaaccauugcuacaauaacuccccaagcccccacgucagaaauucaacugacugauuauggugcccuaacuuuagauugcuccccacgaaccggauuggauuucaacgaaaugguauugcugacaaugaaagagaaaucguggcucguucauaaacaaugguuccuggaccuaccuuuaccauggacaucaggagcaucuacuucccaagaaacguggaacaggcaagaccuacuggucacuuucaaaacugcccaugccaagaaacaagagguuguuguccucggaucacaagaaggagcaaugcauaccgcccuaacuggagcaacagaaauccaaacaaguggcacaacaacuaucuuugccggucaucuuaaaugccgucucaaaauggauaaauuaacauugaaagguacaucauauguaaugugcacagggaguuuuaaacuagaaaaagagguagcggaaacacagcaugguacaguccuaguacaagucaaauaugaaggcacagacgcuccuuguaaaauaccauucuuaacucaagacgaaaaagggguaacacaaaauggaaggcucaucaccgccaauccuauugugacagauaaagaaaaacccguuaacauugaaacugaaccuccguuuggagaaaguuauauuguuguuggagcuggagaaaaagcguuaaaauuaucgugguuuaagaaaggaucuucgaucggaaaaauguuugaagcaacagcucgaggagccagaagaauggcaauacuaggugauaccgcgugggauuucgggucuauagggggaguuuucacgucaguaggaaagcuagugcaccaaguauucggaaccgcauaugguguucuauucagcggugucaguuggaccaugaagauaggaauaggcauuuuauugacgugguuggguuuaaauucacggucuacaaguuuaucaaugacauguauagcuguaggaauggucacauuauaucuuggaguuaugguacaagcggacucaggaugcgucauaaauuggaaagguagggaauuaaagugcgggucaggaauauuuguaacaaacgaaguacauaccuggacugaacaguauaaauuccaagcagauagucccaaaagacuaagcgcugccaucggaaaggcgugggaagaaggcgugugugguauacguucugcaacaagauuagaaaauauaauguggaaacaaauaucgaaugaacuuaaucauauccuacuagaaaaugacaugaaguuuacuguugucgucggcgacgcaaacggcauacuagcucaaggcaagaaaaugauuagaccccaaccaauggaacacaaauacucguggaaaucgugggggaaggccaaaauaauuggggcggauauucaaaacacuacauuuaucauugauggcccggacacaccugaauguccugacaaucaaagggcauggaacauuugggaagucgaagacuauggauucggaauauucacuaccaacauauggcucaagcuacgagacucauauacacaaaugugcgaccacagauuaaugucagcugcaauaaaggacucaaaggcaguccaugcagauauggguuacuggauagaaagugagaaaaaugaaaccuggaaacuagcccgagcaucauuuaucgagguaaaaacauguacuuggcccaaaagccacacguuauggaguaacggaguauuagagagugagaugauaauaccgaaaauauacggugggccuaucucacaacauaauuacagaccuggcuauuucacccagaccgcaggcccguggcaucuugguaaauuggaacuugacuuugacuuaugcgaagggacuacuguaguaguggacgaacacugcggaaauagagguccaucacuccggacaaccaccguuacagggaagauaauacaugaaugguguugcagaaguuguacuuuaccuccacugagauuuaggggugaagacggaugcugguauggaauggagaucagaccugugaaggaaaaagaagaaaaucuuguucguuccaugguaagcgcagggucuggagaaguagauuccuucagccuagguaucuuaugugcgucuauaaugauugaagagguaaugcgguccagauggucgcgaaaaaugcugaugacagggacuuuagccgucuuucuacuucuaguuaugggacaauuaacauggaaugacuuaaucagacuaugcauaauggucggcgcaaacgccuccgaucgcaugggaauggggacaaccuauuuagcgcuaauggcaacuuuuaaaaugagacccauguuugcaguagguuugcuuuuucgacgauuaacaagucgagaaguauuguuauugaccauaggcuuaagccuuguggcuuccguugaauuaccaaacagccuggaggaauuaggagauggacucgcgaugggaauuaugaugcuaaaauuauuaacagaauuucagccccaccaacuguggauaaccuuguuaagucuuacguucauaaaaaccacccuuagucuggacuacgcuuggaagacgacagcaauggcucugucgaucgucucuuuauuuccgcuaugcuugaguacaacaucgcagaaaacuacuugguuaccaguucuucucgguucauucggauguaaaccacuaacaauguucuuaauaacagaaaacaaaauauggggaagaaagucauggccuuugaaugaagggauaauggcaauagguauuguaucaauauuauuaucuucuuuacucaagaacgaugucccuuuggcggguccguuaauugccgguggaauguuaauagcaugcuaugugauaucggguagcucagcggaucuauccuuagaaaaggcggcagaagugaguugggagcaagaagcagaacauucagguaccucccauaauauuuuaguagaggugcaagacgauggaacgaugaagauuaaagaugaggaacgagaugacacacugacuaucuuacuuaaagcgacguuauuggccguauccggaguuuacccgaugucgaucccugcaacgcuguucgugugguacuuuuggcagaagaagaaacagagaaguggaguauuaugggacacacccucuccaccagaaguugaacgagcaguuuuagacgacgguauuuauagaauacuucaaagagggcuacuagggagaagucaagugggaguuggaguuuuucaagacggcgucuuccacacaauguggcaugucacaagaggugcagugcuaauguaucaaggaaaaaggcuagagccaucaugggcgagugugaagaaagacuuaauuagcuauggaggcgguuggagguuucaaggaucauggaacaccggggaagagguacaaguaauugcaguagaaccgggcaaaaacccuaaaaauguacaaaccaugcccggcaccuuuaagacaccugagggcgaaguaggggcuaucgccuuggacuuuaagccggggaccagcgggucaccaaucgugaaucgagaagguaagauaguuggucuguauggaaauggaguuguaacaacuucaggcacauaugucucugcaaucgcgcaggccaaggcaucacaagagggaccucugccagagauugaggacgaaguuuuuaagaaaagaaaucuuaccauuauggaucuucauccaggaucagggaaaacccguagauaccucccggcaaugguccgugaggcaauaaaaagaaaacugagaacccugauauuagcaccaacacgggugguugcgucagagauggcagaggcgcuaaaagguaugccaauacgguaucaaacaacagcagugaaaucugaacacaccggaagagaaauaguagauuuaaugugccacgcaacauucacuaugagacuacucucaccuguccgaguaccaaauuauaacaugauaauaauggaugaagcacacuuuacugauccagcgagcaucgccgcgcgcggguacauuaguacuagaguuggaaugggggaggcagccgcaauuuuuaugacggcuacaccacccggcucaguugaggccuucccgcagucaaaugcuguaauccaagaugaggaaagagauauaccagagcggucauggaacucagguuacgacuggaucaccgauuucccagguaagacagucugguuuguaccaaguauaaaaucagguaaugauaucgcaaacugucuaaggaaaaauggcaagagaguaauucagcugaguagaaaaacuuucgauaccgaauaccagaaaaccaaaaauaacgauugggauuauguagucacgacggacauuagugaaaugggagccaacuuuagagcugaucgggugauugauccaagacgaugccucaagccuguuauuuuaaaagacggaccugagaggguaauacuugcggggccuaugcccgucacgguagcuucugcugcccagcgacguggacgaauagggagaaaccaaaauaaagaaggagaucaauauguuuauaugggacaaccucuaaacaaugacgaggaccaugcacacuggacugaagcaaagauguuauuagacaauauuaauacacccgaaggcauaauaccagcuuuguucgagccggaaagagagaaaagugccgcaauugacggagaguauagacuuagaggugaagcaaggaagacguucguagaacugaugcgacgcggggaucucccagucuggcuaucauacaaaguagccagcgaaggauuccaauauuccgaucgccgcugguguuucgacggagagagaaacaaucagguuuuagaagaaaauauggacguugaaaucuggacuaaggagggugagcggaagaaacugcgaccacgcuggcuagacgcuagaacuuacucagauccgcuugcguuacgugaguuuaaggaguucgcagcuggcagaaggucagucucaggagacuuaauuuuggaaaucgguaaacuuccacaacaccuaacuuuaagagcccaaaaugcauuagacaaucucguaauguugcauaauagugaacaagggggaaaggcuuacagacaugcaauggaggaauuaccugacacaaucgaaacacuuaugcuacuagcacuuauagcaguuuugacaggaggggucacacucuucuuuuuaucaggaaaagguuuagguaaaacuucgaucggucuacuaugugugacagcuagcucagcccuuuuguggauggcgucaguagagccucauuggauagcagcuucuauuaucuuagaguucuuuuuaaugguguuauuaauuccagaacccgacagacagaggacuccccaagacaaucaguuagcuuauguaguuauaggguuauuguuuaugauucugacugucgcagcuaaugaaaugggguuauuggagacuaccaagaaagaucucggaauaggucacguagcugcggaaaaccaccagcaugcgacuaugcuagauguugauuuaagaccagcuucggcguggaccuuauaugcaguugcaacuacagugauaacgccuaugaugcgacacaccauugaaaacacgacagccaauauaucacuuaccgcuauugcuaaucaagcagcuauucugaugggacuugauaaaggcuggccaauuagcaaaauggacauaggaguuccacuauuagccuuggggugcuacucucaagucaauccgcucacccuaacagccgcaguuuuaauguuaguagcucauuaugcgaucaucggcccuggcuuacaggcaaaagcgacucgagaagcucaaaaacggacagccgcugguauaaugaaaaauccuacuguugaugggauaguagccauugacuuagacccgguaguauacgaugcgaaauucgaaaaacaacugggucaaaucaugcuuuuaauucuaugcacuucucaaauacucuuaaugagaaccacuugggccuugugugaaucaaucacucuagcuacuggcccacuaacaacguuaugggaggguagcccagggaaguucuggaauacgacuauagcaguguccauggcaaauauuuuucgggguucauaucuugccggugcagguuuagccuuuucacugaugaagucacuagggggcggccgcagagguaccggagcacaaggagaaacucuaggagagaaauggaagagacaauuaaaucaacucucaaaaagugaauuuaauacauauaaaagaagcggaauuauggaagucgacaggagugaagcuaaagaagguuuaaaaagaggugaaacaacaaaacacgcaguaagucgggguacagcaaaacuuaggugguucguugaacggaauuuaguuaaaccugagggcaagguaauagacuuaggauguggcagaggaggcuggucuuauuacugugcaggacuaaagaaaguaacugaaguaaaagguuauacaaaaggcggacccgggcaugaggaaccaaucccaauggcaacauacgguuggaauuuaguaaagcuacauucagggaaagauguauuuuucaugcccccagaaaaaugugacacgcugcuuugugacauaggcgaaucaucuccuaaccccacaauagaggaaggacggacuuuaagaguguuaaaaaugguugaaccuuggcuacggggaaaucaauuuugcauuaaaauauugaauccguauaugccaucaguggucgagacauuagaacagaugcaacggaaacauggcggaauguuaguucgaaacccauuaucucgaaacucaacucaugaaauguauugggugucaugcggaacgggaaauauagugucugcuguaaauaugacaaguagaauguuauuaaaucgauucacaauggcccaccgaaaaccuacauaugaacgugacguugaucuaggagcaggaacgcgccauguagcaguugaaccagaaguggcaaaucuugauauuauagggcagagaauagaaaacauuaaaaaugaacacaaaaguacuuggcacuacgaugaggauaaucccuauaaaacuugggcauaccauggaaguuacgaaguaaaaccuaguggaucagccuccagcauggugaaugguguagugcgacuucuuaccaagccuugggacguaauucccaugguaacacagauugcuaugacagacacaacaccauucggccaacaaaggguauucaaagaaaaggucgacacacgaacaccccgggcuaagcgagguacgacacaaaucauggaagugacggcaaaaugguuauggggauuucucaguagaaauaagaaaccucgcauauguacaagagaagaauuuacccgaaaaguaagaaguaaugcagcuauaggagcagucuuuguagacgaaaaccaguggaacagugcaaaagaagcaguugaagaugaaagauucugggaucuagugcaucgcgaacgcgaauuacacaagcaaggaaaaugcgcuacguguguauacaacaugaugggaaaacgagaaaagaaauuaggugaauuuggcaaagccaagggaucaagagcuauaugguauaugugguugggagcucgguucuuggaguucgaggcuuugggguucaugaaugaagaccacugguucagcagagagaacucacuaucuggcguugaaggagagggacuacacaaauugggauacauucugagagauauaagcaaaaucccgggagguaacauguacgcagaugauacugccgguugggauacccgaaucacagaagaugaucuccaaaaugaggcgaagauaaccgaaauaauggaaccugaacacgcccuucuggcuacaaguauuuuuaaauugacauaucaaaauaaagugguacgagugcaaaggccggccaaaaauggcaccguuauggauguuaucucgaggagagaucaacgggggaguggucaaguggguacguaugggcuaaacacguuuacuaacauggaaguacaacugauaaggcagauggaaucagaaggaauauuucuaccgagcgaacuagagacuccaaaucuugcugaacggguccucgacugguuggagaaacacggagcagaacgacuuaaaagaauggcuauaaguggagacgauugcguuguuaaaccuauugacgauagguucgccacagcacuaacugcuuuaaacgauaugggaaaaguacgaaaagacauuccgcaaugggagcccuccaaaggauggaacgauuggcaacaaguuccauucugcagccaccacuuucaucagcuaauuaugaaagaugguagagagauugugguccccuguaggaaccaagacgaauuagucggucgagcucguguaucacaaggugccggcuggucucuucgugaaacagccuguuuaggcaagucauacgcacaaauguggcaauuaauguauuuucaccgucgcgaucuaaggcucgcagcgaaugccauaugcucugcuguaccaguagacuggguaccuacaagucgcaccacauggucaauacaugcacaccaccaguggaugacaaccgaagacaugcuauccgucuggaauagaguauggauugaggaaaauccauggauggaggauaaaacacacgugaguaguugggaagaagucccauaucuaggaaaaagagaggaucaauggugugggucuuuaauagguuuaaccgcucgagcuaccugggcuacgaauauccagguagcaauuaaccagguacgacgguugauuggcaaugaaaauuaccuagauuauaugacaucaaugaagcgguucaagaacgagucggauccagaaggugcacuaugguga

SEQ ID NO: 21257 - RNA, 9879 nt, Artificial Sequence
  derived and/or modified CDS sequence (opt6) from DENV-1__KF955443__SS-prME
ucaguuacuauguugcuuauguuauuacccacugcacuagcauuucacuuaacgacucgcgguggugaaccacacaugaucgucucaaaacaagaacgaggaaaaaguuuauuguuuaaaacuucugcaggcguaaacaugugcacacuuauugcaauggauuuaggagaauuaugcgaagauacaaugacuuacaaauguccacaaauuacagaagcagaacccgaugauguagauuguugguguaaugcaacagauacaugggugacauauggcacguguagucaaacaggugaacauaggcgagauaaacgaucugucgcacuugcaccacauguugguuuaggauuagaaacacgaacagaaacuuggaugaguagcgaaggagcauggaaacaaauccaacgcguagaaaccugggcauuaagacauccaggauuuaccgucauagcauuauuuuuagcucacgcaauagguacuagcauuacacaaaaagguauuauauucauauuguugaugcugguaacaccaagcauggcaaugaggugugucggaauugggaacagggacuuuguggagggauugucuggagcuacauggguagacguuguuuuagaacaugguuccuguguaacuaccauggcgaaaaauaaaccaacucuugauaucgaguuauuaaaaacagaagucacuaacccagcaauucuaaggaaacuuugcauugaagcaaaaauuagcaauacuacaacagauagcagaugcccaacacaaggagaggcgacucugguggaagaacaagaugcuaauuuuguaugcagaagaacguuugucgaucgagguuggggcaacggcuguggauuauucgguaaagguucauuauuaacgugugcuaaauuuaaauguguaacuaaacuugaagguaaaauuguucaauaugaaaaucuaaaauauucaguuauuguaacagugcauacaggcgaucaacaccaggugggaaacgaaaccacagaacaugguacaauugcgacaauaacaccccaagcuccuacaagugaaauucagcucacagacuacggugcuuugacccuggacuguaguccacguacuggcuuagauuucaacgaaaugguauuacuaacaaugaaagagaaaaguugguugguacauaaacagugguuucuggaucuacccuuaccauggacaucuggggcaucuacaagucaggaaacguggaauagacaggaucuguugguuacuuuuaaaacugcccaugccaagaaacaagaaguggugguuuuggguucacaagaaggggcaaugcacacugcguuaacuggagccacggagauacaaauguccggcacuacuacgauuuuugcaggccaccuaaaaugcagauuaaaaauggacaaauuaaccuugaaaggcacaaguuauguuauguguacaggcucauuuaaauuagaaaaagaggucgcagaaacacaacacggcacuguauuaguucagguaaaauaugaaggaacagacgcuccaugcaaaauaccauuuuccacgcaagaugaaaaaggcguuacucaaaacgguagacugauuaccgcaaauccaaucguaacugauaaagaaaaaccugugaauauagaaacugagccacccuuuggagaaaguuauauuguaguuggggcuggagagaaagcccuaaaacuaaguugguuuaaaaagggauccuccauagguaaaauguucgaagcaacggcaagaggagcaagacgaauggcaauacuaggggacaccgcaugggauuuuggcucuauuggaggcguuuuuacuucuguggggaagcuaguacaucaaguuuucgguacagcauauggugugcuauucagcgggguuaguuggacaaugaagaucgggauaggaauauuacuaacaugguuaggauuaaauaguagaucaacaucacucucgaugacauguauugcagucggcauggucacacuuuaccuugggguaaugguucaagcugauucugguugugugaucaauuggaaagggagggaacucaaaugcggaagugggauauuugugacgaacgaaguucauacuuggacugaacaguauaaauuccaagccgauucgccgaaacgguugagugcugcaauaggaaaagcaugggaagaggguguuuguggaauuaggucagucacgagauuggaaaauauaauguggaagcagaucucgaacgaauuaaaccauauauuauuagagaaugauaugaaauucacugucgucguaggagaugcuaacgguauauuagcacagggcaagaaaaugauacgaccacagccaauggaacauaaauacucauggaaauccuggggaaaggcgaaaauaaucggugcagauauccaaaauacaaccuuuauuauagacgguccagauacgcccgaauguccagauaaccaaagggccuggaacaucugggaagucgaggauuauggguucgguauauuuacuacaaacauaugguugaaauuaagagauucuuauacacaaaugugugaucaucggcuuaugagugcggccaucaaggauucuaaagcuguacacgcagacaugggguacuggauagaaucugagaaaaaugaaacauggaaauuagcucgcgcuucauucauagaaguaaaaacgugcacauggccaaaaagucacacacuuuggagcaaugguguacuugaauccgagaugaucauucccaaaauauaugguggaccgauaucgcagcauaauuauagacccgguuauuuuacacaaaccgcaggcccuuggcaccucggaaaacuggaauuagauuuugacuugugcgaaggaacuaccgugguaguagaugaacauuguggaaaccguggccccucacucagaacaacaaccguaacugggaaaauuauacaugaauggugcugucgaaguugcacucuaccaccccucagauuccgcggagaggacgggugcugguaugggauggagauaagaccgguaaaagagaaagaagaaaaucuaguucgaaguaugguuucagcaggauccggcgaaguggauagcuucucguuaggaaucuuaugcgcaaguauuaugauagaagaggucaugcguaguagauggucgagaaagauguuaaugacaggaacauuagccguauuuuuacuuuuaaucauggggcaacucacuuggaaugacuuaauuaggcuguguauaauggucggugccaacgcgagcgauagaauggggauggguaccacauaucuagcauuaauggccacauucaagaugagaccuauguuugcaguaggguugcuuuuucgacgacuaacuucuagagagguauuacuauuaaccauaggacuuagucugguugcaagcguagaacuaccuaacaguuuagaagaacugggugauggguuggcaaugggaauaaugaugcuaaaguuguuaaccgaauuucagccgcaucagcucuggacuacacuacuaagccugaccuucauaaaaacuacucuuagccuggacuaugcauggaaaacaacagccauggcucuaaguauaguuucacuauucccauugugcuuauccacaacaucccaaaagacuacgugguuacccguacuacuagggucauucgguuguaaaccucuaacaauguucuuaauuacggaaaauaaaauauggggacgcaaaucuuggccauuaaacgagggaauaauggcaauaggaauaguuucaauucucuuauccagucuguugaaaaaugauguacccuuagcagguccacuuauugccggcggaaugcucauagcuugcuacguuauuagcgggucaucugcggaccugucguuagaaaaagcugcagaaguuucuugggaacaagaagcggagcauucagggacaucacauaacauucugguugaaguacaggaugaugguaccaugaaaauuaaagaugaagaacgcgaugauacucucacgauauuauuaaaggcuacauuauuggcaguaucaggaguguauccuaugucaaucccagcgacacuguuuuuaugguauuucuggcagaagaagaaacaaagaucaggaguuuugugggauacccccucaccgccugaaguggagagagccguguuagaugauggaauauaucguauuuuacaacgcggccuacuuggccguucccaggugggaguaggaguguuccaggacgguguauuccauacaauguggcacgucacuagaggugcaguucucauguaucaaggcaaacgccuagaaccaucuugggcuaguguaaagaaagacuuaauaucuuauggaggcggguggagauuccaaggcaguuggaauacuggagaggaaguucaaguaauugcaguagaaccggggaagaacccaaagaauguucagacaacacccggaacauucaaaacgccugaaggggagguaggagcgaucgcucuagauuuuaaaccaggaacgaguggaucaccuauagucaaucgugagggcaaaauuguaggccuuuaugguaacggaguugugacuaccuccgguacauaugugucagcuauugcacaagcaaaggcuucucaagagggaccgcuaccagagauagaagaugaaguuuuuaaaaagcggaaucucacaauaauggacuugcauccagggucagguaaaacaagaagauauuuacccgcuauaguucgugaagcaauuaaaagaaaacuuagaacgcuaauacuugcgccgaccagagucguagccucugagauggcagaagcguuaaaggguaugccaauuagauaucaaaccacugcugucaaaagugagcauacugggcgugaaaucguagacuuaaugugccaugcuacuuuuacgaugcgacuucucaguccgguacggguuccaaacuauaauaugauaauaauggacgaagcacauuuuacggauccugcuucaauagcugcccgaggauauauaucaacuaggguagguaugggggaggcugcagccauauuuaugacugcgaccccaccgggaucaguugaggcauuuccccaaucgaaugcuguaauucaagaugaggaaagagauauucccgagagaucguggaauagcggcuacgacuggauaaccgauuucccgggaaagacuguaugguucguuccaaguauaaaauccggaaacgauauugcaaacuguuuacgcaaaaacggaaaaagaguuauacaacuuagucgaaaaacuuuugauacggaauaucagaaaacgaaaaacaaugauugggauuaugugguaacaacagauauuuccgaaaugggagcgaacuuuagagccgaucgagugauugauccuaggcgcugucuaaaaccaguuauauuaaaagacggaccggaaagggucauacuagccggcccgaugccuguuaccguugcaucggcagcacaaagacgugggcguauaggcagaaaucagaauaaggaaggcgaccaauauguguacaugggccagccacucaauaaugaugaggaccacgcacacuggacggaagcaaaaauguuacuagauaauauaaauacuccagaagguauaauaccugcauuauucgaaccagaacgcgagaaaagugcagcaaucgauggagaauauagauugagaggugaagcaagaaagacauuuguugagcuaaugagacguggagacuuaccaguuuggcuaucguauaaagucgccucagaaggguuccaguacagugaucgacgaugguguuucgauggcgaaaggaacaaucaaguuuuggaagaaaauauggacguugaaauuuggacaaaagaaggggaacggaagaaacugagaccccguuggcuagaugcacguacuuauagcgauccacuggcauuacgugaauuuaaggaauuugccgcggguagaagaucaguuucaggcgauuugauucuagagaucggaaaacuuccccaacacuuaacauuacgagcucaaaaugcacuagacaaucuugugauguuacauaauucugaacaaggcggaaaggcuuaucgccacgcaauggaagaauuacccgacaccaucgaaacacuuauguuacuagcucuaauagccgucuuaacaggugguguaacguuguucuuuuuaagugggaaaggucuagguaaaacgucuauaggucuguuauguguaacugcgagcuccgcacugcuauggauggcauccguggaaccacauuggauugccgcaucgauuauacuugaguucuuucucaugguuuugcugauaccggaaccggaucgacaaagaacgccccaagacaaucaauuggccuacguuguaauuggucuucuauucaugauccuaacgguagcagcaaacgaaaugggguugcuggaaacuaccaagaaagacuuggggauuggacacguagccgccgaaaaccaccaacaugcuaccauguuggauguugaucugaggccggcaagugcguggacguuguaugcagucgcuacgacggucauaacaccaaugaugcgacacacuauugaaaacacaacugcaaacauuucacuuaccgcaauagcaaaccaagcagccauucucaugggucucgauaaaggguggccgauuaguaagauggacauagguguaccauuacuggcauuagguugcuacagucagguaaauccacucacucuuacugcugcaguacucaugcuaguagcgcauuacgcaauaauuggaccuggacugcaagcaaaagccacacgcgaggcgcaaaaacgaacagcugcugguauuaugaaaaauccuacgguagacggaaucgucgcaauagaucuugacccuguugucuaugaugcaaaguuugagaaacagcucggucaaaucaugcuacuaauauuaugcacaucacaaauucugcuuaugcgaaccaccugggcauuaugugagaguauaacacuagcgacagggccacuuacaacacugugggaagguucaccagguaaauuuuggaacacaacaauagcugugaguauggcaaauaucuucagaggaucauauuuagcuggagcaggucuagcauucaguuugaugaagucgcugggaggcggaagacgaggcacaggugcccaaggcgaaacacuuggagagaaauggaaacgacaacuaaaucaauuaucaaaaucggaauuuaacacauacaagagaucaggaauaauggaagucgaccgauccgaagcaaaagaaggacuaaaacguggcgaaacgacaaagcaugcaguuagucgaggaacggcaaaacuaaggugguucguggaaagaaauuuggucaaacccgaaggaaaggugauugaccuugguuguggacgagguggcuggucuuacuacugugcaggacugaagaaaguaaccgagguuaaaggcuacaccaagggcggaccaggccaugaggaaccaauacccauggcgacauacggauggacucuuguaaaguugcauaguggaaaagaugucuucuucaugcccccagaaaagugcgauacuuuacuaugcgauaucggugaaucaucuccaaacccuacgauagaggaaggccgcacguuaagaguacuaaaaaugguagagccaugguuaaggggaaaucaauuuugcaucaagauacugaauccauauaugccuuccguaguagaaacauuagaacaaaugcaacgcaaacacgggggcaugcuuguccgcaauccacugaguagaaauucaacgcaugagauguacugggugaguugcgguacgggaaauauuguaucagcaguuaacaugacguccagaaugcugcuaaaccguuuuacuauggcucaccguaagccaacguuugaacgugauguagaccuaggugcaggcacccggcacgucgcuguugaaccggaaguggcaaaucuagauauaauuggacaaagaauagaaaauaucaaaaaugaacauaaaaguacauggcacuaugaugaagacaauccuuacaaaacaugggcauaucaugggucauacgaaguaaagccaagcgggagugcaucaaguauggucaacggcgugguccgguuauuaacuaagcccugggaugugauuccuaugguuacgcagauagcaaugacagacaccacaccauucggacaacaaaggguauucaaggagaaaguagauacaagaacucccagagcaaaaagaggaacuacccaaauaauggaaguaacagccaaguggcuauggggauuuuuaagcagaaauaagaaaccgagaaucuguacucgagaggaauuuacucguaaaguccguucaaacgcggcaauaggugcuguguuuguagacgagaaccaauggaacagcgcgaaggaagcgguugaggacgaaagauucugggauuuaguacauagagagagggagcuucacaaacagggcaagugugcuacaugcguauauaauaugaugggaaaaagagagaagaaacuaggggaauuugggaaggcaaaaggaucaagggcaaucugguacaugugguuaggagccagauuucuggaguuugaggcuuuaggguucaugaaugaagaccauugguucucuagagaaaauucacuaucgggcguggagggagagggccuucauaaguugggauacaucuuacgagacaucucaaaaauaccaggugguaauauguaugcggaugauacugccgguugggacacacggauuacagaagaugaccuccagaaugaagccaagaucacagauaucauggaaccggaacaugcgcucuuggcaacaucuauuuuuaaauuaaccuaucaaaauaagguaguaagaguucaaagaccugccaaaaauggaacugugauggauguaauaucuagaagagaccaaagaggaucuggccaaguuggaacuuauggccuaaacacguucacaaauauggagguucaacucauuagacagauggaaucugaaggaauauuucuuccaagugaauuagagacaccuaaccuggcagaaaggguacuagacugguuagaaaagcacggagccgagagacuaaaaagaauggcaauuuccggggacgauugcguugugaagccuauugaugaccguuucgccacagcguuaacugcacuaaaugauaugggaaaaguaaggaaagacauaccacagugggaaccaaguaagggcuggaaugacuggcaacaaguaccguuuuguucucaucauuuccaccaauuaaucaugaaagauggaagagaaauagucguuccgugcagaaaucaagacgaauuaguugguagagcuagggugucucaaggagcaggauggucucugagagagacagccugucuuggaaaaucauaugcgcaaauguggcaacuaauguacuuccaucgaagggaucugagauuagccgccaaugccauuuguucagcaguccccguugacuggguaccaacaucacgaacgacauggaguauacaugcacaccaccaauggaugacaacagaagacaugcucagcguuuggaaucgaguauggauugaagaaaacccauggauggaggacaaaacacacgugucuucgugggaagagguaccuuacuuagguaagagagaggaccaaugguguggaucuuugauuggccuaacagcgcgagcaaccugggccaccaauauucagguugcuauuaaucagguacgacgauuaauuggaaaugaaaauuaccuagauuauaugaccucuaugaaaagauucaaaaacgaaucugauccugaaggggcacuaugguaa

SEQ ID NO: 21258 - RNA, 9879 nt, Artificial Sequence
  derived and/or modified CDS sequence (opt6) from DENV-1__GQ868520__SS-prME
ucuguuacuaugcuguugauguuauuaccuacugcucuagcauuucacuuaacuacucgcggaggagaaccacauaugauagugagcaaacaagaacgaggaaaaucacuguuguucaaaacuucagcaggagugaauaugugcacacuaaucgcuauggauuuaggugaacuaugugaagauacgaugacuuauaaauguccacaaauaacugaagcagaaccagacgacguagacugcugguguaacgcaaccgauacuuggguaaccuaugggacauguagccagacaggugaacaucgccgagauaaacguaguguugcacuugcaccccauguugggcugggauuagaaacacgaacggaaacauggaugucuagugaaggggcauggaaacaaauccagagaguggaaacuugggcacuucgccacccuggguuuacaguaauagcacuuuuccuggcacaugcaauaggaacaaguaucacccaaaaaggaauuauuuuuauccucuuaauguuaguuacaccuuccauggcuaugcggugugugggaauuggaaauagagauuuuguggaagguuuaagcggagcaacauggguugacguaguauuggaacacgguucaugcguuacgacaauggccaaaaauaaaccuaccuuagauauugaauuauuaaaaacugaaguuaccaauccagcuauccuuagaaaauuauguauagaagcgaaaauaucaaauacuacgacggauaguagauguccuacucaaggugaagcgacacugguugaagaacaggacgcaaacuucguaugucgucgcacauuuguagaccgcggauggggaaauggaugcggucuuuuugguaaaggcucacucuuaaccugugcaaaauucaaauguguuacuaaacuagagggaaaaauaguucaguaugagaaucugaaauauucaguaauugucacgguucacaccggagaccaacaucagguaggcaaugaaacuaccgagcacgguacuauagcgacaaucacuccacaagcacccaccucggagauucaacuuacagacuauggagcauugacacuagacugcucaccuagaacugguuuagauuuuaacgagaugguauuacuaacaaugaaagagaaaaguugguugguacauaaacagugguuucuugauuuaccucuaccuuggaccucaggugccucaacaagucaggaaaccuggaaucgccaagacuuauuagugacauuuaaaacugcacaugcgaagaaacaagaagucgucguauuggguucacaagaaggugcaaugcauacugcuuugacaggcgcaacggaaauucagacuucggguacaaccacaauauuugcuggccauuugaaaugccgacuuaaaauggacaaacuaacauuaaaagggacuucguauguuauguguacuggcucguucaaacuggaaaaagaaguagcugaaacccaacacgggacaguuuugguacagguaaaauacgaagguacagacgcgcccugcaaaaucccguuuuccacgcaagacgaaaaagguguuacccaaaacggacgucuuauuacagcaaauccuauuguuacugauaaagaaaaaccggugaauauagagaccgaaccaccauuuggcgaaucauacauaguaguaggagcaggagaaaaagcacugaaacugucaugguucaagaaagggagcucaauaggaaaaauguuugaggcgacugcgagaggcgcucgaagaauggcgauauugggggacacugcaugggacuucgggaguauaggaggaguauucacaucaguggggaaauuaguucaccaaguuuucggaacagcauaugguguacuguuuaguggaguuaguuggacaaugaagauaggcauuggaauuuuauuaaccuggcuaggauuaaauucccggaguaccagucuaucgaugacaugcauugcagucggcaugguuacuuuauaccuagguguaauggugcaagcugauuccggcugugucauuaacuggaaagggcgggaauugaaaugcgguagcgggauauucguuacuaacgaagugcauacauggacagaacaauacaaauuucaagccgauagcccuaagcguuuaucggcagccauagguaaggcuugggaagaagguguuugcggcauaaggagcgccacucgacuagaaaacauuauguggaagcaaauaucgaacgaacuuaaccauauacugcuagaaaacgauaugaaauucacaguuguaguuggugacgcgaauggaauuuuagcacagggcaagaaaaugauacgaccucaaccaauggaacauaaauauuccuggaaaucauggggaaaagcaaagauaaucggagcagauauacagaacaccacguuuaucaucgacgguccagauaccccggagugccccgauaaucaacgagccuggaauauaugggaaguggaagacuauggguuugguauauuuacgacaaacauuugguuaaaacuucgcgacaguuauacccagaugugcgaccauaggcugaugagcgcugcuauaaaagacucuaaggcuguucaugcugauaugggauauuggaucgaaucagagaaaaaugagacauggaaauuagcccgagccucauucauagaaguuaaaacuuguaccuggcccaagucacacacguuguggucaaauggugugcuggaaucugagaugauuaucccgaaaauauauggaggaccgauaucacaacauaacuauagaccugguuauuuuacacaaacugcuggaccauggcauuuagguaaauuagaauuagauuucgaccuuugcgaaggaacuacaguaguaguagaugaacacugugguaaccgcgggcccuccuuaagaacuacaacaguaacaggaaagauaauacacgaaugguguuguagauccuguacauuaccaccacuuagauucagaggggaagauggguguugguaugggauggaaauaaggcccgugaaggaaaaggaagaaaacuuaguccgcuccauggucagugcuggcaguggagaagucgacucuuuuucucuugguauacuaugcgcaaguaucaugauagaggaagucaugaggucacgauggucaagaaaaaugcuaaugacaggaacuuuggcaguauucuuguuauugguuauggggcaacucacauggaaugauuuaauucgacuaugcaucaugguuggugcaaacgcaucagaccguaugggaauggguacaaccuaccuagcucuaauggcgacuuuuaaaaugcggccuauguuugcaguaggauuguuauucagacgacuaacaucucgugaagucuugcuacuaacuauaggucugucucuaguugcaucuguagaguuaccaaacagccuagaagaguuaggagacggccuagcgaugggcaucaugaugcuaaaacuacucaccgaauuucaaccacaccaauuauggacuacauuacugucauuaaccuucauuaagaccacgcucucacuagauuaugcauggaaaacgacugccauggcacuuaguaucguaagccuauuuccgcuaugccuauccacuacaagucagaaaacaacauggcugccgguauuacuaggaucauuuggcuguaaaccacuaacgauguuccuuauuacagaaaacaagaucuggggccgaaaaaguuggccuuugaaugaaggaauuauggcuaucgguaucguauccauucuccugagcagccuauuaaagaaugacgucccacuggcugguccgcuaauagcaggaggaauguugauagccuguuaugugauuaguggaagcucagcagaccuaagccucgagaaggcggcugaagugaguugggaacaagaagccgaacauaguggaacuagccacaauauucuaguugaaguucaagacgaugggacuaugaaaauaaaagaugaagaaagagacgacacauugacaauauuacucaaagcaacuuuauuagcagugagugguguuuacccuaugaguauccccgccacccucuucguaugguauuuuuggcagaagaagaaacaaagaagugguguuuuaugggauacgccuagucccccagaaguggagagggcgguccucgacgaugguauauacagaauuuuacaaaggggucuauuaggacgaucucaaguuggugucgggguauuccaagaugguguauuccauacgauguggcauguuacccgcggcgcaguucugauguaucagggaaaaagacuagagccuucaugggcaagcgucaagaaagaccuaauaucguauggaggcggcuggagguuucaagggaguuggaauaccggugaagaaguacaaguaauagcugucgaaccaggaaagaaccccaaaaauguacagacaaugccuggaacauuuaagacgcccgaaggagaagucggggcaauugcuuuagacuuuaagccaggcacgucuggcucaccaauuguaaauagagaaggaaaaauugugggcuuauacggaaauggaguaguaacaacaagcggcacguacguuagcgcgauagcgcaggcgaaggcuucgcaagaaggaccacuucccgaaauagaagaugagguuuucaagaaaaggaauuuaacaauuauggaucugcauccgggaucggguaaaacacggagauacuuaccugcuauggugcgcgaagcuauuaaacgcaaauuaaggacacuaauuuuagcaccaacaaggguaguggcaagcgaaauggcagaggcccuaaaaggcaugcccaucagauaccaaaccacggcuguuaagagugagcauacuggaagagagauugucgacuuaaugugccaugcaacguucacgaugcgacucuuaucuccaguuagaguaccaaauuauaauaugauaauuauggaugaagcacacuuuacggaccccgcaucaauagcagcaagaggcuacauuaguacucgaguaggcaugggugaagcagcagcaauauucaugacagcuacaccuccugggaguguugaggcuuuuccucaaucuaaugccgugauccaagaugaagaaagagacauuccugaaagaaguuggaacucuggauacgauuggauuacagacuuuccaggaaagacugugugguuuguacccucuauaaaguccggcaaugacauugcaaacuguuuaaggaaaaauggaaaaagaguuauacaguuaucccgaaaaacuuuugacaccgaguaucagaagacgaaaaacaaugacugggauuauguuguuacaacagauaucagcgaaaugggagcuaauuuuagagcagauagaguaauagauccaagaagaugccuaaaaccagugauacugaaagauggaccagaaaggguaauauuggcugguccuaugccgguuacuguugcaucagcggcucaaaggagagggcguauaggaagaaaucaaaacaaagaaggggaucaauacguauauaugggacaaccacuaaacaaugacgaagaucacgcucacuggacagaagcaaagaugcucuuagauaauauuaacacuccagaagguauaauaccagcgcuguuugagccagaaagggagaaaagcgcagcgauugauggagaauacagauuacgaggugaagcuagaaagacauucgucgagcuuaugagacgcggagaccuaccagucuggcuaucuuacaaagucgcaucagagggauuucaguauuccgaccgaagaugguguuucgauggggagaggaauaaucaaguauuggaagagaauauggacgucgagauauggacaaaagagggugaaaggaagaaacucaggccucguugguuagacgccagaacauauagugauccucuugcccuccgugaguucaaagaauuugcugccggcagaagaucgguaagcggggauuuaauccuagagauaggaaagcucccacaacaucuaaccuugagggcacaaaaugcauuagauaaccuugucauguuacauaacagugagcaaggaggcaaagcauaucgacacgccauggaagaauuaccggauacaauagaaacgcucauguuacuggcacuaauagcuguuuuaacgggaggaguaacucuauucuuucucagcggaaaaggacuuggaaaaacgagcauugggcuacuuuguguuacagcaucaucagcauuauuauggauggcaucaguugaaccccauuggauugcggcaucuauuauacuagaguucuucuuaaugguucuauugauucccgaaccagauagacagcguaccccucaagacaaucagcuagcauauguagugauagguuuauuauuuaugauucuaacuguagcugcaaaugaaaugggacuacucgaaacaaccaaaaaggaucuuggaauuggccaugucgcggcagagaaccaucaacacgccacgaugcuagaugucgaucuacgaccagcuagugcuuggacuuuauacgccguagccacaacgguuauuacgcccaugaugcgacauacgauugagaauacuacagcaaauauaucguuaacggcuaucgccaaccaggcagcuauuuuaaugggguuagauaaagguuggccuauaucaaaaauggauauagguguuccauuauuagcauuaggcugcuacagccaaguaaauccacugacacuaacugcggcugucuuaauguuaguagcacacuaugcgauaauaggacccggucuucaagcaaaagcaaccagagaagcucagaaacguacggcggcugggaucaugaaaaauccgacaguugauggaauaguagcaauagaccuggacccggucguauaugacgcuaaguuugaaaagcaacuuggucaaaucauguuauugauuuuauguacaucacaaaucuuacuaaugagaacgacuugggcguuaugcgaaaguauuacguuagcaacaggaccauugacgacacuaugggaaggguccccaggaaaauuuuggaacacgacuauugccguaucaauggcuaauauauuuagaggcucguauuuagcaggagcaggacuggcauuuagcuugaugaaaucucuuggcggggguagaaggggcacaggugcucaaggagaaacacuuggagaaaaauggaagaggcaacuuaaucaguuaucgaaaucagaguucaauacauauaaacgaucugguaucauggagguugaucgaucagaagcaaaagaaggccucaaaaggggagagacaacaaaacaugcuguuaguagggggacggccaaauuacguugguuuguagagagaaaccuaguaaagccugaaggaaagguaauagaucucggcuguggacguggaggauggucuuacuauugugcuggacucaagaaagucacugaaguaaaaggguacaccaaaggcgggccuggacacgaagaaccuaucccgauggcaacuuauggauggaaccucguaaaauuacacaguggaaaagauguguuuuucaugccuccagaaaagugugauacccugcuaugcgacaucggugagucaucacccaacccaacaauagaagaagggcgaacacuucgcgugcuuaaaaugguagaaccaugguuaagagguaaccaauuuuguauuaaaauauugaauccauacaugcccucuguaguugaaacucucgaacagaugcagcguaaacauggagggaugcuaguucgaaauccacucucacgaaauucgacacacgaaauguauugggucagcugcgggacaggaaauauuguuucugcggucaauaugaccagccguauguuacucaauagauucacuauggcacauagaaaaccuacauaugagagagacguagauuuaggugccggaacaagacacguggcuguagaacccgaaguugcaaauuuagacauuauuggucaacggauagaaaacaucaaaaaugagcauaagucgacauggcauuacgaugaagacaaucccuacaaaacaugggcauaucacgggucauaugaaguaaaacccagugggagugcaucaagcaugguuaauggaguuguuaggcuucuuacaaagccuugggauguuauuccuaugguaacucaaaucgccaugacugacacgacaccuuuuggucaacagagaguauucaaagaaaaggucgacacaagaacgccucgugcaaaaaggggaaccacgcaaauaauggaaguaacagcaaaauggcucuggggcuuuuugagcagaaacaagaaaccgcgaaucuguaccagggaagaguucacaaggaaagugcgaucgaaugcggcaauaggugcugucuucguagaugaaaaccaauggaauagcgcaaaggaagccguagaagacgaaagauuuugggaccuaguccaccgggaacgagaacuucacaagcaagggaaaugugcgaccugugucuauaauaugauggggaagcgagagaagaaacucggagaguuuggaaaagcaaaaggcucaagggccauuugguacaugugguuaggcgcacgguuucuagaauuugaagcauuaggauuuaugaaugaagaucauugguuuagcagagaaaacucacuaucagguguugaaggagaaggauuacauaaacuagguuauauacucagagacauaucgaaaauacccgggggaaauauguaugcugacgauacggccgguugggauaccagaauuacugaggacgacuugcagaacgaagcaaaaauaacugaaaucauggaacccgagcaugcacuuuuagccaccucaaucuuuaaauuaacauaucagaacaaaguaguuaggguacaacgcccagccaagaauggaacagucauggauguaauaaguagacgagaccaacgcggaucagggcaagugggaacauacggcuugaacacauucacaaacauggaaguacaauuaauccggcagauggaaucugaaggaauuuuucuaccuucugaauuagaaacaccuaauuuggccgaaaggguauuggacugguuagagaagcacggagcagaacgccuaaaacgaauggcaaucagcggcgaugauuguguaguuaaaccaauugacgacagguuugcgaccgcauugaccgcuuugaaugacauggguaaagugaggaaagauauaccucaaugggaacccaguaaaggauggaaugauuggcaacaagucccuuuuuguagccaucauuuucaucagcugauuaugaaagauggucgagaaauaguuguucccugcagaaaucaagacgagcuaguugguagggcacgcguaucgcaaggagcaggguggucgcuacgagaaacagcaugucuggggaaaucauacgcacaaauguggcaauuaauguacuuucaccgaagggacuuaagauuagcggcaaaugccauauguucagcaguaccuguggacuggguaccaacaagccgcacaacuuggagcauccaugcucaccaucaauggaugacuacagaggauauguuaucaguguggaacaggguauggauagaggaaaacccauggauggaggauaaaacacacguaagcaguugggaagaagugccuuaucucggaaagagggaagaccaauggugugguagcuuaauaggacugaccgcucgugcuaccugggccacaaacauucagguugcaauaaaccaaguaaggcgacuaaucgguaacgaaaauuaucucgacuacaugacuagcaugaagagguuuaagaacgagucagacccugaaggugcuuuaugguaa

SEQ ID NO: 21259 - RNA, 9879 nt, Artificial Sequence
  derived and/or modified CDS sequence (opt6) from DENV-1__GQ868522__SS-prME
ucugugacuauguugcuuauguuacuacccacggcacuagcauuccauuugacgacuagagggggagaaccacauaugauugugucuaaacaagaacgagguaaaagccuucuauuuaaaacaagugcugguguaaauauguguacucuuauugcuauggaccuaggcgaacuaugcgaggacacaaugacuuacaaauguccucaaauuaccgaagcagaaccugaugacguagacugcuggugcaacgcaacagacaccuggguaacauacggaaccugcucccaaacuggagagcaccgacgggacaaaagguccguugcguuggcaccucauguuggcuuaggucucgaaacacguacagagaccuggaugaguagcgaaggugcuuggaaacaaauacaaagaguagaaacgugggcacuacgacauccaggcuucacaguuaucgcuuuauucuuagcacaugcaauagguacguccauaacucaaaaagggauuauauuuauauuacugauguuagugacgccaucuauggcgaugagauguguagggauuggcaacagagauuuuguugaagguuuaucaggagcgacauggguugaugugguucuugagcacggguccugcgugacaacaauggccaaaaauaaaccaacuuuagacauagaauuauuaaaaacggaggucaccaauccagcaauacuucguaaauuaugcauugaagcaaaaauaucgaacacaacaacugacagucgaugucccacgcaaggagaagccacacugguugaggaacaagacgcaaauuuuguuuguagaaggacuuuuguagaccgcggauggggaaauggauguggccuauucgguaaagguucucucuuaacuugugcuaaauucaaaugugugaccaaacuagaaggaaaaaucguccaauacgaaaaucugaaauauucgguuauagucacgguccauacaggcgaucaacaccaaguuggcaaugaaacgacagagcaugguacaaucgcaacaauaacuccccaagccccuacaagugagauucaauuaacugacuauggugccuugacgcuugauugcucuccuagaacaggauuagauuuuaacgagauggucuuacugacaaugaaagaaaaauccuggcuaguucacaaacaaugguucuuagaccucccauuaccauggacuucuggagccucaacaucacaagagacuuggaacagacaagaucuccuaguaacauuuaaaaccgcacaugccaagaaacaagaagucguuguucucggaagucaagaaggagcaaugcacacagcgcuuaccggugcuacugaaauucaaaccuccggaacgacaaccauauuugccggccaucugaaaugccgcuuaaaaauggacaaauuaacacugaaaggcacgucuuauguuaugugcacggguucguucaaacuugaaaaagaaguggccgagacacaacauggaacaguucuagugcaaguuaaauacgaagggacagaugccccuugcaaaaucccguucuccacucaagaugaaaaagguguaacucaaaauggaagacuuauaacagccaauccaauaguaacagacaaagagaaaccagucaacauagagacagagcccccguuuggugaauccuacauaguuguaggagcaggagaaaaggcuuuaaaacuaucaugguucaagaaagggucuucgauugguaaaauguucgaagccacagcacguggagcaagacgaauggcaauacuuggagacacugcuugggauuucgggucaauaggaggaguguuuacaucuguagggaaauuaguacaccaaguauuuggcacagcuuauggcguauuauucucaggcguauccuggacaaugaaaaucggaauagggauucugcuaacaugguuaggcuuaaacaguagaagcacaagucuuaguaugacaugcauagcugucggcaugguaacguuauauuuagguguuaugguacaagcggauuccggaugcgugaucaauuggaaaggaagagaauugaaaugcggaucuggaaucuuugucacaaacgaaguacauacguggacagaacaauauaaauuucaagcagacucuccaaaacgccugucggcugcuauagggaaagcaugggaagaaggcgucugcgguauaagauccgcaacacggcuagaaaacauaauguggaaacaaauaucgaacgagcucaaucauauucuauuagaaaaugauaugaaauucacugugguaguuggagaugcuaaugggauacuugcacagggcaagaaaaugauucgaccgcaacccauggagcacaaguacuccuggaaaaguuggggaaaagcaaaaauuauaggagcagacauccaaaacacaacuuuuauuaucgacggccccgauacccccgaaugcccagauaaucagagagcguggaauauaugggaaguagaagacuacgguuuuggaauuuuuacuacaaauaucuggcuuaaauuaagagacucguauacccagaugugcgaucacagauuaaugucagcggccauuaaagauucaaaagcgguucaugcugacaugggcuauuggaucgaaagcgagaaaaacgaaacauggaaauuggcgcgagcaaguuuuaucgaagucaagacauguacauggccaaaaagucauacacuuuggucuaaugguguucuugagucagaaaugauuauucccaaaauauacggaggacccauuagccaacacaacuacagaccugguuauuucacgcaaacggccggaccuuggcaucuugggaaguuagaguuagauuucgauuuaugcgaaggcacgacuguuguuguugaugaacauuguggcaacagggguccgucuuuaagaacaacuacaguaacuggaaaaauaauacaugaaugguguuguagaagcugcacacuuccaccauuacgauuuaggggagaagacggcuguugguauggaauggaaauucgaccugucaaggagaaggaagaaaaccucguuaggucgaugguaagugcagggucuggugaggucgauucguuuucucuagggaucuuaugugcaagcauuaugauagaagaaguaaugcguucaagauggagucgaaaaaugcuuaugacagguacgcuugccguguuuuuacuccuggugaugggccaacuaacauggaaugauuugauacgucuguguauuaugguaggagcuaacgcgucggaccgaaugggaaugggaacaacauacuuggcacugauggcaacuuucaaaaugcguccaauguuugcgguaggacuucuuuucagacguuugacaucgagggaaguccugcuauuaacuauuggccuuaguuugguagccucaguagaauuaccaaauucacuagaagaacuaggagauggucuugcaaugggaauuaugauguuaaagcuacugacugaauuucaaccgcaccaguuauggauaacauuauuaucucugacauucauaaaaacaacucuaaguuuggauuacgccuggaaaacaacggcgauggcuuuaucaauaguaucgcuuuuuccauuaugucuaucgaccacaagucagaaaacaacauggcuaccaguacuacuuggcaguuuugguuguaaaccuuugacaauguuuuuaaucacagaaaauaaaauaugggggcggaaaaguuggccacuaaacgagggaauuauggcaauuggaaucguaaguauacuguuaucuucuuuacugaagaaugacguaccucucgcagggccacuaauugcuggggguaugcugauagcuuguuauguaauuagcggaucuucggcugacuuaagucucgaaaaagccgcagaggucuccugggagcaagaagcagaacacuccgggacaagucacaacauauuaguagaagugcaagaugacgggacgaugaaaaucaaagaugaggagagagacgauacacugacaauauuauugaaagcaacauuacuugcuguuaguggcguauauccaaugucaauaccagcuacucucuuugucugguauuucuggcaaaagaaaaagcagaggucaggagugcucugggacacaccuucgccaccugaggucgaaagagcuguucuugaugacgguaucuaucggauauugcagcgcggucucuuaggacgaagucaaguugguguggggguuuuucaagaugguguauuucauacaauguggcaugugacucgaggugcugucuuaauguaccaaggaaaaagacuggagccaucuugggcaagugucaagaaagaccuaauaagcuauggugguggguggcgguuucaaggaucguggaacacaggugaggaaguacaagugauugcuguagaaccaggcaaaaauccaaagaauguacagacaaugccagguacauucaagacacccgaaggagaaguuggcgcuauagcuuuagacuuuaagcccgguacuucaggaaguccuauagugaauagagaggguaaaaucgucgggcuauauggaaauggugucgucacuacaagcgguacuuauguaucugcaauagcacaagcaaaagcaagccaagaagggccacuuccggaaaucgaagaugaaguuuuuaagaaaaggaaccugacuaucauggaucuacauccagguucgggaaaaacaagaagauaccucccagcaaugguacgagaggcaauaaaaagaaaauuaagaaccuuaauacuagcacccacgcgcguaguugcaagugaaauggcagaggcucucaaagggaugccaauaagauaucaaacaacagcgguuaaaucagaacacacagggcgagagauuguagacuuaaugugccaugcgacauuuacuaugcgucuguuaucucccguacggguuccaaacuacaauaugaucauaauggacgaagcucacuuuacagacccugcuucaauugcggcucgaggcuacauuucgacacgugucggcaugggagaggcggcagcgauuuucaugacagcaacaccaccaggaaguguagaagcauucccgcaaucaaacgcugugauacaggaugaagaacgcgacauaccagaaagaagcuggaacucggguuacgauuggauuacagacuuucccgguaaaacaguaugguucguacccucuaucaaaucaggaaacgacauagcaaacugucuaagaaagaauggaaagaggguaauacaauuauccagaaaaacauuugacacagaauaccagaaaaccaaaaacaacgauugggacuacguaguuaccacugauauaucagaaaugggagcaaauuuuagagcagauaggguuaucgacccaagacguugcuugaaaccaguuauccuuaaagacggucccgaacgugugauuuuggcgggucccaugccaguuacagucgccuccgcagcacaaagaagagguaggauagguaggaaccaaaauaaggaaggagaucaauauguauauaugggacaaccauuaaauaacgaugaggaucacgcccacuggacugaggccaaaauguuacuagauaauauaaauacuccugaagguauuauacccgcauuauucgagccagaaagagagaaaagugcagcaauagauggagaauauagacugcgaggagaagcaagaaagacauuuguggaauuaaugagaagaggagacuuaccuguguggcuauccuacaagguugcaagcgaaggauuucaauauagcgauagacgcuggugcuuugauggugaacguaauaaucagguauuagaagaaaauauggauguagaaauauggaccaaagaaggcgaaaggaagaaauuaagaccaagauggcuagacgccagaacguauagugacccgcucgcguuaagagaauuuaaagaauuugcagcaggaagaagaucagugucaggggaccuaauacuugaaaucggcaaacuuccgcaacaccugacauuaagggcccaaaaugcucuagauaaucuaguuaugcuucauaauucggaacaaggcgggaaagcguaucggcaugcaauggaagaacucccagauacgauagaaacacuaaugcugcuggcccuaauugcggugcuuacuggaggggugacguuguucuuucuuucuggaaaaggacuagggaaaacaucaauaggacuuuuauguguaaccgccuccucggcccuacuauggauggcaagcguagagccacauuggauugcggcaucuauuaucuuggaguucuuucucaugguuuugcuuauaccggaaccugaccggcaaagaacaccucaagacaaucaguuagcguaugucgugauuggauugcuauuuaugauacuaacaguagccgccaaugaaaugggccuucuugaaaccacgaagaaagaccucggaaucggucacguagcagcugaaaaccaucaacaugcaacuauguuagauguugaucuaagaccggcuagugcauggacauuauaugcgguagcaacuacggucauaaccccaaugaugcgucacacaauagaaaacacuacagcgaauaucucccugacagcuauagcgaaccaagcugccauccuaaugggauuagacaaaggcuggcccauaucuaaaauggacauaggaguccccuuauuagcacuuggaugcuacucucaaguaaauccacuaacacuaaccgcagcuguccuaauguuagucgcucauuaugcaauaauaggucccggauuacaagcuaaagccacccgcgaagcucagaaacggaccgcggcagguauuaugaaaaaucccacuguagauggaauaguugcaaucgaccuagacccuguuguauaugaugcaaaauucgaaaaacaacuuggacagauaauguuauuaauauuaugcaccucacaaauacugcucaugaggacaacaugggcgcuaugugaaucgauaaccuuagcaacaggaccauuaacuacacuaugggaagguucccccggcaaauuuuggaacacgaccauagcaguuaguauggcuaacauauuucgcggaucauacuuggcgggugcaggacuugcuuuuucccucaugaaaucucuaggcggaggcagacgcgguaccggagcccagggugaaacccuaggagaaaaauggaaaagacaauuaaaccaauuaaguaaaucggaguuuaacacauacaaaagaaguggcauaauggaaguggaccgaucagaggcuaaagaagggcuaaaacgcggugagaccacaaagcaugcagucucucgcggcacagcuaaauuacguugguuuguagaacgcaauuuagucaaaccagaggguaagguaaucgauuuaggguguggucgcggcggaugguccuauuauugcgcuggacuuaagaagguaacagaggugaaaggauacacuaaaggcggaccagggcacgaggagccaauaccaauggcuacauauggauggaaucuuguaaaacuucacaguggcaaggauguguucuuuaugccaccagaaaagugugacacguuacuaugugacauaggcgaauccucucccaaucccacuauagaagaaggucgaacucuacggguacuuaaaaugguugaaccuuggcuucgggguaaucaguuuugcaucaaaauucuaaauccauacaugccuaguguaguggaaacucuagaacaaaugcaaagaaaacaugguggaaugcuggugcguaacccacucucuagaaauaguacgcacgaaauguauugggucaguuguggaacuggaaacaucguuagugcagugaacaugacuucaagaaugcuauuaaauagauuuacaauggcucauagaaaaccaacguaugagcgagauguagaucugggagccgguacgaggcacgucgcgguagaaccggaaguagcaaauuuagauaucauuggccaaaggaucgagaauauuaaaaaugaacauaaauccacguggcauuacgaugaggacaacccguauaaaacuugggcguaccauggaaguuacgaaguaaagccgucagguuccgcgaguaguaugguaaauggaguaguaagacuucugacaaaaccaugggacguuauuccaaugguuacgcaaauugcuaugacagauacuacuccauuuggucaacaaagaguuuuuaaagaaaagguagauaccagaacaccccgggccaaacgugguacaacucaaauuauggagguaacagcuaaauggcuauggggguuucuuaguagaaacaagaaaccccgaauuuguacccgugaagaauuuacuagaaaaguccggaguaaugcugcuauaggggccguauucguagacgagaaucaauggaacucugcaaaagaagcggucgaagacgagcgauuuugggaucuuguacaccgagagcgagaacugcauaagcaaggcaagugugcaacuugugucuauaauaugauggguaaaagggagaagaaauuaggagaguuuggcaaagcuaaagggucccgagcuaucugguacaugugguuaggggcaagguuuuuagaauuugaggcuuuggguuuuaugaacgaagaccauugguucuccagggaaaauuccuuaucagguguagaaggugaggggcuacacaaauuggguuacauucucagagacauuaguaagauacccggugggaauauguacgcagacgacacggcugguugggacacaagaauaacggaagaugaucugcagaaugaggcaaagaucacugaaauaauggagccugaacacgcauuacuugccacaaguauauucaaauuaaccuaccagaauaagguaguucgcguucaacggccagccaaaaauggaacgguaauggacguuauuucacgaagagaucaacgaggcaguggucaaguagggacuuauggccuaaauacauuuacaaauauggaaguccaacuaauacgacaaauggaaagugagggcaucuucuuaccaagugaauuggaaacacccaauuuggcagagagaguauuagauugguuagaaaaacauggggcagaacgauuaaagcgaauggcaauuuccggugacgauuguguaguaaagccgaucgaugauagguuugcaacugcauuaacagcuuugaaugauaugggaaaaguaagaaaggacauuccucagugggagccuucaaaagguuggaaugacuggcaacaagcucccuucugcagccaucauuuccaccaauuaaucaugaaagacggucgagagauaguagugccauguagaaaccaagacgaacugguuggaagggcacgggugucacaaggugccggcuggagucugagggagacugcgugucuuggaaaaucauaugcgcaaauguggcagcuuauguacuuccacaggcgagacuugcgccuugccgcaaaugcaaucuguucugcgguacccguugacuggguuccaacaagucgcaccacgugguccauacaugcgcaccaucaguggaugaccacugaagauauguugagcguguggaacagaguauggauugaggaaaaccccuggauggaggauaagacccauguaucuucaugggaagaaguaccauaucuuggaaagagagaagaccaguggugcggaucacugauuggauugacggcacgagcaacaugggcgacuaauauacaaguagcgaucaaucaaguccgaagauuaauugggaacgaaaauuaccuagacuacaugacaucaaugaaaagauucaaaaacgagucugauccggaaggcgcuuugugguga

SEQ ID NO: 21260 - RNA, 9879 nt, Artificial Sequence
  derived and/or modified CDS sequence (opt6) from DENV-1__HQ166036__SS-prME
aguguaaccauguuauugauguuauugccgacagcauuggcauuucaccuuacaacgagagggggagaaccacauaugauaguaaguaaacaagaacgcggaaaaucacucuuguuuaaaacaucagcagggguuaauauguguacuuuaauugccauggauuuaggagaacuaugugaagauacgaugaccuauaaaugcccacaaauuacagaagcagaacccgacgacguagacugcuggugcaacgcuacugauacauggguaacauauggaaccuguucccaaacaggugaacaccggagagauaaacguucugucgcgcuugcaccgcacguaggucuaggguuagaaacaagaacggaaacuuggaugucgagugaaggugcauggaaacaaauucaaaggguagaaacaugggcguuaagacauccagguuucacaguaauugcauuguuucuggcucacgcuauuggaacaaguauaacccagaaaggcauaaucuucauauugcuaauguuaguaacacccucaauggcaaugagguguguuggaauagggaaucgagauuuuguugaagguuuaagcggcgccacaugggucgacguaguucuagagcauggaagcuguguaacgacgauggcuaaaaacaaaccaacuuuggacauagagcuauuaaagacagaaguuacgaauccggcaauacuccguaaacuauguauagaagcaaaaauaucaaacacaacaacagacucuagauguccaacacagggagaagcgacucuaguagaggaacaggaugcaaacuucguaugucgaaggacauuuguagaucgggguuggggaaauggcuguggguuauuugguaaaggaucgcugcuaacuugcgcaaaguuuaaauguguaacaaaauuagaaggcaaaaucguacaauacgagaaucuaaaauauagugucauagugacaguacacacuggggaccagcaucagguuggaaacgaaacaacagaacaugguacaauagcuacgauuacaccucaagcaccaaccagugaaauacaauuaacagacuauggagcucuuacacuagacugcucuccuagaacaggucuagacuuuaacgaaauggugcugcuaacuaugaaagagaaaucaugguuaguacacaaacagugguuuuuagaccuuccgcuucccuggacaucuggagcauccacaucucaggaaacuuggaauagacaagauuuacuuguuaccuuuaaaacggcacacgcaaagaaacaagaaguuguuguucuagguucucaagaaggagcuaugcauaccgccuugacuggagcuacggaaauacaaaccuccgggacgacgaccauuuucgcuggccaucuaaaaugcagauuaaaaauggacaaauuaacucuaaaaggcacaaguuauguuauguguacagguaguuuuaaauuagagaaagagguugccgaaacucaacauggcacaguuuugguucaaguuaaauaugaaggaacugacgcuccuuguaaaauaccauuuuccacucaggacgaaaaaggugucacacaaaacggaaggcuuauaacagcuaacccaauuguuacagacaaagaaaagccuguaaacaucgaaacagagcccccuuuuggcgaauccuauauaguggugggagccggugaaaaggcauuaaaacuaucaugguuuaagaaaggaucaucaauugguaaaauguucgaagcaacggcacguggagccaggcggauggcgauccuuggagauaccgcaugggacuuuggaucaauagguggcguuuuuacuucgguagggaaacucguacaucaaguauucggaaccgccuauggaguuuuguucucugggguaucuuggaccaugaagaucgguauugggauccuacuuacauggcucggccugaauagcagaucaacaucucucucgaugacuugcaucgcagucgguauggugacauuauauuuagguguuaugguacaagcagauucagggugugucauaaauuggaaagggcgugaacuaaaaugcggaucaggaauauuuguaacuaacgaggugcauacuuggaccgaacaguacaaauuccaagcugauucccccaaaagacuuucggcagccauuggaaaagcaugggaggaaggugugugcggcauacgcucggcuacgagauuggaaaauauuauguggaagcaaaucuccaaugagcuaaaccauauuuuacuggaaaaugacaugaaauuuacaguagucguaggagaugcuaauggaauuuuggcucagggcaagaaaaugauccggccgcagccgauggagcauaaauauaguuggaaaaguuggggaaaagcgaagauaauaggggcugauauacaaaauacaacguucauaauagaugguccggauacaccugagugccccgacaaccaaagagcauggaauauuugggaaguagaagacuauggguuuggaauauuuacaacaaauauauggcuaaaacuuagggauucauauacucaaaugugugaucauagacuaaugagugcagcuauaaaagacucuaaagccguacacgcagacaugggcuauuggaucgagucagagaaaaacgagacuuggaagcuagcaagagcgucauucauagagguuaaaacuuguacguggccaaagagccauacacuauggaguaacgguguacuagaaucugaaaugauuauucccaagauauacggaggcccuauaagccagcauaauuauaggccggguuacuucacacagacagcgggcccauggcaccuaggaaaacuugaauuagauuuugaucucugugaggggacgaccgucguaguugacgaacauugcgggaacagaggaccaucuuuacgcacgacaacuguuacugguaaaauuauacacgaauggugcugccguucauguacacuaccaccacuuagauuccgcggggaggacggauguugguacggaauggaaaucagaccgguaaaggaaaaagaagaaaaucuuguucgaucaauggugucagcuggaucuggagagguugauagcuuuucauuaggaauauuaugugcaucgauuaugauugaagaaguaaugaggaguagauggucaaggaaaauguuaaugacugggacguuagcaguauuccuccucuuaguuaugggccaacuaacauggaaugauuuaauacgccuguguauuaugguaggugccaaugcgagcgacagaaugggaaugggcacuacuuaccucgcauuaauggccacguucaaaaugagaccaauguuugcagucggguugcuguuccgaagguuaacaagucgagaaguccuauuauugacgauuggacuuucauuaguagcauccguggaacucccaaauucgcuagaggaacucggagauggacucgcaauggggaucaugauguuaaagcuccucacugaguuucaaccccaccaauuguggacaacucuauugagucuaacuuucaucaaaaccacauugucacuggauuacgccuggaaaaccacugcgauggccuuaaguauaguaucuuuauuccccuuaugucuaagcacuacaucgcagaaaaccacauggcugccaguuuuacucgguucuuucggauguaaacccuugacgauguuucuuauaacagaaaacaaaauauggggacgaaagucguggccacuaaaugaaggcauaauggccaucgguauaguauccauuuuacuuagcucacuucuuaaaaaugacguucccuuggcagguccccugauugcaggagggaugcuuauugcguguuacguaauuuccggcuccucugcugacuuaucgcuagaaaaagcugcagaagucucaugggaacaggaggcugaacacucaggaacaagucauaauauucuuguggagguacaagacgacggaacgaugaaaaucaaagaugaagaaagagaugauacacuuaccauacuucugaaagcuaccuuauuagccguuucagggguauauccuauguccauccccgcaacuuuauucguaugguauuuuuggcaaaagaagaaacagaggagcggagugcuaugggacaccccgucgccgccugaaguugaaagagcuguauuggacgaugguaucuauagaaucuugcaacgggggcuauuagguaggucgcaagugggggugggagucuuccaggaugguguauuucauacgauguggcauguaacgagaggagccguacuaauguaucaagguaaaagauuagaaccgucgugggcuuccgugaagaaagaucuaauaaguuaugggggaggcuggagauucagaggcucuuggaauacuggugaagaaguacagguaauugccguagaaccuggaaagaaccccaaaaauguucaaaccacgccaggaacuuuuaaaacaccggaaggagaggucggggcaaucgcccuagauuucaagccugggacaucagggucaccuauuguaaacagagaaggaaaaaucgugggauuauauggaaaugggguaguuaccacuagcgggacauaugugagugcgauagcacaggcuaaagcgucccaagaaggaccccuaccagaaauagaggacgagguuuuuaagaaacggaacuuaacaaucauggauuuacauccaggaaguggaaaaacuagaagauaccuucccgcaauagucagagaagcaauaaaaagaaaacuuagaacucuuauucuggcuccaacaagagugguugcaagugagauggccgaagcguuaaaaggaaugcccauccgguaccagaccacugcaguuaaaucggagcacacuggccgagaaauuguggauuuaaugugucacgcgacuuucacgaugagauuacuuaguccuguaagaguaccgaauuacaauaugauuaucauggaugaggcacauuucacugacccugcuucgauagcagcaagaggauauauuuccacaagggucggaaugggcgaagcagcagcgauuuucaugacagcgacacccccaggaucgguugaggcuuuuccacagucaaacgcgguaauacaagaugaggagcgagacaucccagaacgguccuggaauagcggauaugauuggauaacggacuuucccggaaagacgguuugguuuguaccuucaaucaaaagcgguaacgauauugccaauuguuugaggaaaaaugguaaaagagugauccaacucuccagaaagacguuugauacugaauaucagaaaacuaaaaauaaugacugggauuaugugguuaccacagauauaagugagaugggagcaaauuuccgagcagaccgaguaauugaucccaggagguguuuaaaaccaguaauauuaaaggaugguccugagaggguaauacuagccgggccuaugccaguuacgguugcuagugcagcacagaggagaggaaggauaggacgaaaucaaaacaaagaaggggaucaauacguguacaugggucaaccacugaacaacgaugaggaccacgcgcauuggacugaagcuaaaaugcuacucgacaauauaaacacaccagaaggaauaauaccugcguuauucgaaccugagagggaaaaaucggcugccauagacggugaguauagauugcgaggcgaagcaagaaaaacuuucguugaauugaugaggagaggagaccucccaguuuggcuaaguuauaagguugccucagaaggauuccaauacucagaccgccguuggugcuuugacggggaacguaacaaucaaguuuuggaagaaaauauggacguagagauauggacaaaagaaggcgagagaaagaaacuaagaccaagauggcucgacgcaagaacauauucagauccacuggcuuuaagagaguucaaagaguucgcagcgggaagacgaucggucucuggagaucucauauuggaaauuggcaaacuaccacaacaccuaacuucacgggcucagaaugcucuagacaacuuaguaauguugcauaacucagaacagggaggaaaggccuaccgucaugcaauggaagaauuaccagacacaauagagaccuuaauguuauuagccuuaauugcuguacucacuggaggaguaacacuguuuuuccuaagcggaaagggacugggaaaaaccucaauaggacuccuaugcguaacagccaguucagcucuauuauggauggcaucuguagaaccucauuggauugcggcaucaauaauccuagaguucuuccuaaugguccuauugauaccagaaccagaucgacaaagaacaccucaagauaaucaacucgcauacguaguaaucggacuauuauucaugauucucaccguagcagcaaaugaaaugggcuugcuagaaacaacaaagaaagauuuaggaaucggucaugucgcagcagaaaaccaucaacacgcgacuauguuagacguagaccuaagaccagcuagcgcauggacacuauaugcgguggcaacuacaguaauuacaccaaugaugagacacacuauagaaaauacaacugccaacauuaguuuaacugcaauagcaaaucaagcggcuauauuaaugggauuagacaaaggauggccuauaucaaaaauggacauagggguaccuuuacuggcccuugguugcuauagccaagugaauccauuaacauuaacggcggcuguauuaaugcuggucgcccacuacgcaauaauaggcccaggccuacaggcuaaagcgacaagagaagcccagaaacgaacagcugcaggaaucaugaagaauccuacaguagauggaaucgucgcaauugaccuugauccuguaguauacgacgcuaaauucgaaaagcaauugggucagauaaugcuacucaucuuaugcacuucgcaaauauuacugaugcggacaacaugggcacucugugaaucaauaacgcuugcaacuggcccccuuaccacguugugggaaggaaguccugggaaauucuggaauacaacaauagcgguaucaauggcgaacauauuccguggaucuuaucuggcgggagcaggauuagcauuuucucuuaugaaaucauuggguggaggacgcagaggaacuggggcgcagggggagacuuugggagaaaaguggaaacgacaauuaaaucaguuaucuaagagugaguucaauacauauaaacgcucagguauuauggaaguagaucgguccgaagcaaaggaaggucugaaaaggggagaaacuacaaaacaugcugucaguagagguacggcaaaacuuagaugguucguagaaaggaacuuagugaaaccagaagguaagguaauagacuuaggcuguggacgaggaggcuggucuuauuauugcgcggggcucaaaaagguaacagaagugaaagguuauaccaaaggaggaccaggucaugaagaaccaauuccuauggccacguauggcuggaaccugguaaaacuacauaguggaaaagaugucuucuucaugcccccugagaaaugcgauacacuucuaugugacauaggggaaaguucgccuaauccaacaauagaagaaggacgcacacuacgagugcugaaaaugguagaacccuggcucaggggaaaucaguucugcaucaaaauauugaacccguauaugccaucaguugucgagacucuagaacagaugcaaagaaaacacgguggaauguuagucaggaauccacuaaguagaaauucaacacacgaaauguacugggucucgugcggaacggguaauauagucuccgcugucaauaugacuucacgaaugcuauuaaacagguucacaauggcgcacagaaaacccacuuaugagagagacguagauuuaggugcgggaacuaggcacguugccguugagccugaggucgcuaaccuggauaucauaggacaacgcauagaaaacaucaaaaaugagcacaaaucaacguggcacuacgaugaagauaacccguauaaaacuugggcuuaccacggaaguuacgaaguuaaaccguccggaucggcuagcucgauggugaaugggguuguaagacuauuaacuaaaccaugggauguuauaccuaugguuacucaaauugcaaugacagauacuacaccuuucggacaacagcgaguguuuaaggaaaaagucgauacucgaacaccaagagcgaaacggggaacaacucaaauaauggaagugacugcgaaaugguuauggggauuuuuaucacgaaauaagaaaccacgaauauguacaagagaggaauuuacuagaaaaguacgcagcaaugcugcaauaggagcagucuucguagaugaaaaucaauggaacagugcaaaagaagcuguggaagaugagagauuuugggaucucgugcacagagagcgagaacuacauaagcagggcaagugugcaacaugcguauacaacaugaugggaaaacgggagaagaaauugggagaauuuggcaaagcgaaggguucccgcgcaaucugguauauguggcuuggugcacgauuucuagaguucgaagcguuagguuuuaugaaugaagaucauugguuuucaagggaaaauaguuuaagcgguguagaaggcgaaggacugcacaaauuaggguacauucucagagacauuaguaagauaccaggaggaaauauguaugcugaugacaccgcaggcugggauacuagaaucacagaagaugacuuacaaaacgaagcuaagauaaccgagauaauggaaccggagcaugcgcuacuugccacauccaucuuuaaguugacuuaucaaaauaaaguaguucgaguacaaagaccggccaaaaacggcacaguaauggauguuauaagcagaagggaucagagaggaucagggcagguuggcacauauggguugaauacuuuuacaaauauggagguccaacuaauccgucaaauggaaagcgaagguauauuucugccguccgagcuugagacaccaaauuuagcagaaagggugcuagauugguuagaaaaacacggagcagagcgguuaaaacgaauggcaaucucuggugacgauugugucguuaagccuauagaugauagauucgcaacugcauuaacagcgcuaaaugacauggguaaaguaaggaaagacaucccacaaugggagccguccaaaggguggaaugauuggcaacaaguaccuuuuuguagccaccauuuccaucaacugauuaugaaagacggucgagaaauuguagugccuugccgaaaucaggaugagcuaguuggacgugcgagagucucgcaaggggcggguuggagcuuacgagaaacagcgugccuaggaaaaagcuaugcacagauguggcaauuaauguauuuccauagacgggauuugcgucuggcagcaaacgcaauauguagugccgugcccguagauugggucccuacuucaagaacgaccuggaguauucacgcgcaucaucaguggaugacaaccgaggacauguuaagugucuggaaccgcguuuggaucgaagaaaacccuuggauggaagauaaaacccauguaaguucgugggaagagguuccguacuuaggaaaaagagaagaccaaugguguggaucucugauagguuugacugcuagggcuaccugggccacgaacauccagguugcuaucaaucagguucgacgguugauaggaaacgaaaauuaucuugacuauaugaccucaaugaagcgcuuuaagaacgagucugauccggagggagcacuuugguaa

SEQ ID NO: 21261 - RNA, 9879 nt, Artificial Sequence
  derived and/or modified CDS sequence (opt6) from DENV-1__GU131981__SS-prME
ucaguaacaauguuacuuaugcuccugccuacagcacucgcauuccaccuuacgacaagaggaggugaaccucauaugauuguaucuaaacaagaaaggggaaaaagccuucuguucaaaacaagugcaggcguaaauaugugcacauuaaucgcaauggacuuaggagaauugugcgaagacacaaugacauacaaauguccccaaauaacggaagcagaaccggaugauguagauuguuggugcaaugccacagauacguggguuacauacgguacauguagccaaacaggcgaacacaggcgugauaaaagaucuguggcauuagcaccucacguuggccuuggucuugaaacacggacggaaacauggaugagcagugaaggggccuggaaacaaauucaacgaguggagacuugggcuuugagacauccuggauuuaccgugauugcucuauuuuuggcacacgcaauaggcacguccauuacgcaaaaaggaaucauuuuuauuuugcuuaugcucguuacucccucaauggcgaugagguguguaggaauugggaacagagauuucguagagggauuaucuggagcaacuuggguagacgucguguuagaacacggaagcugcguaacgacaauggccaaaaauaaaccaaccuuagauaucgaacuacuuaaaacugaaguuacaaacccagccauucuccgaaagcuauguauugaggcuaagaucuccaacacuaccacugauucaaggugucccacgcaaggugaggccaccuuaguagaggaacaagacgcaaauuucgucugcaggcguacauucguagaucgaggguggggaaacggcugcggacuuuuuggaaaagguaguuuacuaacgugcgccaaauucaaaugcgucacaaaacuagaaggaaaaauagugcaauacgaaaaccugaaauacagugucauuguuacgguacauaccggagaucagcaucaaguagguaaugaaacuacagaacauggaacgauugcuacaauuacgccacaggcuccgaccucggaaauacaacucacggauuacggcgcuuuaacuuuagauuguucaccucgaaccggauuagacuuuaaugaaaugguauugcuuacgaugaaggaaaaaucaugguugguucacaaacaaugguuuuuagauuuaccacugccauggacauccggcgcaucaacuucgcaagaaacuuggaauagacaagaucuucuuguuacauuuaaaacugcgcacgcaaagaagcaagaaguuguuguucuagggucacaagagggagcaaugcauacugcacucacgggagcaacggaaauucagacauccggaacgaccacaaucuucgcgggucaccuaaaaugccgacucaaaauggacaaacugacuuuaaaagguacuucauauguaauguguacaggaucguucaaauuagaaaaagaaguggcggaaacccagcaugguacagucuuaguccaagugaaauacgagggaacugacgcaccguguaagauccccuucaguacacaggaugaaaaaggcgucacacaaaauggaagacuuauaacagcuaaucccauuguuaccgauaaagaaaagccaguuaauaucgaaaccgaaccuccguucggcgagucguacauuaugguaggugcaggagaaaaagcacugaaacuuucgugguuuaagaaaggcaguagcauaggaaagauguuugaagcuacagcccgaggggcucgaagaauggcgaucuuaggcgauacggcaugggauuucggguccauagguggagucuuuacaaguguagguaaacuuguucaucaagucuuugggacagcuuacggaguauuauuuagcggcgucucauggacuaugaaaauuggaauagggauauuacuuaccugguuaggacuuaauagucgaucaaccucccucucuaugacauguaucgcuguuggcauggugacucuuuacuuaggaguaaugguccaagccgauucugguuguguuaucaauuggaaagggagagaacugaaaugcggaucgggcauauuuguaacaaacgaaguacauacauggacagaacaauauaaauuccaggcagauaguccaaagagacuuagugcggcaauaggcaaagcaugggaagaagguguuugugguauaagaagcgccaccagauuggagaauaucauguggaagcaaauuaguaacgaauuaaaccacauccuucuagaaaacgauaugaaauucacgguuguaguuggagacgcaaacggaauacuggcucaaggaaagaaaaugauuaggccucaaccaauggagcacaaauacaguuggaagucuuggggaaaggcaaagauuauuggugcagacauucaaaauaccacauucauuauugaugguccagauacgcccgagugcccagacaaucaaagagcauggaacauuugggaagucgaagauuaugguuucggaaucuuuacaacaaacauuugguuaaagcugcgagauucauacacacaaaugugcgaccaccggcuaaugucagcagcaauaaaagauuccaaagccguacaugccgauaugggcuacuggauugagagcgagaaaaacgagacguggaaauuagcaagagcuucuuucauagaaguaaagacuuguacauggccgaaaagucauacacucuggucgaacgguguacuagaaucugaaaugauuauuccaaaaaucuacggggguccgauaucacaacauaacuaucguccgggcuacuuuacucaaaccgcugguccauggcacuuagguaagcuagaacuugacuuugaucuuugugaaggaacuacggucgucgucgaugaacacugcgguaaccguggaccaucacuaagaacaacuaccgugacggguaaaauuauccaugaaugguguugucggaguuguacauuacccccucuccguuuccggggugaagauggauguugguauggaauggagaucagaccuguaaaggagaaggaagagaaucugguaagaucaaugguuagugcggguuccggcgagguagacaguuuuucguugggaauuuugugugcuagcauaaugauagaagaaguuaugagauccagguggucuagaaaaaugcuaaugacaggcacauuagcaguauuucuucuauuaguaaugggacaacuaacuuggaaugaucuaauucgacuauguaucaugguaggagcaaaugcuagugaucgaaugggaaugggcaccacauaucuagcccucauggcuacauucaaaaugagaccgauguuugccguaggacuacucuuuagaagguuaacaucaagagaagucuuauugcucacuauuggauuaucauuaguagcgagcguagagcugccuaauucauuagaagaacucggagacggacuagcuauggguauaaugaugcucaaauuacuaaccgaguuucagccccaccaauuauggauuacucuccuguccuuaaccuuuauaaaaacgacgcuaucucuugacuacgcauggaaaaccacugcaauggcuuugagcaucguaucauuauucccacugugucuuaguacaacaagucagaaaacgacaugguuaccaguucuacuugguucguuuggguguaaaccacuaacgauguuucugauuacagaaaauaaaauauggggaaggaagucuuggccguuaaacgaagguauuauggcuaucggaaucguaagcauauugcuauccucucuacugaagaaugaugugcccuuagccggaccucuaauugcaggcgguauguuaauugcguguuacguaauauccggcagcucagcggacuuaagccuagagaaagccgcugagguaaguugggaacaagaggcugagcauucuggaacaagucacaacauucucguagaggugcaagacgacggaacuaugaaaauaaaagacgaagaacgagaugauacauugacgauacuucugaaagcaacauuacuagcggucucagguguauauccaaugagcauaccugcaacacuguuuguaugguacuuuuggcagaaaaagaaacaaaggaguggcguacuuugggacacacccuccccuccugaagucgaaagagcagucuuagacgauggaauuuaucgcauauuacagcgugguuugcuaggaagaucacagguuggagucgggguguuucaagaugggguuuuccauacaauguggcauguaacccgcggagcaguacuuauguaccaggguaaacgccuugaaccgucuugggcaucaguuaaaaaggaccucauaaguuauggagguggauggcguuuucaaggaucauggaauacuggugaagaaguacaaguuaucgcuguugaaccagggaaaaauccuaaaaauguacaaacaaugccagguacauucaagacuccagaaggcgaaguaggagcgauugcauuggacuuuaaaccugggacaucgggaagucccauaguuaacagggagggaaaaauagugggacuauacgggaacggcguugugacuacaagcggaacauacgucagcgcaaucgcgcaagcaaaggccucacaagagggaccgcuaccggaaauagaagaugaaguguucaagaaacgaaaccuaaccauaauggaucuucauccgggaaguggcaaaacgagaagauauuugccggcuaugguacgugaggccauaaagcguaaacuuagaacacuaauccuagcaccuacucguguaguggccagugaaauggcagaggcauugaaggguaugccgaucagauaccagacuacggcuguuaaaucggaacauacggguagggaaauuguagauuugaugugccacgcaacuuucacaaugagacuauuaucaccaguuagggugcccaacuauaauaugauuaucauggacgaagcgcacuucacugacccagcaucgauugcagccagaggguauaucucaacaagagucggaaugggcgaggcagccgccauauuuaugaccgcaacaccgccuggaucaguagaggcuuuuccgcagucuaacgccgugauccaagacgaagagagggauauaccagagcguaguuggaauagcggguacgacuggauaacagauuuuccaggaaagacuguaugguuuguacccucaauuaagaguggaaaugauauagcaaacugucuucggaaaaauggaaaaagagucauccaacuuaguaggaaaacguuugauacagaauaccagaaaaccaaaaacaaugauugggauuauguagucacgacagauauuagugaaaugggugcaaauuucagagccgaucgaguuauagacccuagaagauguuuaaagccagucauacuaaaagacgggccggagcgaguaauauuagccgguccaaugccugugacuguagcaagugcagcacaacgacgaggaaggauaggacguaaucaaaauaaagaaggcgaccaauauguuuacaugggacaaccuuuaaacaacgaugaagaccacgcgcauuggacagaagcgaagauguuauuagauaacauaaacacccccgaaggaauaauuccagcauuauuugaaccugagcgagaaaaaucggcagcgaucgacggagaguaucgauuacgaggagaggcaaggaagacauuuguugaguuaaugcgaagaggcgaucuuccuguuugguuauccuacaaaguagcaucagagggguuucaguauagcgauagacgaugguguuuugauggugaaagaaauaaccaagucuuagaagagaauauggauguagaaauuuggacgaaggaaggagaaagaaagaaauuaagaccacgauggcuagaugcgcggacauacagugauccauuagcacuaagagaauuuaaagaauuugcugcugguagacgaagugugucgggugaucuuauacuugaaaucggcaaacuuccacaacaccugacucugagagcucaaaaugcccuggacaaccuuguaaugcuacauaacagugagcaaggggguaaagccuacaggcaugcuauggaagaacuuccagacacuauagaaacauuaauguuauuagcacuuauagcuguacuaacugguggcguaacacuauucuuucuaucagguaaagguuugggcaaaacuuccaucggacuuuugugcgucacagcgucuuccgcauuauuguggauggcgucaguugaaccgcacuggaucgcggcuucaaucauacuagaauuuuuccuuaugguuuuguugauaccggaaccggauagacaaagaacuccacaagauaaucaacuagcauauguaguaauaggauuauuauuuaugaucuuaacgguggcagccaacgaaaugggauugcucgaaacaacgaagaaggaucuagguaucggacauguggcggcagaaaaucaccaacaugcgacaauguuagacguugaccuaagaccagcaucugcauggacucuauacgcugucgccacgaccguaauaacuccgaugaugagacacacuauagaaaauacaaccgcaaacauuagccucacggcaauugccaaucaggccgcuauucucaugggguuagauaaagguuggccaauaaguaaaauggauauaggugugccauuacuugcccuaggguguuauagucaaguuaaucccuuaacacucacagcggcaguauugaugcuaguggcgcacuacgcuauuauuggaccagggcuacaagcgaaagcaacaagggaggcucagaaacgcacugcagcaggaauaaugaaaaauccuacuguugacgguaucguagcaauagaccuugauccgguuguauacgacgccaaauuugagaaacaauugggccaaauaauguugcuuauacuauguacaucccaaauauuacuaaugcgcaccacaugggcauuaugugaaucaauaacguuggccacuggaccgcucacaacguugugggagggaucaccgggcaaguucuggaacacgaccauagcuguaagcauggcuaacauuuuucgaggaucuuaucucgcaggagcuggauuggccuuuaguuuaaugaaaagucucgggggaggucgaaggggaacaggagcgcagggcgaaacauugggagaaaaauggaaacgucaguugaaucaacugucuaaaagugaauuuaacacauauaaacgaagugguauuauggaagucgacagaucagaggcuaaggagggacugaagagaggagaaacaaccaagcacgccguuagccguggaacggcaaaacugcguugguuuguggaacgaaaccuugugaaaccagaaggcaaaguuaucgaccuaggauguggacgagguggcuggaguuauuacugugcaggucuaaagaaaguaacggaagugaaggguuauaccaaagguggaccagggcaugaagaaccaaucccgauggcuacuuauggauggaauuuagucaaauuacacucugggaaagacguauucuuuaugccaccagaaaagugugacacgcuucucugugauauuggagaaucaucuccaaauccgacgaucgaagagggucguacccuaaggguccugaagaugguagaaccuugguuacgugguaaucaauucugcaucaaaauacuaaacccauauaugccgucuguaguugagacacuugaacaaaugcaacgaaaacauggcggaaugcuaguaagaaaccccuugucaagaaacucuacucacgaaauguauugggucucuuguggaacgggaaacauugugucagccguaaacaugacuucuaggauguuauuaaaucgguucacuauggcacaucguaagccuacuuacgagcgagacgucgaucuaggagcugggacacgucaugucgccguagaaccggaaguagcaaaccuagacauaauaggacagagaauagaaaacauuaaaaaugaacauaaaucaacuuggcacuaugaugaggacaacccauacaagacaugggcauaccacggaucuuacgaggucaagccaagcggaucugcaucaucaaugguaaauggcguagugcggcuguuaacuaagccuugggacguaaucccaaugguaacccaaauagcgaugacagacacgacuccauuuggucaacaaagaguauuuaaagaaaagguagauacgcgaacuccgcgugcgaaacguggaacaacacagaucauggaaguuacagcaaaauggcuaugggguuuccuuagucgaaauaagaaaccuaggauuugcacucgcgaagaauuuacaaggaagguacgcucaaacgcagcuauaggggcaguauuuguggaugaaaaccaauggaacucagcaaaagaagcuguggaagaugaaagauuuugggauuuaguacaucgagagcgcgagcuucacaaacaagguaaaugcgccacaugcguauauaauaugauggguaaacgcgagaagaaacucggagaauuuggcaaagcaaagggaagccgagcgauuugguacaugugguuaggagcgagauuucuugaguucgaagcucuaggauucaugaaugaagaucauugguuuagucgggaaaauagcuuaucagguguagaaggagaaggacuucacaagcuagguuauauucugagggauauaucuaaaauaccaggagguaacauguacgcggaugauacagccgguugggauacgagaauaacagaagacgaucuucaaaacgaggcaaaaauuacagaaaucauggaaccagaacaugcgcuuuuggcuacaaguauuuucaaguuaaccuaucaaaauaaagugguuaggguccaaagaccggccaaaaauggaaccguaauggauguaauaucacgccgggaucaaagaggaucaggacaaguuggaacauauggucuaaauacguuuacgaacauggagguccaacuuauaagacaaauggaaagcgaaggaaucuuucugccaagugaacuagaaacaccaaacuuggcagaaaggguacuagauuggcuggaaaagcauggagcugagagauuaaaacguauggccauaagcggggacgauugcgugguuaaaccaauagaugacagauuugcgacggcccuaacggcucucaacgauauggggaaaguuagaaaagauauaccacaaugggagccaagcaaagguuggaaugauuggcaacagguuccguucuguucccaucauuuucaucagcucauaaugaaggauggcagagaaauaguaguacccugucguaaucaggacgaauugguugguagggcacgaguaucacagggcgcgggauggucacuaagagaaacugcuuguuugggaaaauccuaugcccaaauguggcaacuaauguauuuccauagacgagaccuaagauuggcagccaaugcuauauguucagccguaccaguggauuggguuccaacaagccgaaccacuuggucuauccaugcucaucaucaguggaugaccacagaggauaugcuaucggucuggaacaggguuuggauugaagaaaauccguggauggaagauaagacccacguaucgagcugggaagaaguccccuaccuaggcaaacgagaagaucaauggugugguucacuaauuggcuuaacagccagagccaccugggcaacaaauauacagguugcuaucaaccagguaagacgauuaaucgguaacgaaaauuaucuugauuacaugacauccaugaagagauuuaaaaacgaaagugaucccgaaggagcauuaugguaa

SEQ ID NO: 21262 - RNA, 9879 nt, Artificial Sequence
  derived and/or modified CDS sequence (opt6) from DENV-1__GQ868529__SS-prME
ucggucacuauguuacucauguuacuuccuacugcuuuagcguuccauuuaaccacgagaggaggggaaccccauaugauaguuucuaaacaagaaagagguaaaagccugcuuuucaaaacgagcgccggaguuaacauguguacacucauagcaauggaucuaggagaauugugugaagauacaaugacuuacaaaugcccgcagauuacggaagccgaacccgacgacguugacuguugguguaacgccaccgauacguggguuacuuauggaacguguucacagacuggcgaacaccgucgagauaaaaggagcgucgcuuuagcaccccauguagguuugggauuggaaacgcgaacugaaacauggaugagcucagaaggugcguggaaacagauacaaaggguggaaacuugggcauuacgacacccaggcuucacagucauagcauucuuuuuagcucaugcaauaggaaccagcauuacucaaaaagguauaauauuuauuuuauuaauguuaguuacuccuaguauggcuaugagauguguaggaauaggaaacagagacuucguagaaggauugucaggggcaacuuggguugacgucguacucgaacauggaaguugcguaaccacaauggcuaaaaauaaaccaacgcuugacauagaacugcuaaagacagaagucacgaaccccgcgauauugagaaaauugugcauagaagcgaaaauuucaaauacaacaacagauaguagguguccaacacaaggcgaagccacauugguggaagaacaggaugccaauuuuguaugccgucguacuuucguagauagggguuggggaaauggaugugguuuauuuggcaagggcucccuauugacgugugcaaaauuuaagugcguuacaaaacuugaagguaaaacaguacaauacgaaaacuuaaaauauucggucauuguuacaguucauacuggggaucaacaucaaguuggcaacgagacaacugaacaugggacaauagcaacuaucacaccacaagcaccuacaagcgaaauccaauuaacggacuauggggcccuuacccuggacuguucaccaagaacaggauuggauuuuaacgagauggucuuauuaacgaugaaagaaaaaucuugguuaguucacaaacaaugguuucuggaucugccauuaccguggacgaguggugcuucgacaucucaggagaccuggaaccgacaagaccuguuagugacauuuaaaaccgcacaugcuaagaaacaagaaguugucgucuuggggagccaggaaggugcaaugcacacagcucuaacaggugcgacagaaauucaaacaucaggaacaaccacaauuuucgcugggcauuuaaaaugcagacuuaaaauggauaaauugacacugaaaggcacauccuauguaauguguacagggagcuuuaaauuggaaaaagaaguugcagaaacgcaacaugggacaguauuagugcaaguaaaauaugaagguacugaugcuccuugcaaaauuccauucucaacacaggacgaaaaagggguuacccaaaacggaagauugaucacggcuaaucccauaguuacagacaaagagaaaccaguaaacauugaaacugaaccacccuuuggugaaucuuacauaguuguaggggcaggcgaaaaagccuugaaacuguccugguuuaagaaagguagcagcauaggaaaaauguuugaggccacagccagaggcgcaagacguauggcuauuuuaggcgacaccgcuugggacuuugguucgauuggaggggucuuuacaaguguuggaaaacuuguucaccagguauuuggcacugccuacggaguucuuuuuagugggguaucauggacgaugaaaauugggauagguauauuacuuacgugguugggucuaaacagcagaaguacaucauuaaguaugacuuguauagccgucgguaugguaacacuuuaucuaggcguaaugguccaagcagauucagggugcguaauaaauuggaaaggccgugaguugaagugcgggaguggaauuuucgugacgaacgaagugcauacguggacagaacaguauaaguuucaagcagacucuccgaaaagauugagcgcagcaauaggaaaagccugggaagaaggcguauguggcauucgaucugcaacucgucucgaaaacauaauguggaaacagauaaguaaugaauuaaaucauauacuauuagaaaacgauaugaaauuuacaguuguaguuggcgacgcaaacgguauacucgcgcaaggcaagaaaaugauaaggccacaacccauggaacacaaguacaguuggaagucaugggggaaagcgaaaauuauaggugcugauauccaaaacacgacauuuauaaucgaugguccagauacuccugaaugucccgacaaucagagagcuuggaauaucugggagguagaagauuacggauuuggaaucuuuacgacgaacauuuggcuaaaauuacgagauaguuacacccaaaugugcgaccacaggcucaugagcgcggcaauaaaagauaguaaggcaguucaugcugacauggguuauuggauagaaucggagaaaaaugagacauggaaauuagcuagagccuccuuuauugaaguaaaaacgugcacuuggccuaaaucccauacauuauggucuaaugguguccuugaaucggaaaugauaaucccaaagauauacggagggccaaucagccaacauaacuauagaccaggcuacuuuacacaaauagcggguccauggcauuugggcaaguuagaauuggacuuugauuugugugaagguacaaccguaguuguagaugaacauugugguaauagagggccaucuuugcggaccaccaccgucacgggaaaaauaauccaugaauggugcugucgaucaugcacccuuccaccucuacgauuuagaggagaagauggcuguugguauggaauggaaauaagaccaguaaaagaaaaagaagaaaaccucgugagaucaaugguaucagcaggaucaggagagguugauaguuucagccuugguauuuuaugcgcuagcauuaugauugaagagguaaugcgaucuagauggagcagaaagauguuaaugaccggaacacuggcaguauuuuuguuauuggucaugggucaauuaacuuggaaugacuuaauaagguuauguauaauggucggagcuaaugcuagugauagaauggguaugggaacaacguacuuggcuuuaauggcaaccuucaaaaugcggccgauguucgcaguugggcuacuuuuuagaagacugacaaguagggaaguccuuuugcugaccaucggcuuaucucuuguagcgaguguagaauugccaaauucguuagaagaguugggagacggccuagcaaugggaauuaugauguuaaaacugcuaaccgaguuccaaccccaucaacuauggacuaccuuacuauccuuaacauuuaucaagacaacucucaguuuggauuaugcuuggaaaacaacggcgauggcacuaaguauaguaucgcuauuuccauuaugccucucuacaacaagucagaaaacgacgugguugccaguuuuauuagggagcuuuggcugcaaaccacugacaauguuucucauaaccgaaaauaaaaucuggggucguaaaagcuggccguuaaaugaaggaaucauggcaauaggaauaguaucuauauuguuauccucccuccuuaaaaaugaugucccgcuagccgguccucuuauugcgggaggaaugcuaauugcauguuacgucaucuccgguucgucggcagauuuaucguuagaaaaggcagccgaaguaucgugggaacaagaagcagaacauagcggaacaagucacaacauauuaguagaaguacaagacgaugguaccaugaagauuaaggaugaagaacgugaugauaccuuaacgauccuuuuaaaggccacucuccuagcuguuaguggagucuacccuaugucaaucccugccacgcuauuuguaugguauuuuuggcagaaaaagaaacaaagaagugguguucuuugggauacaccgucaccaccagaaguagaaagggcgguauuggaugaugggauauauagaauuuuacagaggggacugcugggucggucacaaguggguguuggaguuuuucaagacggaguauuucauacuauguggcauguuacaaggggagcuguauugauguaccaggguaaaagauuagaaccaaguugggcaucuguaaagaaagauuuaaucaguuaugggggcggauggagauuccaaggcagcuggaauacuggagaagaagugcaagugauugccguggaaccagguaaaaacccgaaaaauguacaaacaacaccgggaacuuuuaaaacuccagaaggugaaguaggggcaaucgcccuugauuucaaacccggaacgucagggucuccuaucguaaaucgggagggcaaaauuguggggcuuuauggaaauggugugguaacaacaucgggaaccuauguaagcgcaauagcacaggcaaaagcaucucaggaagggccccuuccggaaauagaagaugaaguauucaagaaacgcaacuuaacuauaauggauuugcaccccgggucagguaaaacaagaagguacuuacccgcuaugguuagagaagcuauaaaacgaaaguuacgaacccugaucuuagcaccuacgagaguaguagccucagagauggccgaagcucuaaaaggcaugccuauucgauaccaaacuacagcggucaaaucagaacacacagggagggaaaucguagaccuuaugugccaugcaacuuucacaaugagacuacuuucgccugugagagugccaaauuacaauaugauaauaauggacgaggcacauuucacugauccagcaucuauagcggccagaggauauauaaguacaagagugggcaugggcgaagcagcugcaauauuuaugacugcgacaccgcccgguuccguagaggcuuucccucaaucaaaugcuguuauacaggaugaagaaagagauauuccugaacgcucuuggaacuccgguuaugacuggaucacagauuuuccaggaaaaaccguaugguuuguccccucaauaaaaagugguaacgauaucgcuaacuguuuacguaaaaacggaaaaagggugauccaauuaaguagaaagaccuucgauacugaauaccagaagacuaaaaauaaugauugggacuauguagugacaacagacauaucagaaaugggugcgaauuucagggccgaccguguaauugauccaagaagaugcuugaagcccgugauucuaaaggauggaccggaaagaguuauccuggcggggccgaugcccguuacaguagcuagcgcagcgcaaagaagggguagaauagguagaaaucagaacaaagaaggcgaucaauauguguauaugggacagccucugaauaaugacgaagaucaugcacacuggacagaagcaaaaaugcuuuuagacaacauaaauacuccagagggaauuauaccagccuuguucgaaccagaaagagagaaaagugcagccaucgacggcgaguacagacuucguggugaagcuagaaaaacauuuguugaacuaaugagaagaggagaccuaccaguaugguuaucauacaaggucgcgucugagggauuucaauacagugaucggagaugguguuucgacggagaaagaaacaaccaaguauuagaagaaaacauggauguagaaauuuggaccaaagaaggugagaggaagaaauugagaccaagauggcuagacgcaagaacauacagugauccacucgcguuacgagaauuuaaagaauuugcagccggaaggagauccguaagcggagaucuuauguuagaaauuggaaaauuaccacaacauuuaacucuaagagcacaaaaugcccuugauaaucugguuaugcuacauaacagugaacaaggcggaaaagcauaucgacaugcaauggaagaauugccagauaccaucgaaacuuuaauguuguuggcauuaauagcgguucugaccggcgguguaacacuauuuuucuuaucuggaaaagggcucgggaagaccucuauugggcuucucugcguuacugcguccuccgcauugcuauggauggccucaguugaaccacauuggaucgcagcaucuauaauccuggaguucuucuuaaugguacuacucauaccggaaccggauagacaacguacaccucaggacaaucaauuagcauacgugguuauaggacuacuauuuaugauauugacaguugcugcuaaugagaugggcuuacuagaaaccacuaagaaagacuuaggaaucggacauguugcugcugaaaaucaucaacacgcgaccaugcuagacguagaucuacgaccugcaucagccuggacucuauacgccguugcaacuacugucaucacaccgaugaugcgucacacgaucgaaaacaccacagccaacaucaguuugacugcgaucgcgaaucaagcggcaauauuaaugggccucgacaaaggauggccaauuucuaagauggauaucggaguaccguuauuagcacuuggauguuacucacaaguaaauccauugacacugaccgcugcgguccuaaugcuagucgcacauuacgcaauuauuggcccgggacuucaagccaaggccacacgugaagcacaaaaacggacggcggccgggauaaugaaaaauccuaccgucgauggcaucguugcaaucgacuuagacccggugguauaugacgcgaaauuugaaaagcaguugggacagauuauguuauuaauacuuuguacuucccaaauuuuacugaugcggacuacgugggcguuaugcgaaucaauaacacuggcgacuggcccucucacuacauuaugggagggaucucccggaaaauuuuggaacaccacgaucgcggugagcauggccaacauuuuccgagggucauacuuggccggggccggguuggccuuuucacugaugaaaagucuagguggcggaaggaggggcacaggagcacaaggagaaacauugggugaaaaauggaagcgacaacuuaaccaauugaguaaaagcgaguucaacaccuacaaaagaucggguauaauggaagucgaucggagugaagcaaaagagggucuaaagcgcggagaaacgacgaaacaugcgguuucucgaggaacggcaaaauugcguugguucguggagcgaaaucuuguaaaacccgaaggcaaagucauugacuuaggcugcggaagaggaggguggucguacuauugugcuggccuaaagaaagugacagagguaaaagguuauacaaaaggaggucuuggucaugaagacccaauacccauggcuacauauggauggaaccuuguaaaguuacuagccggaaaagacguauucuuuaugcccccugaaaagugcgauacgcuuuuaugcgauauaggagagucgucgccgaacccuacaauagaagaagguagaacauuacgaguacugaaaaugguugaaccguggcugaggggaaaucaguucuguauaaagauucuaaacccguacaugccaagugucgucgaaacucuagaacaaaugcaaagaaaacacggaggcauguuaguccggaauccuuuaagccgcaauagcacucacgaaauguacuggguuucaugugguacuggaaauaucgucucugcuguuaauaugacuagcagaaugcuauuaaaucgcuuuacuauggcccauaggaagccuacuuacgaaagagaugucgaccuaggcgcuggaacacgucauguagcaguagaacccgagguugcgaauuuggauauaauuggacaaaggaucgaaaacaucaaaaaugaacauaaaucaacauggcauuaugaugaagacaacccguacaaaacaugggcauaccauggaagcuacgaaguuaaaccuagcggaagcgccucgucaauggucaauggggucguccgacuauuaacuaaaccaugggauguaauaccuauggucacacaaaucgcuaugacugauacaacacccuucggacaacaaaggguuuuuaaggaaaaaguagacacgcguacaccuagagcuaaacgagguacaacacaaaucauggaaguuaccgcaaaguggcuuuggggauuuuugucacgaaauaaaaagcccagaauaugcacaagagaagaguucacgaggaaaguacgcagcaacgcugcuauuggcgcaguauuuguugaugagaaucaauggaacucugcuaaggaagcggucgaagaugaacgauuuugggaccuaguucauagagaaagagaacuucacaaacaaggaaaaugugcaaccuguguuuauaacaugaugggaaaaagagaaaagaaauuaggugaguucggaaaggcaaaagguagccgagcaauaugguauaugugguuaggugcgcgauuucuagaguucgaagcucuaggauucaugaaugaagaucauugguuuucgagagaaaauaguuuaagugggguagaaggugaaggauugcauaaacuugguuauauuuugagagauauaagcaaaauuccaggcgggaauauguacgcagaugacacggcagggugggauacuagaauaacagaagacgauuuacaaaacgaagcaaaaauaacagagauuauggagccagaacacgcauuguuagccacuucaaucuuuaagcuaacguaccagaacaaggugguucggguacagagaccugcaaagaacgggacagucauggauguaauaucuagaagagaucaaagaggaucgggacaaguuggaacauauggauuaaauacuuuuaccaauauggaaguacagcuaauucgacaaauggaauccgaagguauauucuuaccuagcgagcuugaaacgccaaauuuagcagaacguguacuugauuggcuugaaaaacauggugcagaaagacuaaaaagaauggcaauuucaggcgaugauugugucguaaaaccuauagaugaccguuucgcgacagcccugaccgcucucaacgauaugggcaaagucagaaaggacauaccucagugggagccaagcaaaggcuggaacgauuggcaacaaguaccauucugcucccaucauuuccaucaauuaauaaugaaagacggaagggaaauaguugucccaugucguaaccaagacgaacuuguaggacgagcaagagugagucaaggagcuggauggagucucagagaaacagcuugucuaggaaaauccuaugcccaaauguggcaacuaauguauuuucaccgacgugaccugagauuagcagcgaaugcgauauguagcgcugugccggucgacugggugccuacaagccgcacuacuuggucgauacacgcccaccaucaauggaugacuacagaagauaugcuaagcgucuggaauaggguguggauagaggagaauccauggauggaggauaaaacucauguauccucaugggaagaaguaccauaucuagguaagcgggaggaccaaugguguggaagucucauaggucuaacagcccgagcaacgugggcgacgaauauacagguugcgauaaaucagguccggcgauugauagggaacgaaaauuaucuagauuauaugacuucuaugaagcgauuuaagaaugaaagugacccagaaggagcgcugugguaa

SEQ ID NO: 21263 - RNA, 9879 nt, Artificial Sequence
  derived and/or modified CDS sequence (opt6) from DENV-1__GQ868531__SS-prME
ucuguuacgaugcuccuaaugcuccuaccuacugcacuugcuuuucaucuaaccacgagaggaggagaaccgcacaugauugugucgaaacaagaaagaggaaagagcuuauuauuuaaaacaagugcuggaguaaacauguguaccuuaaucgcaauggauuuaggagaacuaugugaagauacgaugacauauaaauguccacaaauaacugaagcagaaccagacgauguagauugcugguguaaugcgacagauacauggguaacauacggaaccuguucucaaacaggcgaacaucgccgugauaaacgaucgguagcauuagcgccccacguuggacuuggauuagaaacgcgaacagaaacuuggaugucgagugaaggggcauggaaacaaauacaacgcguagaaaccugggcgcuaagacacccaggauuuacgguaaucgcucucuucuuggcacacgccauuggaacgagcauaacucaaaaagggauaauauuuauccucuuaauguuggucacacccaguauggcaaugcggugcguaggaauuggaaaccgagauuucgucgaaggacuuaguggagcaacaugggucgauguaguccuggaacauggaucuugcguaacuaccauggccaaaaauaaaccuacuuuggauauagaauuguuaaaaacagaagugacgaacccagccauacuuagaaaacuuugcauagaagcaaaaauauccaacacuacuacugauucgcgguguccaacacaaggagaagcuacauugguagaagaacaggaugcgaacuucguuugcagaagaaccuuuguugauagagguuggggaaacgguuguggucucuuuggaaaaggcagccuccugacuugugcuaaauucaaaugcguaacaaaacuggaaggaaaaauaguccaguaugagaaucuaaaauacucaguuaucguuacugugcauacaggcgaucaacaccaagugggaaaugaaacuacagaacaugguacgauagcuacgauaacgccucaagcuccuacgucagaaauacagcugacugauuacggagcauuaacauuagacuguucaccccgaacaggacuugacuuuaaugaaaugguacugcuaacaaugaaagaaaaaucuuggcuaguucauaaacaaugguuuuuagaucugccauugccguggaccaguggagcuucaaccagucaagaaacuuggaaucggcaagacuuacugguaacauuuaaaaccgcacaugcuaagaaacaagaagucguagugcucggaagccaggagggagcaaugcauacggcauugaccggagcaacugaaauacagacaaguggcacaaccaccaucuucgcaggccauuugaaaugcaggcuaaaaauggauaaauugaccuuaaaaggcacuagcuacgucauguguacaggcagcuucaaacuagaaaaagaaguggcugaaacgcaacacggaacagugcuaguacaaguaaaauaugaaggcacagaugcgccauguaaaauucccuuuucaacucaagaugagaaagggguaacccaaaauggacgauugauuacagcaaacccgauugucacggauaaagagaagccaguaaauaucgaaacggaaccaccauuuggagaaucauacauaguuguaggcgcaggagaaaaggcacuaaagcucuccugguuuaagaagggauccucuauagggaaaauguucgaagcaacggcaaggggcgccagaaggauggcuauuuuaggagacacagcgugggauuuugguaguauaggugguguauuuacuucaguugguaagcuaguccaucaaguuuuugggacugcauauggcguauuguucaguggcguaucuuggaccaugaaaauugggauugguauauuacuaaccugguugggccuuaauucacggucaacaucacuuagcaugacguguauugcuguuggaaugguuacauuauauuuaggcguuaugguucaggccgacaguggcugcguaauuaauuggaaagggagagaguuaaaaugugguucagggauuuucgucacaaaugaaguucacacuuggacagaacaauacaaguuccaagcagacucgccuaaacgucuuagugcggcuaucggaaaggcuugggaagagggaguuuguggcaucagauccgcgacuagauuagagaauauuauguggaagcagaucaguaaugaguuaaaccacauauuacuugagaacgauaugaaauucacaguagucguaggcgaugcaaauggaauauuagcgcaaggcaagaaaaugauaaggccccaaccuauggaacacaaauauucauggaaaaguuggggaaaggcaaaaauaauuggagcugauauucaaaacacaaccuucaucaucgacggcccugauacuccggaaugucccgauaaccaacgagcuuggaauaucugggagguagaggacuacggauucggcauauuuacaacgaacaucugguuaaagcuaagagacucguacacgcaaaugugcgaucacagauuaaugucagcugcuauaaaagauaguaaagcaguccacgcugauaugggauauuggaucgagagcgagaaaaaugagacuuggaaauuggcuagagccucguuuauagaaguaaaaacauguacuuggcccaaaucucauacacuauggucuaacgggguguuagaaagugaaaugaucauaccuaagauuuacgguggccccauaagccagcauaacuauaggcccggauauuuuacucaaaccgcaggcccuuggcauuuaggaaaauuggaacuugacuucgaucuuugcgaaggaacuaccguuguaguagaugagcacuguggaaaucguggaccgagucuucgcacaacaacuguaacaggcaaaauaauacacgagugguguugcagaaguuguacauuacccccguuaagguuucgaggagaagauggauguugguauggcauggaaauucgcccaguaaaagaaaaagaggagaaucuaguucgaucaauggugagcgcuggauccggggagguagauucauuuucacuaggaaucuuaugugucucgauaaugaucgaagaaguaaugagaucccgguggucuagaaagauguuaaugaccggcacauuggcaguauuccuguuguuaguaaugggccaacuaacauggaaugaccucauacgccuuuguauaaugguaggcgcaaaugcaucagacagaaugggaauggggacgacguaucuagcguugauggcgaccuucaagaugagaccgauguuugcgguaggacucuuauuuagacgucuaacaucgagagagguacuacuuuuaaccauaggacuaucucuaguagcuagcguugaauuaccaaacucacuugaagaacuuggggauggucuagccaugggcauuaugaugcuuaaauugcuaaccgaauuucaaccccaucaguuauggacuacucucuuaucacucacauuuauaaaaacuacacuaaguuuagauuaugcauggaagacaaccgcaauggccuuguccaucguaucauuauuuccacuuugucuuucaacgacaagucagaaaacaacaugguuacccgugcuauuagguucauuugggugcaaaccuuuaacaauguuuuugauaacggaaaauaaaaucuggggccgcaagucguggccauuaaaugaagguauaauggcuauugggauuguuagcauuuugcuguccucucuauuaaagaaugauguaccuuuagccgguccauugaucgcaggaggaaugcucaucgccugcuauguuauuaguggaucuagugcugaccugucauuagaaaaagcagcggaaguaagcugggaacaagaggcugaacacucaggaacuucucauaauauacugguagaaguacaagaugacgguacuaugaaaaucaaagaugaagagagagaugauacucuaacuauacuuuuaaaagcgacguuguuagcaguaaguggugucuauccgaugucaaucccagcaacucuauuuguuugguauuuuuggcagaagaagaaacaaagaagugggguucucugggauacaccaaguccaccugaaguagaacgcgccguacuugacgacggaaucuauagaauacuucagcgaggucuucuagguagaagccaaguugguguaggaguauuucaagaugggguuuuccauacuauguggcauguaacuagaggagccguuuuaauguaccaaggaaaacguuuagaaccauccugggcaucagugaaaaaggacuuaauaagcuacgguggugguuggcguuuucagggaucauggaacacuggagaggagguccaaguuauagcuguggaaccuggcaaaaaucccaaaaauguccaaacuacccccggaacauuuaagacuccagagggugaagugggggcuauagcauuagauuuuaaacccgggacaaguggaagcccuauaguaaaccgagaagguaaaauaguaggauuauacggcaauggaguugucacaacaucaggaaccuauguaucggcuaucgcacaagcaaaagcuagccaagaggguccguugccugaaauagaagaugaaguauucaagaagagaaauuuaacgauaauggaucugcacccgggaucagguaaaacucgacgauauuugccagcgauagucagagaagcaauuaagagaaaacuccggacucugauacucgccccuacgagaguuguagcgagugaaauggcggaagcucuaaaagguaugccaaucagauaucaaacaacugcaguaaaaucugaacauacaggacgugaaauaguagauuuaaugugucaugcaacuuuuacaaugcgauugcuuucuccaguaagagucccaaauuauaauaugauaauaauggaugaggcgcauuuuacugauccggcaucgauagccgcacgcggcuacauaaguacccguguuggaaugggggaagcagcugcaauauuuaugacagcaacgccacccggaaguguugaagcauucccgcagucaaaugcaguaauacaggacgaggaacgggacauucccgaaagaagcuggaacagcggcuaugauuggauaacugacuuuccugguaaaacugucugguuugugccuucuauuaaaagcgggaacgauauagcgaauugcuuaaggaaaaacgggaagcguguuauucaguuaagucguaaaacauuugauacggaguaucagaaaacaaagaauaaugacugggauuacguaguaacaacggauauuagugaaaugggcgccaacuuucgugcggacagagugauagauccuagaaggugccugaaaccaguaauauuaaaagacggaccagaacgcguaauauuagcagguccaaugccugucacuguugccucagcugcacaacgucggggaagaauaggcagaaaccagaauaaagagggagaccaauacguauacaugggacaaccacuaaacaaugacgaagaccaugcccauuggaccgaggccaagaugcuucuagauaauaucaauacaccagaaggaaucauuccugcauuauuugaacccgaacgugaaaaaucagcagcuauugauggggaauauaggcuucguggagaagcacguaagacauuugucgaauugaugaggagaggagauuugccuguguggcucaguuacaaaguugcaagcgaaggcuuucaguacucugauaggcguugguguuucgacggugaaaggaauaaucagguauuagaggaaaauauggauguugagauauggacaaaagaaggugaaaggaagaaauuaagaccaagauggcuagaugcccgcacauacucugacccacuagccuuaagggaauuuaaagaauuugcagcagguagaaggaguguuagcggcgaucugauacuugaaaucggaaaacuuccucagcaucuaacauugagggcacaaaaugcucuggauaaccuuguuauguuacacaauagugaacaaggggguaaagcguaucgucacgcgauggaagaauuaccggauacuauagaaacgcuaauguuacuagcacugauagcagugcuaaccggaggagucacauuauucuuucuaucagguaaaggcuuaggaaaaacaucaauuggccuguuauguguuacagcgucgucagcauuacuguggauggcaucuguagaaccacauuggauagcggcuaguaucauucuugaauuuuucuugaugguguuauugauaccugaacccgauagacaaagaacaccacaagacaaucaacuugcuuauguaguaauagguuuguuauuuaugauauugacuguggcugcuaaugagaugggucugcucgagacgacaaagaaggacuuaggaauaggacauguagcugcugaaaaucaccaacaugccacgaugcuagacguugacuugagaccugcaucugcguggacguuauaugcaguggcuacaacaguuauaacaccuaugaugcgccacacaauugaaaauacaacagccaauauuaguuuaacagcuauagcuaaucaagcugcaauauugaugggauuagacaaaggguggccgaucaguaagauggauauaggagucccccuauuagcucuaggauguuauucacaaguuaauccauuaacuuuaacagcugcaguuuuaauguuaguugcgcauuacgcaauuauaggaccuggauuacaagccaaagccaccagggaagcacagaaaaggacagccgcagggauaaugaaaaacccuacaguagauggaauagucgcaaucgacuuggacccugucgucuaugacgcgaaguucgaaaaacaacuaggucaaauuauguuacuaauuuuaugcacaucucaaauuuugcuaaugcguacuacuugggcauuaugugaaucaauuacucuggcgacuggaccacucacaacacuuugggagggaucucccggaaaauucuggaacacuacgaucgcgguaaguauggcaaauauauuucggggcucguauuuggcgggagcuggacuagcauucucacuuaugaagucauugggaggagguagaagaggcacgggagcucaaggggaaacguugggcgagaaauggaaacggcaacuaaaucaacugagcaaauccgaguucaacacauacaaaaggucugggauuauggagguagaucggucggaagccaaagaggggcuuaaacguggcgagacgacaaaacaugcuguuucaagaggcacagcaaaacuacggugguuugucgaacguaauuuaguuaaaccagaaggaaagguaauagauuuaggaugugggcgaggcggcuggucguacuacugugccggccucaagaaaguaacggagguaaagggauacacaaagggugguccggggcaugaagaaccaaucccgauggcaacuuauggauggaacuuagugaaguugcauagcgguaaagauguauucuuuaugccuccugagaaaugcgauacacuauuaugcgacauuggggagucaucuccgaacccaacaauagaagaaggacguacccugcgaguacucaaaaugguagaacccuggcuaagaggaaaucaauuuuguauuaaaauccuuaacccauauaugccaucggucguagaggcauuagaacagaugcaacgaaagcacgguggaauguuggugcgaaauccuuugagcagaaauucuacacaugaaauguauuggguguccuguggcacugggaauaucguuucagccguaaauaugacgaguaggauguuacuuaauagauuuacgauggcccaccgaaagccaacuuaugaacgagacguggaccugggggcuggaacgcgacauguugcgguagaaccagaagucgcgaaucuagacaucauaggucaacgcauagaaaacaucaagaacgaacauaaaucgacauggcauuaugaugaagacaacccuuacaaaacgugggcauaucacggcucguaugaaguaaaaccuucaggaucagccuccaguaugguuaauggaguagucagacuacuuacgaagccaugggacguuaucccuaugguaacccaaauagcaaugacugauacaacuccuuucggacaacaacgaguguucaaagaaaagguagauaccagaacaccaagagcuaagcgaggaaccacucaaauaauggaagucacagcuaaauggcuauggggguuucuaagcagaaauaagaaaccuaggauuuguacaagggaagaguucacaagaaaagucagaucaaaugcagcaauaggggccguuuucgucgacgagaaucaauggaacucagcuaaggaggcaguagaagaugaaagauuuugggacuuaguacauagggaacgagagcuccauaagcaggggaaaugugcuacgugcguauacaacaugaugggaaaaagagagaagaaacuuggagaguucgggaaagcaaaagguucgagagccauuugguauaugugguuaggcgcuagauuuuuggaguuugaggcauugggguuuaugaacgaagaccacugguuuagccgagaaaauucacucagcggcguagaaggagaaggacuacacaaacuugguuauauccuucgugauauuucuaaaauaccaggagguaauauguacgccgacgauacagccgguugggacacuagaauuaccgaagaugaccuucaaaaugaagccaaaauaacugaaauaauggagcccgagcacgcccuacuagcaacgucaauauucaaacuuacauaucagaacaaggugguaagaguccagagaccagccaaaaaugguacaguaauggacguaaucucuagaagggaccaacggggaucuggacaaguagguacauaugguuuaaauaccuuuacuaacauggagguacaauugauccgacagauggaaucggaggguauuuuucuaccgagcgaacuugagacaccaaaccuagcagaacgcguauuggauuggcuagagaagcacggggccgaaagauuaaagagaauggccauuucaggagacgacuguguuguaaagccaauugaugauagauucgcaacugcauugacagcucuaaacgauauggggaaagucagaaaagacaucccacaaugggaaccguccaaagguuggaacgauuggcagcaagugccguuuuguagucaucacuuccaucaauugauaaugaaggauggaagagagauaguugugccgugcagaaaccaagaugaauuaguaggcagagcgcgagugucucagggcgcaggcuggaguuuacgggaaacggcauguuuagggaaaucguaugcucaaauguggcaauuaauguauuuucauaggcgagaucuaaggcuugcggcaaaugccauuaguagugccguuccaguugacuggguacccacuucacguacuacgugguccauacaugcacaucaucaauggaugacaaccgaggacaugcucucaguuuggaacagaguauggauagaagaaaaucccuggauggaggacaagacccacgugucaucaugggaagaagucccauaucugggcaaacgugaagaccaauggugugguagccuuaucggguugacagcaagagcaacaugggccacuaauauacagguagccauaaaucaaguacgaaggcucaucgggaaugaaaacuauuuggacuauaugacuuccaugaaacgguucaaaaaugaaucugacccugagggggcacuaugguaa

SEQ ID NO: 21264 - RNA, 9879 nt, Artificial Sequence
  derived and/or modified CDS sequence (opt6) from DENV-1__GU131983__SS-prME
agcguaacaaugcuauugauguuacugccaacugcuuuagcauuccacuuaacaacucgaggaggugaaccacauaugauagucaguaaacaagaacgagggaaaagccuucuauuuaaaacaagcgcaggaguuaacaugugcacauuaauagcuauggaccuuggagaauugugcgaagacacaaugaccuauaaauguccgcaaauaacggaagccgaaccggacgauguggacuguugguguaaugcgacugauacguggguuacauauggcacauguagucaaacuggcgaacauagaagagacaaacgauccguagcauuagcaccccacgucggacuaggacuagaaacgcgaaccgaaaccuggaugucgagugaaggugcauggaaacaaauucaacgaguggaaacuugggcuuuacgacacccaggauuuaccgucauagcacuauuucuagcucaugccauuggaacaucgauaacccaaaaaggcauaauauucauacuuuugaugcugguuacaccgaguauggcgaugcguuguguaggaauaggcaaucgugacuucguagaagggcuuucuggugccacauggguagauguuguacuagaacaugguucgugcguaacuacaauggccaaaaacaaaccuacauuagauauagaacuucuuaaaaccgaaguaaccaaucccgcaauacuaagaaaacuaugcauagaagcuaaaauuuccaacacaacgacugauucacggugucccacucaaggugaagccacucucgucgaggaacaagaugcaaauuucguguguagaagaacauucguggacaggggguggggaaauggaugcggauuauuuggaaaaggaucccuauuaacuugcgcuaaauucaaauguguaacuaaauuggagggaaaaauuguucaauaugaaaaccucaaauacuccgucaucgugacaguacacacaggagaucagcaccaagucgguaaugaaacaacagaacacggaaccaucgcaacaauuacaccgcaggcacccacauccgagauacaauuaacugauuacggcgcucuuacgcucgacugcaguccccgaacuggucuggauuucaaugaaaugguauuacuuacaaugaaagaaaaaucauggcuaguacauaaacagugguuucuagauuuaccauugccguggacaaguggugcaucgacaucgcaagaaacauggaauagacaggauuuauuaguuacauuuaaaacggcucaugcgaagaaacaggaaguaguuguacuuggaucgcaggaaggagcgaugcauacugcguuaacuggggccacugaaauccaaacuagcggaaccacgacaauauucgcuggucacuugaaaugucguuuaaaaauggauaaauuaacuuuaaaagguacgucuuaugucauguguacuggaucauucaaacuugagaaagaaguggcagaaacacagcacgggacgguacuuguucaagucaaauaugaagguacggaugccccauguaaaauuccauuuucaacacaagaugaaaagggcguaacccagaacggacgauuaauaacagcuaacccgaucguuacugacaaagaaaagccugugaauaucgaaacggaacccccguuuggagagucuuacauuguuguaggagccggcgaaaaggcacugaaauuaucgugguucaaaaagggaucgaguaucggaaaaauguucgaagcaacugcaaggggugcacgccgaauggcgauuuuaggcgauaccgcgugggacuucgggucaauagggggaguuuucaccagcgucgggaaauuaguccaucagguauucgguaccgcguaugguguucucuuuucagggguaucuuggacuaugaaaauuggaauuggaauacuacugacuuggcucggccuaaauucaaggaguacaucucuaaguaugaccuguauagcgguagguauggugacauuauacuuaggcguaaugguucaggcggauagugguuguguaauaaacuggaaaggacgcgaguuaaaaugugggucagggauauucgucacgaaugaaguccauacauggacagagcaauacaaauuucaggcugacagcccaaaaaggcuuucggcagcgauaggcaaagcaugggaagaaggaguaugcgggauuagaucagcaaccagacuggaaaacauuauguggaaacaaauaucgaaugaauuaaaucauauauuacuagagaacgauaugaaguucaccgugguuguaggcgaugcuaauggaaucuuagcccaagggaagaaaaugauuagaccccaaccuauggagcacaaguacagcuggaaaucguggggaaaagcaaagauaauaggcgcggacauucagaauacaacuuucaucaucgacggaccagauacacccgaauguccagacaaucaaagggccuggaauauaugggaaguagaggauuauggguucggaauauucaccacgaacaucuggcuuaaauuaagagauucuuauacucagaugugugaccacagacugaugagugcugcuauuaaggacaguaaggccguccaugcggauauggguuauuggaucgaaucagaaaagaaugaaacguggaaacucgcucgugcguccuuuauagaaguuaaaaccuguacauggccaaaaagucauacccucuggucuaauggaguuuuagaaagugaaaugauaauccccaagauauauggaggaccuauaagucaacacaauuaucgcccgggauauuuuacacaaacagccggaccauggcacuuagguaaacucgaguuagauuuugaccuaugugaggguacuacaguagucguagacgaacauuguggaaauagaggacccagucucagaacuaccacuguuacaggaaagauaauacaugaauggugcuguagaucauguacccuacccccacuuagauucagaggagaagacggauguugguaugggauggaaaucaggccgguaaaagagaaggaagagaaucuaguccggaguaugguguccgcaggcucuggugaaguugauucguuuucacuaggaaucuuaugcgcuuccauuaugauagaggaaguuaugagaagcagauggucucgaaagaugcuaaugauuggcacacuagcugucuuccuacuacugguaaugggacaacuaacguggaaugaucuuauacgguuauguauaaugguaggagcgaaugcaagugaccgaaugggaaugggaacgacuuacuuagcucuaauggcaacauuuaaaaugagacccauguucgccgugggacuauuauuccgaagguuaacaucuagagaaguauuauuacuaacaauagguuugucguuaguagcgagcgucgaacuccccaacucccuugaagaauuaggcgauggucuugcaauggguauuaugaugcucaaauugcuaacagaauuucaaccacaccaauuauggacgacgcuacuuucgcuaacuuuuauaaaaacuaccuuaagucuagacuacgcguggaaaacaacagccauggcauuaaguauagugucauuguuuccauuaugccuaagcacgacuagccaaaagacuacaugguuaccgguacugcuaggaucuuuuggcugcaaaccauugacgauguuucuaaucacugaaaauaaaauauggggaaggaaaagcuggcccuuaaaugagggaauuauggcaaucgggauuguuuccauauuacuaucaucgcuuuugaagaaugauguaccccuggccgguccccugauugcgggagggaugcugauugcguguuacguaauaucugguucuuccgcggacuugucgcucgaaaaagcagcugaaguaucgugggaacaagaagcggaacacagugggacuucccauaauauuuuggucgaaguucaagacgauggaacaaugaaaauaaaagaugaagagagagaugauacguuaacaauacuucuaaaagcgacauuacuugccgugagcggugucuauccuaugucaaucccagccacuuuauuuguaugguauuuuuggcagaaaaagaaacaaagaucagggguucuuugggacacgccgucaccucccgaagucgaaagggccgucuuagaugauggaauauaccgaauuuuacaacgcggcuugcuuggaagaagucagguuggaguagguguuuuucaggaugguguauuucauacaauguggcacguaacaagaggagcgguuuuaauguaucaggggaaaagguuggagccaagcugggcgucggugaagaaagaucuuauaucuuauggugguggguggagguuucaaggaaguuggaacacuggcgaagagguccagguaaucgcaguagaaccugggaaaaauccgaaaaacguucaaacaacaccaggcacuuucaaaacaccagaaggggaaguaggggcuauagcacuagacuuuaaaccuggaacauccggaucucccaucguaaacagagaggggaaaauaguuggucuuuauggaaacggugucguuacuaccuccggaacguauguaagugcgaucgcacaggccaaggcuagucaagaggggccucuaccagaaauugaagaugaaguuuuuaagaaacgaaauuuaaccaucauggacuuacauccugggagugggaagacgcguagguacuuaccagcuauaguaagagaagcuauaaaacgcaaauuaagaacccuaauucuugcaccaacuagaguggucgccagugaaauggcagaagcccuuaagggcaugcccauacgauaccaaacaaccgcuguaaaaucugagcacacgggucgcgagauaguagaucuaaugugucaugcgacauucacaaugagacuucugaguccaguaagaguaccgaauuauaacaugaucaucauggaugaggcgcauuuuacagaccccgcuucuauagcugcuaggggguacauaucuacaaggguagguaugggggaggcagccgcuauauucaugacagcgacaccuccggguucaguggaagcauucccucaaucuaaugcaguaauucaagacgaagaacgagacauuccugagaggucuuggaacucaggauacgacuggauuacugauuuucccggaaaaacaguaugguuugugccuucgauuaaaucugggaacgauauagcaaauugccuuaggaaaaauggaaagaggguaauacaacuaagccgcaaaacauuugauacagaauaucagaaaaccaaaaacaaugauugggauuaugucguuacuacagauauauccgagaugggcgccaacuucagagcagaucgaguaauugacccuagacgauguuuaaaaccaguaauauugaaagacgguccagaaagagugauauuggcaggacccaugcccgucacuguggccucagcugcacaacgcagagggaggaucggccguaaucaaaacaaagaaggagaccaauaugucuauauggggcaaccacugaacaacgaugaagaucaugcacauuggaccgaagcaaagaugcuuuuggacaacauaaauacuccggaagguauuauaccggcguuguuugaaccagaaagagagaaaagcgcagcaauagauggcgaauauagacuaagaggugaagccagaaagacauucguagaauuaaugagacgaggggaccugccuguuuggcuaucguauaaaguggcuucagagggauuucaauauagcgaccgaagauggugcuuugacggugaaagaaauaaucaaguucucgaagagaauauggauguagaaauauggaccaaggaaggcgaaagaaagaaacucaggccaagaugguuagacgcaagaacauauuccgacccucuggcuuuacgagaauuuaaggaguucgccgcugggcguagauccguuaguggagaccuaauauuagaaauagggaagcuaccccaacacuuaacacugcgggcacagaaugcauuagacaaucuaguaauguugcauaauucagaacaagguggcaaagcauaucggcaugcuauggaagaauuacccgauacuauagaaacuuuaauguuacuagcucugauagcagucuugacaggagguguaacccuauucuuuuuaucugggaagggacucgguaaaacaucaauaggcuugcuauguguaacggccucaagcgcacuuuuauggauggcuaguguggaaccacacuggauugcugcuaguauaauucuagaguucuucuuaaugguuuuacucauaccagaaccagauaggcaacgcacuccucaggauaaccaacuagcauauguggucaucggacuccucuucaugauacuuaccguagcggcgaaugaaaugggucugcucgagacaacgaagaaagaccuaggaauagggcauguugccgcagaaaaccaucaacaugcgacgauguuggauguagauuuaagaccagccagcgcguggacacucuacgcaguugcgacgacaguaaucacuccaaugaugagacauacgauugaaaacaccacagcuaauauaagucuuacagccauagcaaaccaagcugcgaucuuaaugggucucgacaaagguuggccaaucucuaagauggauaucggcguaccccuccuagcgcuaggaugcuauagucaaguaaauccacuuacuuuaacagcugcagugcuaauguuaguugcccacuaugcgauuauuggacccggacugcaagcaaaagcuacccgagaagcacaaaagcgaacagcugcuggaaucaugaaaaauccgacuguggacggaauuguggcaauagaucuagauccuguuguuuaugaugcaaaauuugaaaagcaacuaggacaaauaaugcuauugauuuuaugcaccucacaaaucuuacugaugagaacaaccugggcucuuugcgaaaguauaacacuugcaacugguccacugaccacguugugggaggguaguccagguaaauuuuggaacacuacaauagcuguaucuauggccaacaucuuucgaggaaguuaccuggcuggagccggccuugccuuuuccuuaaugaaaucgcucgguggaggucgccggggaacaggcgcacagggcgaaacccucggagaaaaguggaaaagacaguuaaaucagcuauccaaaagugaguucaauacuuauaaaagaucagguauaauggaagucgaucggagugaagccaaggagggauugaagagaggugaaacuacaaaacaugcaguaagccgugggacugcaaaacuccguugguuuguagagaggaauuuaguaaaaccugaagggaaaguuauugauuuaggaugcgggcgaggcggcuggaguuauuauugcgcggggcucaagaaaguuacagaagucaagggauacacaaaaggagguccaggucaugaagaaccgauuccgauggcaaccuacggguggaauuuaguaaagcuacauucgggaaaagauguauucuuuaugccaccugaaaaaugcgauacucuucuaugugauauaggugaaaguagcccgaacccaacaauagaggaagguagaacacuacguguacugaaaaugguagaacccugguuacgaggcaaccaauucugcaucaagauauugaauccauauaugccuucaguuguugaaacacuagaacaaaugcagagaaaacauggcgggauguuaguaagaaauccauugucccgaaauucuacucaugaaauguauuggguuucaugcggaaccggaaauauaguaagugcaguuaacaugacaagccgcaugcuucucaacagauucacaauggcacauagaaagccaacauaugaaagagauguagauuuaggagcugguacuagacacguggcgguagaaccagaagucgcaaaccuagacauuauuggucaacgaauagaaaauaucaaaaaugagcauaaauccacauggcacuaugacgaagacaauccauauaagacuugggcauaucauggcaguuaugaaguuaaacccagugggucugcuagcagcaugguuaaugggguugucagacuauuaacaaaaccuugggacguaauacccaugguuacacaaauagcgaugacugauacuacuccauucggucaacaacgcguuuucaaggaaaaagucgauaccagaacgccacgcgcgaagagggguacuacgcaaaucauggagguaaccgccaaauggcucuggggcuuucuaagucggaauaagaaaccaagaauauguacaagggaagaguucacgcgaaaaguaagaaguaaugcugcaauuggagcuguauuuguggacgaaaaccaauggaauagugcaaaggaggcggucgaagaugagcgauuuugggaucuaguacauagagaacgggaacuacacaaacaggggaaaugugcuacaugcguauauaauaugaugggcaaaagggagaagaaauuaggugaguucggaaaagcaaagggaucgagggcuauaugguauauguggcuuggagcacgcuuccuagaauuugaagcacuagguuuuaugaaugaagaccauugguuuagcagagaaaacucuuugucggggguggaaggugaaggccuacauaaauuaggguacauacuacgggauauaucgaaaauacccgguggaaauauguacgccgaugacacugcugguugggacacuagaauaacagaagacgaccuccagaaugaagccaagauaacagaaaucauggaacccgaacacgccuuauuagcaacgucaaucuucaaauuaacuuaucaaaauaaaguaguaagaguacaaagaccugccaaaaauggaacagucauggacguaauaucacguagagaccaacgagggaguggacaggucggaacauaugggcugaacacguuuacgaacauggagguacaauugauacggcagauggaaucagaggaaauauuucuaccgucagaauuggaaacaccuaaccuugcagaaagaguucuagacuggcucgagaaacauggggcagaaagacuaaaaagaauggcuauuucaggugaugauugcgugguaaaaccaauugacgaccgcuuugcaacugccuuaacagcauuaaaugauaugggcaaaguucgaaaagacauaccacaaugggaaccuucuaaaggcuggaacgauuggcaacaaguuccauuuugcagucaucauuuucaccaauugauuaugaaagauggaagagaaauagugguacccugccgcaaucaagaugaacuugucgggagagcacgagugucacaaggugccggcuggagucucagagagacugcuuguuuaggaaagagcuaugcacaaauguggcaacuaauguacuuccaucgaagagauuuaagauuagcagcaaacgcgauuuguucagcaguaccaguugauugggugccaacgucacgaacuacguggucaauccaugcgcaccaucaguggaugacuacagaggacauguugagcgucuggaauaggguauggauugaagaaaauccuuggauggaggauaaaacccaugugagcagcugggaggaaguaccuuacuugggaaaacgugaggaccaauggugcggaagucugauaggauuaaccgcucgggcaacuugggcuacgaauauacaaguugcaauuaaucagguacgcagguuaauugguaaugaaaauuaucuagauuacaugacgucuaugaaacgcuuuaaaaaugaaagcgacccugaaggagcgcugugguaa

SEQ ID NO: 21265 - RNA, 9879 nt, Artificial Sequence
  derived and/or modified CDS sequence (opt6) from DENV-1__GQ868532__SS-prME
ucuguaacgauguugcucauguuauuacccacggcauuagcauuccaucuaacaaccaggggaggagaaccgcacaugaucguaucuaaacaagaaagggggaaaucucuuuuauuuaaaaccagugcugguguuaauauguguacauuaauagcaauggauuuaggagaauuaugugaagauacaaugacuuauaaauguccacaaauaacagaagcagaaccagaugacguagauugcugguguaacgcuacagacacauggguaacauacgggacuuguagucaaaccggugaacaucggcgugauaaacgcagcguagcucuagcuccacaugugggacucggucucgaaacucguacagaaacauggaugagcucagaaggagcuuggaaacaaauccaacguguagaaacuugggcuuuaagacacccagguuuuacuguuauagcgcuauuuuuagcccaugcgaucggaaccagcauaacacaaaagggaauuaucuucauucuacuaaugcuaguaacaccaucuauggcaaugagauguguaggcauaggaaauagagauuuuguugagggacucagcggugcgacauggguagauguggugcuagaacauggcagcuguguuaccacaauggccaaaaauaagccuaccuuagauauugaacuacuaaagacagaaguuacuaauccagccauacuacggaaacuuugcaucgaagccaaaauaaguaacacuacaacagacucacguuguccaacacaaggagaagcuacacuuguggaggaacaagaugcgaauuuuguuugucgacguaccuuuguagacagaggguggggaaauggcuguggucuuuucgguaaagggucccucuugaccugcgcaaaauucaaauguguaaccaaacucgaaggcaaaaucguacaauacgagaauuugaaauacuccguuauaguaacagugcacacaggcgaccaacaucaaguugggaacgaaacaacugaacacggcacaaucgcaacuauuacgccucaggcaccaacgucagaaauacaauuaacagauuauggcgcguuaacauuggacuguucuccaagaacaggucuugauuuuaacgagaugguacuccuaacuaugaaagaaaaaucauggcuaguucacaagcaaugguucuuagaccugccucugccauggacuucuggagcuaguacuucccaagagacauggaacagacaagaucuauuaguaacauuuaaaacagcacacgcgaaaaagcaggaagugguagucuugggcucucaagaaggugccaugcauacagcccucaccggagcuacggagauccagacaaguggaacuacuaccaucuucgcgggacaucucaagugucgcuuaaaaauggauaaacuuaccuugaaggggacuucauacguuauguguacggguaguuuuaaauuggagaaagaaguagcggaaacucaacauggcacgguguuaguacaaguaaaauaugaagggacagacgcaccguguaaaauuccauucucaacucaagacgaaaaaggggugacucaaaacggacgacuaauuacugcaaauccaaucgugaccgauaaagaaaaaccgguuaacauagaaacggagccaccauucggugaaucauauauuguagugggcgcaggagaaaaagcauuaaaauuaucuugguucaaaaagggaaguucgaucggaaaaauguucgaagcaacugcccggggagcacgaagaauggcuauccuuggagauacagcgugggauuuugguucaaucggaggaguauucacaaguguagguaagcuaguccaucaaguauuuggaacggcauacggcguauuguuuaguggaguuucauggacaaugaaaauaggcauugguauauuacugacuuggcuuggucuaaacagucggucuacaagccuaucuaugacuuguauagccgucgggauggucacuuuauaccuuggugucaugguacaagccgacucgggauguguuauaaauuggaagggacgagaauuaaaaugcggaucgggaauuuuugugacuaaugaaguacacacuuggacagaacaguauaaauuucaagcagauucaccuaaaagauuaucagcggcaauaggaaaggcuugggaagaagguguaugcgguauaaggagcgcaacuagacuagaaaauauaauguggaaacaaauaagcaacgagcuaaaucauauauuauuggaaaaugacaugaaauucacagugguugugggugacgcuaacgguauucuagcacaagggaagaagaugauaaggccccaaccaauggaacauaaguauaguuggaagucaugggguaaggcaaaaauuaucggcgcggauauacaaaacacaacuuuuauaauagauggcccggauacaccggaguguccugauaaccaaagagcuuggaauauuugggaagucgaagacuacggguucggaauauuuacgacaaacaucuggcuuaaauuacgagacaguuacacgcaaaugugcgaucacagauuaaugagugccgcgauuaaagacuccaaagcaguucaugcagacaugggguacuggaucgagucugagaaaaaugagacguggaagcuggcucgagccucguuuauagaagugaaaacauguacauggccuaaaucacauacacucuggaguaauggcguacucgaguccgaaaugaucauuccaaaaauauacggagguccuauaucccaacauaauuacaggccugguuacuuuacacaaacagccgggccauggcaucuaggaaaacuugaguuggacuuugacuuaugugaaggaacuacuguugugguggaugaacauugcggaaacagaggucccaguuuaagaacgacaacugugaccggaaagauaauucaugaguggugcugcagaaguugcacccuuccaccucuacgcuuccggggugaggaugguuguugguacggaauggaaauucgaccugucaaagaaaaggaagaaaauuuggucagaagcaugguuagcgccgguaguggagaaguugacaguuucagcuuagguauacuaugcgcuucaauaaugauagaagaaguuaugagaagcagauggucaagaaaaauguuaaugacaggcacucuagcaguuuuucuguuauuaguuauggggcaauugacuuggaacgaccuuauaagguuaugcauaaugguaggggcuaaugccucagacagaaugggaaugggaaccacauauuuagcuuuaauggcuacauucaagaugcgcccaauguucgcuguaggccuauuauuucgaagguuaacaaguagggagguccuucuuuuaacuaucggucuauccuuagucgccucaguugaacuaccaaauagcuuagaggaauuaggugacggacucgcuaugggaaucaugaugcuuaaauugcuaaccgaauuucaaccgcaucaguuauggaucaccuuguuaucucucacauuuaucaaaacuacucugucuuuggacuaugcauggaagaccacagccauggcucuaucaauaguaucacuuuuuccauuaugucuaaguacgacaagccaaaagacaacaugguuacccgucuuacuaggaucauucgguuguaaaccauugaccauguuucucaucacggagaauaagauauggggacgcaagaguuggcccuugaacgaaggcauaauggcaauagguauaguaucgauauuauugagcucauuacuuaagaaugacguuccacuagcgggcccauuaauugcaggcgguauguugauagccugcuauguaauuagcggaaacucugcagauuuaaguuuggaaaaagcggcugagguuucuugggaacaagaagcagaacauuccgggacaucccauaauauauugguagaaguacaggaugauggcacuaugaaaauaaaagaugaggaacgcgacgauacacuuacuauuuuauuaaaagcaacccuucuagcaguaucaggaguauacccaaugaguauaccugcuacauuauuugucugguacuucuggcagaagaagaaacaacgaucugggguuuuaugggacacuccuuccccuccugaaguagaacgggcgguuuuggaugacggaauuuaccgcauccuacagagaggacuacuagguagaucucaaguaggugugggugucuuucaggauggaguauuucauacaauguggcauguuacgagaggggcgguauuaauguaccaaggaaaaaggcucgaaccgucuugggcuagugucaagaaagaccugauaagcuacggaggagguuggagauuccaaggaucguggaauacuggagaagaaguacagguaauugccguagaaccagggaaaaaccccaaaaacguccagacuaugccuggaacauuuaaaacacccgagggggaagucggagcgauagcucuagauuuuaaacccgguacaagcgguucgccaaucgugaaucgagaaggcaaaauuguaggcuuauauggaaaugguguagucacaaccagcgguacguauguuucggcaauugcacaagcaaaggcaagucaagaagguccaccucccgaaauagaggacgaggucuuuaagaaaaggaaucucacaauaauggauuuacauccgggaagcggaaaaacucgucgauaucuaccugcaaugguuagagaagcuauaaagcggaaauugaggacauuaauccucgcgcccacaagaguugucgcuuccgaaauggcagaagccuuaaaagguaugccaaucagguaucagacaaccgcugucaaaucagaacauacgggcagagaaauuguagaucuaaugugccacgcaacuuuuacuaugagguuacuuaguccaguacgagugccaaauuauaauaugauuauuauggaugaagcucacuuuacggacccggcaagcauugcagccaggggcuauauaucaacgcgcguuggaaugggcgaagcagcggcaauauuuaugaccgcuacgccgccgggaucuguagaggcuuuuccgcaaucaaaugcagugauacaggaugaagaaagggauauaccugaaagauccuggaacagugguuacgacuggauaacugacuuuccggguaaaaccguuugguucguaccuaguauuaaaucuggcaacgauauugcaaauuguuuaaggaaaaaugggaaacgcgucauccaauugucuagaaaaacauucgauacagaguaccagaaaacuaagaacaaugacugggauuacguuguaacuaccgauauuagugagaugggagcaaauuuucgagcggacagagugauugaccccagaagaugcuuaaaaccaguuauccucaaagauggaccggaaaggguuaucuuagcgggccccaugccgguaacuguagcaagugcagcacaacgcagagguaggaucggaagaaaccaaaacaaggaaggagaucaauacguauacaugggacaaccgcuaaauaaugacgaggaucaugcgcauuggacggaagcuaaaauguuguuagauaacaucaacacaccugaggguauaauuccagcccuauuugaaccggaaagggagaaaagugcagcaauagacggugaauaccgucuuagaggcgaagcuaggaaaacauuuguggaacucaugcguagaggagauuugccaguauggcucagcuacaaaguagcuagugaagguuuucaguacuccgauagaagguggugcuuugauggugaaagaaacaaccaaguacuagaagaaaacauggauguugaaaucuggacuaaggagggggaaaggaagaaauuaagaccgagaugguuagacgcacgaacauauucugauccccuggccuuacgagaauuuaaagaauuugcagcaggccgucguagugucuccggcgaucuaauauuggaaauaggaaaauuaccucagcaccuaacgcuccgagcacagaaugcacucgacaaucuagucauguugcauaacucugagcaaggugggaaagcauauagacacgcaauggaagaauuaccugacacaaucgagacacuaauguugcuuacauuaauugcuguucuaacuggaggcguaacuuuauuuuuccugaguggcaagggucuagguaaaacaucuaucggacuucuaugugucacugcgagcagugcacuacuauggauggcuagugucgaaccgcacuggauagcagcuucaauuauucuagaguucuuucuaauggugcuauuaaucccagaaccagaccgucaacgaacaccacaagauaaucaauuagcuuauguuguaauaggccucuuauuuaugauucuuaccguagcggcuaacgaaaugggucuucuggaaacgacuaaaaaggaccucgguauuggacauguggcagcagaaaaccaccaacacgcuacaaugcuagauguagaucucagacccgcuagugcguggacauuauacgcagucgcaacgacugucauuacaccaaugaugagacacacuauagaaaauacaacagcaaauaucagucuaacagccauagcgaaccaagcagcaauauuaaugggcuuagauaaggguuggcccauuucaaagauggacauaggaguaccccuccuagcucucggcuguuauucacagguaaacccauuaacgcuuacggcagcgguacuaaugcuuguggcccauuacgcgauaauugguccgggcuugcaggcaaaagcuaccagagaagcgcaaaaacggacugcagccgguaucaugaaaaauccaaccguggacgguaucguugcaauugaccuagaccccguagucuacgacgcaaaauuugaaaaacaacugggucagauuaugcuguuaauauugugcacuucucaaaucuuauuaaugagaaccacaugggcacuuugugaaaguauaacacuugcuacagggccauuaaccaccuuaugggagggaucgccagguaaauuuuggaacaccacaaucgccguauccauggcgaacaucuuucgcgguagcuauuuggccggggcaggauuggcauuuucucuaaugaaaucgcuagggggaggaaggcgaggaacuggagcucaaggagaaacuuuaggcgaaaaauggaagcggcagcuaaaucaauuauccaagagugaauuuaauacauauaaaagaucagguaucauggagguugaccguucagaagcgaaggaaggucuuaagcgaggugaaacgacuaaacacgcaguaagcaggggaacggcaaaauuaagaugguuuguagagagaaaucuaguaaagccagaaggaaaaguaaucgacuuaggguguggucgaggcggauggaguuauuacugcgcaggucuuaagaagguaaccgaaguuaaaggauauaccaagggugggccaggacaugaggagccuauaccgauggcuacauauggauggaauuuagucaaacugcauucggguaaagacguauucuuuaugccaccagaaaaaugcgauacucugcugugugacauaggugaauccagccccaaccccacgauagaagaagguagaacacuucgaguccuaaagaugguugaaccaugguuacguggaaaucaauuuugcauaaaaauuuuaaaccccuacaugccaaauguaguagaaacauuggaacagaugcaaagaaaacauggagggauguuaguacgaaauccguuaucacguaauucaacucaugaaauguauuggguaagcuguggaaccggaaauauuguuucagcaguaaauaugaccucucgcauguuauuaaauagguuuacgauggcgcaccggaaaccgaccuaugaacgcgacgucgauuuaggagcgggaaccagacauguagccguagagccugaagucgcaaaccuggauaucauaggacagcguaucgaaaauaucaaaaacgaacauaaaaguaccuggcacuaugaugaagauaacccauacaaaacuugggcuuaccauggcucauacgagguuaaacccagcggaucugcuucuucuauggucaauggcguaguaagacuguuaacaaaaccuugggaugguauucccauggucacacagauagccaugaccgauacaacaccguuuggacaacaaagaguauuuaaagaaaaaguggacaccagaacucccagggcaaaaagaggaacaacucagauuauggagguaaccgcuaaaugguuauggggguuucuaagucgaaauaagaaaccccgaaucuguaccagggaggaguucaccaggaagguuagaaguaaugcagcaauaggugcuguuuuuguagaugagaaucaauggaacucugccaaggaggcaguagaggacgagagauuuugggaucucguucaccgagaaagagaauuacacaaacaaggaaaaugugcuaccuguguauacaacaugauggguaaaagagagaagaaacuaggagaauuuggcaaagccaaggggagucgagccauaugguacaugugguuaggagcaagauucuuagaauuugaggcgcuugguuuuaugaaugaagaucauugguuuucaagagaaaauucacuuaguggcguugaaggagaaggacuccauaaguuaggauauauccuccgagauauaucgaagaucccaggugggaacauguaugcggacgacacagcggggugggauacgcggauuacagaagaugaucuacaaaacgaggcaaagaucacagaaauuauggaaccggagcaugcauuguuagcuaccucaauuuuuaaacuaacuuaucagaauaaaguaguucguguacaaaggccugcgaaaaacgggaccgugauggaugugauuucuagaagagaucaacgcggaagcggucaaguagggacuuauggcuuaaacacauuuacuaauauggaagugcaguuaaucagacaaauggaaagugaggguauauuccuaccuucggaacucgagacacccaaucuggcugaacgaguccuagauugguuggaaaaacauggagccgagcgacugaaaagaauggcaauaaguggugaugauuguguggucaaacccauugacgacagauuugcuacugcucuuacugccuuaaacgacauggggaaggucagaaaagauauuccgcaaugggagccaucaaaaggauggaaugauuggcaacaaguuccauucuguucccaccauuuucaucaauuaauaaugaaagauggccgagaaauuguuguaccuuguagaaaucaagaugagcuagucggccgagcacgaguuucccaaggugccggauggucgcuaagagaaacugccugucucgguaaauccuacgcgcaaauguggcaauugauguacuuucaucgacgggaucucagacuugcugccaacgcaaucuguucggcugucccgguagauugggucccuaccucgaggacaacuuggucuauccaugcacaucaucaguggaugaccaccgaagauaugcuuucuguguggaauagaguauggauagaggaaaacccguggauggaggacaagacgcauguaucuucaugggaagaagucccuuaucucggaaaaagagaagaucaauggugcggaagucuaauuggacuaacugcgcgugcaacuugggcuacgaauauacaaguagccauuaaccaggugagaagguugauagguaaugaaaauuaccuggauuauaugacaucuaugaagagauucaaaaacgagucagacccagaaggagcucucugguga

SEQ ID NO: 21266 - RNA, 9879 nt, Artificial Sequence
  derived and/or modified CDS sequence (opt6) from DENV-1__GQ868533__SS-prME
ucaguaacaaugcuuuuaaugcucuuaccgaccgccuuggcauuucauuugacaacacgaggaggggaaccacacaugaucgugucuaaacaagaaagaggaaaaagccugcuuuuuaaaacgucagcaggagucaauauguguacauuaaucgcgauggaucuaggagaauuaugugaagacacaaugaccuauaaauguccacaaauuacggaagcagaacccgaugacgucgauuguugguguaaugcgacugacacauggguaacuuacggcacguguagucaaaccggcgaacaccgucgagacaaaagaucgguugccuuagccccacacguaggauuaggccuggaaacgcgcaccgaaacguggaugucaucugaaggugcauggaaacaaauccaacgagucgaaacgugggcauuaagacacccuggguuuacaguuauugcccuauuuuuggcacaugcaauaggcacuucaaucacccaaaaaggaauaaucuuuauacuauuaaugcucguaacgccgagcauggcaaugaggugcgucgguauagggaacagagauuucgucgaaggucugaguggugcuacguggguugaugugguucuagaacauggcuccugcguuacaaccauggccaaaaauaaacccacacuugacauagaauuacuaaaaacagaggucacuaacccagcuauauugaggaaauuauguauagaagccaaaauaucaaauacuacaacugauucaagauguccaacgcaaggcgaagcaacauuaguagaggaacaagacgcuaacuucgucugucggagaacuuucguagaccgcggaugggggaaugguugcggacuguuuggcaaagguucacuccuaaccugugcgaaauucaaaugcgucacaaaauuggaggguaaaauaguucaauacgaaaaucuaaaauauucuguaauaguaaccguucauacgggggaccaacaucagguaggaaacgaaacuacagaacacggcacuaucgccacaaucacgccgcaagcaccuacaagcgagauacaauuaacggacuauggcgcauuaacucuagauugcucccccaggaccggauuagauuuuaacgaaauggucuugcuaaccaugaaagagaaaucguggcuaguccacaaacaaugguuccuagacuugccucuaccguggacaaguggagccucuacuucacaagaaacauggaaucggcaagaucuuuuaguuacuuuuaaaacggcucacgccaagaaacaagaagugguggugcuugguucccaggaaggugcaaugcacacagccuuaacgggagcuacugagauucaaacaucagguacaacuaccauauuugcuggacaucuaaaaugucguuugaaaauggacaaauuaacccuaaaagggacgaguuacguaaugugcacaggcuccuuuaaacuugagaaagaagucgcggaaacucaacaugggacuguucuaguucaggucaaauacgagggaacagaugccccauguaaaauacccuuuaguacacaagacgaaaaaggggucacccaaaauggacgauuaauaacugccaacccuauaguaacagauaaagagaaaccuguuaauauagaaacugagcccccuuucggagagucuuacauugugguuggugcuggugaaaaagcacugaaauuaaguugguuuaagaaaggaagcagcaucgggaaaauguuugaagcaacagcacguggugcgagacgcauggcaauauuaggggacacagcgugggauuuugguagcauuggggguguguuuaccucaguagguaagcuaguacaucagguauucgggacugcguacgguguguuguucucuggaguuucuuggacaaugaaaauagguauuggaauacuacuaacuuggcucggauuaaauucuagaucaaccaguuugucaaugacaugcauugcaguaggaaugguaacuuuauaucugggaguaaugguccaagcugauucugggugcguaauaaacuggaaaggccgugaacuaaaaugcgguaguggaauuuuuguaacgaacgaaguacauacauggacugaacaguacaaauuucaggcggauucgccaaaaagguuaucugcugccauagggaaggcuugggaagaaggcgucuguggaauuaggucagcaacuagacuggaaaauaucauguggaaacagauuucuaaugaacuaaaucacauucugcuugaaaaugauaugaaauuuacaguuguugugggagacgccaauggaauauuagcacaaggcaagaaaaugauaagaccucaaccuauggagcacaaguacucauggaaaucguggggaaaggccaaaauaauugaagcugauauucaaaauacaacuuuuauuauagaugggccagacacuccugaaugcccugauaaucaacgagcguggaauauaugggaagucgaagacuauggauuuggaauauuuacaacaaauauaugguugaaacuaagagacuccuauacucaaaugugugaucaucgcuuaaugagugcagcuauaaaagacaguaaagcuguccacgcagauaugggguauuggauagaaagugagaaaaaugaaacauggaaauuagcgagggccagcuucauugaagugaaaacuuguacguggccaaagagccauacucuauggaguaaugggguacucgaguccgaaaugaucauaccuaaaauauacgguggcccaauaagucaacauaacuaccgucccgguuacuuuacucagacugccggccccuggcaccugggaaaacuggaauuagauuuugaccuaugugaaggaaccacaguaguaguagacgagcacuguggaaaccgaggcccuagucuacguacgaccacgguaacgggcaaaauaauucacgaaugguguuguaggagcugcacucugccgcccuuaagauuucgaggagaagauggauguugguaugggauggaaauaagaccagugaaagaaaaagaagaaaaucuuguaagaucaaugguaucggcaggaucgggcgaaguagauaguuuuaguuugggaauauugugcgcguccauaaugauugaggaagucaugagaaguagguggucaaggaaaaugcuaaugaccggaacauuggccguguuccuacuucuagucaugggucaacuuacauggaacgacuuaauuagauugugcaucaugguuggugcgaacgcaucagacagaaugggcauggggacaacauaccuagcacuaauggcaacauuuaaaaugcgcccaauguuugccgugggauugcuuuuucgacggcucaccucacgagaagucuuacuucuuacaaucggacuaucauuaguugcgaguguugaauuaccuaacucguuagaggaauugggagacggcuuggcuaugggaauaaugauguuaaaauugcuaacggaguuucaaccccaucaacuuuggacuacauuauuaucacuuacguucauaaaaacaacccuuagcuuggauuaugcguggaaaacuaccgcaauggccuugucaauaguuaguuuauuucccuuaugucuaaguaccaccucacagaaaacaaccuggcugcccguauuauuaggaucuuucgggugcaaaccgcuaacgauguucuuaauaacagaaaacaaaauauggggaagaaaaucuuggccauugaacgaaggaauaauggcuauaggcaucguuucuauucuucuuuccucacugcuuaaaaaugauguuccucuggcugguccacuaauagcgggagggauguugaucgccuguuauguaaucagcgguagcagcgcagauuuaucacuagaaaaagcagccgaaguauccugggaacaagaagcagaacauucgggaacgucacacaacauuuugguagagguacaagaugacggaacaaugaaaauuaaggacgaagaacgggaugacacucuaacgauccucuuaaaagcgacacuuuuggccguauccgguguguaccccaugagcauaccagcaacacuauuccucugguauuuuuggcagaagaagaaacaacguucagguguacucugggauaccccgucaccgccagaaguugaaagggccguucuugaugacgguauauaccguauauuacaaagaggacuauuaggaagaagucaaguaggagugggcguguuucaagaugguguauuccauacuauguggcauguaacuagaggugcaguauuaauguaucaaggaaaacgacuagaaccuuccugggcaucagucaaaaaggaucugauuaguuauggcggcgguuggagguuccaggggaguuggaauacaggagaagagguacaggugauagcuguggaaccuggcaagaaccccaaaaacgugcaaacuacaccuggaacuuucaagacgcccgaaggagagguaggugcaauagccuuggauuuuaaaccggggaccucaggcucaccaauaguaaacagagaagggaaaauuguaggucuuuauggaaacggagugguuacaacaucugggacauauguaucagcaauugcacaggccaaggcgagccaggaggggccgcuuccggaaaucgaagaugaaguauuuaaaaagcguaaccugacuauaauggacuuacauccagggagugguaaaacaaggcgcuaccuaccagcaauaguucgggaggccauaaaacgaaaacuccguaccuugauacuugcccccacuagaguaguggccagcgagauggcugaggcgcuuaaggggaugcccauucguuaccaaacaacugcaguaaaaucagaacauaccggacgcgaaaucguagaucuaaugugucaugcgaccuuuacaaugcgcuuauuaucgccaguaagggucccuaacuauaacaugauaauaauggacgaggcacacuuuaccgacccugcaucuauagccgcuagaggcuauauaaguacucguguggguaugggcgaggcugcagcuauuuuuaugacggccacaccaccaggaaguguugaggcuuuuccccaaucaaaugcuguaauacaagaugaagaaagagauauuccugaaagaucauggaauaguggcuacgacuggauaacagauuuuccagguaaaacuguaugguucgugcccagcauuaagucgggaaacgauauagcaaauugccugaggaaaaaugguaagagaguaauucaacucucaaggaaaaccuucgauaccgaguaucaaaagacuaaaaauaaugacugggacuacgugguaacuaccgauauaucugaaaugggugccaacuucagagcagacagaguaauugauccaagacgaugccuuaaaccagugauauuaaaggauggccccgaaagaguaaucuuggccggaccaaugccggucaccguugcaucugccgcccagcgucggggcagaauaggaagaaaucaaaauaaagaaggggaucaguacguauauauggggcaaccauuaaacaacgaugaagaucaugcucauuggacagaggcuaaaauguuacuugauaauauaaauacaccggaaggaauaauuccugcauuauucgaaccugaaagagaaaaaucggcugcgaucgauggagaauacagacuacgaggugaagcucgaaaaacauucguggaauuaaugagacgaggagauuuaccgguaugguuaaguuauaaaguggccagugaaggauuucaauacuccgauaggcgauggugcuuugauggggaaaggaacaaucaaguccucgaagagaacauggauguagaaauauggacuaaagaaggggaacgcaagaaacuaagaccuaggugguuggaugccagaacauacuccgauccacuugcacuuagagaguuuaaagaauuugcugcugguagacguaguguuaguggugaucuuauuuuagaaauaggaaagcuaccucaacaccuuacaucaagagcacaaaacgccuuggauaaccuaguuauguuacacaauuccgaacaaggugggaaggcuuaucgccacgcuauggaagaacugccagauacgaucgaaacauugauguuguuagcgcuaaucgccgucuuaaccgggggugucacacucuuuuuccuaucaggcaaaggacuugggaaaacuagcauaggacuccuuuguguuacggcgucuucggcuuuguuauggauggcaagugucgagccccacuggauugcggcaucaauaauauuagaguucuuuuuaaugguccuucuaauaccggaacccgacagacagaggacgccacaggacaaucaacuagcauacguuguuauaggacuacuguuuaugauacucacaguugcagcgaacgagaugggauuacuagaaacuacaaagaaagaccuaggaauaggacacguggcugcggaaaaucaucaacaugcuaccauguuggauguagacuuacggccggcuucagcuuggacgcuguaugcgguagcaacaaccgugauuacaccuaugaugagacauacaauagaaaacaccacagcaaauaucucacuaacugcgauagccaaucaagcagcgauuuuaaugggccuagauaaaggcuggccuauuagcaaaauggauauaggagucccauuacuggcucugggaugcuauucacaaguaaauccucuuacauuaaccgcggcaguauuaaugcuuguagcacauuaugcaauuauugguccgggauuacaggccaaagcaacacgugaggcgcaaaagaggacugccgccggcauaaugaaaaauccaacagucgauggaauaguugcaauagacuuagauccgguagucuacgacgccaaauuugagaaacaacuaggucaaauaauguuauugauuuuauguacaucucaaauucugcuuaugagaacaacaugggcacugugcgaaucaaucacucucgcaacaggaccccuaacaacguuaugggaaggcagccccgggaaguuuuggaauacuacgauagcagucucgauggcgaauauauuccgugguucauaucucgcuggugcaggccuggcuuuuagucuuaugaaauccuuaggaggaggaagaagagguacaggagcucaaggcgaaacguuaggagaaaaauggaagcggcaacugaaucaauugucgaaaucggaauuuaacacuuacaaacggagugggauaauggaggucgaucguucagaagcaaaagaaggauuaaaaaggggagaaacaacaaaacacgcaguuagucguggaacugccaaauugagaugguucguagagagaaaccucgugaaaccagaaggaaagguuaucgaucuaggcugcggcagagggggcuggucauauuacugcgcaggacucaagaaagugacagaagucaaaggguacacaaaaggaggaccaggacacgaggaacccaucccuauggcaacuuauggauggaaccuagccaaauuacauagugguaaagauguauucuucaugccuccggaaaaaugugacacguugcugugcgauauaggagaaaguucuccuaacccaacuauagaagagggaagaacguuaaggguucuaaaaauggucgaaccuugguuacgaggaaaccaauuuugcauuaagaucuuaaacccauacaugcccaguguuguagaaacacuagaacaaaugcaaagaaaacauggagggaugcucguaagaaacccccucucuaggaauaguacgcaugaaauguauuggguuagcugcggaacugguaacauaguuucagcaguaaauaugacaucaagaaugcuuuuaaauagguucacgauggcacauagaaagccuacuuaugagagagauguagaucucggagcagggacacgacauguagcgguugaaccagaagucgcgaacuuagacauaauuggacagcgaauugaaaauauuaaaaacgaacacaaauccaccuggcauuaugaugaagauaauccuuauaagacuugggcuuaucacggaagcuaugaaguaaaaucuucaggauccgcuaguagcauggugaaugggguuguacgauuguugacaaagccuugggacgugauaccaaugguuacacagauugcaaugacugauacaacucccuuuggacaacagcggguauucaaagaaaaagucgauacaagaacaccaagagccaaaagaggaacaacucaaauuauggaaguaaccgcaaaauggcuguggggcuuucuuagcagaaauaagaaaccgcgaauauguacacgggaagaauuuacacgaaaaguaagaucaaacgcugcuaucggagccguuuuuguggaugagaaccaguggaacucugcaaaagaagccguagaagaugaacgauuuugggacuuaguucacagagaaagagagcuucauaagcagggaaaaugcgcaacuugcguuuauaauaugaugggaaaaagagagaagaaacuaggagaguucggaaaggcgaaaggaagccgcgccauaugguauauguggcuuggagccagauuuuuagaguucgaagcauuggguuuuaugaacgaggaucauugguucucaagagaaaacucacuuucaggcguugaaggugaaggacugcauaaauugggguacauuuuaagagauauuucuaaaauccccggaggaaauauguacgcggaugauacagcuggaugggacacuagaaucacugaagaugacuuacagaaugaagccaaaauaacggagaucauggagccagaacaugcccuacuugccacuuccauauuuaaacuaacuuaccaaaacaaggugguuagaguacaacguccugccaaaaauggaacagucauggauguuauaucgcgaagagaucaaagaggaagcggucaagugggaaccuacggacugaauacauuuacgaacauggaaguacaacuaauccgucagauggaaucagaagguauuuucuugcccucugaacuagagacaccaaauuuagcagaacguguacucgauuggcuagaaaagcacggagcugaacgacucaaaagaauggcgauuaguggagaugacuguguuguaaaaccgauugaugauagauuugcgacagcacuaacagcguuaaaugacauggguaaagugcgaaaagacauaccccaaugggagccaucaaaaggguggaacgacuggcaacagguaccauuuugcucacaucauuuucaucaacuaauaaugaaagaugggcgugagaucguugucccuugucguaaucaagacgaacuuguggggagagcaagaguaagucagggagccggauggucucucagagaaacugcgugccuaggaaaaucguacgcacaaauguggcagcuaauguacuuucaucggagggauuuacgacuagcggcaaaugcaauaugcagugcggucccaguagauuggguuccgacgagccguacuacuuggucaauacaugcucaucaucaguggaugacuacggaggauauguuaucaguuuggaacagaguguggauagaagaaaacccuuggauggaagacaagacucaugucucaaguugggaggaagugcccuaccuuggcaaaagagaagaccaguggugcggaucgcuaaucggccugacagcgagagcaacaugggccacaaauauacaagucgcaauuaaucaagugaggcgacuaauugggaacgaaaauuaucuagacuacaugacuucgaugaaacgauuuaaaaaugaaucagaccccgaaggagcacucugguaa

SEQ ID NO: 21267 - RNA, 9879 nt, Artificial Sequence
  derived and/or modified CDS sequence (opt6) from DENV-1__GQ868534__SS-prME
ucuguaacaaugcuccugaugcuacuaccuaccgcccuugcauuucaccugacuacucgggguggagaaccgcauaugauaguaagcaaacaagagcgcggcaaaagucuacuuuuuaaaaccucugcaggaguuaauauguguacgcuaauagccauggauuugggagagcuuugcgaagacacaaugaccuacaaauguccccagaucacggaggcugaaccugaugacguggacugcuggugcaaugcgacagacacauggguaacauauggaacaugcagccaaacuggcgaacauaggcgggacaaacgaaguguagcauuagcaccacauguaggacuuggucuagagaccaggacggaaacuuggaugagcagcgaaggugcuuggaaacaaauacaaagagucgaaaccugggcauuaagacacccagguuuuaccguaaucgcacucuucuuggcacaugcgauuggaaccucaauaacacagaaaggcaucauauuuauauuauuaauguuaguuacaccaagcauggcuaugcgauguguaggaaucgguaacagggacuuugucgaaggacuuaguggcgcgacaugggucgauguaguccuagaacaugguuccuguguuacuacuauggcaaagaauaagccaacgcuugauauugaacuccuaaaaaccgaagugacaaauccagcgauccugcggaaauuaugcauagaagcuaaaauaucgaauaccacaacugacagccgguguccaacacaaggggaggcuacguuaguggaagaacaagacgcaaauuuugucugucguagaacuuucguagaucgaggcuggggaaacgggugcggucuguuugguaaggggucauuacuaacgugcgcuaaauuuaagugugucacuaaacucgaaggaaaaauaguucaauaugaaaaccugaaauacucagugauuguaacagugcacaccggcgaccaacaucaagucggaaaugaaacaaccgaacaugguacgauugcgaccauuacaccacaggcaccuacauccgaaauucaacuaacagacuauggugcuuugacauuagauuguagcccacgcacaggucuagauuuuaacgaaaugguacuuuuaacgaugaaagaaaagagcuggcuugugcacaagcaaugguucuuggaccuuccauugccauggacuucaggagcaaguaccagccaggaaacuuggaaccgacaagauuuacuuguaacauuuaagaccgcacaugcgaagaaacaagaagucguaguguuaggcucgcaagagggugcaaugcauacugcuuuaacaggcgcaacagaaauucaaacaucugggacuacaaccauuuucgcgggacaucuaaaauguagacugaaaauggauaaauugaccuuaaaagguaccucauacguaauguguaccggaaguuuuaaacuagaaaaagagguggcagaaacacagcaugguacuguccuaguccaaguaaaauacgaggggacagaugcuccauguaaaauaccuuucucaacccaagacgaaaaggguguaacucagaauggacgucucauaacagcuaauccaauaguaacagauaaagagaaaccuguaaacauagaaacggagcccccauuuggcgagucauauauugucgugggagccggggaaaaagcccuuaaacuaucaugguuuaaaaaagggaguaguauaggaaagauguuugaagcuacagcuagaggcgcuagaagaauggcuauacuaggcgacacugcaugggacuucggaaguauaggaggagucuucacgucaguaggaaaauugguccaucaaguauuuggaacggcauauggaguccuauuuucaggaguuagcuggaccaugaaaauaggaauaggcauccuauuaacaugguuaggccugaacucuagaucaaccucccuaucuaugacauguauugccgucgguaugguuacacuuuacuuggguguaaugguucaagcagauucugggugcguaauuaacuggaaggggagggaauuaaaaugcggaucagggauauuuguaacaaaugaaguucacacauggaccgaacaauauaaauuccaagccgacagcccaaagcgacuaagcgcugcgaucggcaaagccugggaagagggaguaugcggaauuagaucagcuacaaggcuugaaaacauaauguggaaacaaauaagcaacgaguuaaaccauauauuauuagaaaaugauaugaaauucacugucgugguaggugacgcaaauggaauacuagcacaaggaaaaaaaaugauucgaccucagccaauggagcauaaguauucuuggaagaguugggguaaagcaaagauaauuggagcagauauucagaacacuaccuucauaauugacggaccagauacuccugaaugcccagauaaccaaagggcauggaacauaugggaggucgaagauuauggauucgggauuuucacaacaaauauuugguuaaaacugagagauaguuauacucaaaugugugaccaccgauuaaugucagcugcuaucaaagacucaaaagcgguacaugcagacauggguuauuggauagaaucugaaaagaaugaaacuuggaaauuggcacgugcuucauuuauugaaguaaaaaccugcacguggccgaagagccauacucuauggucgaaugggguucuagagucugaaaugauuauaccaaaaauauaugguggacccauaagucaacacaauuauagaccaggauacuuuacgcaaacugcgggaccauggcaucuaggaaagcuggaacucgauuuugaucuuugcgaaggcacaaccguuguaguugaugaacauugugguaacagagguccgucucuacgaacaacaacaguaacgggaaaaauaauccacgaguggugcuguaggaguugcacauugccgccauuacgauuccguggagaagauggauguugguauggaauggaaauuagacccguuaaagaaaaagaggaaaaucuaguacgaaguaugguauccgcuggcucuggcgaagucgacaguuuuagucuugguauccucugcgucagcauaaugauugaggaaguaaugcgcuccagauggucgaggaaaaugcuaaugaccggcacccuugccguuuuucuauuguuaguaaugggccaacugacauggaacgaucugauucgauuauguauuaugguaggagccaaugcaagcgaccgaaugggaaugggaacaacuuaucuggcuuuaauggcuacuuucaaaaugagaccaauguucgccgucggauuacuguuuagaaggcucacaucacgcgaaguuuuacuauugacaauugggcugucuuuaguagcauccguugaauuaccaaauucacuggaagaauuaggugauggauuggcaaugggcauaaugaugcuaaaauuacuuacagaauuucagccccaucaauuauggaccaccuuauuaagccuuacguucauaaaaacaacauuaagccuugacuaugcuuggaagacuacagcaauggccuuaaguaucguaucgcuauuuccgcucugccuaucaaccacaagccaaaaaacaacauggcucccuguauugcucgggaguuuuggcuguaaaccacuuacaauguuuuuaauaacugaaaauaaaauauggggucguaaauccuggccacucaacgaagguauaauggccaucggaaucguuucaauacuuuuaaguagucuacuuaaaaaugauguuccacuggcagggccuuugaucgcaggcggaaugcuuaucgcaugcuacgugaucucagggucgucugcagaucuaagccuagagaaagcggccgagguaucaugggagcaagaggcagaacauucaggcacgagucacaauauacuaguagaagugcaagacgauggaacaaugaaaauuaaagaugaagaaagagaugauacacucacuauacuacuaaaagccacauuacuagcaguauccggaguuuauccgaugaguauaccggcaacuuuauucgugugguauuuuuggcaaaagaaaaaacaacggucggguguucuaugggacacuccgaguccaccugagguagaacgugcgguacucgacgauggaauauaucgaauacuacaacgagguuuacucggaaggucacagguaggugucggaguuuuucaagauggagucuuccauacgauguggcauguuacuaggggagcaguauugauguaucaagguaaacgauuagaaccuucaugggcaucaguaaaaaaagauuugauuucauacggaggcgguuggagauuucagggcaguuggaacacuggggaagaaguacaaguuauagcuguagaaccugguaaaaauccaaaaaauguucaaacaacuccggguacauuuaaaacgccagagggugaggugggagcaauugcucuugauuuuaaacccgguacaaguggaucccccauugugaaccgagaagggaaaauuguagggcucuaugguaacggcguuguuacgacuuccgggacguauguuucugcuauugcacaggcaaaagcaucccaggaagggccucuaccagaaauagaagacgaaguuuucaagaagagaaauuuaacaaucauggaccuacauccaggcagcggaaagacaaggagguacuugccagccaucgugagagaggcaauaaaacgaaaauuaagaacgcuuauccuagccccuacgagaguagucgcgucugaaauggccgaagcuuuaaagggaaugccuauuagauaccaaacaacugcugucaagagugaacauacaggacgggaaauuguagaucuaaugugccaugcaacauucacaaugcgacuuuuaagccccguacggguaccuaauuacaacaugauuauaauggacgaagcucauuucaccgaccccgcuucaauagcggcuagagguuacauaucuacaagaguggguaugggagaggcagccgcaaucuucaugacugcuacaccgccaggaagcgucgaagccuuuccgcagucaaaugcaguuauucaggaugaagaacgagauauaccagaaagaaguuggaauuccggguaugacuggaucacugauuucccuggaaagacagucugguuuguacccucgauaaaaucaggaaaugauauugccaacugccuacgaaaaaacggaaaacgaguaauucaacuaaguagaaaaacauucgauacagaauaucaaaagacaaagaauaacgauugggauuauguagugacuaccgauauaucggaaaugggugcuaauuucagagcugauaggguuauugacccaaggagaugucucaaacccguaauacucaaagaugguccugagcgugugauacuggcaggacccaugcccguaacagucgcaucugccgcccaacgcagagguagaauagguaggaaccaaaacaaagagggggaccaauaugucuauaugggccaaccacuuaacaaugacgaagaucaugcacacuggaccgaagcaaagaugcuuuuagacaauauuaacaccccugaagggauuauuccugcgcuguucgaacccgagcgggaaaagaaugcugccauagacggagaauauagacuaaggggcgaagcacgaaaaacauucguagagcucaugagacgaggagauuuaccaguguggcugucauauaagguagcuagugaaggauuucaguauuccgacagaagauggugcuuugacggagagcggaauaaucaaguacuggaagaaaauauggacguugaaauauggacaaaagaaggagaacguaaaaaacucagaccucgauggcuggacgccaggacuuauuccgauccucuggcauuacgugaauuuaaagaguuugcagcaggaagaaggucagucucaggggacuuaauauuagaaauaggcaagcugccucagcaucuuacucuaagagcacagaaugcccuugauaaccuagugaugcuacauaacucugaacaaggcgggaaggcauauagacacgcaauggaagaacugccggauacaaucgaaacacuaauguugcuagcauugaucgcaguguuaacgggagguguuacauuauucuuucucucagguaaggggcuaggcaaaaccucaaucggacuauuaugugugacugcaucaagugcccuccuauggauggcgucgguugagccacacuggauagcagcgucaauuauacuagaauuuuuucuaaugguacugcugauuccggaaccggaccgacaacggacaccucaggacaaccagcuagccuauguggugauaggccuacuauucaugauccuuacaguagcagcaaaugaaaugggauugcuugaaacaacaaaaaaggaccuaggcauuggacauguagcggcagagaaucaucagcacgcaacaaugcuagauguugauuugaggccggcuagugccuggacacuauaugcaguagcgacuaccguaauaaccccaaugaugagacauacgauagaaaauacgacggcuaacauuagccuuacugcaaucgccaaucaagcugcaauacuaauggguuuagauaaagguuggcccaucagcaaaauggauaucgggguuccauugcuagcauugggcuguuauucccagguuaacccuuugacccuaaccgcggcagucuuaaugcuaguggcucauuaugcaauuauaggaccagguuuacaggcuaaagcuacgcgcgaagcucaaaaacguacagcagcagguauuaugaagaauccaacuguagaugguauagucgccaucgacuuggacccaguugucuacgaugcaaaauuugaaaaacaacuuggacagauaauguugcuaauacugugcaccagucaaauauuacuuaugaggaccacuugggcguuaugugaaagcauuacccuugccacaggaccacuaacaacauuaugggaaggaagcccuggaaaauucuggaauaccacaauagccgucucgauggcgaauauuuuuagaggaagcuacuuagcgggggcaggcuuagcauucagcuuaaugaaaucacuaggggguggacgaagggguacaggagcccaaggugaaacccuaggggagaaauggaagaggcaguugaaucaguuaucgaagucugaauucaauacauauaagagguccggcaucauggaagucgacaggucugaagccaaagaaggucuaaaaaggggagaaacgacgaaacaugccguaagucgagguacugcaaaacucagaugguuugucgaacguaacuugguuaaaccggaagguaaggucauagacuugggcuguggucgaggagguugguccuacuauugcgcaggacuuaagaaaguaacagagguaaaaggguacacgaaaggaggaccagggcacgaagaaccaauaccuauggcaacauauggguggaauuuaguuaaacuccauaguggcaaggauguuuucuucauucccccggaaaagugugauacacugcuaugugacauaggugagucaaguccaaacccaacuaucgaagaggggaggacucucagaguuuugaaaaugguagaaccuugguuacggggaaaccaguucugcauaaaaauacuaaaucccuauaugcccaguguugucgaggcauuagaacaaaugcaaagaaagcacggcggcaugcucguacgaaauccauuaagccggaauaguacgcaugagauguacuggguaaguugcgguacaggaaauauuguuucagcgguaaacaugacuucccggaugcuccugaauagguucacgauggcucaccguaagccaacauacgaacgcgacguugaucuaggugcgggaacacggcacguagcugucgagccggaaguagcuaaccucgacauaauaggacaacgcauugagaauauaaaaaaugaacauaagaguacuuggcacuacgacgaagacaacccuuauaagacuugggccuaccauggcuccuaugagguaaaaccuagcggaucagcauccucaaugguuaaugggguaguaagacuucuaaccaaaccaugggacguaaucccaaugguaacccaaauagcuaugacggacacaacuccuuucggccaacaaagaguauuuaaggagaaaguagauacccguaccccucgcgcaaagcgcgguacgacucaaauaauggaaguaacagcaaaguggcuuuggggauuccucucuagaaauaaaaagccccggauauguacgcgcgaagaauuuacccgcaaaguuaggaguaacgcagcaauaggagcagucuucgucgaugagaaucaauggaacucagcuaaggaagcaguugaagacgaacgcuuuugggaucuaguccacagggaacgggaauuacauaaacaagguaaaugcgcaacauguguauacaacaugaugggaaaacgugaaaaaaaacugggugaauuugguaaagcaaaggguucaagagcgauuugguacaugugguuaggugccagguuucuagaauuugaagcacugggguucaugaaugaggaucauugguuuucucgcgaaaacagccuaucuggcguggagggugaaggcuuacacaaacugggauauauauuaagagauauaaguaaaaucccuggcgggaauauguaugcagaugacaccgcagggugggacacgcgaaucacggaggaugauuugcaaaacgaagccaaaauaacugagaucauggagccugaacaugccuugcuagcuacuaguauauuuaaacuuaccuaucaaaacaaaguagugagaguccaaagaccggcuaaaaacggaacugucauggaugucauaucuagacgagaucaacgagguucaggacaaguaggaacauacggguuaaauacauuuacaaacauggaagugcagcuaauucggcaaauggagagugaagggaucuuuuugcccuccgaauuggaaaccccaaaccuggccgaaagggcacuagacugguuagagaaacacggggccgaacgccuuaaaagaauggcgaucucgggugaugauuguguuguaaaaccuauagaugaccgcuuugcuacagcucuaacagcauugaaugauaugggaaaaguaaggaaagauauaccgcaaugggaaccuuccaaagguuggaacgauuggcaacagguccccuuuugcagccaccauuuucaucagcuaauaaugaaagaugggagagaaauaguuguuccaugucgaaaccaagacgaauuagugggucgggcaagaguaagucaaggcgccgguuggucacuacgagagaccgcaugccuuggcaaaaguuaugcacagauguggcaacuuauguauuuucauagaagagauuugagauuagcagcaaacgcgauaugcagcgcaguaccuguagacugggugccaacgucacguacaacauggaguauacacgcucaccaccaauggaugacuacugaggauauguugaguguuuggaauagagucuggaucgaagaaaauccauggauggaagauaaaacucacgucagcagcugggaagagguuccauaccuaggaaaaagggaagaccaauggugcggcagccuaauaggucuaacggcacgugcuacuugggcuacaaauauacaaguagcgauaaaucaggugcgcaggcuuauagggaaugaaaacuaccuagauuacaugacaucaaugaaacgcuuuaagaaugaaucagauccagaaggcgcguuaugguga

SEQ ID NO: 21268 - RNA, 9879 nt, Artificial Sequence
  derived and/or modified CDS sequence (opt6) from DENV-1__GQ868535__SS-prME
ucaguaacuauguuacugaugcuacuaccuacugcguuagcuuuucaucucacaacgcgaggaggagagccacauaugauuguuagcaaacaagaacgcggaaaaagucuccucuucaaaacaagugcagggguaaauauguguacauuaauagcaauggacuugggcgaauugugugaagacacaaugacguacaaauguccucaaauuacagaagccgaaccugaugauguagacugcugguguaacgcaacagacacauggguaacguacgggacauguagucaaacgggagagcaucgucgcgauaaacggagcguagcacucgcuccacacguagggcuuggguuggaaacccguacugagacauggauguccucagaaggagcauggaaacaaauacaacgagucgagaccugggcacuucgacacccugguuuuacaguaauagcccucuuuuuggcacaugcgauagguacaucaauaacccaaaaagguauaauuuuuauacuuuuaauguuaguuacuccuagcauggcaaugagaugcgugggcauagggaauagagacuucguugagggcuugaguggagccacauggguagauguaguucuagagcacgggucuuguguaacaaccauggccaaaaacaaacccacucucgacauagaauuacuaaaaacagaaguagcaaacccagcaauauuacggaaauuauguauugaagcaaaaauaucaaauacaacuaccgauucacguugcccaacccaaggcgaggccacauuaguugaagaacaagaugcaaacuuuguuugccgccgaacauucguggacagagggugggguaauggaugcggcuuguucggcaagggcagcuuacuaacaugugcaaaguuuaaaugcguaacaaaacucgaaggcaaaauaguucaguaugaaaacuugaaauauucggugauuguaaccguccauacaggagaucaacaccaagucggaaacgaaacaacugaacauggaacaauagcaacaaucacuccacaagcucccacaagcgaaauacaguuaacugauuauggagcacuaacccucgacuguucgccucgaacuggucuugauuucaaugaaaugguccuucuaacaaugaaagaaaaauccuggcugguucacaaacaaugguuucucgaucuuccucuaccguggacaaguggagcaucuacaucacaggaaacuuggaaucgacaagauuugcucguaacauuuaagacagcccacgcuaagaaacaagaaguaguuguccuuggaagucaggaaggugcaaugcauaccgcguugacuggugcaacagaaauucagacaaguggcacaacgacuauauucgcagggcaucuuaaaugcagguuaaagauggacaagcuaacguuaaaaggaacaucguauguuaugugcacagggaguuuuaagcucgaaaaagaaguugcugaaacacaacacggaacgguauugguacaggugaaauacgaaggcacggacgcgccauguaaaauccccuucucaacucaagacgagaagggugugacucaaaauggccgauuaauuacagcaaauccaaucguaacagacaaggaaaaaccuguaaauauagagacggaaccgccuuuuggugagucguacauagucgucggggcaggggaaaaagcgcuaaaacucucuugguuuaaaaagggcagcucaauaggaaagauguuugaagccacagcucgaggcgcuaggaggauggcgauuuugggggauacagcgugggacuuuggaagcauaggugguguauuuacaaguguugguaaguugguccaucagguuuuuggaaccgcauauggcgucuuguucuccggagucagcuggacuaugaagauaggaauugggauacugcucacauggcucggacuaaacaguagaucaacgucacuaucuaugacaugcaucgcaguaggaaugguaacguuguauuuaggcguaaugguacaggcugauaguggaugcguaauuaauuggaaaggaagagaacucaaauguggaucggggauauucguaacaaaugaaguucacacauggacagagcaauacaaauuucaggccgacucgccaaaacgauuaucagcagcuauaggaaaggcaugggaggaggggguuugcgguauuagaagcgcaacaagacuagaaaacauuauguggaaacaaauauccaaugaacuaaaccauauccuguuagagaacgauaugaaauuuacaguuguuguaggagaugcaaauggaauacuugcucaagguaaaaagaugauacgcccucaaccuauggaacauaaauacagcuggaaguccugggggaaagccaagaucauaggagcagauauccaaaauacuacuuuuaucauugaugggccugauacaccggaauguccagacaaccaacgagcauggaacauuugggagguugaggauuaugguuuuggaauauucacaacaaauauauggcuaaaacuuagagauucauacacucagaugugugaucauagguuaaugucggcagccauaaaagacucaaaagcgguucaugcugacaugggauauuggauugaaucugagaagaaugagacauggaaauuagcgagagccagcuuuauugaaguaaaaaccugcaccuggcccaaaucacauacauuguggagcaauggaguauuagaaagcgaaaugauuauucccaaaauuuacggaggaccaauaucucaacauaauuacagaccaggauauuuuacucaaacagcuggaccauggcauuuaggaaaauuagaauuggauuuugaccugugugaagguacaacaguagucguugacgaacauuguggaaaccgagggccgagcuugcgcacaacuacugucacggguaagauaauucacgaaugguguuguagaaguugcacucuaccuccacuucgguucagaggugaagacggaugcugguaugggauggagauacgaccggugaaagaaaaagaagaaaaucugguucgaucaauggugucugcuggaaguggcgaaguugauagcuucucgcuuggcauuuugugugcaucuauaaugaucgaagaaguaaugcguagucgcuggaguagaaaaaugcugaugacgggaacauuagcuguauucuuacuauuaauaaugggccaauugacguggaaugacuuaauucgccuguguaucauggucggggcaaacgccagcgauagaaugggcauggguaccacauaccuggcacuuauggcaaccuuuaagaugaggccuauguucgcgguaggacuacuauucagacgccuuaccagcagagaaguuuuacuacuaacaauuggauugucauuaguagccucugucgaacugccaaacucgcucgaagaguugggagauggcuuagcuauggguauaaugaugcucaaauuacuaacugaauuucagccccaucagcuuuggaccacgcuacuaucauugacauucauaaaaacaacauuaucucuugauuaugcauggaaaacgaccgcgauggcacucaguauagugucacuauuucccuugugucuauccacaacaucccaaaagaccacuugguuaccaguauuacuaggaucauuuggcuguaagccauuaacuauguuuuugauuacagaaaacaaaauuuggggaaggaaaucguggccccuaaaugaagguauuauggcaauaggcauagugagcauuuuacuaucuucacuccugaaaaacgauguaccccuagcaggaccauugauugcuggaggcaugcuaauugccuguuacgugaucucaggaucaucagcagauuuaagccucgaaaaagcugcugaaguaaguugggaacaagaagcagaacauucggggacaagccauaauauccuagucgaaguacaagaugauggaacuaugaaaaucaaggacgaagagagagaugauacacucacaauauuauuaaaggcaacacugcuagcgguauccggaguguauccaaugucaauaccggcgacacucuuuguaugguauuuuuggcagaagaagaaacaacgaucgggaguuuuaugggauacaccaagucccccugagguugaaagggcaguuuuggaugaugguauuuacagaauacuucaaagaggacugcuaggacgcucgcagguagggguaggaguguuccaggauggcguauuucauacgauguggcacguuacaagaggggccguuuuaauguaucagggaaaaagacuagaaccgaguugggcaagcgugaaaaaggaucuaauuaguuauggagggggauggagguuccaagguucguggaauaugggagaggaagugcaaguuauugcgguagaacccgggaaaaauccaaagaauguccagacuaccccggggacuuuuaagaccccggaaggggaaguuggggccauagcguuggacuucaagccaggaacaaguggaucuccaaucgugaauagagaaggaaaaaucguuggacuuuauggaaauggagugguaacuacaucugguacuuauguuucugcuauagcacaagcaaaggcgucacaagagggaccacuuccugaaauugaagacgaggucuuuaagaaaagaaacuuaaccaucauggaccuacauccgggaagugggaaaacucgacguuaccuuccugcgauaguaagagaagcaaucaaacgaaaauuacgaacgcuaauccuagcgccaacuaggguuguagccuccgaaauggcagaagccuugaaagggaugccaauacgauaccaaacaacagcaguaaaaagugaacauacagggagagagauaguagaccuaaugugucaugcaacguuuaccaugagauuacuaucuccuguaagagucccuaacuauaauaugauaauaauggaugaagcgcacuucacugacccggcauccauugccgcacgaggauauauuagcacuaggguaggaaugggugaagcugcugcgauuuuuaugacugcaaccccuccuggcuccguggaggcauuuccacaaaguaaugcaguuauacaagacgaggaacgagacauuccugagagaucuuggaacucaggguaugauuggauaacugacuuccccggaaagaccguaugguucguaccaucuauaaaaucuggaaaugacaucgcaaauugucuccggaaaaauggaaaacgaguaauucaacucuccagaaaaacuuuugacacagaguaucaaaagacuaaaaauaaugauugggauuauguugugaccacagacaucagugaaaugggcgcuaacuucagagcugauagaguuauugaucccaggaggugccuuaaaccaguaauucuaaaagacggaccugaacgaguuauauuagcggggccaaugccggugacagucgcaucugccgcccaacgacguggaagaaucggucggaaucaaaacaaagaaggugaucaguacguguacaugggccagccgcuaaauaacgaugaagaucaugcacauuggacagaagcuaaaaugcuguuggauaauauaaauacuccggaagggauuaucccagccuuauucgaaccagaacgugaaaaaucugcugcaauagauggugaguaucgccuaagaggagaggcgcguaaaacauuuguggaguuaaugagacgcggcgauuugccagucuggcuaagcuauaaaguagcaagugaaggguuucaauacagcgaccggcggugguguuuugacggugaacgaaacaaucaaguuuuggaagaaaacauggauguagagaucuggacaaaggagggugagagaaagaaauugaggccccgguggcucgacgcaagaacuuacucugauccguuagcauuaagggaauuuaaagaauuugcugcaggacgacguucuguaaguggcgaucugauacuagaaaucggcaaauuaccucaacauuuaacccuccgagcacaaaaugcacuagauaaccugguuauguuacauaacagcgagcaagguggaaaggcuuaccgucaugcuauggaagaacucccggauacaauagaaacccucaugcuacuagccuuaauagcaguauuaaccgguggaguaacuuuauucuuucuaucaggaaagggccuagggaaaacaucaauuggauuacuauguguuacugcgucuagugcucuauuguggauggcuucagucgaaccacacuggauagcagccaguauuauccucgaguucuuuuuaaugguucuuuugaucccugaaccggauagacagcguacgccccaagauaaccagcuugcuuauguggugauaggcuuacuuuucaugauacucaccguugcagcuaaugaaaugggucuacuagaaacaacuaagaaagauuuagguauaggccaugucgcugcugaaaaccaucaacaugcgacgaugcucgacguggaucucagaccagcuagcgcauggacucuguacgcgguugccacuacuguaauaacuccgaugaugcgacacacuauagaaaacacaacagccaauaucagcuuaacugcaauagcaaaucaagcugcuauuuuaaugggacucgauaaaggcuggccaauuucaaaaauggauauaggaguacccuuacuagcccuuggaugcuacucucaaguaaaucccuugacacuuacggcagccguuuuaaugcuaguugcucacuacgcaauaauaggaccuggucuccaggccaaagcuacccgagaagcacaaaagcguacagcggcugguauuaugaaaaacccaacuguugaugguaucguugccauugauuuggacccgguuguauaugacgcaaaauuugagaaacaacuagggcagauuauguuacuaauacuauguaccucccaaauauuguuaaugcgaaccacaugggcucuaugugaaucaaucacuuuagccaccgguccacuuacaacucuuugggaaggaaguccgggaaaauuuuggaacacgacaauugcaguuucgauggcgaauauuuuucgaggaaguuaucuagcuggagcagguuuagcguuuucacuaaugaaaucgcuaggugguggucggagaggaacaggggcacaaggugagacauuaggcgaaaaauggaagcggcaacuuaaccaauuaucaaagagcgaguuuaauacuuauaaacggucagguauaauggagguugaucgcagugaggcaaaggaaggccuaaagagaggagagacgacaaagcacgccguaaguagaggcaccgcaaaacuccgaugguucguagaacguaauuuagucaagccugaaggaaaaguuauugaucucgguugcggacgaggcgguuggucuuacuauugcgcaggcuuaaagaaagucacugagguaaaaggguacaccaagggcggaccaggccacgaagaaccaauaccaauggcuacauauggauggaaucuagugaagcuccauaguggaaaggacguauucuuuaugccuccugaaaagugugacacacuucuaugcgauauaggcgaaagcaguccaaauccaacaaucgaagaaggcaggacgcugcggguacuuaaaaugguagagccuuggcugagggguaaccaauuuuguauaaagauacuaaacccauauaugccaagugugguagaaacauuagaacaaaugcaaagaaaacacggaggaauguuaguuagaaauccacucucgagaaauucgacacaugaaauguacuggguaucuugcggaacugggaauauaguuuccgcaguaaacaugacaucaagaauguuacucaauagauuuacgauggcacaucggaaaccuacauuugagagagauguggacuuaggggcggguacgcgacauguagcgguggaaccagaagucgccaauuuggauaucauaggacaacguauagaaaacauuaagaaugaacauaaauccacauggcacuaugaugaagauaauccauacaagacuugggcauaucaugguuccuaugaggugaaaccaaguggaucagccucuucgaugguaaacgggguuguacgacuguugacuaaaccaugggaugucauaccaaugguaacgcagaucgccaugacagacacaacuccauuuggacaacagcgaguauuuaaagaaaaaguugauacacgaacuccuagagcaaaacgaggaacgacacagauaauggaagucacugcuaaaugguuaugggguuuccucaguaggaauaagaaaccaaggauauguacacgugaagaauuuacuagaaaaguacgaaguaacgcugcaauuggcgcaguuuuuguugacgaaaaccaauggaacucagccaaagaagcgguagaagaugaaagauuuugggaccuuguccaccgugaaagagaacugcacaaacaagguaagugugccacauguguauauaacaugaugggcaaaagagaaaagaaacuuggagaauuugggaaggccaaaggaucucgggcgauaugguauaugugguuaggcgcgcgauuccuagaguuugaagcauuaggauucaugaacgaagaucauugguucaguagggaaaauagucuaaguggaguagaaggggaaggacuacauaaacucggauauauacucagagauauuagcaaaauaccagggggaaacauguaugcagacgauacagcaggaugggauacccgaauaacugaggacgauuuacaaaacgaagccaaaauuaccgauauaauggagcccgagcaugcccuauuggcgacaucuauauuuaaacugacuuaucaaaacaaaguagucagaguacagaggccugcuaagaaugggacggugauggauguaaucuccagaagagaucaaagagguagugggcagguagggacauacggauuaaauacauuuaccaacauggaaguacaauugauuagacaaauggagagugaagguauauuucugccaagugaacuugaaacuccaaauuuggcugaaaggguacucgauugguuagaaaagcauggugcagaaagauugaaaaggauggccauuagcggagacgauugugucguaaaaccaauagaugaucgauuugcaaccgcuuuaaccgcuuuaaaugacauggguaaaguucguaaagauaucccccagugggaaccgucuaaaggcuggaaugauuggcagcaagucccauuuugcagucaucauuuccaucaacucauuaugaaggacggacgcgagauaguagucccgugcagaaaucaagacgaacuugucggcagagcacgaguuagucagggggcaggguggagccucagagagaccgcgugucuuggaaaaaguuacgcucaaauguggcaguuaauguauuuucaccgaagagaucuaagguuagcugccaaugccaucuguagugccgugcccguagacuggguuccaacgucucgcacuacuuggucaauccacgcccaucaucaauggaugacaacagaagacaugcuaaguguuuggaacagaguauggauagaagaaaaucccuggauggaagauaagacacacguaucaucaugggaggaagugccauaccugggaaagagagaagaucaauggugugguucucugauugguuuaacugcucgagccacaugggcaacuaacauucaaguugcgauaaaucaagugcgucggcuaaucgggaaugaaaacuaucuagauuauaugacaucgaugaaacgauucaagaacgaaucagauccggaaggagcccuaugguag

SEQ ID NO: 21269 - RNA, 9879 nt, Artificial Sequence
  derived and/or modified CDS sequence (opt6) from DENV-1__KJ189306__SS-prME
uccgucacuauguuguuaauguuacuacccaccgcgcucgccuuucauuuaacuacucguggaggagaaccacauaugauaguuuccaaacaagaacgaggcaaaucauuauuguucaaaaccucugcgggugugaacauguguacacucaucgcaauggaccucggcgaauuaugcgaagauaccaugacuuacaaaugcccacaaauaacagaggcagagccugaugacgucgauugcuggugcaacgcgacggauacaugggugacuuacggcacuuguagccaaacgggugaacauagaagagacaaaagaucaguagcguuagcuccacaugugggacucggacuagaaacccguacugaaacauggaugaguucugaaggugcauggaaacaaauucaacguguagaaaccugggcguuacgucacccuggauucacugugaucgcccucuuucuugcgcacgcaauuggaacgucuauuacucaaaaagggauaauauuuauauuguuaaugcuugucaccccaucaauggcaaugagaugcgucgggauaggaaaucgggacuuuguugagggucuauccggagcaacguggguagauguugucuuggaacauggaaguuguguaacgacgauggccaaaaacaaaccuacucuggauaucgaacuucuuaaaaccgaaguaacaaacccggcuauucuacgaaaauuauguauagaagcuaaaauuucuaacacgacaacagauuccagguguccaacgcaaggagaagccacauuaguugaggaacaagacgcaaauuucguguguagacgaaccuuuguggaccgugguuggggcaauggcuguggauuauuugguaaggguagucuauugacaugugcuaaauucaaguguguuaccaaacucgaaggaaagaucgugcaauaugagaauuugaaauauucaguaauuguaaccguacacacuggugaucaacaccaagugggaaacgaaacuacggagcacgguacuauagcaacuaucacaccccaagccccaacgagugaaauacagcugaccgauuacggggcauugacacuggacuguaguccaagaacaggauuagacuuuaaugaaaugguauuauuaacaaugaaagaaaagaguuggcugguacauaaacagugguuccuggaucuuccacuucccuggacgaguggugccucaaccagccaggaaacauggaacaggcaagauuugcuagucacauuuaaaacagcacaugcaaagaaacaagaaguaguaguuuuggggucacaggaaggagccaugcacacggcguugaccggagcaacagaaauucaaacuagcggaacuaccacuauuuuugcgggucauuuaaagugucgacuuaaaauggauaagcuaacucugaaaggaacuucauaugugaugugcaccggaccauuuaaacuagaaaaggaaguugccgaaacccaacacgguacagugcuaguucaagugaaauacgaggguacugaugccccgugcaaaauacccuuuuuaacucaggacgaaaaaggagucacgcaaaacggacgacuuauuacugcaaacccuaucguuacggauaaagagaaaccagugaacauagaaacggaaccuccauuuggcgaaaguuacaucguugucggagcuggugaaaaagcucuaaagcuaucaugguuuaagaaagguaguaguauagguaagauguucgaagccacagccagaggugcccguaggauggcuauacuuggagacacagcaugggauuuuggcucuauagggggcguauucacgagcgugggaaaacuugugcaccaaguguuugggacugccuauggcguucuauuuagcgguguaucguggacuaugaaaauagguauagguauauuacuaacuuggcuaggucugaauagcagaucaacuucucuuagcaugacgugcauagcugugggaauggugacauuauaucuagguguaaugguacaggcugauucagguugcgucauuaauuggaaaggucgugaacuaaaaugugggucaggcauauuuguaacuaacgaaguucacacuuggacugaacaguacaaauuucaagccgauaguccaaaaagauugucagccgcuauaggcaaggcuugggaagaagguguuugcggcauucgcucugccacuagacuagagaauauaauguggaaacagauuaguaacgaacugaaccauauauuacucgagaacgauaugaaauucacagugguaguaggugacgcuaaugguaucuuagcacaagguaagaaaaugauacgaccacaaccuauggaacauaaguacucuuggaaaaguuggggcaaagcaaaaauaaucggagcggacauccaaaacacuaccuuuauaauagacgguccugauacacccgaguguccugacaaccaacgcgcuuggaauaucugggagguugaggauuacggauuuggcauuuuuacaacaaacauuugguuaaaacuaagggacucguauacucaaaugugugaucaccgauuaaugucggcagcuauaaaggauucaaaagcuguucacgcugauaugggauacuggauugagagugagaaaaaugaaacuuggaaacuggcgagggcaucauucauagaaguuaaaacauguacauggccaaaaagucacacacuauggucuaauggaguccuugaaagcgaaaugauaaucccuaaaaucuauggggguccaauuucucaacacaacuaucgaccaggguauuuuacgcaaaccgcaggaccuuggcacuuggguaaauuagaacuggacuuugaucuaugugaagggacuaccguugucguagaugaacauugcggaaauagaggacccagucuuagaacaacaacuguuacugggaaaauaauacaugaguggugcugcagauccuguacucugccaccauuaagauuucguggugaagacggcuguugguacgggauggaaauaaggccaguaaaggaaaaagaagaaaacuuaguacggucaaugguaagcgcgggaagcggagagguagauucguuuucacugggaaucuuguguguauccauaaugaucgaagaaguaaugcguucgcgcuggucgcgcaagauguuaaugacagguacauuggcaguauucuuauuacuugucaugggccaacuuacuuggaaugaucuuauacguuuauguauaaugguuggcgccaaugcaucagaucguaugggcaugggaacaacguaucuagcacuaauggcaacauucaaaaugagaccgauguucgcgguuggucuuuuauuccgucguuuaacuuccagagaaguacuauugcuuacaauaggucuuucgcucguagccucuguggaacucccaaauucccuugaagaauugggugauggauuagcgaugggaauaaugauguugaaauuacugacugaauuucagccucaucaacuauggacuacauuacuaaguuuaacauuuauuaaaacgaccuuaucccuagauuaugcuuggaaaaccaccgcgauggcauuaucuauuguuuccuuauucccucucugccuuagcaccaccucgcagaaaaccacauggcuaccaguucuauuagguaguuucgguugcaaaccauuaacaauguuccugauaacugaaaacaagaucuggggaagaaaaaguuggcccuugaaugaagguauaauggcaaucggaauuguaaguauacuuuugucuucguuacuuaagaacgacguaccacuagcuggaccacucauugcgggaggcauguugaucgcuuguuacguaauuagcgguucaagugcagauuuaucacuugaaagagcagccgaaguuagcugggaacaagaagcagaacauagcgguacaagccauaacauacuuguagagguacaggacgacggcacgaugaaaauuaaggaugaagaacgagaugacacacucaccauucuuuugaaagcuacguuacuagcugucuccgggguauacccaaugaguauucccgcuacacuuuuugugugguacuuuuggcaaaagaagaaacaacgaucuggaguccuaugggauacuccuaguccgccagaaguagaaagagcaguuuuggaugauggaaucuauaggauucugcagagaggcuuacuuggcagaagucaaguaggaguaggaguuuuccaagauggaguuuuucauaccauguggcacguaacaagaggagcuguacuaauguaccaaggcaaacgcuuggaaccauccugggcaagcguaaagaaagauuugauuucauaugggggagguuggcgguuccagggcucguggaauacaggcgaagagguacaagugaucgcuguugaaccugggaaaaauccuaaaaauguacaaacaaccccaggcacuuucaagacaccagaaggagaaguaggcgcuaucgcauuggacuuuaaaccagguacuagcggaaguccaauuguuaacagggaggguaaaauuguagggcuauacgggaauggagugguuacgacaucuggaaccuaugugucugcgauagcccaagccaaagcuagccaagaaggaccuuugccggaaauagaggacgaaguuuucaagaagagaaaccuaacuauuauggacuuacacccaggaucuggaaaaacaaggcgcuauuuaccugcuauagugcgggaagcuauuaaaagaaaacuuagaacauuaauauuagccccuacaagggucguggcaagcgaaauggcugaagcacuaaaagguaugcccauacgauaucaaaccacagccgucaaaagcgagcauacuggacgagaaauaguagaucucaugugucaugcuacauuuaccaugcgccugcugagcccagugcgagugccgaacuauaacaugauaauaauggaugaagcucacuucacugaucccgcuuccauagccgcucgcggauauauaagcacaagaguuggcaugggagaggcggcugcgauauuuaugaccgcaacgccuccuggaagcguagaggcuuuuccucaaagcaacgcaguuauccaagaugaagaacgggauauuccagagagaaguuggaacaguggcuacgauuggauaacagacuuccccgguaaaacuguuugguucguaccgucgaucaaaucaggaaaugauauugcgaauuguuuacggaaaaacgguaagcgaguuauucagcucucacggaaaacauuugauacagaauaccagaaaacuaagaauaacgauugggacuacguugucacuacugacauaucagaaaugggagccaauuuuagggcugauagggugauagacccgcgacgcugucuuaagccaguaauccucaaagauggccccgagagaguaauuuuagcgggcccgaugccagucaccguugcuucugcagcacaacgacgaggacgaauuggacguaaucaaaauaaagaaggugaucaauacgucuacaugggacaaccccuaaacaacgacgaggaucaugcgcauuggacagaagcgaaaaugcuucuagacaacauaaacacaccugaaggaauaaucccugcucuauucgaaccagaaagggagaaauccgccgcaaucgacggagaauauagauuaagaggagaagcuaggaagacguucguugaguugaugaggaggggagacuuaccaguguggcuuucauauaaaguggcaucggaaggauuccaauacucugauagaagguggugcuucgacggggagcggaacaaucaaguuuuagaagagaauauggacguagagauuuggacuaaagaaggcgaaaggaagaaacuuagaccacgcuggcuggacgcgagaacauacucagauccacuagcguuaagggaauuuaaagaguucgcagcggggcgacgaagcgucucuggcgaucucauccucgagaucggcaaauuaccacagcauuugacacuuagagcacaaaaugcacuagacaaucugguuauguugcacaauucagaacaaggagggaaggccuaccgucaugcgauggaagaauuaccggauacaaucgaaacgcuuaugcuauuagcuuuaauagccguuuugacagguggagucacucuauucuuucuuuccgggaaagguuuaggcaaaacaucaaucggcuuacuauguguaacugcuucaucugcgcuacuuuggauggcuucagucgaaccacauuggauugcugcuaguaucauacuugaguucuuuuuaauggugcuucuaaucccggaaccugauagacaacguacaccccaagacaaccaacuugccuacguuguuauaggauuauuauucaugauacucaccguggcagcaaaugaaaugggcuugcucgaaacgaccaagaaagaccuggguauaggucacguggccgcagaaaaucaucaacaugcaacaaugcuagacgucgacuuacgaccagccagcgcuuggacuuuguaugcagucgcaacuacagucauaacaccgaugaugcgacauacuauagagaauacuaccgcgaauauaagucugaccgcaauagcgaaucaagcggcaauuuuaaugggucuagacaaaggauggccgauaaguaaaauggauauuggcguaccgcucuuggcgcuugguuguuacucacagguaaauccuuuaacacuaacggcagcuguauuaauguuaguggcgcacuaugccaucauaggaccuggucuucaagcaaaagccaccagagaagcucagaaaagaacagcugcaggaauaaugaaaaaucccacuguagaugguauuguggcaauagaucuagaucccgugguguaugaugcaaaauucgaaaaacaacuaggacagauaauguuguuaauccuuugcacuucccaaauauuacugaugcgaaccaccugggcucuaugugaaucuaucacccuagcuacuggcccguuaacaacacuaugggagggcucuccaggaaaauucuggaacacuacaauugcagugucaauggcuaauauauucagaggaucauaucuagccggugcagggcuagccuuuagcuuaaugaaaucgcugggcgggggaagaaggggcacgggagcucaaggagaaacauuaggagaaaaauggaaaaggcaacuaaaucaacuuaguaaaucugaauuucauauauacaaaagaaguggaauuauggagguagaucggagcgaagcaaaagaaggauuaaagcgaggagaaacaacaaaacacgcgguaucucgcggcaccgccaaacuucguugguucguugaaaggaacuuggugaaaccggaaggaaaaguaauagauuuaggauguggaaggggaggauggucguacuacugugcagggcugaagaaaguaaccgagguaaaaggcuacacaaaaggugggccuggacacgaagaacccauaccuauggccacauacgguuggaaucuaguaaaacugcauagugguaaggacguauucuuuaugccacccgaaaaaugcgacacgcuacugugcgauauaggagaaucuaguccuaacccaacaaucgaggagggacguacacuucggguacucaagauggucgaaccauggcuacgaggcaaccaauuuuguauaaagauauuaaauccauauaugccuucaguggucgaaacgcuagagcaaaugcaaaggaagcacggagguaugcuugugcgaaauccacugucacgaaacucaacgcaugaaauguauuggguaucaugcggaacugguaauauaguuucggcuguaaauaugacgucccgaaugcuacuaaauagguuuacaauggcccaucgcaaaccaacauaugagagagauguagaccuaggagcagguacucggcauguggcuguugaaccagaggucgcgaaucuagauauaaucggccagagaauagaaaacauuaaaaaugaacauaagagcacuuggcacuaugacgaggauaauccauauaaaacaugggcauaccacggguccuacgaggucaagccaucaggaucagcaucuucgaugguaaauggagucguccgauuauugacaaaaccaugggauguaauaccgauggugacacaaauagcuaugacugacaccacaccuuuuggacagcagagaguauuuaaggaaaagguggauacaagaacuccaagagccaaaagagguacuacucagauaauggaaguuacugcgaaauggcucuggggguuccuuucaagaaauaagaaaccuagaauauguacaagagaggaauuuauaagaaagguccguuccaacgcagccauaggggcgguauuuguggaugaaaaccaauggaacucagcaaaagaagcaguagaagaugaacgauuuugggacuuaguucauagagaaagagaacuacauaaacaaggaaaaugcgcgaccugcguauacaauaugauggguaaacgagaaaagaaacugggagaauuugguaaagccaaagggucacgagcaaucugguauauguggcuaggagcacgauucuuagaauuugaagcguuagguuuuaugaaugaagaucauugguuuucaagagagaacucacuaagcgguguggagggagaaggucuucacaaacuagguuacauauuacgugauauaucgaaaauuccggguggcaauauguacgcagaugacacagcaggcugggauacuagaauaaccgaagaugauuuacaaaaugaggccaaaauaacugaaauaauggaaccugagcacgcauuauuagcuacuucaaucuuuaaacuaacuuaucagaacaaagugguaagagugcaaagaccggcaaagaacgguacuguuauggacguaauaucgcgacgugaucagcgugguagugggcaaguugggacauauggucugaauacauuuacgaauauggaaguacagcucauucgucaaauggaaucggaaggaaucuuucugccuagugaguuagaaaccccuaaccucgcggaaaggguacuagacuggcuggagaaacauggagcagagcgacuaaaaagaauggcaauauccggagacgauugcgucguuaagccuauagaugacagauuugccaccgcuuuaacagccuuaaacgauaugggcaaaguaagaaaagauauaccacagugggaaccauccaagggauggaaugacuggcagcaaguaccuuuuuguucacaucacuuccaucaacugauuaugaaagaugggcgcgaaauaguaguaccuuguagaaaucaagaugaauuaguaggcagagcgagaguaagucaaggcgcaggauggucacuaagagaaacagcuuguuuaggaaagucauacgcacaaauguggcaacuuauguacuuccauagaagagaucuucgucuagcagcgaaugcaauauguagugcagugccuguugauugggucccgacuucucgaaccacuuggagcauucaugcacaucaucaauggaugaccacagaagauauguuaucuguuuggaauagggucuggauagaagagaaccccuggauggaggauaaaacucauguaaguucuugggaagaggucccauaccugggaaaaagagaagaccaauggugcggaucucuaauaggguuaacugcuagagcuacaugggccacuaauauacaaguagcuauuaaccagguccggagacuuaucggaaaugagaacuacuuagacuacaugaccucaaugaaaagguucaaaaaugaaagcgaucccgaaggagcauuaugguga

SEQ ID NO: 21270 - RNA, 9879 nt, Artificial Sequence
  derived and/or modified CDS sequence (opt6) from DENV-1__KJ189307__SS-prME
uccguaacaaugcuauuaauguuacuaccuacagcacuagcuuuccaucucacuaccagaggaggggaaccucauaugauuguaucaaaacaagaacgagguaaaucucuauuguucaaaacaagcgcuggcguaaauaugugcacgcuaauagcaauggaucucggggaacuaugugaagacacaaugacuuacaagugcccccagauaacagaagcggaaccagacgacguugacugcuggugcaaugccacagauacauggguaacuuacgggaccugcagucaaacaggagaacacagacgugacaaaagaagugucgccuuggcaccccacguaggccuaggguuagaaacaaggacagaaaccuggaugagcucagaaggagcauggaaacaaauacaacguguggaaacuugggcgcugagacauccgggauuuacgguaauugccuucuuucuagcacaugcaauuggcacgaguauaacacagaaaggaauuauuuuuauacuucuuaugcuaguaacgccaucaauggcgaugcgaugcgugggaauuggaaaccgcgauuuuguggaagguuugucaggcgcgacgugggucgaugugguacucgaacauggcucuugcgugacgaccauggcuaaaaauaaaccuacguuggauauugaauuacugaaaacugaagugacaaauccagccauauuaaggaaacugugcauagaagcaaaaauaagcaacacuacuacagacucccgaugcccaacucagggagaagcaaccuuaguagaagaacaagacgcgaauuuugucugucgaagaacauucguggauaggggcugggggaaugguugcggacuuuuuggaaaagggagucuccucacgugcgcgaaauuuaaaugcguuacaaaauuagaaggcaaaauagugcaauacgaaaacuugaaauacuccgucauaguaacaguucauacaggugaccaacaccaaguggguaacgaaacgacagagcauggaacgauagcuacuaucaccccacaagcacccaccucagagauucaacuuacugauuauggugccuuaacgcuagauuguagcccacgcaccgggcucgauuuuaaugaaaugguccuauuaacaaugaaggaaaaaucaugguuaguucauaagcaaugguuccuagaccuaccauugccuuggacgaguggagcaagcacaucucaagaaacuuggaacagacaagacuuauugguuacauuuaaaacggcacaugccaagaaacaggaaguaguuguacuaggcagucaagaaggggcgaugcauacagcgcugacaggagcaacggaaauacagacaagcgguaccacuaccaucuuugcaggucauuuaaaauguagacucaagauggacaaacugacguugaaaggcacaaguuacguaauguguacuggcuccuucaaguuagaaaaggaggucgcugaaacacaacauggaaccguccuaguacaggucaaauacgaggggacggaugccccauguaaaauuccguuuucaacacaagacgagaagggaguuacucagaauggaagauuaauaaccgcaaauccuauaguaacagauaaagaaaaaccaguuaauaucgaaacggaaccacccuucggggaaucauauauaguagugggagcuggagaaaaggcauuaaaacuaaguugguuuaagaaaggcaguagcauaggaaaaauguuugaagcuaccgcgcgaggugccaggaggauggccaucuuaggagauacugcaugggauuucggaucgauaggcggaguuuuuacgucgguggggaaguuggugcaccaaguguuuggaacggccuacggaguauuguuuucagguguuaguuggacgaugaaaauaggaauagggauacuauuaacuugguugggucuaaauaguagaagcacaucauugaguaugacguguauugccguugggaugguaacauuauaucucggagugaugguacaagcagauucgggauguguuauaaacuggaaaggaagggaauugaaaugcgguucgggaauauuuguuaccaaugaaguccauacauggacagaacaguacaaauuucaagcagacagcccaaaaagacuguccgccgcuauagguaaggcuugggaagagggcguaugcggaauccgaucagcaacgcgauuggaaaacauuauguggaaacaaauaucuaaugaauuaaaucauauauuacuugagaaugacaugaaauuuacgguggucgugggagacgcgaacggcauauuggcacaagggaagaaaaugauaagaccccagcccauggaacacaaauauaguuggaaaaguuggggaaaagccaaaauaaucggugccgauauacaaaauacaaccuucaucauagauggcccagacacuccagaaugcccagauaaucaacgugcauggaacauuugggaaguugaagauuacggauucggcauuuuuaccaccaauauaugguuaaaauuaagagauucauacacacagaugugcgaccauagacucaugagugcugcaauaaaagacucaaaggccguacaugcagauaugggauauuggauagaaucagaaaagaacgaaacauggaaacuagcaagagcaaguuuuauagaagugaaaacauguacauggccuaaaucacauacucuguggucaaauggaguacuugagucugaaaugauaauaccaaaaauauacgguggacccaucucgcaacauaacuauaggccuggauauuuuacacagacggcagguccauggcaccucggaaaacuugaacuagacuuugacuuaugugaggguaccacagugguaguugacgaacacuguggaaaucgaggaccgagccuucguacaacuacaguaacaggaaagaucauacaugaaugguguugcagaaguuguacuuuaccgccacugcguuucaggggcgaagauggguguugguaugguauggaaauccgaccaguaaaggaaaaagaagaaaaucuaguucgaaguauggucucugcugguaguggugaaguagauucuuucagucuagggauauuauguguaucgaucaugauagaagaaguuaugcguaguagguggagccgaaaaauguuaaugacugggacauuagcaguauucuuauuauuaguaaugggccaacuuacauggaaugaucugauccgauuaugcauaauggugggagcaaacgcuucagaucggauggggauggguacgacauaccuagcauugauggcgacauuuaagaugcgaccuauguucgccgugggccuauuguucagacgacuaaccagcagagaaguguugcuguuaacgauaggacucagccuagucgcgucaguugaguuaccaaauucauuagaggaauuaggagacgguuuagccaugggcauaaugauguuaaaacuacuaacggaauuucaaccucaucaauuauggacaacauuacuaucauugacauucauuaagacgacucuaucucuugacuacgccuggaaaaccaccgccauggcgcuuaguaucgugucacuuuucccacuguguuugaguaccacuucccagaaaacuaccugguugccgguguuacuggguaguuuuggguguaaaccguugacuauguuccuuaucacugaaaacaagaucuggggcagaaagaguuggccucugaacgaaggaauaauggcgauuggaauaguaucuauauuacuuucgagucugcuaaagaacgacguaccccucgcaggaccuuugaucgcaggaggaauguugaucgccugcuaugugaucucaggaucuagugcagaucuuucacucgagaaagcagcugaagucuccugggaacaagaagcugaacacuccgguacgucacacaacauaccaguggaaguccaggaugaugguaccaugaaaaucaaagaugaagaaagggaugauacuuuaacuaucuugcuaaaggccacauuacuagcuguaaguggcguauacccaaugaguauccccgccacacuuuuuguuugguauuuuuggcagaagaagaaacagagaagcgguguucuuugggacacaccaaguccgccagaaguagaaagagcaguauuagaugacgguauauauagaauuuuacaaagaggacuuuuaggaagaucgcaaguagguguaggagucuuccaggacggaguguuucacacgauguggcaugucaccagaggagcuguauuaauguaucaaggaaaaagauuggaacccucuugggcuagcguaaagaaagaucuuauaucguacgguggcgguuggagauuccaaggaucauggaacaccggagaagaaguucaagucaucgcaguugagccaggcaaaaaccccaaaaacguacaaacuacacccggaacauuuaagacgccggagggcgaagucggugcaauugcgcuugacuucaaaccgggcaccucagguagcccaauaguaaauagagaagguaaaauugugggacuauauggcaacggcguaguaacuacgagcggaacauaugucagcgcaauagcgcaggcaaaggcaucccaagaaggaccccuaccugaaauagaagacgaggucuucaagaaaagaaaucuaacuauaauggaucugcauccagguaguggaaaaacaagaagguauuugccagcgaucguaagagaggcuauuaagcggaaauugagaacacugauauuagcgcccacccgaguuguugcuuccgaaauggccgaagcauuaaagggaaugcccauuagguaccagacaacagcgguaaagucugaacauacagggagagaaauaguugaccuuaugugccaugcuacguuuacgaugaggcuuuugucacccguucgugugccuaacuacaauaugauaauaauggaugaggcacauuucacggacccagcuucgauugcagcaagaggguauaucaguacgaggguaggaaugggugaagcggcagcuauuuuuaugacagcuacuccaccaggguccguggaggcauucccucaaagcaaugcaguaauccaagaugaggaacgcgauauuccugaacgcaguuggaauagcgguuacgauuggauuacagacuuuccaggcaaaacgguaugguucgugccaucaaucaaguccggcaaugauaucgcgaauuguuugcgcaagaaugguaaaagagucauccagcuaagucguaagacuuuugauacagaauaccagaaaacuaagaauaaugauugggauuaugugguuacuacagacauaucagaaaugggagcaaauuuuagggcagaucguguaauugacccaagacgguguuuaaagcccgucauucugaaagacgguccugaacgaguuauacucgcaggaccaaugcccgugacuguagccagugcagcgcaaagacgaggaagaaucggcagaaaucaaaauaaagagggagaucaguacgucuauaugggucaaccacuaaacaacgacgaagaccaugcgcauuggaccgaagcaaaaaugcuacucgauaacauuaacacgccagaagguauuaucccggcguuauucgagccggaacgugagaaaaaugccgcaauugacggggaauauaggcuacguggcgaagcaagaaagacauucguagaacugaugcgacgaggagaucugccuguuugguuaucuuauaaaguugcgagcgaaggauuucaguacagugacagaagauggugcuuugauggugaaagaaauaaucaaguacucgaagaaaacauggaugucgaaaucuggacgaaagaaggagaacgcaaaaagcuaagaccgcguuggcuagaugcaaggacauauucagauccacuugcucuccgggaauuuaaagaguucgcagcaggaagacgaagugucucuggcgacuuaaucuuagaaauaggaaaacuuccccaacauuuaacauuaagagcacaaaacgcacuugacaaucuagucauguuacauaauagcgaacaaggaggaaaagcguacagacacgcaauggaagaguuaccagacaccauugagacgcuaaugcuauuggcauugauugcagugcugacggguggcguaacucuguuuuucuuauccggaaaaggccuagguaaaacaagcauaggauuacuauguguaacagcaaguuccgcacuguuguggauggcuaguguugaaccacauuggauagcagcaucaauuauacuagaguucuuucuaaugguucuacuuauaccggaaccagaucgucagcguacgccucaagauaaucaacuugcauauguagugauaggacuccuauuuaugauccugacaguagccgcaaaugaaaugggucuacucgaaacgaccaagaaagaccuaggcauaggacacguugcagcugaaaaccaucaacaugcuacaauguuagauguugaccuacguccagccucagcguggacuuuauaugcuguugcaaccacuguaauuacgccaaugaugcgucacacaauagaaaauacaaccgcgaacauuagucuaaccgcaauagcaaaccaagcagcaauauuaaugggucuggauaagggauggccuauuucgaaaauggauauuggggugccguuguuagcacuaggaugcuauagccaagucaauccgcuuacuuuaacggcggccguccuuauguuagucgcucauuaugccauaauagguccuggucuccaagcaaaagcaaccagagaagcgcaaaagaggacggcugcaggaauuaugaaaaacccgacaguugauggaaucguagcaaucgaccuagaucccgugguguacgaugcaaaauuugaaaaacaauuaggccaaauaaugcuuuuaauucuauguacaucacaaauccuccuuaugcgaaccacgugggcacugugugaaucuaucacacucgcuacaggaccauugaccacccuaugggaagguucuccaggaaaauuuuggaacaccacaauagcggugagcauggcgaacauauuuagagguaguuauuuagcgggagcuggacucgcauuuagccucaugaaaagccuaggaggcggaaggagagguacaggagcacaaggagagacacuuggcgagaaauggaaacgacaacuaaaccaauuaagcaaaagugaauuuaacacauauaaaagaucaggaaucauggaagucgauagaagugaagcaaaagaaggacuaaaacgaggugaaacaacgaagcacgcuguaucucggggcacugccaagcuaaggugguuuguugagaggaauuugguaaaaccugaagguaaaguaauagaucuaggaugcgggaggggagguuggucuuauuacugugccggcuugaagaaaguuacagaaguaaaaggauauacaaagggagggccugggcacgaagaaccaauuccuauggcgacuuacggguggaauuuaguuaaguugcauagcggcaaagacgucuucuuuaugccgccggaaaagugcgauacccuauuaugugauaucggcgaaagcaguccgaauccuacuauugaggagggcaggacgcuaagagucuugaaaaugguagaacccuggcuaaggggaaaucaauuuuguauuaaaauccuuaacccauauaugccaaguguaguugagacacuagaacagaugcaaaggaagcauggagguauguuaguaagaaauccacucucacgcaacaguacacacgaaauguacugggucucaugcgguacagggaacauagugucagccguuaauaugaccagucgaaugcuccuaaacagguuuacuauggcgcaucguaaaccgacauaugagcgagaugucgaccucggagcagguacucgacauguagcgguggaaccugaggucgcgaaucuugauauaaucggucaaagaaucgaaaauaucaaaaaugaacauaaauccacauggcauuacgaugaagauaauccauauaagacgugggccuaccacggcaguuaugaaguaaaaccaagcgggucugcuucaucgauggucaauggugucguacgauugcugacuaaacccugggauguaauacccaugguuacacaaauagccaugaccgacacaacaccauuugggcaacagagaguauuuaaagaaaaaguagauaccagaaccccaagagcgaaacgcggaaccacgcagaucauggaaguaacagcgaaauggcuguggggauuucuuucccgaaauaagaaaccaagaauuuguacaagggaagaauuuacccguaaggugcgcucuaaugcagcaauuggagcaguuuuuguagaugaaaaucaauggaacucagccaaagaagcugucgaagacgagcgguucugggauuugguacaucgugaaagagaauugcauaaacaaggaaaaugugcuacuuguguauauaacaugaugggcaagagagagaagaaacuuggagaguucgguaaagcaaaagggucucgagccauaugguauauguggcuaggagcccgcuuuuuggaguucgaagcucucggcuuuaugaaugaagaucauugguuuucuagagaaaauucauuaagugggguagaaggcgaaggucuacauaaacuaggguacauacuacgugauauaagcaagauaccaggaggaaauauguacgcugacgauacugccgguugggacaccagaauaaccgaggaugauuuacaaaaugaagcuaaaauuaccgaaauuauggaaccugaacacgccuuguuggcgacgagcauauuuaaacuuacauaccaaaauaaaguagugcggguucaacgaccagccaaaaacggaacuguaauggacguaauaaguagaagagaccaaaggggaucaggacagguaggaaccuacggauuaaauacguucacaaauauggaaguccagcuaauuagacaaauggaaagugaggggauauuucuaccuucugagcucgagacgccuaauuuagcugagagaguuuuggauuggcuugagaaacauggagccgaacgucuuaagagaauggcgauaucuggagacgauugugucguaaaaccuauagaugauagauuugcgacagcguugaccgcauuaaacgauaugggaaagguaagaaaagauauaccacagugggaaccuucuaaaggauggaaugauuggcaacaaguuccuuucuguucacaucacuuucaccaacuaauaaugaaggauggacgagagauuguagugccaugccggaaccaagacgaguuaguggguagggcacgagucagucaaggagcagguuggucuuuaagagaaacagccugcuuagguaaaucauaugcccaaauguggcaguuaauguauuuucauagacgugaccugcgguuggcagcuaaugccauaugcucugcgguuccaguagacuggguaccgacuucucgaacuacauggucuauacacgcacaucaccaauggaugacuacagaagacaugcugagcguauggaauaggguauggauagaggaaaacccauggauggaagauaaaacgcauguaagcagcugggaagaaguccccuaccuuggaaaaagagaagaccaauggugugggagcuuaauagggcuuacugcuagagccacuugggcuacaaauauacagguagcuauaaaucaagucagaagguuaauaggaaacgaaaacuauuuagauuacaugacaaguaugaagagguuuaaaaacgaaucggauccagaaggagcguuaugguga

SEQ ID NO: 21271 - RNA, 9879 nt, Artificial Sequence
  derived and/or modified CDS sequence (opt6) from DENV-1__KJ189318__SS-prME
uccguaacaauguuauuaaugcuuuugccaacagcuuuagcuuuucacuuaacaacgagaggaggagaaccucauaugauuguuucaaaacaagaaagaggaaaaagucuacucuuuaaaacaagcgccgguguuaauauguguacauuaauugcgauggaccugggagaacucugugaagauaccaugacuuacaaaugcccacaaauaacugaagcggaaccagacgauguggauuguuggugcaaugcgacagacacauggguuacuuaugggacauguucucaaacuggagaacauagacgcgacaaacgcagcgucgcuuuggcgccacauguagguuuaggauuagaaaccaggacagagacauggaugucaagugaaggugcauggaaacagauccaaagaguagaaacaugggcucucagacauccaggauucacaguaauugcacuguuuuuggcacaugcgauagggacaucgauuacccaaaaagggaucauauuuauacuguuaauguuaguaacuccaaguauggcuaugagauguguuggaauaggaaaucgagauuucguugaaggacugucuggagcaaccuggguggauguuguauuggaacacgguuccugugugacuacuauggcuaaaaauaaacccacucuagacauagaacuauuaaagacggaaguaacgaauccagcuauccuaaggaaguugugcaucgaagcaaagauuucaaauacaacgacugacaguagaugccccacccaaggagaagcaacguuaguugaagaacaagacgcuaauuucgucuguagaagaacauuuguggaucgcggauggggaaacggcugcggucuauuuggaaaggggucacuacuuaccugugcaaaguuuaaaugcguaacuaaauuagaaggcaaaauagugcaauaugagaauuugaaauauucgguaauuguuacagugcauacuggugaucaacaucaaguaggcaacgaaaccacagagcacggaaccauagcgacuauaacaccccaagcaccgacauccgagauacaauugacggacuauggcgcacuuacuuuggauugcucaccgcgaacagguuuagacuuuaacgagauggucuuauuaacaaugaaagaaaaaucuugguuagugcacaaacaaugguuccucgacuuaccauuaccuuggacgucaggagcgucuacaagucaagaaacauggaaccgacaagauuuauuggugacuuuuaaaacagcacaugcgaaaaagcaagaagugguuguucuaggaucucaagaaggagccaugcauacagcucucacuggggcaacugaaauucaaacgucuggcacaacaaccaucuuugccggacaucucaagugucgucugaaaauggauaaacugacucuuaaagguacuucauauguuauguguacaggaaguuucaaacuugaaaaagaaguggcggaaacgcagcacggaacaguguuaguacaagucaaauacgagggcaccgaugcccccugcaaaauuccauucucaacacaagacgaaaaaggagugacucagaacggcagauugauaaccgcuaauccaauaguuacugauaaagaaaaaccagucaacauagaaacagagccgccauucggugagucauauauaguugugggcgcaggagaaaaggcucucaaguuaaguugguucaagaaaggcucgucgauaggaaaaauguucgaagcuaccgcucguggagcccggagaauggcuaucuuaggagacacagcaugggauuucggaaguauaggaggaguauuuacauccguggggaaauuaguacaccaaguauuuggaacggcauaugguguucucuuuuccggaguuaguuggacuaugaagauuggcauagguaucuuguuaacuugguuaggcuuaaauucaagaagcacaagccugaguaugacuuguauagccguugggaugguuacacuauaucuuggcguuaugguacaggcagauagcgggugcgucauaaacuggaaaggacgugaauuaaaaugugguucugguauauucguaacaaacgaaguacacacuuggaccgaacaguacaaauuucaggcggauucgccgaaacgauuaagugcagccauugguaaggcuugggaagagggaguauguggcauucguagugccacgcgacuugaaaacauuauguggaaacaaauaucuaaugaguuaaaccacauucuccuugaaaaugauaugaaauuuacagucguuguaggagaugcuaacgggauauuagcacaaggcaagaaaaugauuagaccucagccuauggaacauaaauauucauggaaaucauggggcaaggcgaaaauaauaggcgcggauauacaaaauacaacuuuuaucauugacggaccagacacgccagagugcccugacaaucaaagagcauggaacauaugggagguugaagacuacggcuuugggauuuuuacaacgaauauauggcuuaaacuaagagacucuuacacacaaaugugugaucaucgucuaaugucagcagccauuaaagauuccaaagcaguacaugcagauaugggauacuggauagaaagcgagaaaaaugaaaccuggaaacuagcgagagcguccuuuauagaagugaagacgugcaccuggccaaaaucgcauacucucuggucaaauggcgugcuggaaagugaaaugauaaucccaaaaauuuauggaggcccgauaucucaacauaacuaucgaccagguuauuucacucaaacagcgggcccauggcacuuaggcaagcuagagcuagauuuugaucuaugcgaaggcaccacaguaguaguagaugagcacugcggcaaccgagggccuucacuaagaacaaccacaguaacaggaaaaauaauccaugaaugguguugucgaaguugcacacuuccuccgcugagauuucgaggugaagauggcuguugguauggaauggaaauuagaccuguaaaagagaaagaagaaaaucucguaagaaguaugguaagugcgggaagcggugaaguugacagcuuuucucucggaauacugugcgcuucaauaaugauagaagaaguuaugagaaguagauggucuaggaaaaugcugaugacgggaacccuggcaguauucuuauuguugauaaugggucagcugaccuggaacgacuuaauaagauuaugcauaauggucggggcgaaugcaagugaccgaaugggcaugggcaccacauaccuggcacuuauggcuacuuuuaagaugcgaccaauguuugcuguaggguuauuauuucggagauuaacaagucgcgaagucuugcuccuaacuauaggacugagucuuguagccagcguagaauuaccgaacucacuugaagaauuaggcgacggauuagcgauggguauaaugaugcuaaaauuauugacugaauuucagccucaucagcuauggaccacacugcuaagccuaaccuucauaaagacuacccuuaguuuagauuaugcguggaagacuacggcaauggcucucagcaucgucagccuuuucccuuuaugucucucaacaaccagccagaaaacuacaugguugccaguacuccugggcaguuucggaugcaagccucucaccauguuucuaauaacagaaaacaaaaucuggggucguaaaucuuggccauuaaacgaggggauaauggcaauaggaauuguaucuauucuucuauccaguuugcuuaaaaaugacguuccacuagcagguccucucaucgcgggugguaugcuaauugcauguuacguaauaucaggauccagugcagaccuauccuuagagaaaacugcugaagucagcugggaacaagaagcagaacauucaggaacaagucauaauauucucguggaaguacaagaugaugguacuaugaaaauaaaagacgaagaacgugacgauacauuaacuauucucuuaaaggcaacauuauuggcagucucaggaguguauccaaugaguauuccggcuacacuuuuugugugguacuuuuggcagaagaagaaacaaagaucgggcguauuaugggacacaccaucgccgccggaaguagagcgagcaguacuugaugauggaaucuacaggauucuacaaagaggacuacuaggacgcucucaaguaggagucggagucuuucaagacggaguguuccacacgauguggcaugugacgcgaggggcggugcuaauguaucaaggcaaaagauuagaaccaucuugggcuucaguuaagaaagacuugauauccuacggagggggauggagauuucaagguaguuggaauacuggagaagagguacaaguaauagcaguagaaccagguaaaaaccccaaaaauguucagacuacaccgggaacuuucaaaaccccagaaggagaaguaggggcuaucgcuuuagauuuuaaaccagggacaucuggaucgccgauuguaaaucgugaaggcaagauagucggacuuuauggaaaugggguuguaacaaccagcgggacauauguuucagcaauagcccaagcaaaagccucgcaagaaggcccacuaccagaaauagaagacgagguguuuaagaaaagaaauuugacgauaauggacuuacacccuggcaguggcaagacgcggcgguaccuaccugccauuguccgagaggccauaaaaaggaaauuaaggacuuuaauacuagcaccuacaagaguuguugcaucagaaauggcagaggcacucaaaggaaugccuauaagauaccaaacaacggcaguuaagagugaacauacaggaagagagauagucgaucugaugugucaugcaacuuuuacgaugagauugcuaucuccgguuagaguaccgaauuauaacaugauaauuauggacgaagcacauuuuacagaucccgcaucgauagccgcucguggcuacauaucaacuagaguaggcaugggcgaggcagcggccauauucaugacggcuacaccgccaggaagugucgaagcauuuccacagaguaacgcuguaauucaagaugaagaacgggauauccccgaaaggucguggaacucgggauaugauuggauuacugauuucccaggcaaaacaguuugguuugucccgucaauaaaaagcgguaaugauauugccaacugcuuaagaaagaaugguaaacguguaauccaacuuucuagaaaaacauuugacaccgaauaucagaaaaccaaaaauaaugauugggacuacguaguaaccacugacauaagugaaaugggcgcaaacuuucgggcggaucgaguaauugacccuaggagaugucuuaaacccguuauacucaaagacggaccugaacgagugauuuuggcagggccuaugcccgugaccguagcaucugcagcccaacgaaggggucgcauaggaagaaaccaaaacaaagagggcgaccaauauguauauaugggucagccauuaaauaacgacgaggaucaugcucauuggaccgaagcaaagaugcuauuagauaauauaaacacuccagagggaaucaucccagcgcucuuugaaccagaaagagaaaagagcgccgccauagacggcgaauauagguugcgcggugaagcgcggaagacauucguugaauuaaugaggagaggagacuuacccguuugguuaucauauaaaguagcguccgaagguuuucaauauagcgacaggcgcugguguuucgauggugaaagaaauaaucaaguuuuggaagaaaauauggacguggaaauuuggacuaaagaaggugagaggaagaaacuaagaccaagauggcuggaugcuagaacuuauucugaccccuuagcacucagagaguucaaagaauuugcugccggaagacgcucagugaguggcgaucuaauccuugaaauagggaaacucccgcagcaucugacucuaagagcacagaaugcuuuagacaaccugguuauguuacauaauagcgaacaaggcggaaaagcauauagacaugcuauggaagaauuaccggauacgaucgagacauuaaugcuauuggcacuaauagcaguccucaccgguggcguaacuuuauuuuuccuaagcggaaaaggguuaggaaaaacuagcauaggucuucuguguguaacagcaucauccgcgcuacuauggauggcgaguguggaaccccauuggauagcggcaucaauaauacucgaauuuuucuugaugguauuguuaauuccagaaccagaucggcagcggacuccgcaagacaaucaacuagcauaugugguuauaggucuacuauucaugauuuuaacuguggcugccaaugaaaugggguuacuagaaacaaccaagaaagacuugggcauaggccacguagcugcagagaaucaucagcacgcaacaaugcuugauguggaccuaaggccggcgagcgcauggacacuauaugcaguagcuacaacuguuauuacgccgaugaugcgacauacaauugaaaacaccacugcuaauauaucguugacagcuauagcgaaccaagcagcaauucuaaugggauuagacaaaggauggccuauuagcaaaauggacauuggagucccucuacuagcuuuaggaugcuacucgcaaguaaaucccuuaacuuuaacugcggcaguacucauguuaguagcccacuaugcaauaauaggaccuggucuccaagcuaaagcuacccgcgaagcacagaaacgaacagcugcagggauuaugaaaaaccccacugucgauggcaucguagcuauagaccuugauccagucguguacgaugcaaaauuugaaaaacaguuagggcaaaucauguuauuaauuuuguguacuucacagauuuugcuaaugcguacaacaugggcucuaugcgagaguauuacucuugccacugggccauugacuacgcuaugggagggaucgccaggaaaauucuggaauacgacaauugccguuaguauggcgaauauuuuucgagggucauaucuagccggugcaggacuagcguucucuuuaaugaagucauuaggugggggaagacgcgguacaggggcacagggggaaacacugggcgagaaauggaaaagacaauuaaaucaacugaguaaaagcgaauuuaauacauauaaaagaagugguauuauggaaguagauagaagcgaagccaaagaaggcuuaaaaagaggugagacaacgaagcacgcagugucaagagggacggcuaaguugagaugguuuguagaacgaaacuuagucaaaccagaaggaaaaguuauugaucuugggugcggacgaggaggauggucauacuacugugcuggacuaaagaaagugacagaaguuaaaggauauaccaaaggcggaccaggucacgaagaaccuauuccaauggcaacuuacggcuggaaucucguuaaacuucacagcgguaaagaugucuucuuuaugcccccugaaaaaugcgacacacuucugugcgacauuggagaaaguucaccgaauccaacaauagaggaaggaaggacucugagagugcuuaaaaugguugaaccauggcuuaggggaaaucaauuuugcauaaaaauuuuaaacccauacaugccaucuguuguggaaacacucgaacagaugcagagaaaacacgggggaaugcuugugaggaacccuuuaaguagaaauuccacgcaugaaauguauuggguaucuugcggaacgggcaacaucguaucagcuguaaauaugacaagcagaauguuacuaaacagauuuacaauggcucaucgaaagccgacuuuugaacgcgaugucgaucuuggugcuggcaccagacacguagcuguugagcccgagguagcuaaucuagacauuauaggucaacguauugaaaacaucaaaaacgaacauaaaucgacuuggcacuaugaugaggauaacccauauaaaacgugggcuuaccacgggucuuacgaaguaaaaccaucagggucagccuccagcauggucaauggugugguaagacuauugacgaaaccaugggacguuauuccaaugguaacacagauagcgaugacagauacaacuccguuuggccagcaacgaguuuuuaaagaaaaaguugacacucgcacccccagagcaaaacgagggaccacacaaauuauggaaguuacugccaaaugguuauggggauuuuuaucgaggaauaagaaaccucgcauaugcacacgagaggaguuuacacgaaagguaaggucaaacgccgcgauuggcgcuguauuuguagacgaaaaucaguggaauagcgccaaagaagcaguagaagaugaaagauuuugggaccuaguacaucgagaacgagaauuacacaaacagggcaaaugugcgacuugcguauauaauaugaugggcaaacgugagaagaaauuaggagaauuuggaaaagccaaagggucaagagcuauaugguauauguggcuaggcgcuagguuucuagaauuugaggcuuuggguuucaugaacgaagaccauugguuuuccagagaaaauucacuuucagguguagaaggggaaggauugcacaaacuaggauacauacuacgagauauaaguaaaauuccaggcgguaauauguacgcugaugacacagccggaugggauacaagaauaaccgaagaugacuuacaaaaugaagcuaaaauaaccgauauaauggaaccugagcaugcacuacucgcaaccucaauauuuaaacucacguaucagaauaagguuguuaggguucagcgacccgccaaaaacggcacagucauggauguaauuucaagaagagaucaaagagguucgggucaggugggcaccuauggauuaaauacauuuaccaauauggagguacaacuaaucagacaaauggaaucugaagggauauuuuugccuucugagcucgaaacuccuaauuuggccgaaagaguucucgauugguuagaaaaacacggugcggagcgauuaaaaaggauggcuauuucuggugacgacuguguagugaaaccaauugacgauagauuugcaacagcauuaacagcucucaaugacaugggaaaaguuaggaaagacauuccgcagugggaaccuucaaagggauggaacgauuggcagcaaguacccuuuuguucucaucauuuucaccaacugauaaugaaagacggaagggaaauagugguuccaugucgaaaucaagacgaacugguagguagagcgaggguaucucagggugccggcuggucacuaagggaaacagccugccuagguaagaguuaugcccaaauguggcaauuaauguauuuucaucggagggaucuaagguuggcagcaaacgccauuuguagugcaguaccgguugauuggguaccuacuagccgaacgacauggagcauacaugcgcaccaucaauggaugacgacggaagauaugcucucagucuggaaucgaguauggauagaagaaaacccauggauggaagauaaaacucacguuuccucuugggaagaggugccguaccuuggcaagcgagaggaucagugguguggcaguuugauaggguugacugccagagccacaugggcaacaaauauacaaguagcaaucaaucaaguucgcagacugauuggaaaugagaacuaccuggacuauaugacaaguaugaagagauuuaaaaacgagucagacccugaaggcgcucuaugguga

SEQ ID NO: 21272 - RNA, 9879 nt, Artificial Sequence
  derived and/or modified CDS sequence (opt6) from DENV-1__KJ189319__SS-prME
agugugacuaugcuacuaaugcuacuaccuacugcucuagcguuucaucucaccacuagaggaggggaaccucauaugauagugagcaaacaagaaagggguaaaucuuuauuguuuaaaacaucagcgggaguaaacauguguacauugauugccauggaucuaggcgaauuaugcgaagacaccaugacauauaaauguccucaaaucacagaagcagaaccggacgacgucgacugcuggugcaacgcaaccgauacauggguaacauaugggacuugcucacaaacaggcgaacaccggagggauaaacgcuccguagcauuggcuccgcauguugggcuagguuuggaaacgagaaccgaaaccuggaugucaagcgaaggagcauggaaacaaauccaaaggguagaaacgugggcacuccgacacccuggauuuacaguuauugccuuauuccuagcacacgccauaggcacaucaaucacucaaaaagggauaauuuuuauacuauuaaugcucguaacaccgucaauggccaugagauguguggggauaggaaaccgcgacuuuguagaagggcuaaguggcgccacuuggguagacgugguauuggaacaugggucuugugugacaacaauggccaaaaauaaaccaacccuagacauagaacuacugaaaaccgaaguuacuaacccugcuauacuccggaaguuauguauagaagcgaagauuaguaauacuacaacugacaguagaugcccaacacaaggggaagcuacuuuagucgaagaacaggacgcaaacuuuguguguagacgcaccuucguagaucgaggauggggcaacggauguggauuauucggaaaggggucacuccucacgugugccaaauucaaaugcgucacaaaauuagaaggaaaaauaguucaauaugaaaaucuaaaauauaguguuauuguuacuguacacacgggugaccagcaucaagucggaaaugaaacaacagaacacggaacuauugcaacuauuacaccacaagcaccaacgucagaaauacaauugacagacuacggagcauuaacucuagacuguagcccaaggacuggacucgacuuuaaugagaugguacuauuaacaaugaaagagaagucguggcuaguccacaaacaaugguuucucgaccugccccuaccguggacguccggagcaaguacuucacaagaaacguggaauagacaagaccuguuaguaacauucaaaacggcacaugccaagaaacaagaaguagugguucuaggaagucaagaaggugcuaugcauaccgcucugacaggcgcgacugaaauucaaaccucaggaacaacuacgauauuugcuggccauuugaaauguagauuaaaaauggauaagcuaacacuaaaaggaacaagcuauguuauguguacugggaguuucaaguuagagaaagaaguagcugaaacucaacacggaacuguauuaguacagguuaaauaugaagggacagacgcgccauguaaaauuccuuuuagcacacaagacgagaaaggcgugacacaaaauggaagauuaaucacggcgaauccaauuguaacagauaaggaaaaaccugucaacauagagaccgaaccaccuuucggugaaucguauauuguugugggggcaggcgagaaggcccuaaaauuaucaugguuuaagaaagguuccucaauaggcaagauguuugaagcaaccgcaagaggggcacgcagaauggcgauacuaggugauacugcaugggauuuuggcagcauaggaggcguguuuacaucuguuggaaaguuaguacaccaaguauuugggacagcguacgguguacucuuuucggguguaaguuggacgaugaaaauuggaauaggaauacuauuaaccugguuaggccuaaauucccgcaguaccucacuaucuaugacaugcauagcagucggaauggucacacucuacuuaggaguaaugguccaggcagauagcgguugcgugauaaacuggaaaggcagggaguugaaaugcgggucggggauuuuugugacgaaugaaguucacacuuggacagaacaauacaaauuccaggccgacaguccuaaacgauuaucugcagcgauaggaaaggcgugggaggagggcgucugcggaauuagaucagcuacacgacuagaaaauauaauguggaaacagauuaguaacgaauuaaaucacaucuuauuggaaaacgauaugaaguuuaccguaguagugggagaugcaaacgggaucuuagcgcaaggaaagaaaaugaucagaccccaaccuauggaacauaaauauucuuggaaguccugggguaaagcaaaaauaauuggggcggauauucaaaacacgaccuucauaauugauggcccugauacucccgaaugcccggacaaucaaagagcauggaauauaugggaaguagaagauuauggauuugguauauucaccacaaauauuuggcucaaacuucgagauucguauacgcagaugugugaucauagauugaugucagccgcaauuaaggauucgaaggcaguucaugccgauauggguuauuggauagaaucagaaaagaaugagacguggaaacuugcaagagccucguucauugaaguuaaaacauguacuuggccaaaaucacauacccucuggagcaacgguguauuagagucugagaugaucauaccaaagauuuauggagguccaauaagucaacauaauuaucgaccaggauacuucacacaaacugcagggcccuggcaucucggaaaacuugaacuagauuucgauuuaugugaaggaaccacaguagucgucgaugaacacuguggcaaucgugguccuaguuuaagaaccacgacuguaacggguaagauuauucacgaauggugcuguagaucuugcacacuuccaccgcucagauuuagaggagaggacggguguugguacggaauggaaauaaggccggucaaagaaaaagaagaaaacuuaguacgaagcaugguaagugcggggucuggagaaguagacaguuuuucccuagguauccuaugcgcaucaauuaugauugaagaaguuaugaggucaagauggagucgaaagauguuaaugacuggaacauuagcaguguuuuuacuauuaaucaugggacagcuaacuuggaacgaucuuauaagauuauguauuaugguaggcgcaaaugcgagugaccgaauggggaugggaacaacuuaucuagcauuaauggcaacuuuuaagaugagaccaauguucgcuguaggauuauuguuccgaagguugacaucacgagaaguccuccuacuaaccauagggcuuagccuuguagccucaguagaguuaccaaauucauuggaagaguuaggagauggacuagcaaugggaauaaugaugcuuaaacuguuaacagaauuucagccacaucaguuauggacaacacuauuaagucuuacuuuuauuaagacuacuuugagcuuagauuacgcuuggaaaacaacugcgauggcuuuaucaauaguuucauuauuuccgcuuuguuuauccaccacuucucagaagacgacgugguuaccgguguuacuaggcucccuaggguguaaaccuuuaacgauguuucugaucacagaaaauaagauauggggcagaaaauccuggccuuuaaaugaagguaucauggcuauuggaauaguaucaaucuuguuaagcucacuucucaaaaacgacgugccauuagcugggccacucauugcugggggaaugcuaauagcaugcuacguaauuaguggcagcagugcugaucuguccuuagaaaaagcggccgaggugagcugggaacaagaagcugaacacucugguaccucccauaauauccuagucgagguucaagacgaugguacuaugaaaauaaaggacgaggagagagacgacacacuaacuauauuguuaaaggcuacauuacucgcaguaagcggaguuuauccaaugucgauucccgcaacacuuuucguaugguauuuuuggcagaaaaagaaacaaagaucaggaguuuuaugggauacacccucgccgcccgaaguagagagagcaguacuagaugauggaauauaccguauucuucaacgaggguugcugggacgaagucaaguuggaguaggcgucuuccaagacggagucuuucacacaauguggcauguaacucgaggugcaguccuaauguaccagggaaaaagauuggaaccaucgugggccagcgugaagaaagaucugaucagcuauggcggaggcuggagauuucaaggaaguuggaauacgggagaagaaguacaaguuauugcuguagaacccgggaaaaacccgaaaaacguacagacgacgccaggcaccuuuaagacuccugagggugaaguuggugcaauagcacuugacuuuaaaccgggaaccagcggaucgccuauuguuaaucgggaagguaaaauaguaggguuauacggaaacggaguggucacuacaaguggcacauauguuucugcgaucgcucaggccaaagcaucgcaagaggggcccuuaccagaaauagaagacgaagucuuuaaaaagcgaaauuuaacuaucauggaucuacauccugggucagguaaaacuagacgauaccuacccgcgauuguuagagaagcaaucaaaaggaaauuaagaacauuaauucuggcuccaacacgaguaguagcaucagaaauggcugaagcccugaagggaaugcccauaagauaccagacaacggccguuaaaagugaacauacggguagagaaauugucgauuuaaugugucacgcgacguuuacaaugcgucuauuaaguccaguuaggguaccgaauuacaacaugauaauaauggacgaagcacauuuuacugacccugcaagcauagccgcaaggggauacaucucaacacgggucgguaugggugaagcagcggcuaucuuuaugacagcuaccccaccagguucaguggaagcguuuccgcagagcaaugcugucauucaggacgaagaaagggacauacccgagcguaguuggaacuccggauacgauuggauaacagauuuuccagguaaaacaguuugguucgugccaaguauuaaaagcgggaacgauauagcaaauugcuuacguaaaaauggaaagcggguuauucaacucucgcggaagacauucgacacagaauaucaaaagacuaaaaauaacgacugggauuaugugguuacuacugacaucucagaaaugggcgcaaauuuuagagcggaccgagucaucgacccaaggagaugucucaagccagugauauugaaagauggaccagaacgggugauccucgccggaccgaugccuguaacaguagcaucggccgcacaacggcgaggcaggauaggcagaaaucagaauaaagaaggggaucaauauguauauaugggacaaccccuaaauaaugacgaagaucacgcacacuggacggaggcuaaaauguuacuggauaacauaaacacaccugaggguauuauaccugcacuauuugagccagaaagagagaaaagcgcggcuauagauggagaguaucguuugaggggagaggcaagaaagaccuuuguugaacucaugagacguggagaccuuccuguauggcuuucuuacaaagucgcuagcgaagguuuucaguauuccgacaggcgaugguguuuugacggagaacgcaacaaccagguauuggaggaaaauauggacguggaaauuuggacuaaggagggggaacgaaagaaauugagaccacggugguuagaugcgagaaccuauucagacccacucgccuuacgcgaguuuaaagaauuugcagcagguagaagaucaguuucuggcgaucuaaucuuggaaaucggcaaauugccacagcaccucacucucagagcacaaaacgcacuugauaaccucguaaugcuacauaauagugaacaaggcgguaaagcauacagacaugcuauggaagaacuuccugacacgaucgaaacucuuaugcuauuagcccuaauugcaguauuaacagggggugucacacucuucuuuuuaucaggaaaaggacucggcaaaacaaguauaggccuauuauguguuacagcuaguagugcauuauuguggauggcaucgguugaaccccacuggauugccgcaucuauuauacucgaguucuuucuaaugguacucuuaaucccggaaccugaccgucaaagaacaccccaagacaaucaacuagcauacgucguaauaggacuuuuauucaugauccuuaccguagccgcuaacgaaaugggucuuuuggaaacgaccaaaaaggaucuggguaucggucauguagcugccgaaaaucaucaacaugcaacuaugcuagaugucgaucuuagacccgcguccgcuuggacucuguacgcuguugcaacaacugugauaacaccuaugaugaggcacacuauagaaaauacaacagcaaacauaaguuuaacagcaaucgcuaaucaggcggcuauauugaugggauuagauaaaggauggcccauaaguaaaauggauauagguguuccauuacuggcucucggauguuauagucagguaaauccauuaacauuaaccgcggcuguucuaauguugguggcccauuacgcuaucauugguccuggguuacaggcgaaagcaacccgagaagcacagaaaaggacagcugcagguauaaugaagaauccuaccguagacggaauagucgccauagaucucgacccgguaguauacgaugcaaaguuugagaaacaacucggucaaaucaugcuucuaauacuauguacaagucaaauacuacuuaugaggacgacgugggcauugugugaauccaucacgcuagccaccggaccacuaacaacccuaugggaaggauccccgggaaaauucuggaauacgacgauugcagugucaauggcaaauaucuuucgagggaguuaccucgcaggggcugggcucgcauucucgcuaaugaagucacuuggugggggaagacgagggacaggagcacaaggagaaacguuaggagagaaguggaagaggcaauugaaccaauuguccaagucagaguucaauacguauaaacgaagcggaaucauggaaguagaccgaagcgaagcaaaagaagggcuaaaaagaggggaaacgacaaaacaugcugugagucggggcacugcuaaacuaagaugguucguagagagaaaccuuguaaagccagaagggaaaguaauagaccucggauguggaagaggaggauggagcuauuacugcgcugggcucaagaaaguuacggaaguaaaaggguauaccaaaggcggucccggacaugaggaacccauccccauggcuaccuauggauggaaccuaguaaaauuacauuccgguaaagacguauucuuuaugccaccagagaaaugcgauacacuacuaugugauauaggagaaucaucaccuaauccaacaauugaagagggaagaacacuccgcguccuaaagaugguagagccauggcugcguggaaaucaauucugcaucaaaauucucaauccguacaugccuagcguagucgaaacauuagaacagaugcaaagaaaacauggggguauguugguccgaaauccuuuaucaagaaauucgacucacgaaauguacugggucagcugcggcacaggaaacauagucucggcugugaacaugaccagcagaauguuauuaaaucgauuuacaauggcucauagaaaacccacauuugagagggauguagaccuuggugcaggaacgcgacauguagccgucgaaccagaaguggcgaacuuggauauuauaggucaaagaauagagaacaucaagaaugaacacaaaucgacuuggcacuaugaugaggauaaucccuauaaaacaugggccuaccauggaucauaugagguuaaaccaagugguuccgcaaguagcauggucaaugggguugugagacuauuaaccaagcccugggauguaauaccuaugguaacucaaauagcaaugacagacacuacgccuuuugggcagcaacgaguguuuaaagaaaaaguagauacuagaacgccacgagcaaagcgugggacuacacagaucauggaggucacagcaaagugguuaugggguuuucuuagcaggaauaagaaaccaagaauuugcacgagagaagaauuuacacgcaaaguacgaucuaacgcagcuauaggggcaguuuuuguagaugagaaucaauggaacagcgcaaaagaggcaguagaagacgagagguuuugggaucuaguacacagagaaagagaacuucauaaacaaggcaagugcgccaccuguguauauaacaugauggguaaaagagagaagaaauuaggcgaguucggcaaagcuaaaggaagcagagcaauaugguacauguggcuaggcgcccgauuucucgaauuugaagcucugggcuuuaugaaugaggaccauugguuuagucgugaaaauucucucucuggcguagagggagaaggcuuacauaaacuaggauauauacugcgugacauuuccaaaauuccagguggaaacauguaugcugacgauacugcaggcugggacacaaggauuacugaagaugaccuacaaaaugaagcuaaaauuacagauauaauggaaccagaacacgcucuguuagcuacaucgauuuuuaagcuaacauaccagaauaaaguagucagaguacagagaccggccaaaaacggaacaguaauggacguuaucucacgcagggaucaaaggggaagcggacaaguuggcacauacggauuaaauacuuuuacaaauauggagguacaacuaauucggcagauggaaagugaagguaucuuuuugccgagugaauuagaaacuccaaaucuggcugagaggguacuagacuggcuggaaaaacauggcgcugaacgacuaaaaaggauggcaauaucaggugaugauugcgugguuaaaccuaucgaugauagauuugcaacagcucucacagcuuuaaaugacaugggcaaaguuagaaaggauaucccccagugggagccaucuaagggauggaacgacuggcaacaaguaccguuuugcucacaucacuuccaucaauuaauaaugaaagaugggcgugagaucguaguaccuugucgaaaucaggaugaacuuguagggcgugcaagagugucucaaggugcuggcuggucauuacgggagacagccugucuugggaagaguuacgcacaaauguggcaacugauguauuuucacaggcgcgaucuacgacuagccgccaaugcgauauguagugcugugccaguugacuggguacccacaucaaggacgacauggagcauacacgcacaccaccaauggaugacuaccgaagacauguugucaguuuggaauaggguuuggauagaggaaaacccauggauggaagauaaaacucaugugucaucuugggaagaaguaccuuaccugggcaaaagagaagaucaaugguguggcucguuaauuggauuaacugcucgagccacaugggcuacaaauauacaagucgcuauuaaccagguacgaaggcuaauuggcaaugaaaacuaucuugacuauaugacaucaaugaaaagauuuaagaacgagucggaucccgagggggcauuaugguaa

SEQ ID NO: 21273 - RNA, 9879 nt, Artificial Sequence
  derived and/or modified CDS sequence (opt6) from DENV-1__KJ189320__SS-prME
ucugugacuaugcuacuuauguuauuaccuaccgcacuagcuuuccaucuaacuacucgaggaggggaaccccauaugauugucucaaaacaagaaagaggaaaaucacuauuauucaaaacuagcgcaggaguaaauaugugcacacugauagcaauggaucugggagaauugugugaggacacaaugacguacaaauguccucaaauuacggaggcggagccggacgaugucgauuguugguguaaugcaacagauacuuggguuacguauggaacaugcucucaaacuggugaacaccgacgagauaaacggucaguggcacuagcaccccauguuggauuaggguuagaaacaagaacugagacauggaugucuucagaaggagcuuggaaacaaauacaacgaguagaaacuugggcucuaagacauccgggcuucacugucauagcuuuauuccuggcacacgcuauagguacuagcauaacacaaaaaggaauaaucuucauucuuuuaauguuaguuacucccucuauggcuaugagauguguugggauuggaaaucgugauuuuguugaaggauuaucuggagcgaccuggguggacgugguuuuggaacauggauccugcguaacuacgauggccaaaaauaaaccaaccuuagauauugaacuucuaaaaacggaaguuacgaauccagcgauacuuagaaaauuauguauugaagcuaaaaucaguaacacuaccacugacucacgauguccuacacaaggugaggcaacuuuagucgaagaacaagaugcuaauuuugugugucgccgaacuuuuguagauagagguuggggaaauggcuguggauuauucggcaaagguagcuuguuaacaugugcaaaauuuaaaugcguaacaaaacuagaaggcaaaauaguccaauaugagaauuuaaaauacucuguaaucguaaccguacauacuggagaccaacaccaaguaggcaaugaaacaacggaacacggcacgauugcuacaaucacuccacaagccccgacaagugaaauacaacuaacggauuacggagcacugacauuagacugcucgccacggaccggacuagacuucaaugagaugguccuccucacaaugaaagagaaaagcuggcuaguccauaaacaaugguuucuggacuuaccacuaccauggacuucuggcgcuagcacgucccaggaaacauggaacaggcaggauuuauugguuacauuuaaaacugcucaugcgaagaaacaagaaguuguuguacugggaucacaggaaggugccaugcacaccgcucuaacaggcgccacagagauccagacauccgggacgacaacgauauuugcuggacaccugaaaugucgacuaaaaauggacaaacuaacuuuaaaaggcacuucuuaugucauguguacugguagcuuuaaguuagaaaaagagguugcggaaacacaacacggaacuguauuaguacagguaaaauacgaggggacagaugccccauguaaaauaccauucucuacucaggacgaaaaagguguaacccaaaauggucgacuuauaaccgcuaauccaaucguuacagauaaggagaaaccagugaacauagagacagaaccuccauucggagaaagcuacaucguaguaggugcuggcgaaaaagcucuuaaguuaucuugguuuaagaaagggucgaguaucggaaaaauguuugaagcaacagccaggggcgcuagaaggauggcaauucuuggagacacagcaugggacuuuggcucaauugguggaguauuuacgagcguuggcaagcucguacaccagguauuugggacagcuuauggcgugcuuuucucaggcguguccuggacgaugaagauaggaauuggaauuuuauugacuuggcucggguuaaacagcaggaguacaucccuaucaaugacgugcauugccguggguaugguaacacucuaucucgguguaauggugcaagcagauucgggaugcgugauaaacuggaaagguagggaauuaaaguguggaucagguauuuuugucacaaaugaagugcacaccuggacagagcaauauaaauuccaagcugauucucccaaacgccuuagcgccgcaauaggaaaagcaugggaagaaggcgugugcgggauucggucugcgaccagacuagaaaauauuauguggaaacagauaucaaaugagcucaaucauauacucuuagagaaugacaugaaguucaccgugguagucggcgaugcuaaugggauauuggcacaggggaaaaagaugauaagaccucaaccuauggaacacaaguauucauggaagucauggggaaaagcuaaaaucauuggagccgacauacaaaauacaacauuuauuauagacggcccagacacaccagaaugcccagacaaucaacgugccuggaacauaugggaaguggaagacuauggauucggcauauucacuacaaauauuuggcucaaauugcgagacucguauacucaaaugugugaucacaggcuaaugagugcagcaauuaaagacuccaaagcaguccacgcugacaugggauauuggauagaaucggaaaagaacgagacuuggaaauuagcuagagccuccuucauagagguaaaaacaugcacuuggcccaaaagccauacauuauggucuaauggaguuuuagaaagcgaaaugaucauucccaagaucuacggcgggccaaucagccaacauaauuaucgaccaggguacuucacacaaacagcuggaccauggcauuuaggaaaacuagaguuagauuuugauuuaugcgaaggaaccacuguuguaguagacgagcauuguggaaacaggggaccgucacuccguacaacaacuguaacggggaaaauaauacacgagugguguuguagaucauguacucuaccacccuugagguuuagaggagaagacggcugcugguacgguauggaaaucagaccagucaaagaaaaagaggagaauuuaguaagaagcaugguaucagcaggaucaggagagguagacucuuuuucuuuagggauccuaugugcaucuaucaugauagaagaaguuaugcgcucaagauggaguagaaaaauguugaugacaggcacccuggcaguauucuuacucuugaucaugggacaauuaacauggaaugaucuaauacggcuuuguauaaugguuggagccaaugcgucugacagaaugggcauggguaccaccuaucuagcgcuaauggcgacguucaagaugcguccaauguuugcaguaggacuucuauucagacgacucacaucaagagaaguacuucugcucaccauaggauuauccuugguugcuucuguagaauuaccgaauaguuuagaagaacugggcgacggauuagcaaugggaauuaugauguugaaauugcugacagaguuccagccacaucaacuauggaccacucugcuuucguuaacuuuuauaaaaacuacacuaucauuagacuaugcauggaaaaccacggcuauggcgcuuucgauuguaucacuuuuuccauuaugcuuaaguacaaccucucagaaaacuaccugguuaccaguauuacuaggaaguuuuggaugcaaaccucucacaauguuccuaauuaccgaaaauaagauaugggggcgaaagucauggcccuuaaaugagggaauuauggcgauaggaauaguaucgaucuugcugagcucucuccuaaagaaugacgucccauuagcgggaccguugauagcgggaggaaugcuaauugcauguuacguuauuagugguucuagugcugauuuaucgcuggaaaaagccgcagaaguaagcugggaacaagaagcagaacauaguggaaccagucauaauauacuuguugaaguccaagacgauggcacuaugaagauaaaggacgaggaacgugaugacacucugacuauuuuauuaaaagccaccuuauuggccgugagcgguguauauccgauguccauaccugcaacacuuuucgucugguauuucuggcagaagaagaaacaaaggucaggagucuuaugggauacuccaaguccaccagagguagaaagagccguacuggaugauggaaucuauagaauauugcaaagaggacuauuaggucgaucucagguugguguagguguguuccaagauggcgucuuccacacaauguggcauguaacgcgcggagcuguuuuaauguaccaaggaaaaaggcuagagccaaguugggcauccguaaagaaagaccuaauauccuauggagguggauggagguuccaaggcucuuggaauacaggcgaagagguacaaguaaucgcuguggagccgggcaaaaauccuaaaaacguucaaacaacucccggaacuuucaaaacucccgagggagaaguuggagcuaucgcacucgauuucaaaccaggaacaucgggaucaccgauuguaaaucgagaagggaaaauagugggguuauacgguaacgguguagugacaaccaguggaacauacguuucggcuauagcacaggccaaagcaagucaagaagguccgcugccagaaauagaagacgagguguuuaagaaacgaaaucuaacgaucauggacuuacacccaggaagugggaaaacacgaagguauuuaccagcuaucguacgcgaagccauuaaacgcaaauuaagaacucuaauucuagcuccgacucgagugguggcaagcgagauggcugaagcucugaaaggaaugccaauucgguaucaaacgacagcaguaaaaucugagcauacuggaagagagauuguagauuuaaugugucaugcaacauucacaaugcgccugcugaguccaguccgggucccaaauuacaauaugaucauaauggaugaggcacauuucacagauccagcaaguauagcugccaggggauacauaagcacuaggguggguaugggugaggcugcggcaauuuucaugacagcuacgcccccugguuccguagaggcuuuuccacaaucuaaugcggucauucaagaugaagaacgugauauuccagaacguucauggaacucaggauaugauuggaucacugauuuuccugguaaaacaguaugguucgugccauccauaaaaucuggaaaugacauagcaaauugccuucgcaaaaaugguaaaagagucauccaacuaucacguaaaacauuugauacggaauaccagaaaacgaaaaauaaugauugggauuauguaguaacgacagacauaucagaaaugggggcgaauuuuagagcggauagagucauagacccucgacguugccuaaaaccaguaauauuaaaggauggcccugaaagagugauacuugcagggccuaugcccgucaccguagcaucagccgcacagagaagaggaagaauuggcagaaaccaaaauaaggaaggagaucaguacgucuacaugggacaaccauuaaacaaugaugaagaucacgcucauuggacugaagcuaaaauguuauuagauaauauaaacacaccggaagguauaaucccagcacuguucgaaccagaaagggaaaagagugcagccauugauggagaauauagacuaagaggugaagcuagaaagacauuuguagaguuaaugcgaagaggugaccuccccguuuggcuaucguacaaaguagcgucugaaggauuucaauauagugacagaagauggugcuuugacggagaaagaaauaaucaaguucuagaggaaaauauggacgucgaaauuuggacaaaagagggugagaggaagaaauuaaggccaagguggcuugacgcaaggacauacagugauccucuugcgcugagagaguucaaagaauuugcagcagggcgcagaucagucucaggcgaccuaauauuagaaauugguaaacucccgcagcaccugaccuuacgcgcacaaaacgcacucgauaacuugguaauguuacacaacucagaacaaggugguaaggcuuacagacaugcaauggaagaacugcccgauaccauugaaacguuaauguugcuugcccuuauugcaguauuaaccgggggagucacauuauucuuucuuaguggaaaaggauuggguaaaaccucaauaggguuacugugugugacugcuagcucggcuuuacuauggauggccucuguagagccucacuggauugcagcgaguaucauacuggaguucuuucugaugguacuucugauuccagaaccugauaggcaaagaacuccccaagauaaucaauuagcguacguugucauaggccuuuuauuuaugauccuuacaguugcugcuaaugagauggggcuccuugaaacgaccaagaaagaccuugguaucggucauguagcagcagaaaaccaccagcaugcaaccauguuggaugucgaccuaagaccugccuccgcauggacauuauaugcaguggccacuacaguuauaaccccaaugaugagacauacgauagagaacacaacagcaaauaucagcuuaaccgcaauugcaaaucaggcggccauauuaauggguuuagauaagggcuggccaaucucaaaaauggacauuggagugcccuuauuggcauuagguugcuacagucaagucaacccucucacccugacagcagcaguacuaaugcuaguagcccacuaugcaauuaucggacccgggcuucaagcgaaagcgacgcgugaagcacagaaaagaacugcugcagguauuaugaaaaauccaacaguugaugggauaguagcgauagacuuagauccgguuguauaugacgccaaauuugaaaaacaauuaggacagaucauguuauuaauauuauguacaucccaaauacuucuuaugcguaccacuugggcauuaugcgaaucaauaacccuagcuacaggaccauuaacaacauuaugggaaggaucaccugggaaguuuuggaacacaacgauugcggucucuauggcaaacauuuuucgugguagcuauuuggcaggagcuggccuagcauucagucucaugaaaucacuagggggaggacgccggggaacaggggcacaaggugagacacuuggggaaaaauggaaacgucagcuaaaccaauugucuaagucagaauuuaacacauauaaacgguccggaauuacagaaguggauagaucagaagcaaaagaaggucugaaacgaggagaaacaacuaaacaugcagugucgcgaggaacagccaaauuacgaugguuugucgagagaaaucuaguaaaaccagaagggaaaguaauagaucugggguguggacgaggaggcuggucauauuauugcgccggacuuaagaaagugacagaaguuaaaggcuauacaaaaggaggcccaggacacgaagaaccgauaccuauggcaacguaugguuggaaccucguaaaguuacauucagguaaggacgucuucuucaugccaccugagaaaugugauacauuacuaugugauauaggggaaucaucuccuaacccaacuaucgaagaagggcguacacuucgaguacuaaaaauggucgaaccauggcugagaggaaaucaauucugcauaaaaauuuuaaauccauauaugccuucaguaguagaaacauuagaacaaaugcagcgcaaacauggaggaaugcuugugcgcaauccauuaaguagaaauaguacccaugaaauguauuggguuucaugugggacagggaauauuguaucugcuguaaauaugacaaguaggaugcuacuaaaucgcuuuacaauggcacacagaaaaccuacauucgaaagagauguagauuuaggagcagggacuagacauguagcuguagaaccggagguugccaaccuagauaucauaggccaacguauagaaaauaucaagaaugaacauaaaucuacuuggcacuaugaugaagauaauccguacaaaaccugggcuuaucacggaucauacgaaguuaaaccaaguggaucggcuaguagcaugguaaauggaguaguacgucuuuugacuaaaccaugggauguaauuccaaugguuacacaaaucgcgaugacagauacuacuccguuugggcagcaaaggguuuucaaggaaaaaguggauacuagaacaccaagagcuaaacgaggaacaacccaaauaauggaaguaaccgccaaauggcuguggggguuucucucuagaaauaaaaagccaagaauuuguacucgcgaggaguucacaaggaagguaaggucuaaugcagcaaucggugcgguauucguugaugaaaaccaauggaacuccgccaaggaagccgucgaggacgaaagauuuugggaucuugugcaccgugaacgagaacuccauaaacagggcaaaugugcaacauguguuuauaacaugauggggaaacgugagaagaaacuuggagaguucggcaaggcuaaaggcuccagagccaucugguauauguggcuaggcgcgcguuuccucgaguuugaggcauuaggauucaugaaugaagaucacugguucucgcgagaaaauucauuaaguggaguagaaggugaaggucuucauaaacuaggcuacauacucagagauaucaguaaaauaccagggggaaauauguaugcagaugacacagcaggcugggacacacggauaacagaggaugaccuucaaaaugaggcaaaaaucacagauaucauggaaccugagcaugcccuauuggcgacuucaauauuuaagcucacauaccagaauaaagucgugagaguacaacggcccgccaagaauggaacagucauggauguaauuucgagaagggaucagagggguaguggacaaguuggaacguaugguuuaaauacauucacaaauauggaaguacaauuaaucagacagauggaaucugagggaauauuuuugcccucggagcucgagacgccaaaccuagcugagaggguauuagauugguuagagaaacacggagccgagcgucuuaaaagaauggcuauauccggagacgauuguguaguaaaaccaauugaugauagauuugcaacugcguugaccgccuugaaugauauggguaaagugcgcaaggauauuccccaaugggaaccuucgaagggguggaacgacuggcaacaggucccauuuugcucacaccacuuucaccagcugauuaugaaggacggacgagagaucguuguucccugcaggaaccaagaugaauuagugggucgagccagagugagccaaggggcagguuggagucuaagagaaacagcguguuuagguaaaucguaugcccaaauguggcagcuaauguauuuucauaggagagaucuacggcuggcagcaaaugcaauuuguucagcuguuccaguugauuggguaccaacuagccgaacuacguggagcauacacgcccaccaucaguggaugacaacagaagacauguuaucgguuuggaauaggguauggauagaggaaaauccguggauggaagauaaaacgcacguaucuaguugggaagaaguacccuaucucgggaaaagagaagaucaauggugugguucuuuaauuggauuaaccgcaagagcgacaugggcgacaaauauccaaguagccauaaaucaagucagaaggcugauugggaaugaaaauuauuuggacuacaugacaaguaugaaaagauucaaaaacgaaucagaccccgaaggugcgcucugguaa

SEQ ID NO: 21274 - RNA, 9879 nt, Artificial Sequence
  derived and/or modified CDS sequence (opt6) from DENV-1__KJ189323__SS-prME
ucaguuaccauguugcuuaugcugcugccaacagcacuagccuuucaucucacaacaagagguggagaaccacauaugaucguauccaaacaagaaagaggaaaaagucuacuguucaaaacgucagcugggguaaacauguguacgcucauagcuauggaucuuggagaacuaugcgaagauaccaugacauauaaauguccacaaauaacagaagcggaaccagacgaugucgauuguugguguaaugcaacggauacauggguaacauauggcacauguucacaaacgggagaacacagaagggauaaaagaucgguugcuuuagcgccacacguaggacugggacuagaaacucgaacagaaaccuggaugaguagcgaaggggcguggaaacaaauucaacgcguugaaacaugggcauuacggcacccaggguuuacaguaauagcgcuauuccucgcacaugccaucggcacgucaaucacacaaaaaggaaucaucuucauacucuuaaugcuagucacaccaaguauggccaugcguugugucgguaucggaaacagagacuuuguggaaggauuauccggggcaacguggguagaugucguacuagaacacggcaguugcguuacaacaauggccaaaaauaaaccaacucuugauauagaacuuuuaaaaaccgaagugacaaaccccgcuaucuuaagaaaacuauguauugaagcaaaaauaagcaacacgacgacugauucaagaugcccgacucaaggagaagcaacuuuaguugaggagcaagaugcaaacuuuguuuguaggagaaccuuugucgauaggggauggggaaacgguugcggccuuuuugggaaaggcagcuuauuaacuugugcuaaauucaaauguguuacgaaacuggaagggaaaauuguacaauacgaaaaucuuaaauauucaguuaucguuacagugcacacaggugaccaacaucaggucggaaacgagacuacagaacacgguacgauagcaacuauaacaccacaggcaccuaccagugaaauccaauuaacugacuauggugcacuuacucuagacuguucuccgcgaacgggccuagauuucaaugagauggucuuauugacgaugaaagagaaaucguggcuuguucacaaacaaugguuuuuggacuuaccccuacccuggacaucuggagcuucuacaucacaggagacauggaaccggcaagacuuacuugugaccuuuaaaaccgcacacgcaaagaagcaggaggucgucguacugggcucccaagaaggggcaaugcauacagcacugacaggagcaacagagauucagacaucaggcaccacgacaauauucgcaggucauuuaaaaugcagacuuaaaauggauaaauugacguugaagggaacguccuacguaauguguacaggcccguuuaaacuagaaaaagaagucgcugaaacucaacaugguacaguucuaguccagguaaaguaugaggggacagaugccccguguaaaauaccauucucgacacaagaugagaagggcguuacacaaaaugggcgucuuaucacggcaaacccaauaguaacugacaaggagaaaccuguaaacauagaaacagaaccuccuuuuggcgaaaguuauauagugguuggcgcgggcgaaaaggcucucaaacuauccugguuuaagaaaggcuccagcauaggcaaaauguuugaagcaacagcucgcggagcgcgacguauggcuauuuuaggagauacagcaugggauuuuggaucgauuggcggcguguuuaccucuguaggaaaguuaguucaccaaguuuuuggaacagcguacgguguauuauuuucaggcgugagcuggacuaugaaaauaggaauuggaauuuuacuaacauggcuuggacuaaauucuagaucuacaucgcuuuccaugacguguaucgcaguaggcauggugaccuuguaucuaggggucaugguucaagcagauagugguugcgucaucaauuggaaagguagagagcuaaaaugugggucaggaaucuucguaacaaaugaaguacacacauggacagaacaauauaaguuucaagcugauucacccaaaagacucagcgcggcaaucggaaaagccugggaggaagguguuuguggcauacguucggcaaccagauuagaaaacaucauguggaagcaaauaagcaacgaguuaaaccacauacucuuagaaaaugauaugaaguuuacaguggugguaggugacgcaaacgggauauuagcgcaaggcaagaaaaugaucagaccccaaccaauggaacacaaauacaguuggaaaucguggggcaaagccaagauuauaggugcagauauccagaacacaacguucauaauagauggcccggauacgccggaguguccugauaaucaacgagccuggaacauaugggagguagaagacuaugguuuugguauuuuuacgaccaacauuuggcucaaacuaagggauucguauacacagaugugcgaucaccgcuuaaugagugccgcaaucaaggacaguaaggcgguacacgcugauaugggcuauuggauugagucugagaaaaacgagacauggaaauuagcccgugcuucuuucauagaaguaaaaaccugcacuuggccuaagucgcacacgcucugguccaaugggguauuagaaucugaaaugauaauuccuaaaauauauggaggcccuauaucccaacauaauuacaggccaggauacuucacucaaacagcuggacccuggcaucuugguaaacuagaauuggacuuugaucuaugugagggaacuacuguagugguugacgaacauugcgguaaucgagguccuagucuaagaacaacuacagugacuggcaaaauaauacaugaaugguguuguaggucauguacucuacccccauugagauuuagaggggaagacggguguugguauggaauggaaauaagacccguaaaagaaaaagaagagaaucuagucagaucuauggucagugcugguucuggagaaguggacuccuucagucucggaaucuuguguguuucaauaaugauagaagaaguaaugcgaaguagauggagccgcaaaauguuaaugacaggcacgcuagcgguauuucuacugcuugucaugggucaauuaacauggaacgauuugauuagacuguguauaauggucggugcgaaugcgagugaccguauggguauggggaccacuuauuuagcccucauggcgacauucaaaaugcgucccauguuugccguaggcuuacuauuuagacgucuuacgucaagagaaguuuuacucuuaaccaucggacucucauuaguggccucggucgaacucccaaacagccuagaagaacuaggagauggacucgcaaugggaauuaugauguuaaaacuacuuaccgaauuucaaccacaccaauuauggacgacuuuacucucauugacauuuauuaagacuacuuugucauuggacuacgccuggaaaacuaccgcaauggcauuaucuauuguuagccuuuucccauuaugucuaucuaccacuucccagaaaaccacuuggcucccuguuuuauuggggucguucgguugcaaaccacugacaauguuccugauaaccgaaaauaaaaucuggggaagaaaaucuuggcccuuaaacgagggcauuauggcgauuggaauaguaaguauucuuuugucaucauugcuaaagaaugacguaccauuagcugguccauuaauagccgggggaauguugauagcuuguuacgucauaucaggcaguucagcagauuugagucuagagaaagcagcagaagucucgugggaacaagaagcagaacacucaggaacaagucacaacauccuaguagaaguucaagacgacggaacgaugaaaaucaaagacgaagaaagagacgauacacuuacaaucuuauuaaaagccaccuuacuagcaguuucgggagucuauccaauguccaucccagcaaccuuauuuguaugguauuucuggcagaaaaagaaacagaggucugggguuuuaugggauacaccaucuccaccagagguugagagggcagugcucgaugauggaauuuauagaaucuuacaaagaggacucuugggccgcagucaaguaggugugggagucuuccaaggagguguauuccauacaauguggcacgucacacggggcgcuguccuuauguaccaagggaaaagguuagaaccgucaugggcgucagugaagaaagauuuaauaucuuacggcggaggauggcguuuucaaggaagcuggaauaccggugaagaaguucaaguuauugcaguggaaccagggaaaaaucccaaaaauguccaaaccacaccgggaacuuuuaaaacuccagagggcgaaguaggggcaauagcuuuagacuucaaaccugguaccagugguucaccuauugugaaucgagaagggaaaauuguaggguuauacgguaauggcguagugacaacuucaggcacuuacguuucugcaauugcgcaagcuaaggcuucacaagaaggaccguugcccgaaauagaggaugaaguauucaagaaacgaaaucuaaccaucauggaucugcauccugguuccggaaaaacaagacgauauuuaccugcaaucgugagagaggcuauaaagagaaaacuucgcacucuaauucuggcacccacgagagucguugccagugagauggcugaagccuuaaaggguaugccgauaagauaucagaccacagcaguaaagagcgaacauaccggcagggagauaguugaucucaugugucacgcuacauuuacuaugagacuacuuuccccaguacggguaccgaacuauaauaugauaauaauggacgaagcucacuuuacagauccugcuucuauagcugcaagaggcuauaucaguacgaggguuggaaugggugaggccgcagccauauuuaugacagcuacgccaccuggaucaguagaggcuuucccccaaucaaaugcagucauacaagaugaggaaagagacauccccgaacgaagcuggaauaguggcuacgauuggauaacggacuuuccugggaaaacaguuugguucguaccuaguauaaaaucugggaaugauauagccaauugucuaaggaagaaugggaaaagaguaauacaauuaucaagaaaaaccuuugauacugaguaucagaaaacuaagaauaacgauugggacuauguugucacaacagauauaucggagaugggugcgaacuuuagagcagauagaguaauagaccccaggcgguguuugaaaccuguaauacuaaaggauggcccugaacgggugauauuagccggcccaaugcccguaacaguugccucagcugcccaacgcagggguaggauugggcguaaucagaacaaggaaggagaccaauacguauacaugggacaaccacucaacaacgacgaggaucacgcacacuggacagaagccaagauguuacuagacaacauaaauacaccggaaggaauaauuccagcuuuguuugaaccagaaagggaaaaaucagcugcgauugauggagaauauagauuacguggagaggcacgaaagacuuuuguugagcuaaugaggagaggagaccuaccagucugguuauccuauaaagucgcuagugagggguuccaauauagugacagacgaugguguuuugauggagagcgaaauaaucaaguacuagaagaaaacauggacguagagauuuggaccaaggaaggggaacgaaagaaacuaaggccacguuggcuugaugccaggacauacagcgacccacuugcacugagagaguuuaaagaguucgcagcuggacgacggucaguuagcggagacuuaauauuggaaaucggaaaauuaccacaacaccuuacccuacgcgcccaaaacgcacuugauaaccuaguuaugcuacacaacucugaacaaggggguaaagccuaucgucaugcaauggaagaguuacccgauacaauugaaacgcuaaugcuucucgcccuuauugcaguacugacgggaggaguaacguuauucuuuuuaucuggcaagggccuaggaaagacaagcaucggauuauugugcguuacugcuagcagugcacuauuauggauggccagugucgaaccacauuggauagcagcaaguauaauauuagaguucuuuuuaaugguccuacuuaucccugaaccagaucgacaaagaaccccgcaagacaaccaacucgcuuacguuguaauaggacuacuauuuaugauucuuaccgucgcagccaaugaaaugggccucuuagagacuacaaagaaggaucuuggaauaggacauguagcugcagaaaaucaccaacaugccaccauguuagacgucgauuugcgccccgcaucugcauggacguuauacgcagucgcaacaaccgucauuacccccaugaugagacauacaaucgaaaacacaacggcuaauauuuccuuaaccgcaauagcaaaccaagcagcaauauuaaugggauuagauaagggauggccaauaucuaaaauggauauuggugugccucuacuagcuuuagguuguuauucacaagucaacccucugacacuaacugcggcaguacuaaugcuuguagcacacuacgcuauuauaggaccagggcuucaagcaaaagcaacacgagaggcacagaaaagaacagcggcaggcaucaugaaaaauccaaccguugauggaauaguagcgauagauuuagauccuguuguauacgaugcuaaguucgagaaacagcuaggacaaauuaugcuacuaauauugugcacuucacaaauacuucuaaugcgaacaacuugggcguuaugugaauccauaaccuuagcuacaggaccgcuaacuacccuuugggaaggaucucccggaaaauuuuggaauacaacaauugccguuuccauggccaacauuuuccgcgggucuuaccuagcuggugcaggauuagcauuuucacugaugaaaucucugggaggaggaagaagaggaacuggugcccagggagaaacgcuuggagaaaaauggaaacgucaguugaaucaauugucaaaaagcgaguucaauacguauaaaaggucugguauuauggaaguagauagaucagaagcuaaagaaggauuaaaaaggggagaaacgacuaaacacgcagucucacgaggaacagcuaaauuaagaugguuuguugagagaaauuuagugaaaccugagggcaaaguuauugaucuagggugcgggagaggaggcuggaguuauuauugugcagggcuaaagaaaguuacagaaguaaaagguuauacaaaggguggaccuggucaugaagaaccuauuccgauggcaacauauggauggaaucugguuaaacugcauuccgguaaagaugucuuuuucaugccaccagaaaaaugcgauacuuuauuaugugacauuggggagucuagucccaacccgaccauagaagaaggaaggacuuugagaguacugaaaaugguagaaccuugguuacguggaaaccaauuuugcaucaagauuuuaaacccguacaugccauccguaguugagacgcuggaacaaaugcaacgcaaacauggaggcaugcuuguccgaaauccacugucuagaaauaguacccaugagauguacuggguaucuugcggaacuggaaauaucguaucggccguuaacaugacaagccgaaugcuacuaaauagauucacaauggcacaccgaaagccaaccuacgaaagagaugucgacuuaggagcuggcacaagacacguugcuguagaaccagaaguagcuaauuuagauauaauagggcaaagaauugaaaauauaaagaaugagcacaagucuacuuggcauuacgaugaagacaauccuuacaaaacuugggcguaccaugguucauacgaaguucgcccgucgggcucugcuaguucuauggugaaugggguugucagacuguuaaccaaaccaugggacguaauaccuaugguuacacaaauagcaaugacugauacaacuccauucgggcaacagcguguauucaaagaaaagguggacacgcggacaccaagggcaaagcguggaacuacacaaaucauggagguuacagcaaaauggcuuuggggcuuccuaucgaggaauaagaaaccucgcaucuguacacgagaagaguucacuagaaagguacguucaaaugcagcaauaggagcaguguuuguagacgaaaaucaauggaacuccgcaaaggaggcgguagaagaugagcgauucugggauuuaguccaucgagaaagagaauuacauaaacaaggaaagugugcaacuuguguauauaauaugaugggaaaaagagagaaaaaguuaggcgaauuuggaaaggccaaagguuccagagcaaucugguauauguggcuuggugcaagauuucucgaguucgaggcauugggauuuaugaaugaggaccauugguuuagcagagaaaacucuuuaucgggcguagaaggugaagguuuacauaaacuaggauacauauugagagacauuucaaaaaucccagguggaaauauguaugcagaugauacagccggaugggacacgagaauaacugaagacgauuuacaaaacgaagcaaagauaacagagauuauggaaccugagcaugcguuacuugcgaccucgauauuuaaauuaacuuaucaaaauaaaguaguucguguacagaggccagcaaagaaugguacaguuauggauguaauuucgcguagagaucaaagagguucuggucaaguagguacguacggacuaaacacauucacuaacauggaaguucaacuaauacgacaaauggagucagaagguauuuuucuuccgucagagcuggagacucccaaucucgcggaaaggguacuagauugguuagaaaaacauggcgcggaacgacuuaagcgcauggcaaucucgggugaugauugugucguuaaaccgaucgaugauagauucgcuacagcacuuacggcacugaacgauauggguaagguaagaaaagauauaccccaaugggaacccucaaaagguuggaaugauuggcaacaagugccauucuguagccaucauuuucaucaacuuaucaugaaagacggacgugaaauuguaguuccuugccgaaaucaggacgaacugguuggccgcgcacgaguaagucaaggcgccggguggaguuuaagagaaacugcuuguuuaggcaagagcuaugcacaaauguggcaguugauguauuuucaucgaagggaccucaggcuugcugcaaaugcaauuugcucagcagucccaguggauugggugccuacaucgcgaacgacuuggaguauacaugcacaccaucaguggaugacaaccgaagacauguuauccguauggaauagaguguggauugaagaaaauccauggauggaagacaaaacacauguaaguaguugggaagagguaccuuauuugggcaaacgagaagaccaauggugcggcucccuuauaggguuaacagcacgagcaacaugggcaacaaacauacaaguggcuauuaaccaaguuagaagauugauaggaaaugaaaauuaucuugauuauaugacaagcaugaagcguuuuaaaaaugaaagcgacccggagggagcccuaugguga

SEQ ID NO: 21275 - RNA, 9879 nt, Artificial Sequence
  derived and/or modified CDS sequence (opt6) from DENV-1__KJ189324__SS-prME
ucaguaacuauguuacucaugcuuuuacccacugcacucgcuuuucauuuaaccacuagaggcggagaaccacauaugauaguuaguaaacaagaaagagguaaaaguuuacuauuuaaaacaucagcugguguaaauauguguacguuaauugcaauggaucuaggcgaacuaugcgaagauacuaugacuuauaaauguccccaaauaacugaagcggaaccggaugacguugacugcugguguaaugcgacggauacauggguuacguacgguaccugcucacaaacaggggaacaucguagagacaaacgcucgguggcguuggcuccgcacgugggauuggguuuagaaacgagaaccgaaacuuggaugucaucugaaggugcuuggaaacaaauucaaagaguagaaacaugggcucuacgacauccggguuucaccguuauagcgcucuuuuuagcucaugcgauaggaacgagcauaacucagaaaggaauaauauuuauauugcucauguuaguuacuccaucgauggcgaugcgcuguguaggaaucgggaaucgagacuucguagaaggacugucaggagcaaccuggguagauguaguccucgaacauggaucaugcguaacgacaauggcgaaaaauaaaccuacacuagacauagaacuauugaaaacagagguaacuaacccagcuauacuccggaaauuguguauugaggcgaaaauuagcaacacaacuacugauucaagauguccaacucagggugaagcuacgcugguagaagaacaagacgcaaauuucguuugccgacgaacuuuugucgaucguggaugggguaauggguguggccuauuugguaaagguucacuauuaacaugugcuaaauuuaaauguguuacuaaauuggaaggaaaaauaguacaguaugaaaaucuaaaguacucaguuauaguaacaguacauaccggggaccaacaucagguuggaaaugaaacaacugaacauggaaccauugcgacaauuacgccucaagcacccaccagcgaaauucagcugacugauuauggagcauuaacacuagacugcaguccaagaacuggguuagauuucaaugaaaugguucuauuaacgaugaaagaaaaguccugguuaguucauaaacagugguuuuuagauuuaccacuaccauggacaagcggagcuuccacgucgcaagaaaccuggaacagacaggaucuauuaguaaccuuuaaaacagcacacgccaagaaacaagaaguuguaguacucggaucacaggaaggggccaugcauacugcauuaaccggcgcaacagaaauacaaacaaguggaacuacaacuauauuugcgggacacuuaaaaugcagauugaaaauggacaaacucacguuaaaaggaaccuccuauguaauguguacagggaguuucaaacuugagaaagaaguagcagaaacacagcacgguacagugcuaguucaaguaaaguacgaaggaaccgaugcgccauguaagauacccuucaguacucaagaugaaaaaggaguaacccagaacggccgucucaucacagcaaacccuauuguuacagauaaggaaaaaccgguuaauauugaaacugagccgccguucggcgagucauauauaguugucggugcgggcgaaaaagcacugaaguuauccugguuuaagaagggauccucgauaggaaagauguucgaagcaacagcgaggggagcacgaagaauggccauuuuaggcgacacagcuugggauuucggaucuauagguggcguguuuacaucaguagguaaguuaguacaccaagucuuugguacagcuuaugguguauuauucaguggugucuccuggacaaugaaaauagguauagggauucuguuaacuuggcucggacuuaauucgcgaucuacgaguuuaucaaugacaugcauagcagucggcauggugacuuuguaucugggaguuaugguucaagcagacucaggcugcguaauaaauuggaaaggacgggaauuaaaaugugguucuggcauuuucgucaccaaugaaguccauacuuggacagaacaguauaaguuucaagccgacaguccaaaacgacuauccgcagcaauagggaaggcgugggaagaagguguguguggcauacgcucggccacacgcuuagagaacauaauguggaaacagaucucgaaugaacugaaccauauucuauuggaaaaugauaugaaguucaccguuguaguaggggaugcaaauggaaucuuagcucaaggcaagaaaaugaucaggccccagccaauggaacauaaguauaguuggaagaguugggguaaggcaaaaauaaucggagcagauauccaaaacacuacauuuauaauagaugggccugacacaccagaaugcccagauaaccagagggcuuggaauauuugggaaguugaagacuacgguuuugggauauuuacaacgaauauauggcugaaguugcgugauucauauacccaaaugugugaccaucggcuuaugucagcagcuauuaaagauucgaaggcuguacacgcagauaugggauauuggauugaaagugaaaagaacgaaacuuggaaacuugcgagggcuagcuuuauugagguuaaaacuuguacauggccgcguucccauacuuuauggucaaauggugugcucgagucggagaugauaauaccuaaaauuuacggagggcccauaucacaacauaacuaccgcccugguuacuucacgcaaacggcaggcccuuggcacuuagguaaauuagaacuugacuuugauuuaugcgaggguacgacagucgucguagacgagcacugugguaaucguggccccagccuaaggacaaccacaguaacaggaaaaaucauacacgaauggugcugcagaucauguaccuugccuccguugagauuucgcggagaagauggcugcugguaugguauggaaauucgaccgguuaaggagaaagaagaaaaucuaguaaggaguaugguaagugcgggguccggugagguagauucguuuagucuugggauucuuugugccagcauaaugaucgaagaaguaaugagaucaagauggagcagaaaaaugcucaugacagguacucuagcaguauuccucuuacucguuauggggcaauuaacguggaaugauuuaauaagauuauguauuaugguaggugccaacgcaucugacagaaugggaaugggaacuacuuaucuggcauugauggcaacguuuaagaugaggccuauguuugccgugggccuauuguuucgaagauuaacaagccgagagguccuacuuuuaacaaucggauuaaguuuaguugcuucuguagaauuaccaaacuccuuagaagaacuaggggauggacuugcuaugggcauaaugaugcuaaaacuauugacugaauuucaaccucaccaguuauggacaacacuauuaucucuaaccuucauaaaaacaacacugucacucgacuaugcauggaaaaccacagccauggcgcuaucaaucguuagccucuucccccuaugcuuaaguacuacuucgcagaagacaacaugguuaccagugcuauuggguaguuuuggauguaagccacucacaauguuucuaaucacagaaaauaaaauaugggggcguaaaaguuggccuuuaaacgaagguauuauggcuauagguauaguaucaaucuuacucucgucacuguuaaagaaugauguuccuuuagcgggaccacuaauagcgggugguaugcuuauugcauguuacguaaucucaggaucuucagcagaucuuagccuagaaaaagcagcagaaguuucaugggaacaggaagcagagcauucggggacaagucauaauauauuagucgaaguccaagacgauggaaccaugaaaauuaaagaugaagagagagacgacacauugacgauccugcuaaaagcuacacuacuagcaguaagcgggguuuauccaaugucgaucccagcgacucuguuuguaugguacuuuuggcagaaaaagaaacaaagaagcggaguccugugggacacuccaucaccgccagagguggaacgagcugucuuagacgacggaaucuacagaauccuucagaggggacuccuuggccguucgcaaguugguguagggguauuccaagaugguguauuccauacaauguggcaugucacuagaggugcgguguuaauguaucaagggaaaagauuggagccuuccugggcuagugucaagaaagauuuaauaaguuacggaggggguuggagauuucaaggaagcuggaauacgggugaagaaguucaagucauagcgguugaaccuggaaagaaccccaaaaacguacaaacuacaccagggaccuuuaaaaccccagaaggugaaguuggagcaauagcacuugacuucaagccgggaacaagcggaagcccuauaguaaauagggaagguaaaauaguuggauuauacgguaauggugugguuacaacuucagguacuuauguaagugccauugcacaggcgaaagcgucacaagaaggucccuugccagaaauugaagaugaaguauucaagaaacgaaauuuaacaauaauggaucuccauccagguagugguaagacaagacgauacuugccugcgauugucagagaggcgaucaaaagaaagcugcggacauuaauauuagccccuacucgcguuguagccagugaaauggcagaggcccugaaaggaaugccuauacgauaccaaacaacggcgguaaagagugaacacacaggacgagaaauaguggaucuuaugugccaugcgacuuuuacaaugcgacuacuaagucccgucagggugccaaacuauaacaugauuauaauggaugaggcucacuuuaccgauccggcuucaaucgcugcacguggguacauaagcacacggguaggcaugggagaagcugcagcaauuuuuaugaccgcuacaccacccggcagcgucgaagcguuuccacaaaguaacgcagugauccaagaugaggagagagacaucccagaacguagcuggaacuccgguuaugacuggauaacagacuucccaggaaagaccguaugguuuguuccaucgauaaaauccggaaacgauauagcaaauugccugaggaaaaauggaaaacgcgugauacaauuaagucguaaaacauuugacacugaauaucagaaaaccaaaaacaacgacugggacuacgucguuacaacagacauaucagagaugggcgcgaauuucagagcugacagagucauagaccccaggcguugcuuaaaaccgguaauccucaaagauggcccagaaagaguaauauuagcaggaccgaugccaguuacgguggcuucagcugcacaacgcagaggaagaaucgggcguaaucaaaauaaagaaggagaccaguauguuuacaugggucagccguuaaauaacgaugaggaccacgcacauuggacagaagcaaaaaugcuauuggacaacauaaacacaccagaaggaaucauuccagcucuuuuugaaccggaacgugaaaagucagcagcgauagauggcgaauacagguuacgaggugaagcuaggaaaacauucguugaacuaaugaggcggggcgaucuaccuguaugguuaaguuauaaaguggccuccgaggguuuucaauacucugaccgaagaugguguuucgacggggagcguaauaaucagguacuagaagagaacauggauguagaaauauggacuaaagagggagagcgcaagaaauuaaggccaagaugguuagaugcuagaacguauucggacccauuagcgcugcgagaguucaaagaguucgccgcagguagaaggaguguaaguggagauuuaaucuuggaaauaggaaaacuuccacaacauuuaacguugagagcacaaaaugcuuuagacaaccuuguaaugcuccacaacucagagcaaggagguaaagcguauagacacgcgauggaagaacuaccggauacaaucgagacccuaauguuacuugcucuuauugcaguccuaacagguggagugacguuauucuuuuuaagcggaaaaggguuggguaagaccaguauugggcuguuguguguuacugcuucaucagcgcugcucuggauggccaguguugaaccacauuggauagcugcaucaaucauccucgaguucuuucuaauggugcuuuuaauuccagaaccggaccgacaaagaacuccacaggacaaccaacuagcauacgugguuaucggucuguuauuuaugaucuuaacaguagcagcuaaugaaaugggauugcucgaaacuacuaaaaaggaccuugguauaggacauguugcagcggaaaaccaucaacaugcaacaaugcuugauguagauuuacggccagcaagcgcauggacguuauacgcaguugcuacgacugugauaacuccuaugaugcgucacacgaucgagaauacaacagcaaacauuuccuuaaccgcuaucgcuaaccaggcagcaauauuaaugggucuagauaaaggauggccaaucaguaaaauggacaucggaguaccacuucuggcguuaggaugcuauagccaaguaaauccuuugacccuaacagccgcaguacuaauguuagucgcucauuaugcaauuauuggaccgggauugcaagcaaaggcaacgagggaggcccagaaacggacggcagcgggcauaaugaagaaucccacugucgacggcauuguagcaauagacuuagauccgguaguauacgacgccaaauuugaaaaacaacucggacaaauaauguuguugauauuaugcacgagccagauucuucugaugcguacgaccugggcacuaugugaaagcauaacauuagcuacagguccguuaacaacucuaugggaaggcucaccugggaaauuuuggaacacgacaaucgcugucucaauggcuaauaucuuuaggggcucauauuuagccggugcaggacuagcauucucgcuaaugaaaucacuuggagggggccgccgggggacgggggcacaaggugagacauugggagagaaauggaagagacaacuaaaucagcucucaaaaagcgaauuuaauacauacaaacguucugggauuauggagguagauagaagugaggcaaaagaggguuuaaaacgaggugaaacaacaaaacacgcaguaucgagaggaaccgcaaaguuacguugguucguugaacgaaaucuagugaaacccgaagggaaagugauagaucucggcugcggacgugggggauggucuuauuauugcgcagggcuaaagaaagugacagaagugaaaggauauacgaaaggaggaccggggcacgaagaaccgauacccauggccacauacggauggaaccuagugaaacuucauucugggaaagacgucuucuucaugccacccgagaaaugugauacccuacucugugauaucggcgaaagcaguccaaacccuacuauugaagaagguaggacccuuaggguuuuaaaaaugguagaaccauggcuucguggaaaccaguuuuguauaaaaauacucaacccuuauaugccauccguagucgagacuuuagagcaaaugcagcgcaagcauggaggaauguuaguaaggaauccauugagucgcaauucaacacaugaaauguauuggguaaguugugggaccggcaacauugugucagcagugaauaugacgucacggauguuauugaaucgauuuaccauggcgcacagaaagcccacuuaugaaagggauguugauuugggggcggguacaagacauguagcaguugaaccagaaguagccaauuuggauaucauaggacaacguauugaaaauaucaaaaaugaacacaaaaguacauggcauuaugaugaggauaacccauacaagacaugggcauaucauggaucauacgaaguaaaaccaaguggaucugccucgagcauggucaauggugugguaagauuauugacaaaaccgugggacgugauaccuaugguuacacagauugcaaugacggauacuacuccuuuuggccaacaaaggguuuuuaaggaaaaaguggacacaagaacuccccgcgcgaagcgaggaacuacucaaauaauggaaguuaccgcaaaaugguuguggggauucuugucacguaacaaaaagccaaggaucugcaccagagaagaguucacuagaaaaguacguaguaacgcagcaauuggcgcggucuucguagaugaaaaucaauggaacuccgcaaaagaggcuguagaagacgagcguuuuugggacuugguccaucgugagcgggagcuucauaaacaaggaaaaugugcaaccugugucuauaacaugaugggcaaaagagaaaagaaacuaggcgaauuuggaaaagcaaagggaagccgagcuauuugguauauguggcuaggcgccagguuuuuagaauuugaagcauugggcuucaugaaugaggaucacugguucucaagagaaaauagccuuucggguguggaaggggaaggacuacauaaauugggguacauccucagagauaucagcaaaauaccaggaggaaacauguaugccgaugacacagcugggugggacacgagaauuaccgaggacgacuuacaaaacgaagcaaagauuacggaaauuauggagccagagcaugcgcuguuagcaacaaguaucuucaaacuaacauaccaaaauaagguugucagaguucaacgccccgccaaaaaugguacaguaauggauguaauaucuagacgagaccagagagguucuggacaggugggaacauauggucuaaauacauuuacaaacauggaagugcaacuuauaagacaaauggaaagcgaggaaauauuuuugccaagugaacuggaaacuccaaaucuagcugaaagaguauuagacuggcuggagaaacauggggcggaacgcuugaagagaauggcaauaaguggugaugacuguguagucaagccuaucgacgaucgcuucgcaacggccuuaacugcccuaaacgacauggguaaagugcgaaaagauaucccacaaugggaacccagcaaaggauggaaugauuggcaacaaguacccuucugcucucaucauuuccaucaacucaucaugaaagauggaagggaaauuguagucccguguagaaaucaagaugagcuaguagggagagcgagagugagucaaggagcuggguggucccugcgggaaacugcaugucuaggaaaaaguuacgcacaaauguggcaauugauguauuuccacagacgagaucuacgauuggcagcaaaugccauauguuccgcaguaccaguugauugggugcccacaucaagaacaacuuggucaauacaugcccaccaucaauggaugacaacggaagauauguuaagcguguggaaucgaguuuggaucgaggaaaacccauggauggaagacaagacgcacgucucgucgugggaagaaguuccauaucuuggaaaacgugaagaucaauggugcggaucacuuauugguuuaacugcucgggcuacuugggcaacaaauauacagguugcuaucaaucaaguucgucgauuaauaggaaacgaaaacuaucuagauuacaugacuuccaugaagagauuuaagaacgaauccgauccagaaggagcccuaugguaa

SEQ ID NO: 21276 - RNA, 9879 nt, Artificial Sequence
  derived and/or modified CDS sequence (opt6) from DENV-1__KJ189325__SS-prME
ucgguuaccauguuacuuaugcuauugcccacugcucucgcguuccaucugaccaccagagggggagaaccccauaugaucgucuccaaacaagaacgaggcaaaucacuuuuauuuaaaacaagugccgguguaaacauguguacacuuauagcaauggaccucggagaauuaugcgaagacacaaugaccuauaaaugcccacaaaucacagaagcagaaccagaugauguugacuguuggugcaacgcaaccgauaccuggguaacuuauggcacauguucucaaacaggugaacaccgacgagauaaaagguccguggcauuagcaccucauguggguuugggacucgaaacucgcacugaaacuuggaugagcucagaaggagcauggaaacaaauacaacggguagaaacaugggcacuuagacacccuggauucacaguaauugcacuguucuuagcgcaugcaauagguaccucaaucacucaaaaaggaaccauuuuuauauuguuaauguuagucacuccaagcauggccaugcgcugugucgguaucggaaaccgagauuuugucgaaggcuuaaguggcgcaaccuggguagacguuguuuuggaacacgguucuugcguuacaacgauggccaaaaauaaaccaacccuagauaucgaacugcugaaaacagaaguaaccaacccagcaauauuaagaaaauuauguaucgaagcaaaaaucucaaauacaaccacugauucgaggugcccaacccaaggagaagcaacacuuguagaagaacaagaugcaaacuuuguuugccgcagaacguucguagaucgugguugggguaacggcugcggucuguuuggaaaaggaagccucuuaacaugugcgaaguuuaagugcgucacaaaguuagaagguaaaauaguacaauacgaaaauuuaaaauacuccguuauugugaccguucauacgggugaccaacaccaaguggguaaugaaacuacagagcacggaaccauagcuacuaucacaccucaggcaccaacuucagaaauacaacugacugauuauggcgcguugacacuugauuguagcccucggacaggucuagacuuuaaugaaaugguauuacuuacaaugaaagaaaaaucuuggcuaguacauaaacaaugguuuuuagaucucccuuuaccauggaccagcggcgcaaguacaagucaagaaacuuggaacagacaggauuuauuaguaacauucaaaacugcacaugccaagaaacaagaagugguugugcuuggaagucaagaaggugcaaugcauacugcacuuaccggugcaacggaaauccaaacaucagguacaaccacgauuuucgccggacaccuaaaguguaggcugaaaauggauaaacucacauuaaaggguacuucguacgucauguguacagggagcuuuaaauuagaaaaagaaguagcagaaacacaacacggaacaguacucguucaagucaaauaugagggaacggacgcacccuguaaaauuccuuuuaguacucaagaugagaaaggaguuacccaaaauggaagacuuauaacagccaacccuauaguaaccgauaaagaaaagccaguaaacaucgaaacagaaccaccguucggcgaaagcuacaucguuguuggggcaggagagaaggcuuuaaaacuuucgugguuuaagaaagguucuaguauagggaaaauguuugaagcaacugcccguggcgcucgcaggauggccauauugggagauacggcgugggauuuuggguccauaggggguguauucacaucugucggcaaauuaguucaccaaguauucgggacggcauacgguguacuguuuucaggagugucauggacuaugaaaauuggcauaggaauauuacuaacuuggcuaggacucaacuccagaucaacaagccuaagcaugacuugcauugcuguaggaaugguaacacuguaccuaggaguaaugguucaggcagauagcgggugcguaauaaacuggaaaggcagagagcuaaagugcggcucaggaauauuuguaacuaacgaaguucauaccuggacugagcaguacaaguuucaagcggauucacccaaacggcuaucggcagcgauugggaaagccugggaagaagguguauguggaauuagaagcgccacaaggcuagaaaauauaauguggaagcaaauaaguaaugaguuaaaucacauauuacucgaaaacgauaugaaguucacaguuguagucggggacgcgaacgggauauuagcacaagguaagaaaaugauaaggccucaaccuauggaacauaaguauuccuggaagucaugggggaaggcaaaaauaauuggagcagacauucaaaacacuaccuucauuaucgaugguccugacacaccagaaugucccgauaaucaacgggcuuggaacauuugggaaguagaagacuauggauuuggaauuuucacgacuaacauaugguugaaauugagggacucguacacucaaaugugugaccauagacucaugagcgcagccauuaaagauucaaaggcuguucaugcagauaugggcuacuggaucgaaagugagaaaaaugaaacauggaaacuugcgagggcgaguuucauugagguuaagaccuguaccuggccuaagucccauaccuuauggucuaauggaguacuugaaucagaaaugaucauaccgaaaauuuauggaggaccaauaucucaacauaacuaccgaccuggcuacuuuacucaaacagcagggccuuggcaucuugguaagcuagaacuugauuuugacuuaugugaaggcacaacaguagucguagacgaacauuguggcaauagagguccaucacugcguacgacaacaguaacaggcaaaauuauccacgagugguguuguagaucaugcacacuaccaccccuuagguuuagaggggaggaugguuguugguaugggauggaaauacguccuguuaaagaaaaggaagagaaucuagucagaucaaugguuuccgccgguucuggagaaguugacucguucucccuaggcauucucugcgcgucaaucaugauagaagaaguaaugcgaucaagauggucaaggaagaugcuuaugacuggaacucuugcuguauuuuuauuauuagucaugggacaauuaacuuggaacgacuuaauacgacucuguauuaugguuggugccaaugcaucugaccggauggguaugggcacaaccuacuuagcguugauggcaaccuucaagaugcggccaauguuugcaguagguuuacucuucagaagacuaacaucgcgcgaaguuuuacuauugaccaucgguuuauccuuaguggccagcguggaacuuccuaauucguuggaagaauuaggugauggucuagcaaugggaaucaugaugcuaaagcuacuuacugaguuccaaccacaucaacuauggaucacguugcucagcuuaacauuuauaaaaacuacuuugucauuagacuacgcuuggaaaacaacggcgauggcauugucgauuguuucacucuucccauuauguuuaucaacuaccagucagaaaacuaccuggcuaccagugcucuuaggaaguuuuggaugcaagccacuuacaauguuuuugauaacagagaacaaaauauggggacgaaagagcuggccccuaaacgaagguauaauggcaauagggauuguuaguauuuuacuaucaagucuacuaaagaaugacgucccucuagcuggacccuuaauagcagggggaauguugauagccuguuacguaaucucaggguccucagccgacuugucauuggaaaaggcugcagaaguaagcugggaacaagaagcagaacacucagggacuucccauaauauuuuagucgaaguacaagaugaugguacuaugaaaaucaaagaugaggaaagagaugauacacuuacaauccuccuuaaagcuacucuauuagcagugagcggcguuuaucccaugaguauaccugcaacgcuauucgucugguauuuuuggcaaaagaagaaacaaagaucugggguguuaugggauacaccuagcccacccgaggucgaacgcgcaguauuggaugauggaauauacagaauccuacagcgaggccuccuuggaaggagucaaguaggcguuggaguauuccaggacggugucuuucacacaauguggcauguaacaagaggagcaguuuugauguaccagggcaaaagacuugaaccaaguugggcuaguguaaagaaagacuugauuucguacggagguggcuggagauuucaaggcucuuggaauaccggagaagaaguccaaguaauagcaguagaaccagguaaaaaccccaaaaacgugcaaacgaugccaggaacuuucaaaacuccagaaggugaaguaggggcaauugcccuggauuuuaaaccaggcaccucuggaucuccgauugucaauagagaaggaaaaauaguaggacuuuacggaaacggaguaguaaccaccucugguacuuauguaagugcaaucgcucaggcgaaagccucgcaagaagguccguuaccugagauagaagacgaaguguuuaagaaacggaauuuaacaauaauggauuuacauccaggaucugguaaaacucguagguaccuaccggcgaugguccgggaagcaauuaaaagaaaacuaagaacacucaucuuagcuccuacacgaguaguggcuucagaaauggcagaggcuuugaaaggcaugccaauuagauaucagacuacggcugucaagucagagcacaccgguagagaaauaguagacuuaaugugccacgcaacauuuacaaugcgacucuuaucaccuguacguguuccgaauuauaacaugauuauaauggaugaagcacacuucaccgacccggcauccaucgcagcaagagguuauauuuccaccagaguuggcaugggggaagccgccgcaauuuucaugaccgcuacgccucccggaaguguagaagccuuuccccaaucuaacgcuguaauccaagaugaagagagggacauuccagaacgaagcuggaacuccggauaugauuggaucacggacuuccccgggaagacaguaugguuugugccaucuauuaaaucggggaaugauauagcaaacugccuaaggaaaaacgggaaaagaguuauacaguuaagcagaaagacuuuugauacagaguaucagaaaacuaaaaauaaugauugggacuauguaguaacaaccgacauuagugaaaugggagcuaauuuucgagcagauagaguuauugauccucggagguguuuaaaaccugucaucuuaaaagauggaccggaacgaguaauauuggcaggccccaugccaguaacuguagccucagcugcacaaagaagagguaggauuggucguaaucaaaauaaagagggagaucaauacguauacaugggucaaccacuaaauaaugacgaggaccaugcacacuggacagaggcuaaaauguuacucgauaacaucaauacaccagaagguauuauuccugcccuguuugagccugaaagggagaagucagcggccauagacggcgaauaucgucucagaggggaagcaagaaagacuuuuguugaacuaaugcgcagaggagacuuaccuguuuggcuaucauacaaaguugcuucagaaggcuuccaauauucugauaggagauggugcuucgauggagaaaggaauaaucaaguauuggaggaaaauauggacgucgaaauauggaccaaagagggagagcgaaagaaacucaggcccaggugguuagaugcuaggacuuauucugauccguuggcguugcgcgaauuuaaagaguucgcggcagguaggagaucuguuagcggagaucugauuuuagaaauagguaaacuaccccagcaucucacgcuaagggcacaaaacgcauuagauaauuuggugaugcuucauaacagcgaacaaggaggaaaggcuuacagacaugcaauggaagaacuuccggauacaauugaaaccuuaaugcuucuagcacugauagccguuuugacaggaggggucacccuauucuuucuuuccggaaaaggucuagguaaaacaaguaucggccuucuaugcguaacugcuucaucggcauuguuguggauggcuagugucgaaccucauuggauagccgcauccauaauuuuagaguucuuucuaaugguguuacuaauuccugaaccugaccgacaaagaacuccucaagauaaucagcuugcauauguuguaaucggucugcuuuucaugauuuuaacaguugcagcgaaugaaauggguuuguuagaaacgacaaagaaagauuuaggaauagggcauguugcggcagaaaaccaccaacaugcuacgaugcuagauguagaccuaagaccagcaagugcguggaccuuguacgcaguggcuacaacuguaauuacacccaugaugagacauacaauagaaaauacgacagcuaacaucaguuuaacagcuauagcaaaucaagccgcaauacuuauggggcuggacaagggauggccaauuucgaaaauggacauagguguaccucuccuagcauuggguugcuacucacaaguuaaucccuuaacgcucacggcugcugugcuaauguuagucgcacauuacgcaauuaucgguccaggcuuacaagcaaaagcgacucgggaggcccagaaaagaacagcggccggaauaaugaaaaacccuacuguugaugguauaguagcuauugaccuagaucccguuguauaugacgcgaaauuugaaaagcaacuaggucagauaauguuacucauauuauguacaagucaaauauuguuaaugaggacaacuugggcuuuaugugaaaguauuacgcucgcaacaggaccguuaacaacacuuugggaaggaucacccgguaaguuuuggaauaccacuauugcuguaaguauggcaaacaucuuucgaggaagcuaucuggcaggagcugguuuggcuuuuagucuuaugaaaagccuagguggaggacgccgcgggacuggagcgcagggagaaacacuaggagaaaaguggaaacgucaauuaaaccaacuaaguaaaucggaauuuaauacguauaaaaggucuggaaucauggaaguagacagaucugaagcaaaggagggauuaaaaagaggggaaacuacaaagcacgcugucucuagaggcaccgcuaaguuaagaugguucguagaaagaaacuuaguuaagccugaagggaagguuauagacuugggauguggacgaggaggguggaguuauuacugcgcggggcuaaagaaagucaccgagguuaaaggauacacaaagggaggcccgggacaugaggaaccuauaccuauggcuacauaugguuggaauuuagucaaacuacauucagguaaagauguuuucuucaugccgccagagaaaugugauacguuacuaugcgacaucggagagaguagcccaaauccaacaauagaagagggcagaacccuaagaguacuaaaaaugguggaaccaugguuaaggggaaaucaauucugcauaaagauccuaaacccauacaugccaucuguuguagaaacgcucgaacaaaugcaaagaaaacacggagguaugcuugugagaaauccauuaagccgaaauuccacccacgaaauguauuggguaucuugugguaccgggaacauuguuagugcagucaauaugacaucaagaaugcuccucaaucguuuuacgauggcccauagaaaaccuaccuacgaacgagaugucgaucuaggugcaggaacccgccauguagcaguugaaccagaaguggcaaaucuugacauuaucgggcaacggauagaaaacaucaagaacgaacacaaaaguacguggcauuaugaugaagauaacccguacaagacuugggcauaccacggaucuuaugaagugaaaccgucaggauccgccucauccaugguuaauggagucgucagauugcucacgaaaccgugggacguaauaccuauggucacgcaaauagcgaugaccgauacuacaccauuuggacagcaacguguauucaaagaaaagguggacacccguacuccucgugcaaagcgaggaacgacgcaaaucauggaggucaccgcaaaauggcuauggggauuccucucacguaacaagaaaccuagaauuuguacgagagaggaauuuacacgaaaaguuagaucuaacgccgcgauaggcgcuguauucgucgaugaaaaucaauggaauagugcaaaggaagcaguggaagaugaaagauucugggauuugguucacagagaaagagaauugcauaagcaagggaagugcgcgacauguguguacaauaugaugggaaaaagagaaaagaaguuaggggaguucgguaaggcaaagggauccagggccauaugguacaugugguuaggugcgagauuucuggaguucgaggcguuaggcuuuaugaacgaagaucauugguucucaagggagaacucccuuucaggugucgaaggagagggguuacacaaguuagguuauauauugcgagacauaucaaaaaucccuggagguaauauguacgcagacgauacugcagguugggacacuagaaucaccgaagaugaccugcagaacgaagccaaaauaacggaaauuauggagccugaacacgcuuugcuugcgacuuccauuuuuaaauuaaccuaucagaauaaaguggugcgcguacaaaggcccgccaaaaacgggacggucauggauguuaucagucguagagaccaacgugggucaggacaaguagggaccuauggauuaaauaccuuuacaaacauggaaguacaguuaauacgacaaauggaaucagaggggauauuuuuaccuagcgaauuagagacaccaaaucuugccgaacgaguacuggauuggcuggaaaagcauggcgcagagagauuaaaaagaauggcuaucagcggcgaugauugugucguuaaaccuauagacgauagauuugccacggcacuaacugcgcuuaaugauauggggaaaguaagaaaggauauaccucagugggaaccuucuaaagguuggaaugacuggcaacaaguaccuuucuguucccaccauuuucaucaauuaauuaugaaggacgguagggagauagucguuccaugccggaaucaagaugaguuaguaggacgagcgcgaguuucccaaggagcaggauggucauuaagagagacagcguguuuaggaaaauccuacgcacagauguggcagcuuauguacuuccauagacgugacuuaagacuugcggcaaacgccauuuguagugcggucccgguugacuggguuccuacgaguagaacuacauggucaauccaugcucaucaccaguggaugaccacagaagauaugcuuucgguauggaaccgaguguggaucgaggagaauccuuggauggaagacaagacccaugucucuaguugggaagaagugccuuaucuagggaaaagagaagaucaauggugcggaucauuaaucggucuaacggcgagagcaacaugggcaaccaacauacaagucgccaucaaccaaguucgcagacucauugguaacgaaaauuauuuagauuacaugaccagcaugaaaagauuuaagaacgaaagugauccagagggcgcucuaugguag

SEQ ID NO: 21277 - RNA, 9879 nt, Artificial Sequence
  derived and/or modified CDS sequence (opt6) from DENV-1__KJ189326__SS-prME
ucaguuaccaugcuuuuaaugcuauuaccaacagcauuagcuuuucauuuaacaacgagaggcggagaaccgcacaugauuguuuccaaacaagaaagaggaaagagcuuauuauuuaaaacaagugcuggaguaaacauguguacauugauagcaauggacuuaggagaauuaugcgaagacaccaugacguacaaauguccgcaaauaacagaagcggaaccggaugauguagauuguugguguaaugcaacagacacauggguuaccuacgggaccugcagucaaacaggugaacauaggagggauaagcgaaguguagcacuagcgccgcauguuggucuaggacucgagacgcgaacugaaaccuggaugucaucggaaggagcguggaaacagauacagcguguagaaacuugggcgcuacgucauccuggauucacaguaauugcgcuauuucuagcacaugcgaucggaacaagcauaacucagaaagggaccauuuucauccugcuaauguuagucacucccuccauggcaaugagauguguaggaauaggaaacagagacuuuguagaaggauuauccggggcaacauggguugauguaguauuggaacaugggucguguguuacuacgauggcuaaaaauaaaccaacauuagauauugaacuguuaaaaacagaaguaacaaacccugcaauacuaaggaaauugugcauagaagccaaaauaagcaauaccacaacugacucaagaugcccaacacaaggagaagcaacuuuggucgaagaacaagaugcaaacuuugugugcagaagaacauuugucgaccgcggcuggggaaaugguugugguuuauucgguaaaggaucacuccugacuugugccaaauuuaaaugcgugacaaaacuugaaggaaaaauuguccaguacgaaaaccuuaaauacucuguuauaguuacuguccauacuggcgaucaacaucaaguagggaaugaaacuaccgaacauggaacaauagccacuauaacgccacaagcaccuacaucugaaauucaauugaccgacuauggagcucuaaccuuggacuguaguccaagaacgggauuagauuucaaugaaaugguccuauugacaaugaaagaaaaaucuuggcuaguacauaaacaaugguuucuugaucucccguuaccguggaccucaggggcuucaacaucccaagaaaccuggaaucgacaggacuuauuaguuacauucaagacggcgcaugccaagaaacaggaaguaguaguccugggaucucaagaaggagcgaugcauaccgccuuaacuggagcuacugaaauucaaacaucaggaacaacgacaauuuuugccggacaucuuaaaugucgucuaaaaauggauaaacucacccucaaaggaacaagcuauguaaugugcacgggaucuuucaaguuggaaaaggaggucgcagaaacucaacauggcacgguguuaguucaagugaaguacgaggguacggacgcaccauguaagauacccuuuaguacucaagaugaaaaaggcguuacgcaaaauggucgccuuaucacagcuaacccaaucguuacugacaaagaaaaacccgugaacauagaaacugaacccccuuucggggagucguacauaguagucggagcaggagaaaaagcacucaaacuuaguugguucaagaaaggaucuucaauaggaaagauguucgaagcuacagcacgaggagcgagacgaauggcaauauuaggugauacugcaugggauuucggaaguaucgggggaguuuuuacaaguguaggaaagcuaguucaucaaguguuugggacugcauaugguguacuuuuuagcgggguaagcuggacgaugaaaauaggcauugggauccuacuaacauggcuagggcuuaacuccagaagcacauccuuaagcaugacauguauagcagucggaauggugacuuuguaccucggcguaauggugcaagcagacagugguugcguuauaaacuggaagggucgagaacuaaagugcgguaguggcauauuuguaaccaaugaaguucauacauggacagaacaauacaaauuccaagcagacagcccuaagaggcucagcgcagcaauugggaaggccugggaagaaggaguauguggaauaaggucggcaacccguuuagaaaauauuauguggaaacaaauaucuaaugaauuaaaucauauucuuuuagaaaaugauaugaaguuuaccguaguuguaggggaugcuaauggaauacucgcucagggcaagaaaaugauuagaccccaaccuauggaacauaaauauuccuggaaaucaugggguaaagcaaaaauaauuggcgcggauauacaaaauaccaccuuuauaauagauggcccagacaccccagaauguccagauaaucaacgugcguggaacaucugggaaguagaggauuacgguuuugguauauucacuacuaauaucuggcuaaaauuacgugacucuuauacacaaaugugugaucaccgauuaaugagcgcagcuaucaaggauucuaaagcaguacaugcugacaugggguauuggaucgagucagaaaagaaugagacuuggaaacuugcgagggcuagcuucauugaagucaaaacaugcaccuggccgaaaucacauacuuuauggucaaacggaguccuagaaucagaaaugaucauaccaaaaauauacggugguccgauaagucagcacaauuauagaccaggauauuuuacucaaacggcuggaccuuggcacuuagguaaauuagagcuugauuuugaccuaugugaagggacuacagugguaguagacgaacauugugguaauagagguccaucguugagaacgacaacaguuaccggcaaaauuauacaugaauggugcugucguucguguacucuaccaccauugcgauuucggggagaagaugguuguugguacgggauggaaauaagacccgucaaagaaaaagaggaaaaccuuguacggucaauggugagcgcgggguccggcgaaguugacucguucagucuagggauacugugcgcuaguaucaugauugaagaagugaugagaucgagauggucccgaaaaauguuaaugacaggaacuuuagccguguuucuauugcugguaaugggacagcucacauggaacgaccuuauuagacuuuguauaaugguuggugcgaacgcaucggaucgaaugggaaugggaacgacuuauuuggcauuaauggcaacauucaaaaugcgcccaauguucgcgguagguuuauuauucaggagacuuacaaguagagaaguacuucuuuuaacaaucgguuuaagccuugucgcuucgguugaacuacccaauaguuuagaagaacugggugauggauuagcgauggguauuaugaugcucaaacuacugacagaguuccaaccgcaccaauuguggacaacacuguuaucucuaaccuuuauaaaaacuacguugucucuagauuacgcauggaaaacaaccgccauggcccucagcauuguaucucuauucccguuaugcuuaucuacaaccucacagaaaacuacaugguuaccaguacuacuaggaucauuuggguguaaaccauuaacuauguuccuaauaaccgagaauaaaauuugggggcggaaauccuggccguuaaaugaaggcauaauggcuaucggaaucguaaguauuuuauugucuuccuuguugaaaaaugauguaccccuagcugggccccuaauagcugggggaaugcucauagcauguuauguuauaagcgguucaucagcugaccuaagucucgagaaggcagcugagguaagcugggagcaagaagccgagcacagugggacgucccacaauauccuaguagaaguacaagacgauggcaccaugaaaauuaaagacgaagaaagagacgacacccucacaauacuauuaaaagcuacacuacuggcagucagugggguuuauccaaugucaauaccugcuaccuuauucgucugguauuucuggcagaagaagaaacaaaggagcgguguuuugugggauacucccucacccccugagguagaacgugcaguguuagacgaugguaucuacagaauauugcaaaggggacuauugggaagaucccaaguuggcgucgguguguuccaagauggaguauuucauacuauguggcaugucacuagaggagcaguacuaauguaucaaggaaaacgccucgaaccgucuugggccucugugaagaaagaucuaauuaguuauggaggugguuggagauuucaaggucuauggaauacaggagaagaaguccaaguuauagcagucgagccaggcaaaaaucccaaaaauguacagacaaccccaggaacauuuaagacaccagagggcgaagugggagcgaucgcuuuagacuuuaaaccaggcaccaguggaagcccaauuguaaacagggaggggaaaaucguuggccuauauggaaacggaguugucacgaccagugguacauauguuucagcuauagcgcaggcuaaagcgucacaggaaggacccuuaccagaaauagaagaugaaguauucaagaaaagaaaucuaacuaucauggaccuucauccgggcucaggcaagacgcggcgauaucuaccugcuaugguaagagaagcaauuaagaggaaauuacgaacgcuaaucuuagcaccuacuagaguaguagccucagaaauggccgaggcacucaagggaaugccuauacgauaucaaacgacagcugucaaaucggaacauacggggagggaaaucguugauuuaaugugccaugcaacuuucacuaugagauuguugaguccuguaaggguuccuaauuacaacaugauaauaauggaugaagcccauuuuacagauccugcaucaaucgccgcaagagguuauauaucuacgaggguugguaugggugaagccgcagcaaucuuuaugacagcaaccccuccuggaaguguagaggcuuuuccacaaucaaacgcgguaauacaggaugaagaacgcgauauacccgaaagaucauggaauagcggguaugauuggauaacagauuuucccgggaaaacagugugguucgugccuagcauuaagucgggaaacgauauagcgaauugucugaggaaaaaugggaagagggucauccaacuaucuaggaaaacuuucgauaccgaauaccagaaaacuaagaacaaugauugggacuacguaguaacuacggauauaagugaaaugggagccaauuuuagagcggauagaguuaucgacccucggcguuguuuaaaaccaguuauucuaaaagaugggccagaacgagucauuuuagccggaccgaugcccguuacagucgcuucugcggcacaaaggcgggguagaauaggcaggaaucaaaacaaagagggcgaucaauaugucuacaugggccaaccauuaaacaacgaugaagaucacgcucacuggacagaagcaaaaaugcuucuagacaacauaaacacuccagaagggauaauaccagcucuuuucgaaccugaacgugaaaaaucugcagcuauagacggcgaauacagacuuaggggagaagcaagaaaaaccuucgucgaauuaaugagaagaggugaucugcccguuuggcuaagcuacaaagucgccucugaaggguuccaauauagcgacagaagaugguguuucgauggugagagaaacaaucaaguccucgaagaaaacauggauguugaaauuuggacuaaagaaggcgaacggaagaaauuacguccaagauggcuagacgcucgaacauauucagacccgcucgcguuacgugaauuuaaagaauuugcagcagguagaaggucaguaucgggugauuuaauucuugagauaggcaagcugccacaacauuugacauugagagcccagaacgcacuggacaacuuaguaauguugcacaauagcgaacaaggcgguaaggcuuacaggcaugcaauggaagaacuaccagauacaauugaaacccuaaugcuccucgccuuaauugcaguacuaacagguggcguuacguuauucuuuuugucaggaaagggauuagguaagacaucaauuggauuauugugcguuacugcuagcagugcguuauuauggauggcgagcguggagccccauuggauagcugcaagcauaauacuagaauuuuucuuaaugguacuccuaauacccgaaccagacagacagagaacuccacaagauaaucagcuggcuuacguaguuauuggccuauuauuuaugauccuaacaguggcagccaaugaaaugggacuucucgaaacaacuaagaaagacuugggaauuggucacguggcugcugagaaucaccaacaugcuacgaugcuggacguggaucugagaccugcaucggcauggacguuguaugcaguagcaacuacagucauaacuccaaugaugcgucacacuaucgaaaauacuacggcuaacauaagccuaacggcaauugcgaaccaggcugcaauucucaugggacucgacaaaggauggccaaucucgaaaauggacauugggguuccacuacuugcacuggguuguuacucacaaguaaauccacugacuuugacagcugcgguuuugauguugguagcucauuacgcaauaauaggcccagguuuacaagcaaaagcaacacgagaagcacaaaaacgcacagcagcugguauuaugaagaaccccacuguagacgguauaguugcuauagauuuagauccuguuguguacgaugcaaaauucgaaaaacaacugggacaaauaauguuauuaauacuaugcacaagucaaauauuacuaaugcgaacuacgugggcucugugugagaguauuacgcuggcuacaggcccgcuuacaaccuuaugggaaggguccccgggaaaauucuggaacacgacgauagccgucucuauggcuaacaucuuccguggcaguuaucuugcaggagcagguuuagcauuuucucugaugaaaucgcucggagggggucgccgaggaacuggugcgcagggugagacacuaggcgagaaguggaagaggcaacugaaucaacucaguaaaucugaauuuaauacauacaagagaaguggaauuauggagguagauagaucagaagcaaaagaaggauugaagaggggagagacuaccaaacaugcaguuucgcggggaacagccaaacuuaggugguuuguugagcgcaaucuuguaaaaccugaagggaagguaauagaucucggcuguggcagaggugguuggaguuacuauugugcgggucucaagaaaguuacugagguuaaaggguacaccaaaggcggaccaggacacgaagaacccauaccaauggcuacauaugguuggaaucuagugaaacuacauucgggaaaagaugucuucuuuaugcccccugaaaaaugugauacacuucuuugcgauauaggcgaaucaaguccuaauccuacaauagaagaaggacggacucuuaggguacuaaagaugguggaaccaugguuacgaggaaaucaauuuuguaucaaaauacuuaauccauacaugccuucgguuguugagacguuagaacagaugcaaaggaagcacgggggcaugcuaguuaggaauccacuaagcagaaauaguacacaugaaauguacuggguaagcugugguacggguaauaucgugagugccgucaacaugacuagcagaaugcuacuaaauagauuuacuauggcucaccgcaagccaacuuacgaacgagacguagauuuaggugccggcacucgacauguggcuguagaaccagagguugcaaaccuagauaucauaggccaacgcaucgaaaauaucaaaaaugagcacaaaagcacuuggcauuacgacgaggauaacccuuacaagacgugggcauaucacggcucguaugaaguaaaaccauccgggucagcuaguaguaugguuaacggggucgugagauuguugacuaagccaugggacgucauaccaaugguaacucaaauugcuaugacagauacuacaccuuuuggucaacagaggguauucaaagaaaagguggauacacgcacuccucgggcaaaaagaggaacaacgcaaauaauggaaguaacagcgaaaugguuaugggguuucuuaucuagaaacaagaaaccuaggaucugcacaagggaagaguuuacucgaaaagugcgcucaaacgcugccauaggagcaguauuuguugacgaaaaccaauggaauagcgcgaaagaagcaguugaagacgagagauuuugggaucuaguacauagggaacgggagcuucacaaacaaggaaaaugcgcaacuugcguguauaauaugauggggaaaagagagaagaaauuaggugaguucgggaaagcaaaaggcaguagagcuauaugguacauguggcucggagcaagauuucuagaguucgaggcuuuaggcuucaugaacgaagaucauugguuuucuagagagaauagcuuaucgggcgucgaaggugagggacuccacaaauuaggauacauacuccgugacaucucaaaaaucccugggggcaauauguaugccgacgacacagcagguugggauacacgcauaacagaagacgacuuacaaaacgaagcaaaaauuacugaaauaauggaaccugaacaugcauuacuagccacuucaauuuucaaauuaacauaucaaaauaaaguaguuaggguacaacgaccugccaaaaaugguaccgugauggacguaauuucuagaagggaucaaagaggaaguggacaaguaggcacguauggccugaacaccuucacaaauauggaaguacaauuaauacgacaaauggaaucagaagggaucuuuuuaccaagcgaguuggaaacuccgaauuuagcugaaagaguauuggauugguuagagaaacauggugccgaaagauuaaagaggauggcaauuucaggugaugacugugucguaaaaccaaucgaugaucguuucgccacugcauugacugcucuaaacgacaugggaaagguucgaaaggacauuccgcaaugggaaccaucaaagggauggaacgacuggcaacaaguaccguuuugcucacaucauuuccaccaacuuaucaugaaagaugggcgcgagauuguaguuccuugucgaaaucaggacgaacucguuggucgagcaagaguaucacaaggagcuggcuggagccuucgugaaacugcuugccuuggaaaaaguuacgcucagauguggcaguuaauguauuuucauagacgcgaucuucgacucgcggcuaaugccaucugcucugcgguacccguggauuggguaccaacaagucguaccacuuggagcauucaugcccaccaucaauggaugacuacugaggacaugcugagcguauggaacagaguuuggaucgaagaaaacccauggauggaagauaaaacucauguuucaucgugggaagaaguaccauaucuggggaaacgugaagaccaauggugcgggagucuaauuggacuaacagcacgggcgaccugggcgacuaauauucaaguugcaaucaaucaaguucggcgacuaauaggcaaugaaaacuaccuagauuauaugacauccaugaaaagauucaaaaaugagucugaccccgagggagcauugugguaa

SEQ ID NO: 21278 - RNA, 9879 nt, Artificial Sequence
  derived and/or modified CDS sequence (opt6) from DENV-1__KJ189327__SS-prME
ucuguuacuaugcuucuuauguuauugccuacugcucuugcguuucaucuuacaacgcguggaggugaaccccauaugauugucucuaaacaggaacgugguaaaaguuuacucuuuaaaacgucagccggagugaacaugugcacauugauagcaauggauuuaggagaacucugcgaagacacaaugacauacaaauguccccaaauaacagaagccgaaccugaugacgucgauugcuggugcaaugcuacagauacaugggugacguaugggacaugcagccaaacuggggaacaucggcgugaaaaacguucuguagcguuagcuccucauguugguuuaggucuugaaacgagaacagaaacguggauguccucagaaggagcguggaaacaaauacaaagagucgaaacuugggcauuacgacacccuggauucacugucauagcccuguuccuagcgcacgccauaggaacauccauuacacaaaaaggaauuauuuucauacuacuuaugcucguaacuccaagcauggcgaugagaugcguagggauaggcaaccgagauuuuguggaaggucuuucaggcgcaaccuggguagauguagugcuagagcaugggagcugcgucacaacuauggcgaaaaacaaaccgacacuugacauagaacuacucaaaacugaggugaccaauccagcaauacuacgaaaauugugcauagaagcuaaaauaucgaauaccacaacugacuccagguguccgacgcaaggggaagcuacauuaguagaagaacaagacgcgaauuucguauguagacgaacguucguggacagaggguggggcaauggguguggacuauucggaaagggcagcuuauuaacaugcgcgaaauuuaaaugcguaacuaaacuugaagggaaaaucguacaauaugagaauuuaaaauauaguguuauaguaacagugcauacuggagaucagcaucaagucggaaacgaaacuaccgaacauggcaccauugcaaccauaacaccacaagcaccaacuucagaaauacagcuaacugauuacggggcucuaacccuugacugcucaccacgaacaggacuugauuuuaacgagaugguacucuugacaaugaaggaaaaaucuugguuaguccacaagcaaugguuccuggacuuacccuuaccuuggacaaguggcgcuucgacaucacaagaaacauggaacagacaagauuuacucguaacuuuuaaaacggcacacgccaagaaacaagaaguaguugugcuggggucccaggagggugcgaugcauacugcucuaacuggggcaacggaaauccagacgagugggacaacuacgaucuucgcuggacaccugaagugucguuuaaaaauggauaaacuuacacucaaagggacauccuauguaauguguacugguucauucaaauuagaaaaagaaguugcagaaacgcaacacggcacagugcuuguacaggucaaauaugaaggcacagaugcgccuuguaaaauuccauucagcacacaagaugaaaagggagucacccaaaacggacgucuuaucacugcuaaccccauuguaacggauaaggaaaaaccagugaacauagagaccgaaccuccguuuggagagaguuacauaguuguaggagcuggcgaaaaggcguuaaaacuuaguugguuuaaaaagggcaguucuauagggaaaauguuugaagccacagccaggggcgcccgaaggauggcuauuuuaggugacacagcuugggauuuugggagcauaggaggugucuuuacaagcgucggcaaacuuguucaccaagucuuugguacggcauacggggugcuauuuagugguguuagcuggacaaugaaaauugguauagggauccucuuaacaugguugggauuaaacucaagaucaacaucgcuaucaaugacaugcauugcggucgggaugguaacacuauacuuaggugucaugguucaagcagauucaggcugcguaauaaauuggaagggcagagaguuaaaguguggaaguggaauauuuguuacaaaugaaguacauacauggacagaacaauauaaauuucaagcugauucgcccaagagauuauccgccgcuauugguaaagcgugggaagaaggugugugcgguauacgaagugcaacacgucucgaaaauaucauguggaaacaaauaucuaaugaacuaaaucacauauugcuagaaaaugacaugaaauuuaccguuguaguaggagaugccaauggcauucucgcacaaggaaagaaaaugaucagaccccaaccuauggaacauaaguacagcuggaaaaguugggguaaagcaaaaauaauuggcgcggacacccaaaacacaacuuuuauaauagauggaccagauaccccagaauguccugauaaccaacgggcauggaauauuugggaaguggaagacuacgguuuuggaauuuucaccacgaauauaugguugaaauuaagagacagcuacacacagaugugugaucauagauuaaugagcgcggcaauaaaagacucaaaagcuguacaugcagauaugggauauuggauugaaagcgagaaaaaugaaacauggaaacuagcuagggcaucauuuauagaaguuaaaacuugcacuuggccaaagagucacacacucuggaguaacggugucuuagagucggaaaugaucauuccaaagauuuaugguggaccaauaucacaacauaacuauaggccugguuauuuuacacaaaccgcaggaccauggcaucugggcaaacuggaauuagauuuugaccuaugugaaggaacaacggucguuguugaugagcauugcggaaacagaggcccgagcuuaagaacuacuacuguaacagggaagauaauucaugaaugguguuguagaucuugcacauuaccaccacuacgauuucgaggggaagaugguugcugguaugggauggaaauccgcccgguuaaagaaaaagaagagaacuuaguacgaucaauggugagcgcagggucaggagagguagacucguucucacuuggcauucugugugcauccauuaugauugaggaaguaaugaggucacgguggucacgaaagauguuaaugacugguacauuagccguguuucuuuuguuaaucaugggccaacuaacguggaaugaucuaauuagauuaugcauuaugguuggugcuaaugcaucagauagaauggguauggguacgacauaucucgcgcucauggccacauucaaaaugcgccccauguucgcgguaggccuauuguuccgucgguuaacuucgagagaaguauuacuccuaacaauaggacuauccuugguugcuucagucgaacugcccaauuccuuagaggaacuuggagaugguuuagcaauggguauuaugaugcuaaaacuauuaaccgaauuucagccucaucaacuauggacgacgcugcuaagccuaacuuucauaaaaacaacgcuuucguuggauuacgcuuggaagacuacggcaauggccuuaaguaucgugucuuuauucccccuaugucucucuacaacgucucaaaagacaacauggcuuccaguuuuguugggauccuuuggcuguaagccguuaacaauguuccuaauaacggaaaauaagauuuggggaaggaaaaguuggccgcuaaaugagggaauaauggcuauagguauaguuucaauacuacugucauccuuauugaaaaaugacgucccgcuagcuggacccuuaauagccggugguaugcuaauagcguguuacguaauuucagguaguucugcagacuuaucacucgaaaaggcagcagaaguuucuugggaacaagaagcagaacacagugguacuucacacaacauacuuguagaaguccaagaugacgguacaaugaaaaucaaggacgaagaacgagacgauacauuaaccauccugcucaaggcgacucuauuggcuguaucagguguauauccuauguccaucccggcgacccuauuuguaugguacuuuuggcagaagaagaaacagcgcaguggggugcugugggauacaccaucuccaccggaagucgagagagcgguucuugaugacgguauuuauagaauccuccagagaggauuauuagguagaucucaaguuggaguagggguauuucaagauggaguguuucauacaauguggcacguaaccagaggugcaguauuaauguaucagggaaaaagguuggaaccuucaugggcuagugucaagaaagaccucauuuccuauggagggggcuggagauuccaggggucguggaauacuggggaagaaguucagguuauagcaguugaaccugguaaaaauccaaagaacguacaaacaacuccaggaacuuucaaaacacccgagggagaagucggagccauagcauuagacuucaaaccaggaacgucuggaucuccuauuguaaacagagagggaaaaauagucggguuauaugguaacggaguuguuacuaccucugguaccuauguauccgccauagcacaagcaaaggcaagccaagaggguccacuaccagagauugaggaugaagucuucaagaaaagaaacuuaacaauaauggaccuacauccaggcagcgguaaaacacggcguuacuugccagcaauuguacgcgaagccauaaaacgaaaauugcgcacacuaauacucgcaccgaccagaguuguagcaagugaaauggcugaggcgcucaaagguaugcccauacgguaucagaccacggcggugaaaucugaacacacuggaagagaaauuguagaucuaaugugccaugcuacguucacuaugagacuguugagucccguuagaguaccuaacuauaacaugaucauaauggacgaagcucauuuuaccgauccagcuaguauagcagccagaggauacauuuccacccgaguuggcaugggggaagcugcugcuauuuuuaugacggcaacgccacccggcucaguggaggccuuuccgcaaucaaacgcaguaauacaagaugaagaacgagacaucccagaaagaaguuggaacucgggguaugacuggauaacugauuucccgggaaaaacgguuugguuuguuccgaguauuaaaagcggcaaugauauagcaaacugcuuaaggaaaaacgguaaaagagucauacaacucucuagaaaaacuuuugauacagaguaucagaaaacuaaaaauaaugacugggauuauguuguaacuacugacauuucagagaugggagcaaauuuccgagccgauagaguuaucgacccgagacgaugucuaaaacccgugauacucaaggauggaccagaaagaguaauccucgccgggccuaugccagucacaguagccucugcggcacaaagaagaggcagaaucgggagaaaccaaaauaaagaaggggaucaauauguuuacaugggacaaccucuuaauaacgaugaagaucaugcgcauuggacagaagcaaaaauguugcucgauaacauaaauacuccagaagguaucauaccggcucuauuugaaccagaacgggagaaguccgcagccaucgauggagaauaucgccuucguggggaggcacgcaagacauuuguagaacuaaugagaagaggugaucuucccgucuggcugagcuacaaaguggcgucugaaggauuucaauacucugacagaagauggugcuucgacggggaacgcaauaaucaagugcuugaagaaaauauggacguugaaauauggacaaaagagggcgagaggaagaaacuucgaccgcguugguuagaugcacgaacauauucagauccuuuggcauuacgugaauuuaaagaauuugccgcaggccgaagaucuguuucaggggacuuaauucuugaaauaggcaagcugccccagcacuuaacauugcgugcgcaaaacgcucuagacaauuuagucaugcuccauaauagugaacagggugggaaggcguauagacaugccauggaagaacuaccggauacaauagaaacucucauguuauuagccuuaauugccguauuaacagguggugugacacuauucuuuuuaucagguaaaggacucggaaagacaucuauuggacuccugugcguaacagcaagcuccgcucuccuuuggauggcaagcguagaaccacacuggauagcagccucaauaauacuagaguucuuuuuaaugguacuuuugauaccggaaccagauagacaacgcacgccacaagacaaccaacucgcauacguagucauagguuugcuauucaugaucuuaaccguagcggcaaaugaaaugggauuguuagaaacgacuaaaaaggauuuggggauaggucauguagcggcggaaaaucaucagcacgccaccaugcuggacguagacuugaggccugcaagugccuggacccuguaugcaguggccacaacagucaucacaccaaugaugaggcauacaaucgaaaauacaacagcgaauauaagccuaacugcuauugcuaaccaggcagccauauuaaugggacuagacaaaggauggccgauaucuaaaauggauauaggagucccauuacuagcuuuaggauguuacagucaaguaaacccauugacccuuacagcagcuguguuaaugcuggucgcccauuaugcuauaauugggcccggacugcaagcaaaagcgacaagagaagcucaaaaacgcaccgcugcagguauuaugaaaaauccuacaguagaugguaucguggccauugauuuagacccagucguauaugacgcuaaguuugagaaacaguuaggacaaaucaugcucuuaauacuauguaccucacagauccuacuaaugcguacaacaugggcauuaugcgagucuauaacacuagccacagguccauuaaccacauugugggaaggaucucccggcaaauuuuggaacacgacaaucgcaguuucaauggcaaauaucuucagagggucguacuuagcaggagcuggccucgcuuuuucacuaaugaaauccuuaggagguggaaggcguggaacaggcgcacagggugaaacguuaggugaaaaauggaaaagacagcuuaaccaauugucaaaaucggaauuuaauacauauaaaagaagcggaauaauggagguugacaggagcgaagccaaagaaggauuaaagcguggagaaacgacuaaacaugccguaucacgcggaacugcaaagcucagaugguuuguagagagaaaucuugucaaaccggagggaaaaguuauagaccuaggcuguggucgaggagguuggucauauuacugcgcuggacugaaaaaggucacagagguuaaaggauauacuaaaggagguccaggucaugaagaaccuauucccauggcaacguauggauggaacuuaguaaaacuucauucaggaaaagauguauucuuuaugccgccugagaaaugcgacacacuguuaugugauauuggugaaaguucgccaaauccgacaaucgaagaaggaaggacacucagaguacugaagaugguagaaccauggcuaagagggaaccaauucugcaucaaaauccuuaauccauauaugccgucaguugucgaaaccuuagaacaaaugcaacgaaaacacggcggaauguuaguucgaaauccguuaucaagaaauuccacacaugagauguauuggguaucuugugggacaggcaauauuguaucagcgguaaauaugacaucucgaaugcuuuuaaaccgguuuacuauggcucacagaaaaccgacauucgaacgggauguugaccuaggagcaggaacacggcacguagcuguggaaccagaaguugcaaacuuagauauaauuggacaacgaaucgaaaacaucaaaaacgagcauaagucaacauggcauuaugaugaggacaauccguauaaaacuugggccuaccaugggagcuacgaggugaaaccuucuggcuccgcuucauccaugguuaauggagugguacgucuauuaacaaagccaugggacgugauuccuauggucacacagauagcgaugacagauacaacacccuuugggcaacaacggguguucaaagaaaaggucgauacacguacgccucgcgcgaagcgagggacaacacagauaauggaaguaacagcgaaauggcuuuggggcuuuuuaaguagaaacaagaaaccacgcauuuguacgagagaagaauuuacaagaaaaguuaggucaaaugccgcuaucggcgcaguguucguugacgaaaaucaguggaacuccgcuaaagaggcgguagaagacgagcgguuuugggaccuuguacacagagagcgcgaauuacacaagcaagggaaaugcgccaccuguguguauaauaugauggguaagcgcgagaagaaauuaggugaguuugggaaagcuaaagguaguagagcaauaugguauaugugguuaggcgcacguuuccuagaauuugaagcacucggauuuaugaacgaagaucacugguucucaagggagaacucauuauccggaguagaaggugaaggucuucacaaauugggauacauacuaagagacaucagcaagauaccuggaggaaacauguacgcugacgacacggcuggaugggauacaaggauaacagaggacgaucuccaaaacgaagcaaaaauaacagacaucauggagcccgaacaugcauuacuugcaacaaguauuuucaagcuaaccuaccaaaacaaggucgugcgcgugcaaagaccugccaaaaauggaacaguuauggauguuauuucaaggagagaucaaagggggaguggacaggucgguacauauggucugaauaccuuuacuaauauggagguacaacuuaucagacagauggagagugaaggaauauuucuacccucagaacuugagacucccaauuuagcagagcgaguucuagauugguuagaaaagcacggcgcugaaagauugaaaagaauggcuaucucuggugacgacuguguugugaaaccuauugaugauagauucgccacggcgcuaacggcauuaaacgacaugggaaaaguuagaaaagauauuccgcaaugggaaccaucgaaagguuggaacgauuggcaacaagugccauuuugcagccaucauuuucaucagcuaauaaugaaagaugggcgagaaaucguaguaccguguaggaaccaagacgagcuaguagggcgagccagaguaucacaaggagcuggauggucucuaagggaaacagcaugcuuaggaaaaucauacgcgcagauguggcaacuuauguauuuucaucgaagagacuuacgacuugcggcgaacgcaauuugcagcgcagugccaguagauuggguaccuacuucccgcacaacaugguccauacacgcucaucaucaauggaugacaacagaggauauguugagugucuggaaucguguguggaucgaagagaacccuuggauggaagauaaaacacauguaucuagcugggaagaaguaccauaccuaggaaaaagagaagaccaaugguguggcaguuuaaucggacuaaccgcacgugcaaccugggcaacuaacauacaaguugcaaucaaccaaguaagacgacugauagggaaugaaaacuaccuggauuacaugacgucuaugaagagauuuaagaacgaaagcgauccagaaggugcgcuaugguaa

SEQ ID NO: 21279 - RNA, 9879 nt, Artificial Sequence
  derived and/or modified CDS sequence (opt6) from DENV-1__KJ189328__SS-prME
agcgugaccauguuauuaaugcuauuaccaacugcccuggcauuucauuuaacgacaagaggcggugaaccccauaugauugugucaaaacaagaaagagggaaaucauuauuguuuaagacaagugccgggguaaauauguguacgcugauagccauggaucuuggcgaacuaugugaagacacuaugaccuacaaauguccucaaauaacggaagcagaaccugaugaugucgauuguugguguaaugcgaccgauacuuggguuacauacggaacuugcucacaaacgggcgaacaucggcgcgagaaaagaucuguggcccuagcaccccacgucgguuuaggacuggaaacacguacagaaacuuggaugagcagugaaggcgcguggaagcaaauucaacgagucgaaacaugggcauugcgacauccaggguuuacaguaauugcgcuauuuuuagcacaugcaauaggaacuucgauaacacagaaagguauaauauuuauauuacucaugcuagugacgccgucaauggcgaugcguugcgucgguauagguaacagagauuuugucgaaggacuaaguggggccacguggguggacguagucuuagaacauggauccugcguuaccacuauggcuaaaaauaaaccgacacuagacauagaacuauugaaaacagaaguaacaaaccccgcgauucuucguaaacuuuguaucgaagcuaaaauaaguaauacaaccaccgacaguagauguccaacccagggagaagcaacacuuguagaagaacaggaugcgaacuuuguuugucgcaggacauuuguagauagaggauggggcaacggguguggacuuuucggaaagggcaguuuguugacgugugcaaaguucaaauguguuacuaaacucgaagggaaaauaguacaauacgaaaaucuuaaguacucaguuauaguuacaguccauacgggagaccaacaccagguugggaaugaaacgacagaacacggaacuauagcaacgauaacaccacaagcgccgaccagcgaaauacaguuaacagacuauggugcucuaacacucgauugcucgccgcgaacuggacuugauuucaacgaaauggugcucuuaaccaugaaggagaaauccuggcuuguacauaaacaaugguuucuagacuuaccucuuccguggacgagcggugcaucgacaagucaggaaacuuggaauagacaagauuuauuaguuacauuuaagacagcucacgcaaagaaacaagagguaguagugcuuggcucacaagaaggugcuaugcauacagcacuaaccggagccacugaaauacaaacaucuggcacuacaacaaucuuugcgggccaccuaaaaugccgccucaagauggacaagcucacauugaaaggaaccucguauguuauguguacaggcuccuucaaacuagaaaaagaggucgcggagacucaacauggaacgguccucguucaaguaaaauaugaggguacagaugcaccauguaaaaucccguuuagcacccaagacgagaaagggguaacccaaaauggacgacuaauuacagcuaacccuauuguuacugauaaagagaaaccgguaaacauagaaacggagccaccauucggagaaucauacauuguuguaggggcaggagagaaagcucugaaacuuagcugguuuaagaaaggaucgaguauuggaaaaauguucgaagcuacagcuagaggagcucguagaauggcaauucuuggugacacagcaugggacuucgggucaauagguggaguuuucacuagcguaggaaaacuuguccaucaaguuuucgggacagcguacggaguucucuuuuccggggucucuuggacgaugaaaauuggaauugguaucuuacuaacaugguuggguuuaaauucacggucaacuagccuaucaaugacgugcauugccgugggaauggugacucuauaccuaggaguuauggugcaggcagacucgggcugcgugauuaauuggaaaggucgugaauuaaaaugcgguucgggcauauucgucaccaaugaaguacauacauggacagaacaguauaaauuccaagccgacucuccaaagagguuaagcgcggcuauaggcaaagcgugggaggaaggggucugugguauuagauccgcgacgagacuggaaaauauaauguggaaacaaauaucaaacgaauuaaaucauauucuacuagaaaacgauaugaaauucacuguagugguaggcgacgcgaaugggauucuggcucaagguaaaaagaugauaaggccccaaccaauggaacacaaauacucauggaaaagcugggggaaagcgaaaaucauaggggcagacauacaaaauaccacuuuuaucauagacggcccagauacacccgaauguccagacaaccagagagcauggaacauaugggagguagaagacuauggguuuggaauuuuuaccacuaauauuuggcugaaauugagagauuccuauacacagaugugcgaucauaggcuuaugucugcggcaaucaaggauagcaaagcgguucaugcagauaugggguauuggauugaaucggaaaagaaugaaacauggaaguuggcucgcgcuaguuuuaucgaaguaaaaacuuguacauggccgaaaucgcacacuuuauggucgaacgguguacuugaaagugaaaugauaauacccaaaauuuaugguggucccauaucacaacacaauuaccgacccgguuauuucacacaaacugccggaccauggcauuuaggaaaacuagaacuagauuucgacuuaugugaaggaacgacgguugugguagacgaacacuguggcaaucggggacccuccuuaaggaccacaacaguuacggguaaaauuauacaugaaugguguuguagaucguguacuuuaccaccccuacguuucagaggagaggauggaugcugguacggcauggaaauaaggccuguaaaagaaaaagaagaaaaucuuguaagaucaaugguaagugcaggcucaggugaaguugauaguuuuucacucgguauauuaugcgugucuauaaugauagaagaagucaugcgaucaagauggucacggaaaauguuaaugacuggaacucuagcaguguuucuccuacuaauaaugggucaauugaccuggaaggaccuaauccgccuauguauaaugguaggcgcuaaugccagcgauagaaugggcaugggcacaacauaucuggccuugauggcaacauucaagaugagaccgauguuugcuguuggguuacuauuccggagacuaacguccagagaaguacuauuauuaacuauuggucugucgcucguagcgucaguagagcucccuaauagucuagaagaauugggugauggauuagccaugggaauaaugauguugaaacuuuuaaccgaauuucacccucaccaacucuggacuacacuauuaagucuuacuuucaucaaaacgacuuuaucauuagauuaugcguggaaaacaacggcaauggcguugucuauaguuagucuuuucccauugugucuuucuacaacaucccagaaaacaacaugguuaccagucuugcucgguuccuucgguugcaaaccauuaacaauguuuuugauaaccgaaaacaaaaucuggggccgaaagaguuggccauugaacgagggaauuauggcaaucggcauuguaaguauuuuauugaguucuuugcucaaaaaugacguaccgcuagcuggaccuuuaauugcuggugguaugcuaauugcuuguuacguaauaagcggaucuucagccgauuuaucgcuagaaaaagcagcggagguuaguugggaacaagaggcagagcauucagguacaucacacaacauccuaguagaaguacaagacgaugguacaaugaagaucaaagacgaagaaagagaugauaccuuaacuauacuccucaaagcuacacuauuagcuguuucaggagucuacccaaugagcauaccggcaacuuuguuugucugguauuuuuggcagaagaagaaacaacguucaggagugcuuugggacacaccuaguccaccugaaguggaaagggcaguguuagacgaugguauuuacaggaucuugcaaaggggacuauuaggcaggagucagguagguguaggcguuuuucaagacggagucuuucauaccauguggcauguuacaaggggagcgguccuaauguaucaggguaaaagguuagaaccgucgugggcgaguguuaaaaaggacuugaucucauacggaggggguuggagguuucagggaagcuggaacacaggagaagagguccaggugauagcuguugaaccuggcaaaaauccgaaaaauguacaaacaacaccaggaacuuuuaaaacgccugaaggagaaguaggugcgauugcauuggacuuuaaacccgguaccucggggagucccaucguuaacagagaaggaaaaaucguagguuuauacggcaacggugugguaacuacaagcggcacuuauguuuccgcaaucgcacaagccaaggcaucacaggaagguccccuuccagaaaucgaggaugaaguguuuaagaaaagaaauuugacaauaauggacuuacacccuggaucuggaaaaacaaggagguacuuaccggcaauuguuagagaagcgauuaagcgcaaguuacgaacacuaauauuagcuccuacucgugucguagcuucagaaauggcggaagcacuaaagggaaugccaauccgcuaccaaacgacagccguuaaauccgagcauaccggaagagaaauaguagacuuaaugugccacgcuacauuuacaaugagauuacuuagcccaguucgaguuccgaacuacaauaugauuauuauggaugaagcccacuuuaccgauccagcuuccauagcugcacgaggcuauaucaguacccgcguaggaaugggagaagcggccgcaauuuucaugacggcaacgccaccaggaucaguagaagccuucccccaaucaaacgcgguaauccaagaugaggaacgagauauaccggaacguucguggaacagcgguuacgauuggauaacggauuucccaggcaaaacggugugguuuguaccaagcauuaaaucugggaacgauauagcuaacuguuuaaggaaaaauggcaaaaggguuauucaacuaucccgaaaaacauucgacacagaauaucagaaaaccaaaaauaaugauugggacuacguaguaacaacagauauaucggaaaugggugccaacuuuagagcagauagggugauugauccaagaagaugcuuaaaacccguuauucuaaaagauggcccagaaagagucauauuagcagggcccaugccaguuacaguagcuuccgcugcacaaaggcgaggucguaucgguagaaaucaaaacaaagaaggugaucaguacguauacaugggccagccccuuaauaaugaugaagaccaugcccauuggacagaagccaaaaugcuacuagacaacauaaauacaccagaaggaauuauuccagcacuguuugaaccagaaagagagaaaucagcugcgauagacggagaauauaggcuacggggagaagcucgaaagacauucguagaacugaugcggcgaggagaccugccaguauggcuaaguuacaaggucgcgucugaaggauuccaguauucagaccguagauggugcuucgacggagagaggaacaaucaaguauuggaggaaaacauggauguugaaauauggaccaaagagggugagcguaaaaaguuaagaccaagaugguuggacgcccggacauacagugacccgcucgcauuaagagaguucaaagaauuugcggccggccgacgcucaguuucaggcgacuugauuuuagaaauaggaaaauuaccacaacaucuuacacuaagagcacagaaugcucuugacaacuuggucaugcuccauaauagugaacaaggaggaaaggcguaucgacacgcaauugaagaauugcccgacacuauugaaaccuuaaugcuuuuagcacuuauagccguuuuaacaggaggcguaacauuguucuucuuaagcggcaaaggauuagggaagacgucuaucggguuacuauguguaacugccucauccgccuuauuauggauggcuagcguggagccucacuggauugcagcaucaauuauacuugaguucuuuuuaaugguccuacuaauucccgaaccugaucgacaacgaaccccacaggauaaucaacuagcuuacguggucaucggccucuuguuuaugaucuuaaccguugccgccaacgaaaugggauuacuugaaacgacaaagaaagaucuugguauaggacauguagccgcagaaaaucaucaacacgcaacgaugcuagacguagacuugaggccugccucugcauggacguuauacgcaguagcaacuacuguuaucacucccaugaugcgacauacgauagagaauacaacugcaaauaucucucuaacagcaaucgcuaaucaggcugcaauacuaauggguuuagacaagggcuggccaauuucaaaaauggauauuggaguuccguuacuagcacucgguuguuauucacaaguaaauccacuuacacucacagccgcaguucuaauguuaguugcucauuaugcaauaauagguccaggauuacaagcaaaagcgacccgugaagcccagaagcggacagcugcuggaaucaugaaaaauccuacuguugacggaauaguagcaauugaccuggauccgguaguauaugaugcaaaauuugagaaacaacuaggacaaauuaugcuucuuauauuguguaccagucaaauacuccuaaugagaacaaccugggcacuuugugaaagcauaacuuuagcaacugggccauuaacuacauugugggaagggucacccggaaaauucuggaauacuacaauagccgucagcauggcgaacauauuuagggguaguuaccuagcuggagcuggacuagcuuuuagucuuaugaagagucuugguggagggcgaagagguacgggugcgcaaggggaaacccuaggagaaaaauggaaacgucaauuaaaucaacuaucuaaaagcgaauuuaauacauacaaaagaagugguaucauggagguagacagaucugaggcaaaagaaggucuaaagagaggagaaacuacgaagcaugcagugaguaggggaaccgcgaaauugagaugguuuguagaacgaaaucuaguaaaaccagaagguaaggugauagauuuaggauguggaagaggugguuggagcuauuacugcgccggccuaaagaaaguaacagaaguuaaaggauauacgaaaggaggucccggccaugaggaaccuauaccaauggcuacuuacgguuggaauuugguaaaauugcauucaggcaaagacguguucuuuaugccgcccgaaaaaugcgacacccuacugugugauaucggcgaaaguagcccaaauccgacuauagaagaaggacgaacccucaggguauugaaaaugguggagccguggcuaagaggaaaucaauuuugcauaaaaauccucaauccuuacaugccaucgguaguugaaacauuagagcaaaugcagagaaaacaugguggaauguuaguaaggaauccuuugucaagaaauaguacacacgagauguacuggguaucaugugguacugguaacauagugucagccgugaauaugaccucacggauguuguugaauagauucacuauggcgcaucguaaaccgaccuaugaacgcgauguagauuuaggcgcaggaacacggcauguugccguagagccugaggucgcaaauuuagauauaauuggccagcgaauagagaacaucaaaaacgaacauaaaaguacuuggcauuaugacgaagacaacccauacaaaacuugggcauaucacggaucauaugaggucaagccaaguggcagcgcuucguccaugguuaauggcguuguuagauuauugacaaaaccaugggauguaauaccaaugguaacucaaauagcaaugacugacacuacacccuuuggacagcaacgaguauucaaagaaaaagucgacacccgaaccccuagggccaaaagggguacaacgcaaaucauggagguaacagcaaaaugguuauggggauuuuuaaguagaaauaaaaagccaagaaucuguacucgggaagaauuuacuagaaaaguaaggucgaaugcagcaauaggagccgucuucguugaugaaaaccaauggaacuccgcaaaagaagcaguagaagaugagagguucugggauuuagugcauagggaaagggaacuacauaaacaagguaagugugcaacuuguguauauaauaugaugggaaagcgagaaaagaaauuaggagaauuugguaaagcuaaagggagcagagcgauuugguacauguggcuaggagcuagguuuuuggaguuugaggcacugggauucaugaacgaagaucacugguuuucacgugaaaacucacuaagcggaguagaaggugagggcuuacauaaauuagguuauauccugagggacauaaguaagauaccugguggaaacauguacgcagacgauaccgcagguugggauacucgaauuacugaggaugacuugcaaaaugaagcuaaaauaacugauauuauggaaccagaacaugcauugcuagcaacaagcauuuuuaaauuaacuuaccaaaacaaagucguaagaguacagcgccccgccaaaaacggcacuguaauggauguuauuucccgacgugaucaacgaggaucaggccaaguugguacauacggauuaaacacauucaccaauauggaaguucaacuaauuaggcaaauggaaagugaggguauauucuugccauccgagcuagaaacucccaaucucgcugagagaguauuagacugguuagagaagcauggcgcagaaagauuaaaaaggauggcgauuucaggcgacgauugcguaguaaaaccaauagacgaccgcuucgcuaccgcauuaacagcguuaaaugauaugggaaaaguucgaaaagauauaccucagugggaaccuucuaaaggcuggaacgacuggcaacaagucccauuuuguagccaucacuuucaccaauuaaucaugaaagauggacgugagauugucguaccgugcagaaaccaggaugagcuugugggucgggcccgagugucacagggugcaggauggaguuuaaaagagacugccugcuuagggaaguccuaugcucaaauguggcaacuaauguacuuucacagacgagaccuaagacuagcagccaacgcuauauguagcgccguuccaguggauuggguaccgacgucacguacaacauggagcauccaugcccaucaucaauggaugacaaccgaagacaugcuauccguauggaaccgaguguggaucgaagaaaacccguggauggaagacaaaacucauguaagcucuugggaagaaguacccuaucuaggaaaacgugaagaucaaugguguggcucuuuaauaggacuaacggcgcgugccacaugggccaccaauauacaaguagcaauaaaccaaguuagaaggcugauagguaaugaaaacuaucucgacuacaugaccucaaugaagagauucaaaaaugaaagcgauccagagggugcuuuaugguaa

SEQ ID NO: 21280 - RNA, 9879 nt, Artificial Sequence
  derived and/or modified CDS sequence (opt6) from DENV-1__KJ189329__SS-prME
uccgucaccaugcuacuuaugcuacuaccgacugcauuagcauuucaucuuaccacucgagggggagaaccccauaugauaguauccaaacaagaaagggguaaaagccuacuuuuuaaaacaagugcuggcgugaacauguguacgcucauagcaauggaccuaggggaauuaugcgaagacacuaugacguacaaauguccgcaaauuacagaagcagaaccggaugauguggauuguugguguaaugcaacagaugcaugggucacguacgguacgugcagccaaacaggugaacacagacgugauaaacguagcgucgcacuagcuccucauguaggacucggauuagaaacuagaacagaaacauggaugaguucagaaggcgcauggaaacaaauacagcgagucgaaaccugggcauugagacacccaggauucaccguaaucgcauuuuucuuagcucaugcuauagguacuuccauaacacaaaaaggaauaauauucauacuacuaaugcuagucacgccaucaauggcgaugcggugcguaggaaucggaaacagagauuuuguagaagguuuaucaggggcaacuuggguagauguagucuuagaacacgguucaugugugaccacaauggccaaaaacaaaccaacauuagacauagaacuucuaaaaacggaggugacgaaccccgcaauucuaagaaaacuaugcauagaggcaaaaauaagcaauacaaccacggauagucggugcccgacgcaaggcgaggcgacucuaguugaggaacaagaugcaaauuuuguaugcagacgaacauuuguugaucguggaugggggaauggcugcggucuuuuugggaaagguagccuucucacgugugcaaaauuuaaauguguuacaaaacuagaaggaaaaaucguacaauaugagaaccuaaaauauaguguuaucguaacuguucauacaggagaucaacaucaaguaggaaacgaaacgacugaacacggaacaaucgcgacuauuaccccacaagcgcccacaucagaaauucaauuaacagauuauggagcguuaaccuuagacuguuccccgcgcacaggacuagauuucaaugaaaugguucuuuuaacuaugaaagaaaaaucgugguuaguucauaaacagugguuccuggaucuaccauugccauggaccagcggugcaaguacaucacaagagacguggaauaggcaagauuuauuggugacauucaaaacugcacacgcaaagaaacaggaaguagucguguuggggagucaagaaggugcgaugcacacugcguugacuggagcaaccgaaauucaaacaaguggcacuacaacuauuuuugcuggccaccucaaaugcagauuaaaaauggacaaguuaacgcuaaaaggaaccucguaugucauguguaccggaaguuucaaauuagaaaaagagguagccgaaacacaacauggaacaguauuaguccaaguuaaauaugaaggaaccgacgcaccguguaaaauaccauuuucuacgcaagaugagaagggggucacccaaaacggaagauuaauaacagcuaauccuauaguuaccgauaaagagaaaccgguuaauauagaaacugagccaccuuuuggcgaaucuuacaucguuguuggggccggagaaaaagcccuaaaauuaaguugguuuaagaaagggucaucaauaggaaaaauguuugaagcaacugccagaggggcaagaaggauggcaauauugggugauacagcuugggauuucggaucaauaggggguguauucacuucaguuggcaaacucguacaucaaguauuugggacugcuuauggcguacuguucucuggugucucauggacaaugaaaauuggaaucgguauacuucucacgugguugggacuuaauagccgguccaccucauuauccaugaccugcaucgcaguagggauggucacgcuuuaccuaggagugaugguccaagcagauucugguugcguuaucaacuggaagggccgagaacuuaaaugcgguuccgguauuuuuguuacuaaugaaguacauacauggacagaacaauauaaauuucaagcugauucuccuaagagacuaagcgcagccaucggaaaagcgugggaggagggaguaugugggauacggagcgcaacacgacuagaaaacauuauguggaaacaaauuagcaacgaguuaaaccacauacuacuggaaaacgauaugaaauucacugugguugucggggaugcaaacggcauacuagcucaaggaaagaaaaugauuagaccacaaccgauggaacacaaauacucuuggaaaucaugggguaaagcuaaaauaauaggcgccgauauucaaaauacuacuuuuauuauugauggaccugacacaccagaaugccccgauaaccaaagagcuuggaauauaugggaaguggaagauuauggauucggaauuuuuacgaccaacauuugguuaaagcuaagagauuccuacacucaaaugugugaccaucgacugaugagugcagccauaaaagacucaaaggcagugcacgcggacaugggguauuggauagagagugagaaaaaugaaacuuggaaauuagcacgagcuaguuuuauagagguaaaaacuuguacauggcccaaaagucauacuuuauggucuaauggaguccuagaaucggaaaugaucauacccaagauauacgguggucccauaucacaacauaauuaucggagcgguuauuucacucaaaccgcugggccauggcaucucgggaaguuggaguuggauuucgacuuaugugaaggaacaaccgucguaguggaugaacauugcggaaaccgcggcccaucucuacguacaacuacuguaacugguaaaaucauccacgagugguguugccgaagcuguaccuuaccucccuugcgcuucaggggcgaagaugguugcugguacggaauggaaauuagaccugucaaagaaaaggaggaaaauuugguacgaucgauggucagugcaggaucgggugagguagauucauuuagccugggaauacuuugugcguccauaaugaucgaagaaguaaugaggagucgauggucaagaaaaauguuaaugacagguacacuagcuguauuuuugcuucuaguuaugggccaacuaacauggaaugauuugauucgauuauguauaaugguaggugcaaaugcguccgauagaaugggaaugggaaccacauaucuugcgcuaauggccacuuuuaaaaugagaccgauguucgcuguagguuuacucuuuagaagauuaacaagucgagagguucuccuucuuacaauuggccuauccuugguagcaagcguugagcuaccaaacucucuugaagaacugggggauggucucgcuaugggaaucaugaugcuaaaauuauugacagaauuucaaccucaucaacuuuggacaacucuacucucuuugacguuuauaaaaacaacacuaagucucgauuaugccuggaaaacuacagcgauggcuuuaaguaucguuagucucuuuccuuuaugucucucaaccaccucacagaaaacaacuuggcuaccgguucuguuagguuccuuugguuguaagccgcuaacuauguuucuaauaacagaaaauaaaauuugggggaggaaaucguggccauuaaacgaaggaaucauggcaaucggaauaguuaguauucuauugagcucauuguugaaaaaugaugugccauuagccgggccuuuaauugcaggcgggaugcuuaucgcauguuaugucauaagugguaguucagcagacuugaguuuagaaaaggcugcagaggucucuugggagcaagaagcugagcacagcggaaccagucacaacauucucguggaaguccaagacgauggaacaaugaaaauaaaagaugaagaaagagaugauacuuugacaaucuuauuaaaagcuacuuuacuagccguaucggggguuuaccccaugagcauccccgcgacucuauuuguaugguacuuuuggcagaagaagaaacaacguagcgggguuuuaugggacacgccaucaccucccgaggucgaacgagcgguauuggaugaugggauauacaggauauuacaacgcggucuccuaggucguucucaagugggaguaggagucuuucaggacggaguuuuucauacaauguggcacgugacaagaggcgcuguucucauguaucagggaaaacgacucgaaccaagcugggcgagugucaaaaaggaucuaauaagcuaugggggcggcuggcguuuucaaggaucauggaauacgggagaagagguucaaguuaucgcuguugaaccaggcaaaaauccuaaaaauguccaaacaacaccgggcacauucaaaacuccagagggcgaagucggcgcaauugcacucgauuuuaagccagggacaucagggucuccaaucgugaacagggagggaaaaauaguuggauuauacggaaacggggugguaaccacgucugguacguauguaucagcuaucgcgcaggcaaaggcuucccaggaggguccgcuuccagaaauagaggacgaagucuucaagaaaagaaacuuaacgaucauggauuuacauccuggcucaggaaaaacgaggcgauaucuuccagcuauugugagggaagcgauaaaacguaaacuaagaacuuugauacuugcaccuacaagagucguugcaagugaaauggcugaagcacuaaagggcaugccgauacgguaccagacgacugcugucaagucagagcauacaggaagggaaauuguugaucuuaugugccaugcaacauuuacaaugaggcuacuuucucccguuagaguuccaaacuacaacaugauuauaauggacgaagcacacuucacagacccagcaucgaucgccgcaagaggauauauuuccacgcgugugggcaugggagaggcugcugcuauuuuuaugacagcaacucccccaggcucgguugaagcauucccucaaucuaacgcuguuauacaagacgaggaaagagauauaccagaaagaucauggaacucaggguacgacuggauaacagacuuuccagguaaaaccguaugguuugugccauccauaaaaaguggaaacgacauagcaaauugucuacggaaaaacggaaaacgagucauacaauuaucuagaaagacauucgauacugaauaucagaaaacgaagaacaacgacugggacuauguaguaacgacugauauaucggaaaugggugcuaauuucagggccgauagaguaaucgacccaaggagaugcuuaaagccagugauucuuaaggacgguccagaaagaguuauacuagcggggccuaugccugucacgguagcgagcgcugcacagaggcgagggagaauagggaggaaucagaacaaggaaggugaccaguacguauacauggggcaaccccuaaauaaugaugaagaucaugcacauuggacagaagcaaaaaugcuguuagauaauauuaauacaccagaaggaauuauuccagcccuauuugaaccugaaagagagaaaagugcagcaauagauggcgaguacagacuacggggugaagcaaggaaaacguucguggaguugaugcguagaggagacuuaccgguauggcuauccuacaaaguagccagcgaagguuuucaauauagcgauaggcgaugguguuucgacggugaacggaauaaucagguguuagaagaaaacauggauguagaaauuuggacgaaagaaggagagcgcaagaaauugagaccaagaugguuagaugcacgaacguauuccgacccccuagcgcuaagagaauuuaaggaguuugcagccggucgacgcuccguuagcggagaccucauauuagagaucggaaaauugccgcaacauuuaacaaguagagcacaaaaugcguuagauaauuugguaaugcuacacaacucugaacaagggggaaaggcuuauaggcacgcuauggaagaacuuccagacacaauagaaacauugaugcuacucgcacuuauagccguauuaaccggaggcguaacguuauucuuccuaagcggaaaagggcuaggaaagacgaguauuggauuauugugcgugacggccucgagugcuuuacuauggauggccucaguagaaccacauuggauugcggcaagcauaauacuggaguucuuuuuaauggugcuacuaauaccggaaccugaccgacaaaggacaccccaagauaaucaacuggcauauguuguuauaggacucuuauuuaugaucuuaacaguggcagcaaaugaaauggguuuacuugaaacuacaaagaaagaucuaggaauuggacauguagcagcagaaaaucaccaacaugcuacuaugcucgauguagauuuaagaccugcgucagcauggacacucuaugcaguggcgacgacuguuaucaccccaaugaugagacauacaauugaaaauaccaccgcgaacauaucacuuacagcgauagccaaucaggcugcaaucuugaugggacuagauaaggguuggccaauaucgaaaauggacauagggguaccgcuguuagcgcucggaugcuacagucaaguaaaucccuuaacacuaacagcggccguauugaugcuaguagcgcauuaugcaauaauaggaccuggcuugcaggcaaaggcuacaagggaagcacaaaagagaacagcagccggaauaaugaaaaaucccacaguugaugguauuguugcuauugaccuggaucccgucguuuacgaugcaaaauuugaaaagcaacuggggcaaauaaugcugcuaauacuauguaccagccaaauauuacucaugcguaccacgugggcuuuaugugaaucaauaacacuugcaacgggaccguugacaacacuaugggaagggagcccaggaaaauucuggaauacaacuaucgcagugagcauggcuaacauauucagagggagcuacuuagcaggcgcaggauuggcuuucucucuaaugaaaagccucggcggaggacgucgaggaacgggagcucagggagaaacucuuggcgaaaaguggaaaagacaauuaaaccaguuaucuaaaagcgaguuuaauacuuauaagagauccgguauaauggaaguggauagguccgaggcaaaggaaggucuaaaaagaggugaaacuacaaaacaugcuguaagcagagggacagcgaaguugagaugguucguagaaaggaaucucguaaagccugaaggaaaaguaauagaucugggcuguggcagagguggguggaguuauuauugugcaggauuaaagaaagugacggagguaaaggguuacacaaaaggaggaccggggcaugaagaaccaauaccaauggcaacuuacggauggaaccuagucaaauuacauucaggaaaagauguauucuuuaugccaccggaaaaaugcgauacacuuuuaugugacaucggagaaucaucaccaaacccuacuauagaagaagggaggacgcuacguguucuaaaaauggucgaaccuuggcuacgaggaaaccaauuuuguauaaaaauucuaaacccauacaugccauccguuguagaaacucuagaacaaaugcaacgaaagcauggugggauguuggucaggaauccuuugucacguaauucgacccaugaaauguacuggguaucauguggaacggggaauauaguuucugccgucaauaugacaagucggaugcuacucaauagauuuacgauggcucaucguaagccuacauaugaacgagauguggauuuaggcgcagguacccgacacguagccguagagcccgaaguagcuaauuuagauauaauaggacagagaauugaaaauaucaaaaacgaacacaaaaguacguggcauuacgaugaagauaauccauaccguaccugggcuuaucauggaaguuacgagguaaaaccaucaggauccgccucaucaaugguuaacggaguuguaagguuacugacgaaaccuugggaugucaucccaauggucacacagauagccaugacagauacuaccccauuuggccaacaaagagucuucaaagaaaaaguagauacuaggacaccgagagccaaaagaggcaccacacaaauaauggaagucacagccaaaugguuauggggguucuugucaagaaacaagaaaccuaggauaugcacccgcgaagaauuuacgcguaagguuagaucgaacgcagcaauuggagcaguuuuuguugacgaaaaucaauggaacuccgcuaaagaagcaguugaagaugaaagguuuugggaccuaguacacagggaacgagaacuccauaagcaaggaaaaugugcgacaugcguauauaacaugauggggaaacgugagaagaaacucggcgaauuuggaaaagcaaaggguagucgggccauaugguauauguggcuuggggcgagauuucuagaguucgaggcgcucgguuuuaugaaugaagaucacugguucaguagggaaaacucgcuuucagguguagaaggugagggccuacacaaacuaggauauauucuccgagauaucuccaagauuccuggagggaauauguaugcagacgauacagcagguugggacaccagaauaacugaggaugacuugcaaaaugaagcaaagauuaccgaaauaauggaaccagaacacgcauuguuagcaaccucaauauuuaaacuaacuuaucagaauaaaguaguacggguccagagaccugccaaaaaugguacggucauggauguaauaucaagacgcgaucaaagagggucuggucaaguagguacuuacgguuuaaacacuuucacuaacauggagguacaauugauuagacaaauggaaucagaagggauuuuucuuccaucugaacuugaaacaccgaacuuagcagaaaggguacuagacugguuggaaaagcauggagcugaaagauuaaaacgcauggcaauaucaggggaugacugcguuguuaaaccuauugaugacagauucgcuaccgcucuuacagccuuaaacgauaugggcaaaguccggaaggauaucccacaaugggaaccaucaaagggauggaacgauuggcagcaggucccauucuguagucaucauuuucaucaauuaauuaugaaagaugggcgagagauuguugucccgugucguaaucaagaugaauuggucggacgugcaagaguaucacagggagcaggauggaguuuacgagaaacagccuguuuggggaaaaguuaugcgcaaauguggcaacuaauguacuuccauaggagagauuuaagguuagcugcaaacgcaaucuguuccgcaguaccugucgacuggguuccaaccucgaggacaacuuggagcauacaugcucaucaccaauggaugacuacagaagauaugcuaucuguguggaauaggguuuggauagaagaaaauccauggauggaagauaagacacaugugaguagcugggaagaggugccuuaucuuggaaaaagggaagaccagugguguggcucauugauuggauuaacagcgagagcaacuugggccaccaauauccaagucgcuauaaaccaagugcgacgacuaauagguaacgaaaacuacuuggacuauaugacguccaugaaacgcuuuaaaaacgaaucggauccagaaggcgcucuuugguaa

SEQ ID NO: 21281 - RNA, 9879 nt, Artificial Sequence
  derived and/or modified CDS sequence (opt6) from DENV-1__KJ189331__SS-prME
ucagugacgaugcugcuaaugcuacuacccaccgcacuagcguuccauuugacaacaagaggaggagaaccacauaugauugugucuaaacaagaaagaggaaaaagucuacuauuuaaaacaagugcaggaguaaacaugugcaccuuaauugcaauggauuuaggugaauuaugugaagauacaaugacguacaaauguccacaaauaacugaagcagaaccagaugauguggacuguuggugcaaugcaaccgauacaugggucacguauggaacuugcucacaaacaggagaacacagacgugauaaaagaagcgucgcucuugcuccccauguuggucugggauuagaaacucggacagaaacauggauguccuccgaaggcgcuuggaaacaaauacagcguguugaaacaugggcucuuagacauccaggguuuacaguuauagcacucuuucucgcgcaugcaauagggacaaguauuacgcagaaagggauaauauuuauacuauuaauguugguaacuccgucaauggcuaugcgauguguaggaauuggaaaucgagacuuuguggaaggucucaguggagcaacauggguugaugugguucuagagcacggauccugugucaccacgauggccaaaaauaaaccaacauuagacauagaauuacuaaaaacggagguaacgaauccagcuauuuuaaggaaacuuugcauagaagccaagauuucuaauacaaccacggauucacgaugucccacacaaggagaggcuacauuaguugaagaacaagaugcaaacuuuguaugucguagaacauuugucgauagggguugggguaaugguugcgggcuuuuugguaaaggaucuuuacucacaugugcuaaauucaaguguguaacgaaacuagaaggaaaaauaguccaauacgaaaaucuaaaauacagcguaauuguaacaguacacacaggggaccaacaucagguaggaaacgaaacaaccgaacaugggacaauagccacaauaacaccccaagcaccuacaagcgagauccaauugacagauuacggagcccuaaccuuagacuguucaccaagaacaggacuggauuuuaaugaaauggugcuacuaacuaugaaagagaaaucuuggcuaguacauaaacaaugguucuuagaucuaccacuaccauggacuagcggagcuagcacaucccaagaaaccuggaacagacaagaccuacugguuacauuuaaaacagcccaugcgaaaaagcaagaaguaguuguauuagggucucaggaaggagccaugcauaccgccuuaaccggugccacagaaauacagaccucaggaacaacaacaauauucgccggacacuuaaaaugccgccuaaagauggauaaacuaacauuaaaagguaccaguuauguaauguguacaggcagcuucaaacuugaaaaggaaguggcggagacccagcacggaacugucuuaguucaagucaaauacgaaggaacggacgcaccgugcaagauacccuuuucuacgcaagaugaaaaaggaguuacacaaaaugguagacugaucaccgcuaacccaauuguuacagauaaagaaaaacccgugaauauagagacggagccaccuuucggagagucauauaucguggugggagcaggagagaaagcucuaaaauuaagcugguucaaaaaggguucuagcauugguaaaauguuugaagccaccgcccgaggugcgcguaggauggcaauucucggggauacagccugggauuucggaucaauaggugggguuuucaccagcguuggaaaacuuguacaccaaguuuuugguacggcuuauggcguauuguuuucuggcguuucguggacaaugaaaaucgggaucgguauucuacugacauggcuaggauugaacucccgcucaacgucccuaucuaugacaugcauagcgguuggcauggucacgcucuauuuggguguaaugguucaagcggacagugguugcguuauuaauuggaaagggagggagcuuaaauguggaagugggaucuuugugacaaacgaaguccauacguggacagaacaauacaaauuccaagcugacagcccuaagcgcuuauccgcggccaucgguaaagcaugggaagaaggcguauguggcauucggagugcuacacggcuugaaaauauaauguggaagcaaauauccaaugaauugaaccauauccuacuagaaaacgacaugaaguucacuguagucgugggggaugccaacggcauauuagcacagggcaagaaaaugauuaggccacagccuauggaacacaaauacaguuggaagaguuggggaaaagcuaaaaucauaggagccgauauacagaauacgacauuuaucauugacgguccagauacgccugaauguccagauaaucaaagagcguggaacauaugggaaguagaagauuauggauucgguauauuuacaacaaauaucuggcuuaaauuacgggacucauauacucagaugugcgaucacagacugaugucugcagccauaaaggauucaaaagcaguacacgcugacaugggcuauuggaucgaaucagagaaaaaugaaacauggaaacuagcuagagcaaguuucauagaagucaaaacauguacuuggccaaaaagucauacgcuauggucaaacggaguguuagaaucggaaaugauaauaccaaaaauuuauggaggcccuaucagucaacauaacuacagaccaggcuauuuuacacaaacugccgguccguggcaccuagggaaacuagaguuagauuuugaucucugcgaaggaacaacgguuguuguggaugagcauugcgguaauagaggucccagccucagaacaacgacagugaccggaaaaauuauacaugaguggugcugccgaucauguacacuuccgccgcuccguuuucgcggggaggacggauguugguaugguauggagauacgucccguuaaagagaaggaggaaaaucuggucagaucuauggugucugccggaucgggugaagucgacucauuuucucuuggcauucucugugcauccaucaugaucgaggaaguuaugcguucgagauggucuagaaaaauguuaaugauaggcacuuuggcuguauuuuuacuguugaucaugggacaacuuacauggaaugaucuaauacgguuauguauaaugguaggugcuaacgcaucagacagaaugggaaugggaacuacuuaucucgcgcuaauggcgacguuuaaaaugcggcccauguucgcaguaggauuacuuuuucgaagguuaaccagucgggaaguccuauuguuaacgauagguuuaucacugguagccucgguagagcucccuaacagcuuagaagaauuaggagauggccuagcgaugggaauuaugaugcuaaaacuucuuacugaauuucaaccgcaccaauuauggacuacuuuacuaucacugacuuucauaaaaacuacauugucauuagacuaugcuuggaaaaccacagccauggcacugagcauugucaguuuguuuccauuaugucuaucaaccacaucacagaagacgacaugguuaccuguccuucuagguaguuuuggauguaaaccucuuacuauguuucuuauuacagaaaauaaaauaugggggcgaaaaucguggcccuuaaacgaagguauaauggcaauuggaauaguaucaauucuauugucgucacuccuuaaaaaugacguuccccuagcuggaccauugauagccggugguauguuaauagcaugcuacguuauuagugguucaagugcagaccuaagccuagagaaaacugcagaaguaagcugggaacaggaggcggaacauucugguacaucacauaauauccuagucgaaguccaagaugacggaacuaugaaaauuaaagaugaagaacgugacgauacacuaaccauccuguuaaaggcaacucuacucgcagucucaggcguauauccaauguccauaccagccacucuauuugugugguauuuuuggcaaaagaagaaacaacgaucuggaguucuuugggauacccccucaccuccugagguagaacgcgcgguauuagaugaugggauuuauaggauucuacagcgcgggcuucucggacggagucagguaggaguggguguguuccaagaugggguauuucacaccauguggcauguaacaagaggcgcuguauugauguaucaaggcaaacgauuggaaccaucuugggcuuccgugaaaaaggaccuuauaaguuacgguggcggauggcgauuucaggggucauggaauacaggugaagaaguacaggugauagcgguagagcccggcaaaaacccuaaaaacguccaaacgacaccggguacguuuaaaacaccagaaggagaaguaggagcuauagcacuagacuuuaaaccaggaacuucaggcagcccaauaguaaaucgggaaggcaaaauagugggccuauaugguaaugguguagugacuacuuccgguacguaugucucagccauagcccaagcaaaggcuagucaggaaggcccauuaccagaaauugaagacgaagucuucaagaaacguaauuugacaaucauggaccuacacccagggagugguaagacaagacgauaccuacccgcgauaguacgcgaagcuauaaagcguaaauugaggacucuaauacuggcuccaacaaggguagucgccagcgaaauggcagaagcccuaaaaggaaugcccauacgauaccaaaccacagcggucaaaucugaacauacgggacgggagaucguugaccugaugugucaugcaacguuuacaaugaggcuacugagcccaguacggguccccaacuauaauaugauuauaauggaugaagcucacuuuacagaucccgccuccauagccgcgcgaggauacauaucuacacgagucgggaugggugaagcggccgccauuuucaugacagcaacaccgcccggaucgguugaagcauucccucaaucaaaugcggucauccaagacgaggagagagacauuccagaaagaucuuggaacucaggcuacgacuggauaaccgauuuuccaggaaagacagugugguuuguaccaagcauaaaaucagguaacgacauagcuaacugucuacggaaaaacgggaaacgaguuauccaauuaagcaggaaaacuuucgauacagaguaucagaaaacuaaaaauaaugauugggacuauguagucaccacggauauuucugaaaugggagcuaauuuucgagccgauagaguaauagacccacggagaugucuaaaaccuguaauacuaaaggaugggccagaacgaguuauacuagcagggccuaugccaguuacaguagcaucugcugcgcaaagacgcgggcguauuggucguaaccaaaauaaagaaggcgaucaauacguauacaugggacaaccacuaaauaacgaugaagaucaugcucauuggacagaggcgaaaauguugcuagacaacauuaauacgccagagggaauuauaccugcuuuauuugagccagagagagaaaaaucugcagccauagauggagaauaccguuugagaggggaagcaagaaaaacauuugucgaacuaaugcgaaggggugacuugccugucuggcuauccuacaaaguagcgucagagggguuucaauauucugauagacgauggugcuuugauggagaaagaaauaaucaagugcuggaagaaaacauggauguagaaauuuggacuaaagaaggggaaaggaagaaauugcgaccucgguggcuggaugccagaacauauucggacccucucgcgcuacgagaauuuaaggaauuugccgccggaagacguuccguuaguggagauuuaauuuuagagaucggaaaacuuccacaacaucuuacccuuagagcacagaacgcucuggauaaccuggcuaugcuacauaauucggaacaaggaggaaaagcauauaggcaugcuauggaggaacugcccgauaccaucgaaacuuugaugcuacuugcacugauagcagucuuaacugggggaguuacuuuauuuuuccuaucagguaaaggacuuggcaagacaucaauuggucucuugugugucacagcaucaucagcgcuguuauggauggcuaguguugaaccucauuggauagcagcaagcauaauccuagaauuuuuccuuauggucuuauuaauaccugaaccagacaggcaaagaacaccacaagacaaccagcuugcguacgucguuauugguuugcuauucaugauccuaacgguugcagcaaaugagaugggacucuuagaaaccaccaagaaagaccugggaaucggacacguugcugcagaaaaucaccagcacgcuaccaugcuagacguagauuuaaggccggcuucagccuggacauuauaugcaguugcgacaacuguaauaacaccaaugaugcgacauaccauagagaauacaacagcaaacauuucauugaccgcaaucgcuaaucaggcagccauauuaaugggacuagacaaagguuggccuaucucuaagauggacauagguguuccgcuuuuagcucuuggaugcuauucacaagucaauccuuuaacacucacugccgcuguuuugaugcucguugcgcacuacgcuauaauaggcccgggucuucaagcaaaagccacccgagaggcacaaaaacgaacggccgcuggaauaaugaaaaaccccacagucgacgggauaguugcuauagaucuagauccggucguguaugacgcaaaguuugaaaagcaacucggccaaaucauguuacuuauacucugcacaucccagauauuacuaaugagaacuacaugggcuuuaugugaaagcauaacucucgcuacuggaccacuaaccacacuaugggagggcucgccgggaaaguucuggaacacgacuaucgcggugaguauggcaaauauuuuucgaggaagcuauuuagcgggcgcaggacucgcguucagucuaaugaaaaguuuaggaggaggccguagagguacaggggcccaaggagaaacucuaggugaaaaauggaaacgccagcugaaccaacuguccaagagugaguucaauacuuauaaacggucagguauuauggaaguugauagaucagaagcaaaagaaggucuaaaacgaggugaaacgacaaagcacgccguaagccgugggacagcaaaacucagaugguucguugagcggaaucuuguaaaaccagaagguaaagugauugaucuagguugcggacgaggaggauggaguuacuauugugccggauugaagaaagucacagaaguaaagggcuauacaaaaggugggccaggacaugaagaaccuauaccuauggcaacguauggauggaaccuaguaaaacuacacagcggcaaagacgucuucuucaugccaccagaaaaaugugacacauuauuaugugacaucggcgaaucuucuccaaauccgacuaucgaggaaggccgaacacuacgaguccuuaaaaugguggaaccuugguuacguggaaaccaguucugcauuaagauucuaaaucccuauaugccauccguaguagagacacuugaacaaaugcagaggaaacacggaggaaugcuagucagaaauccguugagccguaauucuacucaugaaauguauugggucaguugcgggacaggaaauauagugucugccguuaauaugacaucgcggauguuacuaaaucgauuuacaauggcucacagaaaacccaccuucgagagagacguugauuuaggugcuggcacaaggcaugucgcgguugaaccugaagucgcaaaccuagauauaauuggccaaaggauugaaaauaucaaaaaugaacacaaaaguacuuggcauuaugaugaggacaauccuuacaaaacaugggcguaccaugggucauaugaaguaaagccuucagguucagccaguaguauggucaauggagucguaaggcuucuuacaaaaccaugggauguuauaccuaugguaacgcaaauugcuaugacagacacgacgccauuuggacaacagcgcguuuucaaagaaaagguagauacacggacaccaagagcgaaacgggguacaacccaaauuauggaagucacugcgaaauggcuauggggauuccuaagcagaaauaagaaaccaagaauauguacacgagaagaguuuacgcguaaagucaggucuaacgcagcuauaggagcuguuuucguagacgaaaaucaauggaacucagcaaaagaagcuguugaggaugagcgauuuugggauuuaguccauagggaaagggaauuacauaaacaaggaaagugugcuacaugcguauauaauaugaugggcaagcgugaaaagaaguuaggcgaguucggaaaagcuaagggaaguagagccaucugguauaugugguugggugcuagauuucuugaguucgaagcacucgguuucaugaaugaagaucauugguucucccgugaaaacagccuguccgguguggagggagaaggccuucacaaauuagguuauauauuaagagacauaucaaaaauaccuggugguaauauguacgccgaugacacugcuggcugggauacacgaauaacugaggaugaccuucaaaacgaagcaaaaaucaccgauauuauggagcccgaacacgcauuacuagccacaaguaucuucaaguuaaccuaucaaaauaagguaguuagggugcagagaccugcuaaaaauggcacaguaauggauguuaucagucgccgagaccaaagagguagcggucaaguggggacuuauggccuaaauaccuuuacgaauauggaagugcaauugaucagacaaauggaaucagaagguauauucuuaccaagugaauuagaaacacccaauuuagcagaaagaguauuagauuggcuggagaaacauggagccgaaagauuaaaaagaauggccauaucaggugaugauugcgugguaaaaccgauagacgaccgauuugcuacggcccuuacagcauuaaaugacaugggcaaaguccgaaaagauauaccacaaugggaaccaucaaaaggcuggaacgacuggcaacagguaccuuuuuguagucaccauuuucaucagcuuauuaugaaagacggcagggaaauuguugugccguguagaaaccaggacgagcugguggggagagcaagaguuucucaaggugcaggguggagcuuacgugaaacugcgugccuagguaagucauacgcgcagauguggcaacuaauguauuuucaccggcgagacuuaagacuagcugcaaaugcgauuuguuccgcgguaccuguagauuggguaccuacgucacgaacaacuugguccauacacgcgcaucaucaauggaugacuacggaagauaugcuaucugucuggaacagagucuggauugaggaaaauccauggauggaagauaaaacucaugucucuucgugggaggaaguaccauaccuagggaaaagagaagaucaaugguguggaucucucaucggucucacagcacgagccacaugggcuacaaacauacaaguagcaauaaaucaagugcgaagguugauuggaaaugagaacuaucuggauuauaugaccucuaugaaaagauuuaagaacgagucggauccagaaggagccuugugguaa

SEQ ID NO: 21282 - RNA, 9879 nt, Artificial Sequence
  derived and/or modified CDS sequence (opt6) from DENV-1__KJ189332__SS-prME
ucagucacuauguuauugauguuauuacccacagcgcuagcauuccacuuaaccacaagaggaggagaaccccauaugauaguuuccaaacaagaacguggaaaaucccuauuguucaaaaccuccgcaggggucaacauguguacacuuauagcgauggaucuuggugaauugugcgaagacacaaugacauacaaauguccacaaauuacagaagcagaacccgaugacgucgacuguugguguaaugcaacggacaccuggguaacauacggaacauguucacaaaccggugaacaucgaagagauaaacgaucaguagcucuggcaccgcaugugggucugggguuggaaacucgaacagaaacauggauguccucugaaggggcguggaaacaaauacaaaggguagaaacaugggcucuaagacauccagguuucaccguaauagcucuauuuuuggcucacgcgauuggaacaagcauaacucaaaaaggaacgauuuuuauccuguugaugcuuguuaccccaucaauggcaaugagaugcguggggauuggaaauagggauuucguugaaggauuaucaggcgcgacguggguugacguaguuuuagaacacggaucuuguguuacgacgauggcgaaaaauaaaccaacacuagauauugaacuguuaaaaacugaaguuacaaacccagcuaucuuaagaaaacuauguaucgaagcuaaaauaucaaacaccaccacagauagucgaugccccacccaaggagaagcaacuuuagucgaagaacaagaugcuaauuucguaugccguaggacauuuguagaccgagguugggggaaugguuguggacucuuugguaaagggagcuuacuaacaugugcaaaauuuaaaugugugacuaaacuagaaggaaaaauaguucaauacgaaaaccuaaaauauucgguaauagucacuguucacaccggugaccaacaccaaguaggaaaugaaaccacugaacacggaacaauagccacuauuaccccucaagcuccaacuagcgaaauccaauugacggauuauggcgcuuugacuuuagauugcucucccaggacugggcucgauuucaaugaaauggugcucuugacuaugaaagagaaaaguuggcuaguccauaaacaaugguuuuuggauuuaccauuacccuggacaagcggagcgaguacuucacaagaaacuuggaacagacaagaucucuuaguaacauucaaaacugcacaugccaagaaacaagaaguggucguacuuggaucacaagaaggcgcaaugcauacagcauuaacgggagcaacagaaauacaaacuagcggaacgaccacaauauuugcuggacacuugaaaugcagauugaaaauggauaaacuaacccuaaaagggacgaguuacguuaugugcaccggaaguuuuaaacuugagaaagaagucgccgaaacucaacacgggaccguauuaguccaaguaaaauaugaagguaccgaugcaccauguaaaaucccauucagcacacaggaugaaaaaggcguuacgcaaaauggacgccuaauaacagcaaacccaauuguaacggauaaagaaaaaccagugaauauagagacggagccaccuuucggcgaauccuacauuguaguaggggcuggagaaaaagcguuaaaacuuagcugguuuaaaaagggaagcagcaucgguaaaauguucgaagcuacagcaagaggugcgcgaagaauggccauacuaggagacacagccugggauuucgguuccauuggcggaguuuucacuucaguuggaaagcuaguucaucaaguuuucgguacggccuacggaguacuauucagcgguguaagcuggaccaugaagauagguauaggcauucugcuaacaugguuaggacuaaauucgcggucaacaaguuuaucgaugacguguauagcugugggaaugguuacauuguaccuagguguaaugguucaagcggacucuggauguguaauaaauuggaaaggaagggaauuaaaaugcggaucuggaauauuuguaacgaacgaaguucacacuuggaccgaacaauacaaauuucaagccgauucgccaaaacgguuaagugcagccaucggaaaggcuugggaggagggagugugcggcauacggagugccacaaggcuagaaaauauaauguggaaacaaauaucgaaugagcugaaucauauacuucuugaaaacgacaugaaguucacaguuguaguaggagaugccaaugguaucuuagcccaaggcaagaaaaugauaagaccccaaccuauggaacacaaauauaguuggaaauccugggguaaagcaaaaauaauaggugcugauauucaaaacacaacguucaucaucgauggacccgauacaccugagugcccagauaaccagcgagcauggaauauaugggagguagaagauuacggauucggaauauuuacaacaaauauauggcuaaaauuacgagacucuuacacgcaaaugugcgaucaucgacucaugagugcagcuauaaaagauagcaaggcgguacaugcagacaugggcuauuggauagaaagcgagaaaaacgaaacauggaaauuagccagagcuuccuuuauagaagugaaaacguguaccuggccuaagucucacacguuauggaguaacgguguauuggagagugaaaugauaauaccuaaaaucuacggaggacccauuucacaacacaacuaucggccgggguauuuuacgcaaaccgcaggaccguggcaccuaggcaaauuggaacuugauuucgauuuaugugaaggaacaaccguggugguugacgaacacugcgguaauagaggaccauccuuacgaacgacgacggugacgggcaagauuauacacgaaugguguugucggagcuguacguuaccaccacuaagauucagaggagaagacggaugcugguacggaauggaaauacgacccgugaaagaaaaagaagaaaacuuaguacgaagcaugguaucagcgggaucuggagaaguagacaguuuuucuuuaggcauacuuugcgcaagcauuaugaucgaggaaguaaugagaucaagauggucucguaaaauguuaaugacaggaacguuagcagucuuucuccuuuuaauuaugggucaauuaacauggaaugacuugauuagauugugcauaaugguuggagcuaacgcuucagauagaauggggauggguacuacauacuuagcacuuauggcuacauuuaaaaugcggccuauguuugccgucggcuuauuauuuaggaggcugacgucacgagagguauuguugcucaccauaggacuaucauuaguagccucgguugaacuaccgaauagcuuggaggaacuaggugauggccuugcaauggguaucaugauguugaaguuacucacugaauuucaaccgcaccaauuauggacuaccuuacuuucacuaaccuuuauaaaaacaacguugucacuggauuacgcguggaaaaccacagcaauggcgcuaucaauagucagcuuauuuccacugugccugucuacaacgucacagaaaacuacgugguuaccaguacugcuaggcagcuucggguguaaaccacuaacaauguuucugaucaccgaaaacaagauauggggucgaaaaaguuggccauuaaaugaagguauuauggcaaucgguauuguaucaauccuuuuguccucauuauugaagaacgauguaccgcuugcgggcccacucauagcugggggcauguuaauagccuguuauguaauuucggguuccagugcagauuuaucacucgagaagacugcagaaguuaguugggagcaagaagcggaacacaguggaacuucacauaacaucuuaguggaaguacaagaugauggaacuaugaaaauaaaagacgaagagagagacgauacucuuacaauacuacugaaagcuacccuuuuagcaguuucuggaguuuacccuaugucaaucccagcuacucuauucguaugguauuucuggcagaagaagaaacaaagaucaggaguguuaugggauaccccgaguccacccgaggucgagagagcaguauuagaugauggaauuuacagaauacuacagagaggucuuuuagguagaagccagguagguguugguguauuucaggaugguguuuuccauaccauguggcaugugacgaggggcgcaguccuaauguaucaggguaaaagauuggagcccucaugggcuaguguuaagaaggacuugauaucuuauggagggggcuggcgauuucagggcucauggaacacuggagaagaaguacagguuauagcuguagaaccagguaagaacccgaaaaacguucaaaccacucccggaacguuuaaaacuccggaaggagaaguaggagcgaucgcucuggauuuuaaacccggaacgagugguucgccaauaguaaacagggaaggcaaaaucguuggacuuuacgguaaugguguuguaaccacauccgguacauaugugagcgcaauagcucaggcaaaagcaucgcaagaaggaccauugccugagauagaagaugagguuuuuaaaaagcgaaaucuuacaauaauggaccugcacccugggucaggaaagaccagacgguauuuacccgcaauaguucgagaagcgauuaaaagaaaacuccguacacucauauuagcaccgacacguguaguggcaucagaaauggcugaagcucugaaaggcaugccgauacgauaccaaacuacagccguaaaaucggagcauacgggaagggaaauaguugacuugaugugccaugcuacuuuuacaaugcgccucuugagcccuguacggguaccgaacuauaauaugauuauuauggaugaggcacacuuuaccgauccugcaucaauagcagcacgagguuacauuucaacgagagugggcaugggcgaggcggcagccaucuuuaugaccgccacaccaccuggcucaguugaagcauuuccacaaucaaacgcuguaauacaggaugaggaaagagauauaccggagcgaucuuggaacagcggguaugacuggauaacggauuucccaggaaagacaguaugguucguucccagcauaaaaucagggaaugauauagcaaauugcuugaggaaaaauggaaaaaggguuauacaacuuagccguaaaacauuugacacggaauaccaaaagacaaagaauaaugacugggauuacguaguuacuacagauauuucagagaugggugcgaacuucagagcggaccguguuauugacccaagaagaugucuaaagccgguaauacuuaaggauggaccagaaagagucauacuggcagguccuaugccgguaaccgucgcaucagcggcacaaagaagagggcggaucggucgcaaucaaaacaaagaaggggaccaauauguguacaugggucaaccguuaaauaaugaugaagaucaugcccacuggacagaagccaaaaugcuucuugacaauauuaacacccccgaagggauaauaccagcacuauuugagccggaacgagagaaaagcgcggcgauagauggugaauacaggcuacguggagaagcgagaaaaacguucguagaacugaugagaagaggcgauuuaccuguuugguugucuuacaagguugccagugaagguuuucaauauucugacaggcgcugguguuuugauggcgaacgcaacaaccaaguuuuggaagaaaauauggauguugaaauuuggacaaaggagggcgaaaggaagaaacuuaggccucguugguuagacgcaagaacauacucugaccccuuagcauuaagggaauuuaaggaauuugcugcagguagacggagcguuucuggugaccuuauacuggaaauugggaaacuuccacagcauuugacccuaagagcacagaacgcuuuagauaaucuggccaugcuucacaacucugaacaaggagggaaggcuuaccgacaugcgauggaagaacuaccggacaccauugaaacacuaaugcuauuagcacuaaucgcugucuuaacaggaggaguaacauuguuuuuccucucaggcaaaggccuuggcaagacauccauaggccuacuauguguaaccgcaucaagugcauugcuuuggauggcaucuguugagccgcacuggauagcagcgucaauaauccuagaguucuuucuaaugguucuacuaauaccagagccggauaggcagcgcacaccacaggauaaucaguuggcauauguaguuauugguuuauuauucaugauacugacuguggcugcaaacgagaugggcuuauuagaaacaacuaagaaagaccuggguauaggucacgucgcugcugaaaaucaucagcacgcaacaaugcuugauguggacuuacgaccagcaucugccuggacccuguacgccguagcuacuacagugaucacgccaaugaugcgacacacgauagaaaauacuaccgcgaacauaagccuaacagccauugcgaaucaagcugccauacucauggggcucgauaaaggauggccuaucucuaaaauggauauagguguaccauuacuggcacuugggugcuacucacaagugaauccucuuacuuuaacugccgcaguucugauguugguggcgcauuaugcaauaauuggaccgggacugcaagcaaaggcaacaagagaagcucagaaaagaacagcggcagguauuaugaaaaaucccacgguugauggaauaguugcaaucgacuuagaccccgucguuuacgacgccaaauuugagaaacaacuaggacaaauuauguuacucauucuuuguacaagccagauucuauuaaugcguacgacgugggcauugugcgaauccauaacauuagcaacagguccauuaaccacuuuaugggaagguucacccggaaaauucuggaauacaacaauagcaguuagcauggcuaacauuuucagggguagcuaucucgcuggagcagggcuggccuuuucgcucaugaaaaguuuaggaggagggagaagagguacgggagcucaaggagaaacccuaggagaaaaauggaaaagacaacuuaaucaacucucaaaaagcgaguucaauacauacaagcggucuggaauaauggaaguugaccguucggaggcgaaagaaggucugaaaagaggagaaacuacgaagcaugcaguaagcagaggaacagccaaacuacgcugguuugucgaaagaaauuuaguuaaacccgaagguaagguaauugacuugggaugcggaaggggcggcuggucauauuacugugcuggacugaagaaaguaacagaaguaaagggauauacuaaaggaggucccggacaugaagaaccuauccccauggcaacguacgguuggaauuuagugaaauuacacuccggaaaggaugucuucuucaugccacccgaaaagugugauacacuccuaugugauauuggggaguccaguccaaacccuacgaucgaagaaggucgaacccuccgaguacuaaaaaugguggagccaugguuaagaggaaaucaauuuuguauuaaaauucuuaauccauauaugccaucaguaguugaaacgcuagagcaaaugcaaagaaaacacggagguaugcuuguuaggaauccacuuucaagaaauaguacacacgaaauguacuggguaagcugugggaccgguaacauuguauccgcaguaaacaugacaucaaggaugcucuuaaacagguucaccauggcucauaggaagccaaccuucgagagagacguagaucugggggccggcacccgacauguagcaguugagccagagguagcgaacuuagacauuauuggacaaaggauagaaaauaucaaaaaugagcauaaauccacauggcacuacgacgaggauaauccauacaaaacuugggcauaucacgggucguaugaaguuaagccaagugguuccgcaaguucaaugguuaacggugucguaagauuauuaaccaaaccaugggaugugauaccgauggucacacagauugcuaugaccgauacaacgcccuuuggacaacaaagaguuuucaaagaaaaggucgacacacgaacgccacgcgcaaagagagguacaacacagauaauggaaguuacagccaagugguuguggggcuuucuaagucgaaauaagaaaccacgcauaugcacccgugaagaguucacacgaaagguccgaaguaacgcagcuauaggcgcuguauuuguagaugaaaaccaauggaacagcgcaaaggaagcuguagaggacgaaagguucugggacuugguccacagagaaagagaguuacauaagcaagguaaaugcgccacaugcguuuauaauaugauggggaagcgggagaagaaacuaggugaguucggaaaggcaaaaggaagccgcgcaaucugguacaugugguuaggagcaagauuccuugaauuugaggcuuuaggauuuaugaacgaagaucauugguucagccgcgagaacucacuuaguggcgucgaaggugaaggccugcacaagcugggcuauauauuacgagauaucaguaagauaccgggcggaaauauguacgccgaugacacggccggaugggauacaagaaucacagaagaugacuuacaaaaugaagccaaaauaacggauauaauggaacccgaacaugcuuuguuagcaacaucgauuuucaagcuaacauaucaaaacaaaguaguccgaguucaaagaccagccaaaaacgggacuguuauggauguaauaaguagacgagaucagcguggcucaggacaggucggaacguauggauuaaacaccuuuacaaacauggagguucaauuaauaaggcaaauggaaagcgaaggaauauuuuuaccuuccgaauuagaaacucccaauuuagcggagaggguauuggacuggcuggagaaacauggcgccgaaaggcugaaacguauggcaauuuccggagacgauugcguagucaagcccauugaugauagauuugcaacugcauuaaccgcacuaaaugauaugggaaaaguucgaaaggauauuccacagugggaaccaucgaaaggauggaaugauuggcaacaaguuccguucuguagucaucauuuucaucaauuaauuaugaaagacggccgcgaaauagucguacccuguagaaaucaagacgagcuuguaggcagagcucgaguaucccaaggagcgggauggucuuuacgagaaacagcauguuugggaaaaucguaugcucagauguggcagcugauguauuuucacagacgcgaucuuagacuagcagcaaacgcgauauguagugcaguaccggucgauuggguaccuacaucucgaaccacuuggucuauucaugcucaccaucaauggaugacuacugaagacauguuaucaguauggaaccguguguggauugaagagaaucccuggauggaagacaagacucauguuaguucaugggaagaaguaccauaucuugggaaacgagaagaucaaugguguggcucuuuaauaggacuaacugcacgggcuaccugggcgacuaauauccaggucgcuauaaaccaagugcgccgucuaauugggaacgaaaacuaccuagacuacaugacaagcaugaaaagguuuaaaaacgaaagcgaucccgaaggcgcuuuaugguaa

SEQ ID NO: 21283 - RNA, 9879 nt, Artificial Sequence
  derived and/or modified CDS sequence (opt6) from DENV-1__KJ189334__SS-prME
ucggucaccaugcuauugaugcuauuaccaacagcguuagcauuccauuuaaccacacgggguggagaaccgcauaugauaguuagcaaacaagaacgcgguaaaagccuacucuuuaaaguaagcgcgggugucaacaugugcaccuuaauagcuauggauuugggugaauuaugugaagauaccaugacauauaaauguccucaaauuacagaggcagagcccgacgauguagauugcuggugcaaugcaacugauaccugggucacauaugggacguguagccaaacuggagaacacaggagggauaaacgaucaguggcauuagcaccacaugucggucuaggucuggaaacccguacagagacauggaugucuuccgagggggcguggaaacaaauccaaagaguagaaacaugggcacuucgacauccaggauuuacagugaucgcauucuuucuugcccaugcgauagguacuagcauaacacaaaaggguaucauuuuuauucuacuuaugcuagugacaccaagcauggcaaugcgguguguugggauuggaaauagggauuucgucgaaggauuaucaggagcaacuuggguagauguaguccuagaacauggaucguguguuacaacgauggccaaaaauaaacccacauuagauauagagcuauuaaaaacugaagugaccaacccugcuauuuuacgaaaauuaugcaucgaagcaaagauuuccaacacaacaacugauucccguuguccuacacaaggggaagcaacauugguugaagaacaagaugcuaauuuuguaugcagaagaacauucgucgacagaggcuggggaaacggauguggccuauuuggaaaagguagccugcuaacuugugcgaaauuuaaguguguaacaaaacuagaagguaagaucguucaauacgagaauuuaaaguauucggucauaguuacgguucauacaggugaucaacaccaagucggaaaugaaacaacagaacaugggaccauagcuacaauaacaccccaagcaccuacuucagagauacagcuaacggauuauggugcucucacacucgauuguaguccacguacggggcuggacuucaacgaaaugguauuguuaacgaugaaagagaagaguuggcuagugcauaaacaaugguuccucgaccuaccacuaccguggacuagcggcgcaucuaccucucaggaaaccuggaaucgacaagauuuauuagucacauucaagacagcccacgcgaagaaacaagaaguggucgugcuaggaucacaagaaggagcaaugcauacagcucugacaggggcaaccgaaauucagacaaguggcacaacaaccauauuugccggacaucucaaauguagacucaaaauggauaaacucacauuaaagggaacuucauauguuaugugcaccgguaguuuuaaacuugaaaaggaaguugccgaaacgcaacaugguaccguuuuaguccagguaaaauaugaaggaaccgaugcaccuugcaaaaucccauucucaacucaagacgaaaaagggguuacgcaaaauggucgucuaauaaccgcuaaccccaucguuacagauaaggagaagccagugaauaucgagacagaacccccguuuggugaaucauauauagucguaggagcgggagaaaaggcacuaaaacucucuugguucaaaaagggaagcucgaucgguaaaauguuugaagcgacugcacgaggagccagaagaauggcaaucuugggagauacagcaugggacuucggaaguaucggagguguguucacguccguugggaaacuugugcaccaaguauuugggaccgccuauggaguccuuuuuaguggaguuaguuggacaaugaaaauaggaauuggcauucuacucacguggcucggcuuaaacucccguaguaccagccugagcaugaccugcauugcuguaggaauggugacauuauacuuagguguuaugguacaagcugauagcgguuguguaaucaauuggaaaggaagggaauuaaaaugugguucuggcauauuuguuaccaacgaaguucauacauggacugaacaauacaaauuucaagcagauucuccaaaacgucucucggcggcaauaggaaaggcuugggaagaggguguauguggaauaagaagcgcaacgagacuugaaaauauaauguggaaacaaauaucgaacgaauuaaaccauauacuguuagaaaacgacaugaaauuuacuguaguaguaggcgaugcuaacgggauucuggcccagggaaagaagaugauuagaccccagccgauggaacacaaguacucauggaaaagcugggguaaagcuaagauaauaggagcagauauacaaaacacaacuuucauaaucgacgggccagauacgccagaauguccggauaaccagagggcauggaauauaugggaaguugaggauuauggcuuugggauuuuuacaacaaauauauggcuaaaauuacgagacucguauacgcagaugugugaccaucgauuaauguccgcagcuauuaaagauucgaaggcgguacaugcagauauggguuauuggaucgaaagugagaaaaacgaaacguggaaguuagcacgagccuccuuuaucgaaguuaaaacaugcacauggccuaaaagccacaccuuauggaguaacggcguauuagagucagaaaugauaauaccaaagauauauggagguccaaucagucaacauaauuacaggccagguuacuuuacucaaaccgcuggaccuuggcacuuagguaagcuagaauuagacuucgauuugugugaaggcacgacagugguaguagaugaacauuguggaaauagaggaccaagucuaagaacgaccacaguaacgggaaaaauaauccaugagugguguugcagaaguuguacucucccaccucuaagauuccgcggcgaggacggauguugguacgguauggaaauccgaccuguuaaagagaaagaggagaauuuaguucgaucuaugguaucagcuggauccggagaaguagauagcuucucauuaggaauacuauguguaaguauaaugauugaggagguaaugaggucgcgauggucccgcaaaauguugaugaccggcacacuagcuguuuuucuucuucuaguaauggggcagcuuacuuggaacgauuuaauacgacucuguauaauggucggggcuaacgcuagugacagaaugggaauggguacuacauaccuggcacucauggcaacguucaagaugagaccaauguuugcaguuggcuuacuuuuuagacgucuaacaucacgagagguccuauuacugacgauuggccuaucacucguagcaucgguagaauuaccaaauaguuuagaagaauuaggagauggucucgcuauggguauaaugaugcuaaaauuauuaacagaauuucaaccacaucaauuauggacuacucuucuaucccugacauuuauuaagacgacuuugagucuagauuaugcuuggaaaaccacagcaauggcgcucucgauaguguccuuauuuccucugugucuuucgacgacuucucagaaaaccacuugguugccuguacuacuagguucguuuggcugcaaaccacugacgauguuccucauaacagaaaauaaaauauggggaagaaaaaguuggccacucaacgaaggaaucauggcuaucgguauaguaagcauuuuacuuucgaguuugcuaaagaaugauguacccuuagccggaccauuaauagcuggugggauguugauagcuuguuacguuauaagugguucgucggcugacuuaucauuggagaaagcagcagagguaucuugggaacaagaagcagaacauagcggcaccagucauaauauccuaguugaaguacaggacgacgguacgaugaaaauaaaagacgaagaaagagaugacacauuaacuauacuguuaaaagcaacauuauuggcaguaucaggaguuuacccaaugagcauacccgcgacauuauuuguuugguacuucuggcagaaaaagaaacaacguagcggaguacuuugggauacacccucaccaccagaggucgaacgcgcuguuuuagacgauggcauauauagaauauugcaacggggacuauuaggacgaagccaggugggcgucgguguauuucaagacggagucuuucacacgauguggcacguuacgaggggagcaguacucauguaccaagguaaaagauuagaaccuaguugggcaaguguuaagaaagacuuaauuucauauggaggggguuggagauuucaaggcucauggaauacaggggaagaaguucaaguuauagcgguggaacccggcaaaaauccaaagaauguacaaacgacaccgggcaccuucaaaacuccagaaggagaaguaggggcgauagccuuagacuuuaagccggguacuagcgguagccccauugucaaucgugagggcaaaauugugggacuauauggaaauggagucgugacuacauccggaacuuauguaucagcgauagcgcaagcuaaggcaagccaggaaggaccguuaccagaaauagaagaugaaguuuucaagaaacgaaaucuuaccauaauggacuugcauccagguagcgguaagacaagacgguaccuacccgcuauuguccgagaagcuauaaaaagaaagcuacgaacccuaauucuugcacccacgagaguuguugcuagugaaauggcagaggcuuuaaaagggaugccuauuagauaucagacuaccgcuguaaaauccgagcauaccggucgugagauaguugaucucaugugucacgcaacauucacuaugagacuccugagcccggucagaguaccaaacuauaauaugauaaucauggaugaagcacauuuuacagauccggcaagcauagcugcccguggguacaucucuacaagaguugggaugggagaggcugcggcuaucuucaugacagcgacgccgccaggaaguguggaggcauuuccacagucaaacgccgugauucaagacgaagagagagauauaccugaaaggucauggaacuccggauaugauuggauuacagacuucccaggcaaaacaguaugguuuguaccuuccauuaagucugguaacgauauugcgaauuguuugcggaaaaacggaaaaagaguaauacagcuaagccgaaaaaccuucgacacagaguaccagaaaacgaagaacaaugauugggauuacgugguuacaacggacauuagugagaugggugcaaacuuuagagcagauagagucaucgauccuagaagaugucucaagccggugauacugaaggauggaccagaaagaguuauuuuagcagguccaaugccagucaccguagcaucugcugcucaaagaaggggaaggauaggucguaaccaaaauaaagagggggaucaauacguguacaugggucaaccguuaaauaaugaugaggaucaugcccacuggacugaggccaaaaugcucuuggauaauauaaacaccccagaagguauuaucccugcguuauucgaaccagaaagagaaaagaaugcagcgauagauggugaauaccgccucagaggagaagcuaggaaaacauuugucgaauuaaugaggcguggugacuuaccugucugguuaaguuauaaaguagcaucggaaggauuucaauacucagaucgaagauggugcuucgacggagaaagaaauaaucaaguguuggaagagaauauggacguugaaauauggacuaaagaaggagaacggaagaaauuaagaccaaggugguuagaugcucggacauauagcgauccucuggcauuacgagaguuuaaagaauuugcagcagguagacgcucgguuucuggagaucuuauacuugaaauagguaaauugccgcagcacuugacacugagagcacaaaaugcacuagacaaccuagugaugcuacauaauagugaacaaggugguaaagcauacagacacgccauggaagaauuaccugacacgaucgagacucuaaugcucuuagcguuaauagcaguauuaacagguggaguuacauuauucuuuuugucagggaaaggacuuggaaagaccucaauuggacuacucugugucaccgccuccucggcguuauuguggauggcaagcguugaaccgcacuggauagcggcgucaauaauacuagaauuuuucuugaugguacuacucauccccgaaccggaccgacaaagaacuccucaagacaaccaacuugcauaugucguuauuggucugcuuuuuaugauacuaacaguugcagcaaacgaaaugggcuuauuagaaaccaccaagaaagaccucgguaucgggcauguggccgcagagaaucaucaacacgccacuauguuagauguugauuuacgaccagccucggcauggaccuuauacgcaguagcuacaacaguuaucacaccgaugaugcgucacacgauugaaaauacgacggcgaacauaaguuuaacggcaauagcaaaucaagcagcgauuuuaaugggacuagauaaaggauggccaauuucuaaaauggacauaggagucccgcuucuagccuuaggauguuauagucagguaaacccucugacguuaacugcagcaguacuaauguuagucgcgcauuaugcgaucauaggcccaggcuuacaagcgaaagcaacccgugaagcucagaaaagaacggcagcgggaaucaugaaaaaccccacgguugaugguauuguagccauagaucuugauccagucguauacgacgcaaaauuugaaaaacaacugggacaaauuaugcuucugauacuauguacgucccaaauauuacuuaugaggaccaccugggcucucugugagagcauaacacuagcaacaggcccuuuaacaacguuaugggagggaagcccaggaaaauucuggaauacgacgauagcuguuucaauggcaaacauauucagaggcaguuaucuagcuggugcuggguuggcauucuccuuaaugaaaagucucggaggaggaagacguggaacaggagcucaaggagagaccuugggagaaaaauggaaacgccaacugaaccaacuuucgaagucugaauuuaauacguauaaacgaucuggaauaauggaagucgauagaagugaagccaaagagggguugaaaaggggagagacuacaaaacaugcaguaagucguggaacugcgaaacuuagaugguucguugaaagaaaccuuguaaaaccagaggguaaaguaauagaucuugguugcggaagaggugguuggaguuauuauugcgccggcuugaagaaaguuaccgaaguuaagggguacacgaaaggaggaccgggucaugaagaaccuaucccaauggcuacauaugguuggaauuuggucaaacuccauagcgggaaagacguauuuuucauaccuccugaaaaaugugacacauuauuaugcgacauuggagaaucaucucccaaucccacaauagaagaaggcaggacacuaagaguacuuaaaaugguugagccaugguugcguggaaaucaauuuuguauuaaaauauuaaauccauacaugcccucaguuguagaagcccuugaacaaaugcaaagaaaacacggagggauguuggugcgaaauccucuaucgagaaauucaacccacgaaauguauuggguaagcugcgguacagggaacauagucagugcaguaaacaugacuucacgaaugcuacugaacagauucaccauggcgcaucguaaacccacuuacgaaagagacguagacuuaggagcagguaccagacauguugcugucgaaccagagguugcuaauuuagauauaaucggacagcggauagaaaacaucaaaaaugaacacaaaaguaccuggcacuaugaugaagacaacccauacaagaccugggcauaccaugguaguuacgagguaaaaccuucgggaucggccucgaguaugguaaacggcguuguuagacuauuaacaaaaccaugggacguuauucccaugguaacucaaaucgcaaugacugacacgacuccauuugggcaacaaagagucuucaaggaaaagguagauacgcggacuccacgggcaaaacgcggaaccacgcaaaucauggagguaacagcgaagugguuaugggguuucuuaagucgcaacaagaaaccucggauaugcacgcgagaagaauuuacaagaaaaguacgaucuaacgcggcaauuggcgccguuuuuguugacgagaaccaauggaacagcgcaaaagaagcuguagaagaugaaagguucugggaucuaguccacagagaaagggaacuacauaaacagggcaagugugccacaugcgucuacaauaugaugggcaaacgagaaaagaagcuaggggaauuuggcaaggcaaaagggaguagagcaaucugguauaugugguuaggcgcacgauuuuuagaguucgaagcgcuaggcuucaugaacgaagaucauugguucagccgcgaaaauucccugucagggguggaaggugagggacuucauaaauuagguuauauauuacgcgacauuucaaaaauaccugggggcaauauguaugccgaugacacugcugggugggauacgagaauaacagaggaugacuuacagaacgaagcgaagauuacugaaauuauggaacccgaacaugcacuucuagcuacaucuaucuuuaaacuuacauaucaaaauaaaguugugcggguacaaaggccagcuaaaaaugggacaguaauggaugucauuaguaggcgugaucaaagaggguccgggcaaguaggaacuuacgguuuaaacacauucacaaacauggaaguacaguuaauaagacaaauggaauccgaagggaucuucuuaccaucggaacuagaaacaccuaaucuggcagaaagagucuuagauugguuagaaaaacauggagccgaaagacuuaaaagaauggcuauauccggagacgauugugugguaaagccuauugaugauagauuugcaacggcauugacugcgcucaacgauauggguaagguaaggaaggacauaccgcaaugggagcccagcaaaggauggaaugauuggcaacaagucccuuucuguucgcaccacuuucaucaacugauaaugaaagacggaagagagauuguaguuccaugccguaaucaagacgagcucguuggacgagcccggguuagucaaggugcaggauggucuuuaagagaaacagcaugucuagguaaaucuuaugcgcaaauguggcagcugauguauuuucaccguagggaucuacgucuagcagcaaacgcgauaugcucagccguacccgucgacuggguacccacaucucgcacgacgugguccauucaugcucaccaucaguggaugacaaccgaagauauguuaagcguuuggaacagaguauggauugaagagaaccccuggauggaggauaaaacccacguaaguucuugggaggaaguuccauauuuagggaaaagggaagaccaaugguguggcagcuugauaggauugacugcccgagccacaugggcgacgaacauacagguugcgauuaaucaggugagaaggcuuauaggaaaugaaaacuauuuggauuauaugacuucaaugaagcgauucaaaaaugaaagugacccugaaggggcgcugugguag

SEQ ID NO: 21284 - RNA, 9879 nt, Artificial Sequence
  derived and/or modified CDS sequence (opt6) from DENV-1__KJ189335__SS-prME
agcgucacuauguuacuaaugcuucuuccgacggcacuagcuuuucaucuuacuacccgagguggugaaccucauaugauaguguccaaacaagaaagggggaaaagucuacuauucaaaacuucagcaggcgucaauauguguacacuaauugcuauggauuuaggcgaacucugugaagauacaaugacuuacaaauguccgcagaucacggaagcggaaccagaugauguagacuguuggugcaacgcuacggacacaugggugacauaugguacgugcagucaaacgggggaacauagaagagauaaacgaucaguggcguuagcaccacauguuggcuuaggccuagaaacuagaacagaaacguggaugucgagcgaaggagcguggaaacagauacaacguguugaaacuugggcacuaagacacccaggcuucacaguuaucgcuuucuucuuagcucaugcgauaggaaccaguauaacccaaaaagggauaauuuuuaucuuacuaauguuaguaacaccaucuauggcaaugagaugcguaggaauugggaacagagauuucgucgaaggguuguccggugcaacguggguagauguggucuuagaacacgggucaugugucacaacaauggcgaaaaacaaacccacucuagauauagaacuguuaaaaaccgaaguaacaaacccagcaauacuacguaaacuauguauugaagcaaaaauaaguaacaccacaacagacucuagauguccaacacaaggcgaagcaacacuuguugaagaacaagaugcuaauuuugucuguaggaggacauucgucgaucggggauggggcaacggauguggacuauucggaaaagguuccuugcuaacaugcgcaaaauucaaauguguaacuaaauuggaaggcaaaauaguacaauaugaaaaccugaaauauucugucaucguaaccguacauacuggugaucagcaucaaguuggcaaugaaacaacagaacauggaacgauugcaacaauaacaccacaagccccuacuucagaaauccaacuuacugauuacggagcacuaacauuagauugcucuccacguacuggucuggauuuuaacgaaauggucuuacuuacaaugaaggaaaagagcuggcuuguacacaaacaaugguucuuagaucugccacuuccauggacaagcggugcaucaacaucacaagaaacguggaacagacaggaccugcuaguuacguuuaaaacagcucaugcuaagaaacaagaaguagucguucugggcagccaggaaggagcuaugcauaccgcacuaacaggagcgaccgaaauccaaacgucuggcacaacgacgauauuugcaggacauuuaaagugucgauugaagauggauaaguuaacguugaagggaaccaguuacgugauguguacagguucauucaaacucgaaaaagaaguagcugagacgcaacauggaacugucuugguacagguuaaguaugaagguaccgacgcaccaugcaaaauuccauuuagcacccaagaugaaaaaggcgucacucaaaauggucgucucauuacggccaauccaauuguuacagauaaagaaaaaccugugaauauagaaacugaaccuccguucggagaaucguauauaguaguaggugcgggcgagaaggcguuaaaacucaguugguuuaagaaagggaguucuaucgguaaaauguuugaagcgaccgcaagaggggcaagaagaauggcuauacuuggagauacagcaugggauuuuggaucuauaggaggggucuuuacuucgguuggaaaguuagugcaucaaguuuucggaacagccuauggcguucucuucaguggcguguccuggacaaugaaaaucggcauagguauacuacuuacauggcuuggacuaaacucacguaguacaucacuuucuaugaccuguaucgcaguagggaugguaacccucuaucuaggaguaaugguacaagcugacaguggauguguaauaaauuggaaaggcagggaauuaaaguguggcuccgggaucuucguaacgaacgaaguacauacauggacagaacaauauaaauuucaagccgauaguccaaaacguuuaucagcugcuauagggaaagcaugggaagaaggcgucugugguaucagaucagcaacaagauuagaaaacauuauguggaagcaaauaagcaaugaauuaaaccacauuuuacuugaaaaugauaugaaauuuacuguuguaguaggggacgcgaauggaauacuagcccaaggaaagaaaaugauccguccucagcccauggaacacaaauacaguuggaaaagcuggggcaaggcaaaaaucauaggagccgacauacagaacacaacguuuauuauugacggaccugacacacccgaaugcccugacaaccagagggcauggaauauaugggaaguagaagauuauggauuuggcauauucacgacuaacauaugguuaaaguuacgugauagcuauacacaaaugugcgaccaucgacuaauguccgccgcaauuaaggacucaaaagcaguacaugcugauaugggauauuggaucgaaagugagaaaaacgaaacuuggaaacuagcacgagccagcuuuauagaaguaaaaaccugcacuuggccaaaaucccacacucuuuggucaaacggaguucuagagagugaaaugauuauaccuaaaauuuauggaggccccauaucacaacauaacuacagaccagguuacuucacacaaacagcaggcccguggcauuuaggaaaacuugaacuugauuuugaucucugugaaggcacaacaguaguaguagacgaacauugcggaaauagggguccaucuuuaagaacaacaacgguuacugggaagauuauucaugaauggugcuguagaucauguacucuaccucccuuaagauuuagaggugaggacgguugcugguauggcauggaaauccgaccaguaaaagagaaggaggaaaacuugguuaggucaaugguaucugcagguuccggugaaguggauucguuuucguuagguaucuuaugcgugaguauuaugauugaagaaguuaugcgcucacgauggaguagaaaaauguugaugacgggcacauuggcugucuuucuucuauuaguuaugggacaacuaacguggaaugaucuaauccgccuauguauaauggugggagcuaaugcaagugauaggauggguaugggcacaacuuaccuagcgcuaauggccacuuucaaaaugcgaccaauguuugcagucggauuauuguuccgaaggcuuaccuccagagaaguauuacuacuuacaauugguuugucucuaguggcuagugucgaauuacccaauucauuagaggaauuaggggauggguuagccauggguaucaugauguuaaaacuauuaaccgaauuucaaccucaccaauuauggacaacccuuuuaagucuaacuuucauaaaaaccacacugucucuugauuaugcauggaaaaccacagcuauggcguugucuauaguaagccucuuccccuuauguuuaaguacaacuucacaaaagacaacaugguuaccaguacuucuagggagcuuuggauguaaaccauuaacuauguucuuaauaaccgaaaacaaaaucuggggaagaaaaagcuggccacugaacgagggaauaauggcaaucgguauugugucuauccugcuuaguucccuacucaaaaacgauguuccucuagcagguccauugauagcaggggguaugcuuauugcuugcuaugucauuucuggaucaagugccgaccugagcuuagaaaaggcggcagaggugagcugggaacaggaagcugaacacagugguacgagucauaacauauuaguagaaguacaagaugacggaaccaugaaaauaaaagaugaagaaagagaugacacacuaacaauucuauuaaaagcaacucucuuagcuguuaguggaguauacccgaugucuauaccagcuacucuauuugucugguacuuuuggcagaagaagaaacagcguaguggaguucugugggauaccccaagcccaccagaaguugaacgagcuguacuagaugaugguauuuaccggaucuuacagagaggacuucucgguagaucgcaagucggcguugggguauuucaagacggaguauuucauacuauguggcacguaacaagaggagcaguacuuauguaucaagggaaacgauuagagccgucuugggccucagugaagaaggaccuuaucagcuauggaggaggguggagauuccaagggaguuggaauaccggugaggaaguacaagugaucgcgguagaaccagguaagaaucccaaaaauguacaaacuacuccaggcacauuuaaaaccccggaaggugagguaggggcaaucgccuuggauuucaaaccuggaacgagcgguucgccaauagucaaucgagagggcaaaaucguaggucuguacgggaauggagucguaacuacaaguggaacuuacgugagugcgauagcccaagcuaaagcaucacaagaagguccacuaccagaaaucgaagaugaaguuuucaagaaacggaacuuaacuaucauggauuuacauccugguucuggaaagacaaggcguuaccuaccagcaauaguucgagaagcaauaaagaggaaacugaggacauuaauacuagcaccuacacgaguaguugcuucagaaauggcagaggcauugaaaggcaugccaauuagguaucagacaacagcgguuaaaagugagcacacaggaagagagauuguagauuuaaugugucacgcuaccuuuacaaugcgccuucuuagucccguucgaguucccaauuacaacaugaucauuauggaugaagcacacuuuacggaccccgccagcauugcugcgcgagguuacauaucuacacgaguggguaugggcgaagccgcagcuauuuucaugacugccaccccacccgggaguguggaagcauucccccaauccaaugcagucauccaagaugaagaaagagacauaccagaaagaucuuggaacucuggauaugauuggaucaccgauuuuccggggaaaacagucugguucguacccaguauaaaaucaggaaaugacaucgcaaauugcuuacguaaaaauggcaaacguguaauacaacucucacggaaaaccuuugauacugaauaccagaaaacuaaaaauaaugauugggacuauguagugacuacugacauaucagaaaugggagcuaauuucagagcugaucgcgucaucgacccucgccgaugccugaaaccgguaauauuaaaggauggcccggaaagagucaucuuagcugggccuaugccugugacaguugccuccgcugcacaaagaagagguagaaucggacgaaaucagaacaaagagggggaucaauacguguacaugggacaaccacuaaauaaugaugaagaucaugcccauuggacagaggcuaaaaugcuauuagacaacauuaacacaccagagggaauaauacccgcguuguucgaaccugaaagagagaaaaacgccgcaauagacggggaguauagacugcgaggggaagcccgcaaaacauucguagaacuuaugcgucguggagacuugccaguauggcuaagcuacaaaguagccagcgagggguuucaguauucagaucgccguuggugcuucgacggggaacguaauaaccaaguucuggaagagaauauggauguagagauauggacuaaagaaggugaaagaaagaaguuacgcccucgcuggcucgacgcaaggacauacagugacccuuuagcccuaagagaauuuaaagaguucgcagcagguagaagaucaguaucuggagauuuaauuuuagaaauagguaaguuaccacaacaucuaacuuuacgugcgcaaaacgcacuggauaaccuaguaaugcuacauaacucggaacagggagguaaggcuuaucgucaugcuauggaggaacuacccgauacaauagaaaccuuaauguuacuugcacuaauugccguccugaccggaggaguaacuuuguucuuucugagcggaaagggguuaggaaaaacauccaucggauuacuaugcguuacagcuucuagcgcacuacuuuggauggcaucaguagagccacauuggauugccgcaucaauuauacuugaguucuuucuaauggugcuccuuauuccagaaccagacagacagcgcacaccccaagacaaucagcuagcauauguaguaaucggccuauuauuuaugauuuuaaccguagcugcuaaugagauggggcucuuagaaaccacgaagaaggauuuaggaauagggcacguagcugcagaaaaccaucaacacgcuacuaugcucgacguugacuugagaccggcaucugcauggacucuauacgcaguagcaacaaccgucauaaccccaaugaugagacauaccauagaaaacacaaccgcaaacaucagccugacagcgauugcuaaccaggcagcuauucugaugggauuagauaaaggauggccuauuucuaagauggacauaggugucccauugcucgcuuuagguuguuacucccaaguaaauccgcuaacacugacugcugcaguacuaaugcuggucgcccauuacgccauaauagguccuggucuucaagcuaaagcuacuagggaagcacagaaaagaacggcagcaggaauuaugaaaaauccaacuguugaugguauaguagcuauugaucuagauccaguaguauaugacgcuaaauucgaaaagcaauuaggucaaauaaugcuuuuaauucuuuguacgucccaaauucuauuaaugagaacuacuugggccuuaugcgaaaguauuacuuuggcgaccgguccacugacaacccuuugggaagguagccccgggaaauucuggaauacaacuauugccguuucgauggcgaauaucuuucggggcaguuauuuggccggugcaggucucgcuuuuaguuuaaugaaaagucuagguggaggccgucgaggaacuggugcucagggugaaacccuaggugaaaaauggaaaaggcaguuaaaccaacuaucuaaaucugaauuuaauacauauaaacgcagcgggauaauggaaguugauagaagcgaagcaaaagaaggauugaagcggggcgaaacaacaaagcacgcgguaucuaggggaacagcuaaauuaaggugguuuguagaaagaaaccuaguuaaaccugaaggcaaaguuauagaucuaggcugcggucgaggaggauggucguacuacugugccgggcuaaagaagguaacugaggugaaaggcuauacgaaaggcgguccugggcacgaagaacccauacccauggccacauauggauggaaucuaguuaaguuacacagugguaaagauguauucuuuauacccccagaaaaaugcgauacacuauugugcgacauaggagaaucuuccccaaacccaacaaucgaagaggguagaacccuuagaguacuaaaaaugguugagccaugguuaaggggaaaucaauucugcauaaaaaucuugaauccuuauaugccaaguguaguggaagccuuggaacaaaugcagcggaagcauggugggaugcuaguacgaaauccacuuagccgaaacuccacccaugaaauguauugggucucguguggaacugguaacauugucucggccgucaauaugacaaguagaaugcugcuuaacagauuuacaauggcacauaggaaacccacauaugaaagagacgucgaccucggggcagguacccgucacguagcaguugaaccagaaguggcgaauuuagauauaauuggucagaggauagaaaacauaaagaaugaacacaaaaguacuuggcacuaugaugaagauaaucccuacaaaacaugggcuuaccacgggagcuacgagguaaaaccaagcggaagcgcaaguucgaugguuaauggugugguccgauuacuaacaaaacccugggacgugauaccgaugguaacucaaauagcaaugacagacacuacuccguucggucagcagcguguguuuaaagaaaagguggauaccagaacaccgcgcgcgaaaagagguaccacucaaauaauggaagucacggcuaaauggcuguggggcuucuuaucacgaaauaagaaaccaagaauaugcacacgugaagaguucacucguaaaguuagaucgaacgccgcaaucggugcuguauuugucgacgaaaaccaguggaacucagcaaaggaagcuguagaagaugaaagauucugggauuuaguacauagagaaagagaauuacauaaacaaggaaaaugugcuacaugcguauauaauaugauggggaaaagagagaagaaacucggugaguucgguaaagcaaaaggaaguagggcaauaugguauauguggcuuggagcaagauuucucgaguucgaagcacuuggauuuaugaaugaagaccauugguucucucgagagaauagccuuucaggaguggaaggugaaggacuucauaaacuaggauauauauuacgugauauaagcaaaauuccaggcggcaauauguaugcagaugauacagccgguugggacacuagaauaacagaagaugaccuacaaaaugaggcuaaaauuacagagaucauggagccugaacaugcgcugcuagccacauccaucuucaagcucaccuaccaaaacaaagucguucggguccaacgucccgcaaagaauggaacuguaauggaugugauuagccgcagagaccaacgaggaucaggccaagucggcacauauggauuaaauacuuuuacuaacauggagguucaacuuauacggcagauggaaagugaagggauauuccucccaucggagcuugagacuccaaaucuagcagaacgaguauuggacuggcuagaaaaacauggagccgaacgacucaaacgcauggcaauaucgggggacgauugcguagugaaacccauagacgaccgguuugcaacugcucuaacagcgcuaaacgauauggguaaggucagaaaagauauuccacaaugggaaccguccaagggauggaacgacuggcagcaggucccauuuuguucgcaucacuuccaucaacuaauuaugaaagauggcagggaaauuguaguacccugcagaaaucaagacgaguugguaggacgagcacggguaucacaaggcgcggguuggucauuacgggaaacagcaugucuagggaagaguuaugcccaaauguggcaauuaauguacuuucaucggcgugaucuaaggcucgccgcaaaugcgauauguucagcagugccaguagauuggguuccuacuucccgaaccacuuggucaauacaugcucaucaucaguggaugacuaccgaggauaugcuaucaguuuggaaucgcgucuggauugaagaaaauccauggauggaagauaaaacacauguaagcuccugggaagaggugccuuaucuagggaaaagggaggaucaauggugcggaucuuuaauaggccucacagcgcgcgccacuugggcaacgaauauacagguagcaauaaaucagguacgcaggcuaauagggaaugaaaauuauuuagauuacaugacaucaaugaaacguuuuaaaaaugaaagugauccugaaggugcuuugugguaa

SEQ ID NO: 21285 - RNA, 9879 nt, Artificial Sequence
  derived and/or modified CDS sequence (opt6) from DENV-1__KJ189336__SS-prME
agcguuacuauguuauuaauguuacuuccaacugcacuugcauuucauuuaacaacucguggaggagaaccacacaugauagugagcaaacaagaaagagguaaaaguuuacuuuucaaaacgagugcgggaguuaauauguguacauugaucgcaauggaucuaggugaacuaugugaagauacaaugacuuauaaaugcccgcaaauuacggaggcggaaccagacgauguugauuguuggugcaaugcaacagacacguggguaacauacgguacgugcucucaaacgggugaacacagaagagauaaaaggucaguggcauuggcaccgcacguaggauugggauuagaaacaagaacagaaacguggaugaguagugagggggcuuggaaacaaauucaacgcgucgaaacaugggcccuuaggcauccuggauuuacuguaaucgcacuauuucuggcgcaugcgauaggaacaucuauaacccaaaaaggaaucauauuuauacuucucaugcucgugaccccuaguauggcaaugagaugcguaggaauugguaacagagacuuuguggagggacucuccggagcuacauggguagacguagugcuagaacacggcucaugcguaacuacaauggcgaaaaauaaaccaacacuagacauugaauuacuaaaaacugagguaacgaauccagccauauuaagaaaacuauguaucgaagccaaaauaucaaauaccacuaccgauucucgaugcccuacgcaaggugaagcaacacucguugaagaacaagaugcuaacuucguuugcagaagaacauucgucgacagaggauggggaaacggaugcggccuuuuuggcaaaggcagucuauuaaccugcgcaaaauucaaaugcguaaccaaacuagaggggaaaauuguacaauaugaaaaccuaaaauacaguguuaucguaacuguccauacaggagaccaacaucaagucgguaaugaaacaacagaacacggcacuauugcuacgauaacgccacaagcuccuacaagugaaauacaacuaacagauuacggugcucucacuuuggauuguucuccucgaacuggucuagauuuuaaugaaaugguacuucuuacaaugaaagaaaaauccuggcucguacauaaacaaugguuuuuagacuuaccucuaccuuggacaagcggagccagcacgagucaagaaacauggaaucgacaagacuuauuagucacguuuaaaacugcacaugccaagaaacaagaggucguuguacuaggaucacaagaaggugcaaugcacacugccuuaacgggcgcuacagaaauacaaacaagugggacaacuacuauauuugcaggucauuuaaaaugccgcuuaaaaauggauaaauugacucuuaaaggaacuucuuacgugaugugcacaggaaguuucaaauuagagaaagagguugccgaaacacaacauggaacaguauuagugcaaguaaaauacgaaggaacugaugcuccguguaaaauaccuuucucgacacaagaugaaaaaggcguaacacaaaauggaagauuaauuacagcaaacccaauaguaacugauaaagaaaaaccgguaaauauagaaaccgaaccuccguuuggagaaucuuauauagucguaggugcaggcgaaaaagcucuuaaauuaucgugguuuaagaaagguucaucaauuggaaaaauguuugaagccacagcucgaggugcaagacgaauggcaauccuuggggacacugcaugggauuucggaucaauaggggguguuuucaccucuguaggaaaauugguacaccagguauucgguaccgcauacggcgucuuauucucagguguuucguggacuaugaagauagggauuggcauacuucugacauggcucggucuaaacaguagguccaccagccuuucaaugacauguauagcaguaggcauaguaaccuuauauuuaggaguaaugguacaggccgauagcgggugcgugauaaauuggaaaggcagggaauuaaaaugugguaguggcauuuucguuacuaaugaaguucacacguggaccgaacaauauaaauuucaggcggauaguccaaaacgccuuagugcagcgauagguaaagcaugggaggaagggguaugugggaucaggagugccaccagguuggaaaauauaauguggaaacaaauaucgaaugaguuaaaccauauacuucuggaaaaugauaugaaguuuacaguaguagugggugaugccaacgggauauuagcgcaggguaagaaaaugauacguccacagccaauggagcacaaauacucauggaaaagcugggggaaagcaaagauuaucggugcggauauacagaacaccacauucauaauugauggucccgauacuccggaaugccccgauaaucaaagagcuuggaauauuugggaaguugaggacuauggcuuugggauuuucacgacgaauauauggcuaaaacucagggauucuuauacccaaaugugcgaccaccgacuuaugagugcugcgauuaaagauucaaaagcaguucacgcagacaugggguacuggaucgaauccgagaaaaacgaaacuuggaaacuagcuagagcgucguuuaucgaaguuaagacuuguacauggccaaaaucucauacauuauggaguaacggaguacuugaaucggaaaugauuauuccgaaaauauaugggggaccaauuucccaacacaacuacagacccggauauuucacccaaacugcaggaccauggcacuuaggaaaacuugaauuggacuuugaucuaugcgaagguacuacuguuguuguagaugaacauuguggaaauagggggccuagcuugagaacuacgacaguuacagguaagauaauucaugaaugguguuguagauccugcacauugccgccauuaagauuuagaggagaagauggauguugguacggaauggaaauacgcccgguaaaagaaaaggaagaaaaccuaguacggucuauggucucggcagggucgggugaagucgacaguuucucccuagguauacuuugcgucaguauaaugauagaggaagucaugaggucgagauggagucgaaagaugcucaugacaggaacuuuggcaguuuuucuacuguuggucaugggccaacuaaccuggaaugaucugauacgacuuugcauaauggucggcgcuaacgccagugaucgcaugggaauggggacaacuuaucuugcuuugauggccacuuuuaaaaugaggccuauguuugcuguagguuuacucuuuagaagacugacuuccagagaaguacuauuauuaacgauagguuuaucauugguagcaagugucgaauugcccaauucauuagaagaacucggcgauggacuggcgaugggaauaaugaugcucaaacuauuaacggaguuucaaccacaucaacuguggacuacgcuuuuaucacuuaccuuuauaaagacaacuuuaagucuagacuaugccuggaaaaccaccgcuauggcacuuaguauuguuuccuuauucccgcuaugcuugucaacaacaucacagaaaacaacuuggcuuccagucuugcuuggaucuuucggcuguaaaccauuaacaauguucuuaauaacugaaaauaaaauaugggggagaaaauccuggccguugaaugaaggcauuauggcgaucggaaucgugaguauauuacuuucuucucuauuaaagaaugaugucccuuuagcgggaccauuaauagcgggugguauguuaauagcuugcuauguaauuucuggaagcucugcugaucugucauuagaaaaagcugccgaaguaucuugggaacaggaagcugaacacucggggacaagucacaacauauuaguagaggugcaggaugacggcacaaugaaaauuaaggacgaagaacgugaugauacgcugacgauauuacugaaagcaacacuccuggcagugagcggcguguacccaaugucuauuccugcaacacucuucguuugguauuucuggcagaagaagaaacaacgcucaggagugcuuugggauacgccgucaccuccggagguugaaagggcaguacuggaugacgguauuuacaggauauugcagagaggucucuuaggacgaagucagguaggagucgguguuuuucaagauggcguguuccacacgauguggcaugugacaagaggagcgguauuaauguaucagggaaaaagacuugagccaucaugggcaagcguaaagaaagacuuaauaaguuauggagggggcuggcgauuucaaggaagcuggaacacaggugaagaagugcaaguaauugcaguggagccaggcaaaaaucccaaaaauguccagacaaccccagggacauucaaaacaccagaaggcgaagugggugcaauagcuuuggacuuuaaaccaggcacgucagguucaccaaucguaaaucgugagggaaaaauugugggguuauacggaaacggaguuguaacaacuagcgguacuuaugugagcgcgauugcgcaagccaaagcuagucaggaaggaccauugccagaaauagaggaugaaguuuuuaagaaaaggaauuugacuauaauggaccuacauccgggaagugguaaaacaagacgcuacuugccagcaauagugcgcgaagccauaaagagaaaacuucgaacauuaauacuagcgccaacuagagugguggcgucggaaauggcugaagcccucaaaggcaugccuauaagauaccaaaccacggcagucaaauccgaacacacggguagagagauuguagaucuaaugugucacgcgacauucacgaugcgccuucuuuccccuguaagaguuccaaauuacaacaugauaauuauggaugaagcacauuuuaccgauccugcauccauagcagcacgaggcuauauuucuacucgaguuggaaugggcgaagcagcugcaauauuuaugacugcuaccccuccuggaaguguagaagccuucccacaaaguaacgccguuauccaagaugaggaaagggauauaccggaaagaucauggaacucagguuaugauuggauaacagauuucccugggaaaacagucugguuugucccuuccaucaagucagguaaugauaucgcuaauuguuuacguaagaacgguaaaagaguaauacaacucucacgcaaaacguucgauacagaauaccagaaaaccaaaaauaaugauugggacuacguaguuacaacggauauaucagaaaugggcgcuaauuuucgagcagauagaguuauugauccccgacgcugucuuaaacccguaauucugaaagauggcccggaacguguaauauuagccggaccaaugccuguuaccguugccucugcggcccaacgacgcgggaggauuggucgcaaucagaauaaagagggagaucaguauguguacaugggacaaccucuaaauaacgaugaagaucaugcacacuggacggaagcgaagaugcuccuugacaauauaaacacgccugagggaauaauuccggcccucuucgaaccagagagggagaaguccgcagcuauagacggagaauaucgauugagaggugaggccagaaaaacauucguugagcugaugcgaagaggugauuuaccuguauggcuuucuuauaaaguagcaagcgaaggcuuucaauauagugaucguagauggugcuuugacggagagcguaauaaccaaguccuagaagaaaauauggauguagaaauauggacaaaagaaggugaaagaaagaaacugaggccgcgaugguuagaugcucgcaccuauucagauccacucgcacucagagaauuuaaagaauuugcugcgggacguagaaguguuucuggugaucuaauucuugaaauuggaaaacuaccgcagcacuugacauuaagggcucaaaacgcucucgacaauuugguuauguugcauaauagugaacaaggagguaaagcauacagacaugcaauggaagaauuaccggacacaauugaaacccuuaugcuuuuagcguuaaucgcgguacucacaggggguguaacauuguucuuuuuaucaggcaaaggacuaggcaaaacaagcauaggauuauuguguguaacagcaaguucugcucucuuauggauggcaucuguagaaccacacuggauagcugcaagcauuauauuagaguucuuucuaaugguuuuacugauaccagaaccagauagacaacgaacuccacaagauaaucaacuagcauacguuguaauagggcugcuguucaugauucuaacgguggcagcaaaugaaaugggcuuguuggaaacaacgaagaaagaccugggaauuggacauguugccgcggaaaaucaccagcaugccacaaugcuagauguugacuuacgcccggcgagcgcguggacuuuauacgcuguagcaacaacgguaauaacuccaaugaugaggcacacuauagaaaacacuacagcaaauauuagccuaacugcuaucgccaaucaagccgccauucuaaugggucucgacaaaggguggccuaucuccaaaauggauauagguguuccuuuauuggcucucggcuguuacagucaagugaaucccuuaacucuuacugcagccguucuuauguuaguugcgcauuaugcaauaauuggaccaggucuucaagcaaaagcgacuagagaagcgcagaaacgaacagcggcuggaauuaugaaaaauccaacaguggauggaauuguggcaaucgaucuggaucccgugguguaugaugccaaauuugaaaaacaauugggacaaaucauguuacugauucucuguaccagucaaauauuauuaaugagaacuacaugggcuuuaugugaaucaauaacgcuggcaaccggaccauuaacaacauuaugggaagguucacccgggaaauucuggaauaccacaauagcuguaagcauggcgaauauauuccgcggcucuuaccuagcuggagcuggauuagcguucucacuaaugaagagucuuggaggcggucgccgagguacuggugcccaaggugaaacacuuggugaaaaauggaagcgacaacuaaaucaauugaguaaaagcgaauuuaauacauauaagcgauccggaauuauggaaguggaccgcagcgaagcaaaggaaggucuaaaacgcggagaaacuacaaagcacgcaguauccagaggaacagcuaaacucagaugguuuguugaaagaaaccuagugaaaccagaaggaaaaguaauagaucucggaugcggacggggcggauggucauacuauugcgcuggacucaagaaaguaacagagguaaaaggauacaccaaaggaggaccugggcacgaggaaccuauaccuauggcaacauauggguggaacuuaguaaaacuacacagcggaaaagauguguuuuucaugccacccgaaaaaugugauacauuguugugugauauaggggaaucgagccccaaucccacgauugaagagggaagaacauuaagaguucuaaagaugguagaacccugguugaggggaaaucaguuuuguauaaagaucuuaaauccguauaugccauccguaguggaggcuuuggaacaaaugcagaggaaacacgguggcaugcucguaagaaacccuuuaucacgcaauucaacacaugaaauguauuggguuucaugugggacaggcaacauuguaucugcaguaaauaugacaucacggaugcuauuaaauagguuuacuauggcgcaucggaagcccacuuaugaaagagacguugauuuaggugcaggaacuagacacguagcaguggagccugaagucgcaaaccuggauauaauaggacaaagaauagaaaacauuaaaaaugaacacaagucaacauggcacuaugaugaagauaaccccuacaaaacuugggcguaccauggaucauacgagguuaaaccaagcggcagugccucuagcaugguaaauggcguaguaaggcuacugacuaaaccgugggacguuaucccaaugguuacccaaauagcaaugacggacacaacaccuuucggacaacaaaggguuuucaaggagaaaguggauacuagaacaccccgugcaaagaggggaacuacacagauuauggagguuacggcgaaguggcuaugggguuuccuaucaagaaauaaaaagccucgcaucuguaccagagaggaguuuaccaggaaagucagaaguaaugcagcaauaggagcaguuuucguugacgaaaaccaguggaauagcgcaaaggaagcaguagaagacgaacgcuuuugggaccuuguacacagagagcgagaauugcacaaacaaggaaaaugugccacauguguauacaacaugaugggaaaaagagagaagaaauuaggugaguucggcaaggcaaaagguaguagagcuauaugguacaugugguuaggcgcccgauuuuuagaauuugaagcauuaggauucaugaaugaagaucacugguucagcagggaaaauucccugucuggaguugagggagagggauuacacaaacuaggauacauccucagagauaucucaaaaauacccggaggcaauauguacgcagaugauacagcaggaugggacaccaggaucacagaggaugauuugcaaaaugaggccaaaaucacagagauaauggagccagaacaugcuuuauuggcgacaaguauauuuaaacuuacauaucaaaacaaagucguacgaguccagcgacccgccaaaaauggaaccguaauggauguuauuagccguagagaccaaagagguaguggucaaguaggaacauacggccuuaacacauucacuaauauggaggugcaauuaauccgucaaauggagucugaaggaauuuuccuaccaucggaacucgaaacucccaaucuggcugagaggguacuagacugguuagaaaagcauggagcagaacgacuaaaaagaauggcaauuucaggggacgauugcguugucaagccuauugaugaccguuuugcgacggcacuaacggcucuaaaugauauggggaaaguaagaaaagauauaccucaaugggaaccaaguaaagguuggaacgauuggcaacaaguaccuuucuguucacaucacuuccaucagcuuauaaugaaagacggacgugaaauaguaguccccuguagaaaucaagacgaauuaguggguagggcuaggguuagucaaggcgcuggauggucguuacgggaaacagccuguuuagggaaauccuaugcucaaauguggcaauugauguacuuucacagaagagauuuacgacucgcagcuaaugcuauaugcucggcggucccaguggauuggguaccuaccaguagaacaacauggagcauucacgcacaccaucaauggaugacaacagaggauaugcuuucagucuggaaucgcgucuggauugaagaaaauccauggauggaagauaaaacucauguaucauccugggaggaaguuccauauuuagggaagagggaagaucaguggugcgguucacuuauuggacuaaccgcuagagccacgugggcuacaaacauccagguagccaucaaccaagucaggagauugauuggaaaugaaaauuaccuagauuauaugacgucgaugaaaagauucaagaaugaaucugacccagagggugcccuuugguaa

SEQ ID NO: 21286 - RNA, 9879 nt, Artificial Sequence
  derived and/or modified CDS sequence (opt6) from DENV-1__KJ189337__SS-prME
ucugugacuauguuauuaauguuacuaccgacagcacucgcauuucaccuaacaacacgggguggagaaccacauaugauaguuagcaaacaagaaagagggaaauccuuacuauuuaaaacaucagcaggagucaauauguguacgcucauagcaauggauuugggggaauugugugaagacacuaugacauauaaauguccgcaaauaacagaagcagaaccagaugaugucgacugcugguguaacgcuacagauacuugggucacauacggaacauguucacaaacuggggaacauagaagagacaaacgaagcguugcuuuggccccacaugugggucuuggguuagaaacgaggacagaaacguggauguccagugaaggugccuggaaacaaauacaacgaguugaaacuugggccuugagacacccaggauuuacaguaauagcguuauuuuuagcgcaugcuauaggaacaucaauaacgcaaaaagggauuauauucauucuucuaauguuggucacaccaucaauggcaaugcgaugcguggggauaggaaauagagauuucguugaggguuuaucuggcgcaacauggguggauguuguucuugaacaugggagcugugugacuacuauggcuaaaaauaaaccaacauuagauauagaacuccugaaaaccgaaguaaccaacccugccauauuaagaaaacugugcauagaagccaaaaucucaaauacaacgaccgauucucgauguccaacacaaggugaagcgacccuaguugaagaacaagacgccaauuucguaugcagaagaacuuuuguugauagaggcuggggaaacggauguggacuauuugguaaagguucauuacuuacuugcgcgaaauuuaaaugugucacaaagcucgaaggaaaaauaguacaauaugaaaaucuaaaauacagcguaauaguuacaguucacacaggagaucaacaccaaguggguaaugagaccacagaacauggaacaauagccacgaucacaccucaggcucccacuucggaaauucagcucaccgauuacggugcauuaacccucgauugcagcccacggacuggacuugauuuuaaugaaauggucuuacuaacaaugaaagaaaagaguuggcuuguccauaagcaaugguucuuagaucugccuuuaccuuggaccucaggggcuaguacaucgcaagagauauggaacagacaagauuuacuuguaacuuucaaaacagcccacgcaaagaaacaagaagugguagugcucggaagccaggaaggugcaaugcacacugcauuaacgggagcgacugagauacaaacgucaggaacaacaacaauauuugccggccauuuaaagugcagacucaaaauggauaagcuaacucuaaaggguacgucauauguuauguguacagguucauucaaauuagaaaaagaaguugccgaaacucaacaugggacgguucugguacaagugaaguaugaaggaacugaugcaccuugcaaaauacccuuuagcacgcaagacgaaaagggugucacccagaauggcagacugaucacagcuaacccgauuguuacugacaaagaaaagccaguaaacauugaaaccgaaccgccauuuggcgagagcuauauaguagucggggcgggagaaaaagcucugaaguugucaugguuuaagaaagguucuucuauuggaaaaauguucgaagcuaccgcucguggcgcuagaagaauggcuauuuugggcgauacagcaugggacuuuggcucaaucggagguguguucaccucuguuggaaaguugguccaccaaguauucgggacagcauaugggguuuuauuuagcggaguaagcuggaccaugaaaauaggcauaggcauauuguugacuugguuagggcuuaauaguaggucgacaucuuuauccaugaccugcauagcuguagguaugguuacuuuauaucugggaguuaugguucaggcggauuccggaugcguuaucaacuggaaaggcagagaauuaaaaugcggaaguggaauauuuguuacaaaugaaguacacacguggacagaacaauauaaauuucaagcugauucgccaaagaggcuaucagcagcaaucggaaaggcuugggaagaagggguuugugguauccggucagcuacgcggcuagaaaacauaauguggaaacagauaaguaaugaauuaaaucacauucuauuagaaaaugauaugaaauuuacuguugucguaggagacgcuaacggaaucuuagcgcaggggaagaaaaugauaagaccgcaaccgauggaacauaaauacagcuggaaaaguuggggcaaagcuaaaauuaucggggcagauauacaaaacacuacuuuuaucauagacgggccggauacaccggaauguccugauaaccaacgugcauggaacauaugggaagucgaagauuauggauuuggcauuuuuacgacuaauauauggcuaaaauuacgagacucauauacacagaugugcgaccauagauuaaugucagcagcuaucaaagauucaaaagcuguucacgccgacaugggcuauuggaucgaauccgaaaagaaugaaacauggaaguuagcgcgagcuucguuuaucgaaguaaaaacguguacguggcccaagagccauacacuuuggucgaacggaguuuuagagucagaaaugauuauuccaaaaauauacggaggaccaauaucccaacauaauuacagacccggguauuucacgcaaacagcagguccuuggcaccugggaaaacuugaauuagauuucgaccugugcgaagguacuacaguugucguugacgaacauugcggaaauagaggaccaucacuucguacgacgaccgugacggguaagauaauacacgaguggugcuguaggucauguacucugccaccacuaagauuucguggugaagacggauguugguaugguauggaaauaaggccuguaaaagaaaaggaagagaaucuaguccguucgaugguaucugcgggguccggugaaguugacucauuuaguuuaggaauacuuugugcaucaauaaugauagaagaggucaugagaagcagauggaguagaaagauguuaaugacugggacguuagcgguauuccuguuacuaauaaugggacaauuaacauggaaugaucuuauucgccuuuguauaauggucggggcaaaugccuccgaccgcaugggaaugggcacaacauauuuagcucuaauggcaacguucaagaugcgcccuauguucgcgguuggauuauuauuuagacgauuaaccagccgugaaguccucuuacuaacaauaggccuaucacucguggcaagugucgaauuaccaaauucucuagaagaacuaggagacggauuagcgauggguaucaugauguuaaagcugcuuacagaauuucaaccucaucaauuauggacaacacuauugucauuaacauuuauaaaaacgacauuaucuuuagauuaugccuggaaaacaaccgcuauggcacuaucaaucguaagccuauucccacuaugcuuaucgacgacgucccaaaagacaacgugguuaccaguuuuacuaggaaguuuuggaugcaaaccgcucacaauguuucuaaucacagaaaacaaaauauggggucgaaaaaguuggccacuaaacgaagguauaauggcaauaggaauuguaaguauucucuugucaagccugcuuaaaaaugauguacccuuggcagguccauuaauagccgggggaauguuaaucgcauguuacguuauaaguggaaguucugcagaucugucgcuagagaaagccgcugaggugagcugggaacaagaggccgagcauaguggcacaagccauaacauccuaguugagguacaagaugauggaacgaugaagauaaaagaugaagaacgcgaugacacauuaacaaucuugcuaaaagcaacacuucucgccguuucuggcguuuauccgaugaguaucccggccacacuauuuguuugguacuucuggcagaaaagaaaacaaagaucaggaguacugugggauacaccgucucccccggaaguggaaagggcaguacuagaugaugggaucuaucgaauauuacaacggggccuacucggucguucgcaaguaggggucgggguauuucaagauggugucuuccauacaauguggcacguaacgcgaggugcgguguuaauguaccaaggaaaaagacucgaaccaaguugggcaaguguuaagaaagaccugaucucguaugggggaggguggagauuucaagguagcuggaacacaggugaggaaguccaaguaauagcagucgaaccaggaaagaauccgaaaaaugugcaaacuacuccgggaacguucaaaacuccugaaggagaagucggugcuauagcacuagacuuuaaaccagggacaagcgguagcccaauagugaauagagaaggaaaaauagugggucuuuaugggaacggagugguaacaacuucagggacuuacgugagcgcuauagcacaggcgaaagcaucgcaagaggguccccuuccggaaauagaagaugagguauuuaagaaaaggaacuuaacgauaauggaucuccaccccggauccgggaaaacaagaagauacuuaccggccauagugagagaagcuauuaaacgcaaacugagaacgcugauacuggcucccacaagagucguugcaagcgagauggcagaggcuuugaaagguaugccaauuagauaccaaaccaccgcuguuaaaagugagcauacaggucgggagauaguagaccugaugugucacgcaacguucacaaugcggcuuuuaaguccgguacguguaccaaacuacaauaugauaauuauggaugaagcucauuucacagauccagcaucaauugccgcaaggggauauauuagcacgcgggugggaaugggcgaagccgcagccaucuuuaugacagccacgccuccuggaucuguagaagcguucccacaguccaaugcggucauacaagaugaagaacgcgauauuccagaacguagcuggaacucagguuaugauuggauaaccgauuucccuggaaaaacaguuugguuuguuccuaguaucaaaucgggaaacgacaucgcuaacugucuaaggaaaaauggaaagcguguaauacagcuauccagaaaaacauucgacacugaauaucagaaaacuaaaaauaaugacugggauuacgucgucacuacggacauaagugaaaugggagcaaacuuccgagcggacagaguaauagacccgcguaggugcuugaaaccaguaauauuaaaagacggaccggaacgcgucauacucgcgggaccuaugccaguaacagucgcuucagcggcccagcgucgagguagaauaggcaggaaucaaaacaaggaaggggaucaguauguguauaugggacaacccuuaaauaaugacgaagaucacgcucauuggacugaagcaaagaugcuacuagauaacaucaauaccccugaggggauaauuccugcacuuuucgaaccagagcgcgaaaagagugccgccauagacggugaauauagacuccggggagaagcaagaaaaacauuuguugaauugaugcgacguggagauuuaccagucugguuaaguuacaagguggcauccgaagguuuucaauacucagacagacgaugguguuuugauggcgaaagaaauaaccaaguauuagaggagaacauggacgucgaaaucuggacaaaagaaggcgaacgaaagaaacugcggccuagguggcuagacgccaggacauauucagauccacuagcacuuagagaauuuaaagaauuugcugcaggccgucguagugucuccggggacuugaucuuagaaauugguaaacuaccacaacaucucacgcuaagagcacagaaugcauuagauaacuugguuauguugcauaacagugagcaaggggguaaggcuuacagacaugccauggaggaauugcccgauacgauagagacacuuaugcucuuggcguugauugcggucuugaccggaggagucacauuguuuuuccuaucuggcaagggucuuggaaaaacaaguauaggauuacucuguguaacggccaguagcgcauuauuguggauggcuaguguagagccucauuggauugcagcaaguauaauacuugaguucuuucuaaugguacuuuuaauaccugaacccgacagacagcgaaccccucaagacaaccaauuagccuauguaguaauugggcuauuauucaugauacuuacaguagcugcgaacgaaaugggacuauuagaaacgaccaagaaagacuuaggcauaggucaugucgcagcugaaaaucaccaacaugcuacaaugcucgauguggaccugagaccugcgagcgcuuggaccuuauacgcuguagcaacgacugugauaacaccaaugaugagacacacuaucgaaaacacaacggcgaauaucagccuaaccgcuauagcaaaccaagcagcaauacugaugggauuggacaaaggauggccaaucucgaaaauggacauugguguaccccuucuugcccuuggcugcuauucacaaguaaauccucuuaccuuaacggccgcaguguuaauguugguugcccauuacgccaucauaggaccaggcuuacaagcuaaggcaacaagagaagcucagaaaaggaccgcugcggggaucaugaaaaauccuacaguugaugggauagucgcuauagauuuggacccaguuguauacgacgcaaaauuugagaaacagcuuggacaaauuauguuguugauucuaugcacgagucaaauacuuuuaaugcgaacgacaugggcauuaugcgagucuauaacacuggccacggguccacuaacuacacucugggaaggcaguccaggaaaguucuggaauacaacaauagcggugaguauggcaaauauauuucgcgggucauaucuugccggugcgggccuagcauucaguuugaugaaaagccuugguggugguagaagagguacuggugcccagggugaaacacuaggcgaaaaguggaaacggcaauuaaaucaacucagcaaaucugaguuuaauacauacaaaagaucugguauaauggaaguggaucguuccgaggcuaaggaaggguugaaaagaggugaaacaacuaaacacgcggugagcagaggaacugcgaaauuaagaugguucguugaaagaaaucuggucaaaccugaagguaaaguaauagaucucggcugcggaagggguggauggucauacuacugugcaggauuaaagaaagugacagagguaaaaggauauacaaaaggugguccgggacaugaagaacccauuccaauggcuacauauggauggaaucuggucaaauuacacucugguaaagacguauucuuuaugccacccgagaaaugugauacuuuguuaugcgacauuggagagaguuccccgaauccuacaauagaagaggggagaacucucaggguacuaaaaaugguugaaccauggcuaaggggaaaucaauucuguauaaagaucuuaaacccauacaugccuucaguaguagaaacauuagaacaaaugcaacgcaaacauggaggcaugcuaguccgaaauccacuuucccguaacucuacgcaugagauguacuggguaucaugcggaacugguaacauuguuucugcuguaaauaugacaagucgaauguuacugaaccgguuuacgauggcucacagaaaacccacuuuugaaagagacguggaccugggcgccggaacuaggcacguugcuguagaaccugaaguagcuaauuuagacaucauaggacaaagaauugaaaacguaaagaaugagcacaaaucaacguggcauuacgaugaggacaaucccuauaaaacaugggccuaccacgggagcuaugagguaaaaccguccgguagcgcaagcuccaugguaaaugguguaguaagacuucuuacgaagcccugggauguuauaccuaugguaacucaaauagcuaugaccgauacaacaccguuuggacaacaaaggguauuuaaagaaaaaguugauacaagaaccccaagagcgaaaagagguaccacucaaauaauggaagucaccgcaaaauggcuuugggguuuucuaucucgcaauaagaaaccaaggauuugcacgagagaagaauuuacgagaaaagugcgcaguaaugcugcgauaggagcugucuuuguagaugagaaucaauggaauagcgcgaaagaggccgucgaagacgagagguuuugggaucuaguucaccgugaaagagagcuacacaaacagggaaagugugcgacaugcgucuauaacaugaugggaaagcgugagaagaaauuaggugaguucgggaaagcaaaaggaucacgcgcgauuugguacaugugguuaggcgcgcgauuuuuagaguucgaagcguugggauucaugaacgaggaucauugguuuucccgcgaaaacucuuugucagggguugaaggugaaggacuacacaaauugggguauauuuuaagagauaucucuaaaauacccggugguaacauguacgccgacgauacugcaggcugggacacgaggauaacagaagaugaccuucaaaaugaagcgaaaauaacagacauaauggaaccugaacaugcguuauuggcgaccuccauuuucaaauuaacuuaucaaaauaaagucgugcguguccaacggccagcgaaaaacggcacaguaauggacguaauaucaagaagagaucaacgagguucggggcagguagguacauauggucuaaauacauuuacaaauauggaagugcaacucauacggcagauggaaucugaaggcauauuucuaccuagugaacuagaaacaccuaaccuugcggagaggguacuggauuggcuagagaagcacggagcagaacgcuuaaaaaggauggcuauaagcggcgacgacugugugguuaaaccuauagaugauagauucgcgacugcccuaaccgcuuuaaacgauaugggaaaagugcgaaaagauaucccacaaugggaaccuaguaaggguuggaaugauuggcagcaagucccguuuuguucacaucauuuucaucaauuaauaaugaaagauggccgugaaauaguaguaccuugccggaaucaagaugaauuaguaggcagagcacguguuucccaaggugccggauggucacuuagggaaacagcaugcuuagguaaguccuacgcucaaauguggcaacuaauguacuuccauagaagggaucuacgccuagcagccaaugccauuuguucggcgguaccaguggacuggguuccaaccucacguacaacuuggucgauacacgcccaucaucaauggaugacaacagaagauauguuaucaguuuggaauagagucuggauugaggaaaaucccuggauggaagacaagacacaugucagcucaugggaagagguaccuuacuuaggaaagcgagaagaucaauggugugguaguuuaaucggccugacagcccgagcaacuugggcgaccaacauucaagucgcaauaaaucaaguucgaagauuaauaggcaaugaaaauuauuuagauuauaugacuagcaugaaacgcuuuaagaaugaaucugauccagaaggagcuuuaugguaa

SEQ ID NO: 21287 - RNA, 9879 nt, Artificial Sequence
  derived and/or modified CDS sequence (opt6) from DENV-1__KJ189340__SS-prME
ucggugacgauguuacuaauguuacugcccaccgcgcuggcguuucaccuaacuacuagagggggagaaccucauaugauuguguccaaacaagaacguggaaaaaguuuauuguucaaaacuagcgcuggcguuaauauguguacccuaauugcaauggauuuaggagaauuaugcgaagacaccaugacguacaaauguccacaaauaaccgaagcagaaccugaugauguugacugcugguguaacgccacugauacgugggugacuuauggaaccugcucgcaaacuggugaacaccgacgagauaaaaggagcguggcacucgcaccacauguaggauugggguuagaaacucgaacugaaacuuggaugagcucggaaggagccuggaaacaaauucaacgcguugaaaccugggcacugcggcauccaggguucacuguaauagcauuauuuuuagcacacgcaaucggaacauccauaacgcaaaaaggcaucauauuuauacugcuaaugcuuguuacaccuucuauggcuaugagaugugucggaauaggaaacagggauuucguagaaggacuaaguggugcaacauggguugaugucguauuggaacauggguccuguguaacuacaauggcuaaaaacaaaccaacuuuagacauugaacuucucaaaacggaaguuacuaauccagcgauucuacguaaacuauguauagaagcaaaaauuucaaacacuacgaccgauuccagguguccaacucaaggggaagcaacauuaguugaagaacaagaugcgaacuuugucugccggagaacauuuguugacagaggaugggguaacggaugcggacucuucggcaaagggucucugcuaaccugcgccaaauucaaaugcguuacuaaauuagaggguaaaauaguccaauacgagaacuuaaaauacagcguuauagugacuguacauacgggggaucaacaccaaguuggaaaugaaacgacagagcacgguacaaucgcgaccauaacaccacaagcaccuacuucugaaauacaacuuacagauuacggagcuuugacucuagauuguuccccgagaacuggacuugacuucaacgaaaugguauuacuaaccaugaaagagaaaaguuggcuugugcacaaacaaugguuccuagacuugccuuugccauggacaaguggagcaucaaccucccaagagacauggaaucggcaagaucuguuaguaacauucaagacugcgcacgcuaagaaacaagaaguaguuguucuugguucgcaagaaggcgcuaugcauacugcuuugaccggagcaacagaaauucaaacaucagggacgacaacuaucuucgcuggacaucuaaaauguagacuaaaaauggauaaacuuacguuaaaagguacgucuuacguaaugugcacgggaucauuuaaacuugaaaaagaaguagcggagacgcaacacggaacggugcuaguccaagugaaauacgaagguaccgacgcaccauguaaaaucccauucaguacucaagacgaaaaagguguuacacaaaacggaagacugaucacugcaaacccuaucgucacugauaaggagaaaccaguaaauaucgagacagaaccuccuuucggggaaucauacauaguaguuggagccggcgagaaagcauuaaaacuaucgugguucaagaaaggcucauccauaggaaaaauguuugaagcuacggccagaggagcgagaaggauggcuauucuuggcgauacugcaugggauuuugggucgauagguggaguguuuacuuccguaggcaaguuaguacaucaaguauucggcacugcuuacggaguuuuauucagugguguaagcuggacaaugaaaauuggcauugguauacuacuaacuugguugggucuaaauucuagaagcacgucgcucucuaugacuugcauugcaguggguauggugacucuauacuuagggguuaugguccaagcugauucaggcugcgucauaaauuggaaaggucgugaauugaaaugugguagugguauuuuuguaacuaaugaaguucauacauggacugaacaauacaaguuucaggcagauagccccaaacgcuuaucagccgcgaucggcaaagcgugggaagaaggaguaugcggaauacguagcgcaacaagacuagaaaauauuauguggaagcagauaagcaaugaguuaaaucacauuuuacuugaaaaugauaugaaauucaccguuguagucggagaugcaaacgguauacuggcucaagguaagaagaugauacguccgcagccuauggaacacaaauauucuuggaagucuugggggaaagcaaaaauaauaggagcggauauucaaaauacaacauucauaauagaugguccagacacacccgaauguccagauaaccaacgagcauggaauauaugggaaguagaagacuauggguuuggaauauucacaacuaacauauggcuaaaacuucgagacucguauacacaaaugugcgaucaccgauuaaugucggcggccaucaaggauucuaaggcaguucaugcagauauggguuauuggauagaauccgagaaaaacgaaacauggaaauuagccagagccuccuucaucgaagucaaaacuuguacuuggcccaaaucacacacccuauggucuaauggaguguuggaauccgaaaugaucauacccaaaaucuauggagggccgauuucccagcacaacuaucgaccuggcuauuuuacccaaaccgcugguccauggcacuuaggaaaguuagaauuggauuucgauuugugugaaggaacuacaguugucgucgaugaacacugugggaaccgagguccaucucugagaacuacuacaguuaccggaaaaauaauacacgaauggugcugucguagcuguacuuugccacccuugcgauuucgaggcgaagaugguugcugguacgguauggaaauacguccuguaaaggaaaaagaagaaaacuuaguaagaaguaugguaucugcagguaguggcgagguugacuccuuuucucuagggauccucugcguuucaauuaugauugaagaaguaaugagaucgcgauggucacgaaagauguuaaugacaggaacauuagcaguauuucuauugcuggugaugggacaacuuacguggaaugacuuaauacgacuguguauaauggucggggcaaaugcgucagaucgcaugggaaugggcacaacguaccuugcauugauggcgacguucaaaaugcguccuauguucgccguuggacugcuauucagaagacuaacaucaagagaaguacuccuacucacgauuggucugagccuagucgcuucagucgaacuuccaaauucacuagaagaauuaggugauggauuagcuaugggaaucaugaugcugaaauuauuaacugaauuucaaccgcaucaacuuuggacuacauuacucucgcuaacauucauaaaaaccacgcucucauuagacuaugcauggaaaacgacagcaauggcgcuaaguauaguaucauuauuuccauuauguuugagcacuaccagucagaaaacuacauggcuaccaguauuacuagggagcuucggcugcaaaccucucacaauguucuuaauaacagaaaacaaaauauggggaagaaagagcuggccauuaaaugaaggaauaauggcgaucggaauugugucaauacugcuuucgucauuacucaaaaaugacgucccacucgcggguccacuaauugccggugguauguuaaucgcauguuacguaauaagcggcucaucagcggaucuuagcuuagaaaaagcagcggaagugucgugggaacaggaagcggaacauagugggacaagucacaacauacugguagagguccaagacgaugguacuaugaagauuaaggacgaggaacgcgacgacacccugaccauauuauuaaaagcuacccucuuagcaguaucagggguguauccaauguccaucccugcuacacuauuuguaugguauuuuuggcagaagaagaaacaaagaucuggagucuuaugggauacuccuuccccgccugaaguagagcgugcuguccuagacgauggcaucuauagaauauuacaacgaggucuccucggucgcagucagguggguguuggaguauuucaggacggaguauuucauacaauguggcauguuaccagaggagcaguguugauguaccagggcaaaagacuugaaccaucaugggcuucagucaagaaagaucuaauaucuuacggcggagguuggcgguuccaagguucauggaauacgggugaagaagugcaaguaauagcgguagaaccaggcaaaaaucccaagaacguucaaacgacaccagguaccuucaaaacaccugaaggcgaagugggcgcgauugcacuugauuuuaaaccuggaacaucuggauccccuaucguuaaccgagaagggaaaauaguuggauuguauggcaauggugucguaacgacuggcggaacuuauguaagugcaaucgcucaagcuaaagcgucucaggaggguccccuuccagagauagaggaugaagucuuuaagaaaagaaaccuuacuauuauggaucuucauccagggaguggaaaaacaaggagguauuugccagccauaguacgcgaagcaauuaagcgcaaacuaaggacuuugauucuggcuccaaccaggguugucgcaagcgagauggcagaggccuuaaaaggcaugcccaucagauaucaaacuacagcagucaaaucagaacacacaggacgugaaauaguugaucuuaugugucaugcuacauuuacgaugagacuccucucgcccguccguguuccaaauuacaacaugaucauaauggacgaggcucacuuuacugacccggcaucuauagcagccagaggcuacauaucgacacgaguaggcaugggcgaagcugcagcuauauuuaugacagcaacaccuccaggaucuguagaggccuuuccccagaguaaugcaguaauucaggaugaggaacgggauauuccggaacggucauggaauagcggcuacgauuggauaacugacuuuccuggaaaaacuguuugguuuguaccuagcauaaaaucuggaaacgacauagcaaauugcuuacguaaaaacgggaaacgaguuauucaacuuucaagaaaaacauucgacacagaauaucaaaagacgaaaaauaacgacugggauuacguaguaaccacggacaucagcgaaaugggagcuaauuucagagcggaccgcguaauugacccaagaagaugcuuaaaaccaguaauacuaaaagauggcccagagcguguaauccuggcagggcccaugccugucacaguagcaucugcugcacaacgacgaggaagaauuggcaggaaccagaauaaggaaggagaucaauaugucuauauggggcagccuuuaaacaacgaugaagaucacgcccauuggacagaggcaaagaugcuauuagauaacauuaacacgccagaggguauaauucccgcacucuucgagccagaaagggagaaaagcgcugcuauugacggagaauaucgccuaagaggagaggcaaggaaaacguucgucgaauuaaugagacgaggggacuuaccaguguggcuaaguuacaaaguugcaagcgagggguuccaauacucagaccguagaugguguuuugauggcgaaagaaauaaccaaguauuagaagaaaacauggacguagaaauauggacaaaagaaggagagcguaagaagcuaaggccucgauggcucgaugcgagaacauauucagacccacuggcauugagggaguucaaagaauuugcugccgguaggcgaucuguuucaggcgauuuaauauuagaaauuggaaaacugccacaacaucucacauuaagagcucaaaaugcucuagacaaucuggucauguuacauaacucagagcaaggaggaaaagcauaucgacacgccauggaagaacuaccagacacuauagaaacgcugauguuacucgcauugaucgcaguacuaaccggcggugugacauuguucuuucuaagcgguaaaggucugggaaaaacaaguauuggauuacuuugcguaacagcuuccucagcucugcuuuggauggcuucagucgaaccucacuggauagcagcgucaaucauucuggaguucuuccuuaugguacuacuuauuccugagccagacaggcaacgaacaccacaagacaaucaguuagcuuacguuguaauaggauugcuauuuaugaucuuaacaguagcagcaaacgagauggguuugcucgagacuaccaagaaagacuuagguauaggacauguagcugccgaaaaucaucagcacgcuacaaugcuagacguagauuuacgccccgcuucagcuuggacccuuuacgcgguagcgacaacagucauuacaccaaugaugagacacaccauagagaacacaacagccaauauuagucucacugcaaucgcaaaucaagcagcaauucugauggguuuggauaaagguuggcccaucuccaagauggacauaggaguuccuuugcuugcucuaggcuguuacucccaagugaaucccuugacauuaacggcagcuguauugaugcuaguggcccauuacgcgauaauaggaccagguuugcaggcaaaagcaacucgagaggcccagaaaagaaccgcagcaggcauaaugaaaaacccaacaguggauggaaucguagcuauagacuuagauccggucguuuacgaugccaaguuugaaaagcagcuuggccagauaaugcuacucauacuuuguacaucucaaauacuucuuaugcgaacgacgugggcacuaugugagaguauuacacuugccaccggaccacugaccacauuaugggaaggaucaccugggaaauuuuggaauacaacaauagccgucucuauggcaaacaucuucagaggcaguuaccucgccggcgcgggccuagcuuucucauuaaugaaaucacuaggaggugguagacgaggaacaggcgcacaaggugaaaccuuaggagaaaaauggaaacgacaacuaaaucaauugucgaaaagcgaguucaacacguauaagagaaguggaauuauggaagucgauagaucagaagcgaaggagggacuaaaacguggagagacgacaaaacacgcuguuagcaggggaacagcgaaacuaagaugguucgucgaaagaaaccucgucaagccagagggaaagguaauugacuuggguugcgggcgagggggauggucguacuauugcgcuggauuaaagaaagucacggaagugaaaggguauaccaagggagggccaggucaugaagaaccgauacccauggcaaccuacggguggaauuugguaaaacuccauucugguaaagauguauucuuuaugccgccugaaaaaugcgacacgcuguuaugcgacauaggagaaucuagcccuaauccaaccauagaagaaggucgcacucuuagaguguuaaagaugguagaaccgugguuacgaggcaaucaauucuguauaaaaauacugaauccguacaugccaucaguuguagaagcauuagaacaaaugcaacggaaacauggaggcaugcuagucagaaacccauuaagcagaaacucaacacacgaaauguauuggguuucuugcgguacugguaauaucguaagcgcugugaauaugacuucacguauguuacuaaauagguuuacuauggcacacaggaagccaacuuaugagcgagauguggaccuuggugcaggaacuagacauguugcagucgaaccagaaguagcaaacuuagauauaaucggacagcgaauugaaaauauaaagaaugagcauaaaucaacauggcacuacgaugaagauaacccauacaaaacaugggcauaccauggaucguaugaaguuaaaccuagcggcuccgcaucaagcaugguaaacgggguaguuaggcuacuuacgaaaccuugggaugugauuccaauggugacgcaaauagcaaugacugauacuaccccauuuggacaacaacgcguauucaaggagaaagucgauacaagaacuccaaaagcuaaacgaggcaccacgcaaauaauggaaguuacagcgaaguggcuaugggguuuucuauccagaaauaagaaacccaggauauguacaagagaggaguucacaagaaaaguucggucuaaugcggcaaucggugcagucuuugucgaugaaaaucaguggaacucagcgaaagaagcggucgaagaugaaagauuuugggaucuuguacacagagaaagagagcuccacaaacaaggaaaaugugccacaugugucuacaauaugauggggaagagggagaagaaacuuggugaauuugggaaagcaaaggggaguagagcaauuugguauauguggcuaggugccagauucuuggaguuugaagcacucgguuuuaugaaugaagaucacugguuuaguagagagaacagucuaaguggagucgaaggagaaggacuucacaaauugggauauauacuaagagauaucucaaagauaccaggaggaaauauguacgcggacgauacugcugguugggauaccaggauuacugaggaugaccuacaaaaugaagcaaaaauuacugaaauuauggaaccagaacacgcacuacucgcaacuucuaucuucaaacucaccuaucaaaauaagguaguacgaguacaaagaccugccaagaacgguacggucauggauguuauuucaagaagagaucaacgagguucuggucaagugggcacauacggacugaauaccuuuacuaacauggaaguacaauugauaagacaaauggaaagcgaaggaauauuucuaccaucggagcuugaaacuccaaacuuagcagagcguguacuagauugguuggaaaagcauggugcggaacgucuaaaaagaauggcaauaaguggcgaugacugcgucguaaaaccaauagacgaucguuucgcgacugcucuaacagcgcuaaacgacaugggcaaaguacgaaaagauauuccacaaugggaaccaucuaaaggauggaacgacuggcaacaagucccauuuuguagucaucauuuucaccaauugauaaugaaggauggaagggaaauagucgugccauguagaaaucaagaugaacugguuggccgugcacgaguuucucaaggggccggcuggucccugagagaaacggcguguuugggaaagucguaugcucaaauguggcagcucauguacuuucaccgccgagacuugagacuagcggcgaaugcaauuuguucagcuguccccgucgauuggguaccaacaagucgaaccacauggucaauacacgcccaccaucaauggaugacaacugaagacaugcucagcguauggaauagagucuggauagaagaaaacccguggauggaagauaaaacucacguguccaguugggaagaggugccauaccuugggaaacgagaagaucaauggugcgguagccuuauaggacuuacugcaagagcaacuugggcuacgaauauacaaguagcaauaaaucagguacgucgauuaauaggaaaugaaaauuaccuugauuacaugacgucuaugaaacgcuuuaaaaaugaaagugauccugaaggcgcgcuaugguga

SEQ ID NO: 21288 - RNA, 9879 nt, Artificial Sequence
  derived and/or modified CDS sequence (opt6) from DENV-1__KJ189341__SS-prME
ucggugacaauguuacugauguuauuaccgacugcauuagccuuucacuuaacgacacgagggggugaaccccacaugauaguaucuaaacaagaaagggguaaaucucuuuuauuuaaaaccucugcagggguuaauauguguacucuaauugcgauggaucugggggaacuuugugaagauacuaugacuuauaaauguccucaaaucacugaagcagaaccagaugauguugauuguugguguaaugcuacagacacaugggucacguacgggacaugcucgcaaacagggggucauaggagagagaaaaggucaguugcguuggcuccacacgugggucuuggacuugaaacaaggacggaaacuuggaugucaucagaaggagcauggaaacaaauacagcgaguagaaaccugggcucuaaggcacccugguuuuacaguuauugcuuuauuucuagcucaugcaaucggaacaucaaucacucaaaaaggcauaaucuuuauucuauuaauguuaguuacgcccucaauggccaugcgaugugucggaauagguaauagagauuucguugaagguuugucaggagcaacauggguggacguaguauuggaacauggaucguguguuacgacaauggcuaaaaauaaaccaacucucgauauugaacuauuaaaaaccgaaguaacaaacccugcaguucuaagaaaauuauguauagaagcaaaaauaucaaacacuacaacagacagucgcugcccaacccaaggagaggcuacccuaguggaggaacaagacgcgaacuucgucugucgcaggacuuucguggauagggggugggggaauggauguggguuauucggaaaagguucgcugcuaacaugugcgaaauuuaaguguguuacaaaacuugaagguaagaucguacaauaugaaaaucuuaaguauucuguaauuguaacuguucauacaggggaucaacaccaagucgguaaugagaccacugaacacggaacaaucgcaaccauaacuccacaagcuccuacaagugaaauucagcuaacggauuauggugcauugacuuuagacugcucaccaagaaccggacucgacuuuaaugaaaugguauuacugacaaugaaagagaaaucuuggcucguucauaaacaaugguuucuagaucuaccuuuaccguggacuucuggcgcgucuacaucucaagaaacauggaaucgacaagaucuauuaguaaccuuuaaaacggcccaugccaagaaacaagaaguggugguacuuggcagucaagaaggggcuaugcacaccgcauuaaccggagcuaccgaaauucaaacaucagggacgacuacaauuuuugcuggucaucugaaaugucgucuaaaaauggauaaauuaacccuaaaagguaccucauaugucaugugcaccggcccuuucaaauuagagaaagaaguagcugaaacccagcaugguaccguacucguacaaguaaaauacgaggguacagaugcucccuguaagauaccauuuucaacacaagaugaaaaaggaguuacgcaaaacggcaggcuaauaacugcaaacccuauaguuaccgauaaggagaagccagugaauauugaaaccgagccaccauuuggggagagcuacauaguagugggggcaggagagaaagcauuaaaauuaagcugguuuaagaaaggcaguucgauagguaaaauguuugaagcaacagcucgaggcgcuagacggauggcuauacuaggagacacagcaugggauuuuggcagcauaggaggcgucuuuacuucuguaggaaaacuugugcaucaaguauucgguacagccuacggaguuuuauucagcgggguuaguuggacaaugaaaauagggaucgggauuuuguuaaccugguuaggccugaauaguagaucaacuagcuuaucaaugaccuguaucguagucggcaucguaacucuuuacuuagguguaaugguccaggccgauaguggaugcguaauaaauuggaaggguagagagcuaaaaugcggaucaggaauauucgugacgaacgaaguacacacauggacugagcaauauaaauuucaagcggauucaccgaaaagacugagugcagcuauaggcaaagcaugggaggaaggaguaugugguauucgaagugccacacgucuugaaaauaucauguggaagcaaaucaguaaugagcucaaccacauacuuuuagaaaacgauaugaaauuuacugugguaguuggugacgcaaacggaauauuagcccaggggaagaagaugauuaggccucaacccauggaacacaaauauucuuggaaaagcugggguaaagcgaagaucauaggagccgacacacaaaacacaacauuuauaauugacggaccggacacgcccgaauguccugauaaucagagagcauggaauauuugggaaguugaggacuacgguuucggcaucuuuacgacgaauauuuggcuaaaguuaagagacucauauacacaaaugugugaccaucgcuuaaugucagccgcgaucaaagacucaaaagcaguucaugcagauaugggguauuggauugaaagugagaaaaaugaaaccuggaaacuagcgcgagcaucauuuauugagguaaaaacuuguacauggcccaaaucccacacacuauggucuaaugggguacuugaaucagagaugauaaucccaaaaauauauggagggcccauuagucaacacaauuauagacccggauauuucacccagacagcagguccuuggcaccuaggaaaauuagaauuagacuucgacuuaugugagggaacaacuguuguuguagaugaacauugcgguaacaggggaccuaguuuacgaacgacaacgguaacugguaagauaauacaugaauggugcugcagguccuguacauuaccaccacugagauuuagaggggaggauggguguugguacggaauggaaauacguccugucaaagaaaaagaggaaaauuugguaaggucaauggucucggccgggaguggagaaguugauagcuuuucacuaggaauauuaugugcaucgauaaugauugaagaaguuaugagaucaagguggagccgaaaaaugcuaaugacuggaacacuugcgguauuucuacuacuaaucaugggacaauugacuuggaaagaucugauucgguuaugcauuaugguuggggccaacgcaagugauaggauggguauggggacaacuuaccuagcacucauggcuacauucaaaaugcgucccauguucgcugucggauuacucuuccggcgacuaaccagcagagaaguauugcuuuugacaauuggccugucacuuguggccucgguggaauuaccaaauagccuggaggagcuaggggauggucuagcuauggguaucaugaugcucaaauugcuuacggaguuucaaccacaccaauuauggacuacgcuacuuagcuuaacguucauaaaaacuacucugagccucgauuacgccuggaaaacaacggcgauggcacugucuauaguuagucucuuuccauuaugccugucgacuacuucacagaaaacaacgugguuaccaguauuacuaggcaguuuugguugcaaaccuucaacaauguucuuaauuacagagaauaaaauuugggggcgaaagucauggccacuaaacgaaggcauaauggcgauagguauagucucaauacuucuauccuccuugcuuaaaaacgacgugccucucgcaggaccguugauugccggcgguauguugauugcguguuauguuauaucaggauccagugcagaucugucacuagaaaaagcggcagaaguaaguugggaacaagaggcugaacauucuggcacaucgcauaacauucuuguugaaguacaagaugacggaacgaugaagaucaaagaugaggagagggaugauacuuuaacuauacuucuaaaagcaacccuacuagcgguuucugguguguauccgauguccauaccagccacacuguuuguuugguauuuuuggcagaagaagaaacaacguucagggguauuaugggauacuccaaguccaccagaaguagaaagagcaguucucgacgauggcaucuaucguaucuugcaaagaggguuauuaggucgcagccaaguaggagugggaguauuucaagacgguguuuuccacacaauguggcauguuacacguggagccguauuaauguaucagggaaaaagacuagaaccuaguugggccucagucaagaaagaucugaucuccuauggggguggcuggagguuucagggaaguuggaacacaggagaggaagugcaaguaauagcaguugaaccaggcaaaaauccuaaaaacguacagaccacaccaggaacauucaaaacgccggaaggggagguuggagcuauagcauuagauuuuaaaccaggcacaucaggaaguccaauaguaaaucgcgaagggaaaauagucggacuauacgggaaugguguuguuacaacaagcgguacauacgugucagcaauagcacaagcuaaagcaagccaagaagggccuuugcccgagauagaagacgagguuuucaagaaacguaaucugacaauuauggaccuucacccggguucaggaaagaccagaagauauuuaccggcgauuguacgugaagcgauaaaaagaaaauugcgaacuuugauauuagcaccaacacguguaguagcaucagaaauggcagaagcacuuaaaggcaugccuauaagauaccaaacuaccgcuguaaaaagcgaacauacagggcgggaaauaguggaccuaaugugucaugcuaccuuuacaaugcggcucuugucgccaguucgaguccccaauuauaauaugauaauaauggaugaagcacacuuuaccgacccagcuucgauagcggcccguggauauaucaguacuagaguuggcaugggagaagccgcagcuaucuucaugacagcuaccccaccaggaucaguagaggcauucccacagaguaacgcagucauucaggacgaagaaagagauauuccagaaagauccuggaacucuggauacgacuggaucacagauuuuccggggaaaacaguaugguuuguaccguccauuaaauccgguaaugauauagcaaauuguuugaggaagaauggaaagagggucauccaauugaguagaaaaacuuucgacaccgaauaccagaaaaccaaaaauaaugauugggauuacguaguaacaacggauauaucugaaaugggugcaaacuuuagagccgacagagugauugacccuagacggugucucaaaccuguaauacugaaggacgguccagaaagaguaauuuuagcugggccgaugccgguaacaguagcuagcgcugcacagcggagagguaggauuggccggaaccagaauaaagaaggggaccaauacguauauauggggcaaccacuuaacaaugaugaagaccaugcucauuggaccgaagcgaagauguuauuagacaauauaaauacaccagaagggauuauaccagcccucuucgaaccagaacgagaaaagagcgcagcaauagauggggaguaucgguugagaggugaagcucguaagacauucguugagcuuaugagaagaggcgauuuaccgguauggcuaucguacaaaguugccagcgaagguauacaauacucggacagacgcuggugcuuugauggagaaaggaauaaucaaguguuagaagaaaauauggaugucgaaauuuggaccaaggaaggagaaagaaagaaacuuagaccaagguggcuugacgcucgaacauacucagauccgcuggcacuccgagaauuuaaagaguucgcggccggccgaagaucgguaucaggugaccuaauacuggaaaucggaaaacugccccaacaucuaacauuaagggcccaaaaugccuuagauaaucuggucauguuacacaauucagaacagggugggaaggcauacagacacgcuauggaagaacuaccagacacaaucgaaacacuaauguuauuagcucuaauagccguguuaacggguggaguaacauuguuuuuccuuaguggaaaaggacucggaaaaacaaguauuggucuauuaugugugacagcaaguucagcucugcuauggauggcaucaguggaauuacauuggauugcagcaucgauuauauuggaauuuuuccuaaugguacugcuaauucccgaaccggauagacaacgaacuccgcaggacaaucaauuagcauaugugguaauaggacuacucuucaugauauuaaccguugccgcaaaugagaugggacuacuggaaacaaccaaaaaggaccuugguaucggacauguagccgcggaaaaucaccaacacgccacaauguuagauguagauuuaagaccagcaagugcguggacacucuaugcaguagcaacaacuguuauuacuccuaugaugagacauacaaucgagaauacuaccgcaaacauaagucuaacggcuaucgcgaaccaagcagcuauacuuaugggauuggauaaagguuggccaauaucaaaaauggacauaggggucccccuccuagccuuaggcugcuacagucagguaaauccacuaacauuaaccgcagcaguccucauguugguugcgcauuaugcaauaauaggcccuggcuugcaagccaaagcaacaagagaagcacagaaacgaacugcugcuggaaucaugaaaaacccgacuguggauggaauagucgcuauugaccuagauccggugguuuacgacgcaaaauucgaaaaacagcucggacaaauuaugcuguuaauacucuguacuucccaaauuuuacuuaugagaacaacgugggcuuuaugugaaaguauaacccuagccacagggccccuuacaacgcuaugggaaggaaguccuggaaaguucuggaacacaacaaucgcggucagcauggccaacauauuuagagguucguaucuagcaggagcaggguuagcauuuucuuugaugaaaucucuaggaggagguaggagggguacuggcgcucaaggcgagacucuuggggaaaaguggaagaggcaacugaaucaauugucaaaaucagaguuuaacauauacaagcgaucgggcauaauggaaguagaccgaucggaagcaaaagaaggauugaagagaggagaaacuacgaaacaugcuguaucuagaggaacugcuaaauuaagaugguucgucgaaagaaauuuaguaaagccagaggggaaagucauagauuuaggaugcgguagaggcggcuggagcuauuacugugcagggcugaagaaaguuacugagguaaaaggauauacaaaaggcggaccaggucaugaggaaccaauuccgauggcaacauauggauggaaucugguuaaauuacauucaggaaaggauguauuuuucaugccuccagaaaaaugcgauacacuccugugugacauaggugaaucaagcccuaauccaacaauugaagagggucgaacacuuaggguguuaaaaaugguugaaccauggcuuagaggaaaccaauucugcauuaagauuuugaacccuuauaugccaagugucguagaaaccuuggagcaaaugcaacgcaaacacggaggcaugcuuguacguaauccacugagcagaaauucaacacacgaaauguacuggguaagcugugguacaggaaauaucguaagugcagucaacaugacaucacgaauguuguuaaauagauucacaauggcacauaggaaacccacuuacgaacgggauguagaucuaggagcaggcacuagacacguagcaguggaacccgaggucgcaaaucuagacauaauaggucaaaggaucgaaaacauuaaaaaugagcauaagucaacauggcauuaugacgaggauaauccauauaaaacuugggcauaucaugggagcuaugaagugaagccaagugggagugccucuucgaugguaaacggggucguacgacuccuaacuaaaccaugggaugugauaccuaugguaacacaaaucgcuaugacagacacaacucccuuuggacagcaacgaguuuuuaaggaaaaaguagacacacggacgccuagagcaaagagaggaacuacucaaaucauggagguaacggcuaaauggcuguggggauuuuuaucgcguaauaagaaaccucgaaucuguacucgagaggaguucacgagaaaggucaggucgaaugcagccaucggagcuguuuuugucgacgaaaaucaauggaacucugcuaaagaggcugucgaagaugagcgauucugggaucugguacacagagaacgcgagcuacacaaacaaggaaaaugugcuacauguguuuauaacaugaugggaaaaagagagaagaaacuuggggaguuugggaaggcgaaggguucgagagccauaugguacaugugguuaggagcaagguuucuggaguuugaggcuuuaggauuuaugaacgaagaccauugguuuucaagagaaaauuccuuaagcgggguagaaggagaggguuugcauaaacuaggauacauucuacgugauauuuccaaaauaccgggcggaaauauguacgcagaugacacggcaggaugggauacucgaauuacugaggacgauuuacaaaaugaagcuaaaauuacugacaucauggaaccagaacaugcacucuuagcuacaucaaucuuuaaguuaacauaccaaaacaaaguaguacgcguucagcgaccggcuaaaaacggaacugugauggacgucauuuccaggagggaucaacgaggaaguggacaaguuggaacauaugguuuaaauacauuuacgaauauggaaguacaacuaauacgccagauggaaucggaaggcauauucuuacccucggaacuagaaacaccaaacuuggcagaacgcguucuugacuggcucgaaaaacacggugcggaacggcuaaaaagaauggcaaucaguggcgaugauugcguaguuaaacccauagaugauagauuugccacugcauuaacugcuuugaaugauauggguaaaguacgaaaagauaucccucaaugggaaccaagcaagggcuggaacgauuggcaacagguaccauucuguucacaccacuuucaccaguuaaucaugaaagauggacgggagauaguuguuccaugcagaaaucaagaugaauugguagguagagcacgggugagucagggugcuggauggagcuuacgagagacagccugcuugggaaagagcuaugcgcagauguggcaauugauguauuuccauagaagggauuuaagauuagcugcgaaugcuaucuguagugccgucccuguagauuggguuccuaccagccgcacgacuuggucuauccaugcacaccaucaauggaugacuacagaggauaugcuuucaguuuggaaccggguguggauagaagaaaauccuuggauggaagauaagacucauguaucauccugggaagaaguccccuacuuaggcaagcgagaggaucaguggugcgggucauuaauuggccucacagccagagcaacaugggcaaccaauauucaaguggcuauaaaucaagugagaagauuaauugguaaugagaacuauuuagacuauaugacuagcaugaaaagguuuaagaaugaaucugaucccgagggagcccucugguaa

SEQ ID NO: 21289 - RNA, 9879 nt, Artificial Sequence
  derived and/or modified CDS sequence (opt6) from DENV-1__KJ189343__SS-prME
ucgguaacuaugcuauuaaugcuauuacccacagcauuagcuuuucauuugacuacaagagggggugaaccacauaugauuguaucuaaacaagaaagaggaaaaucgcuauuauucaaaacaucggcaggagugaacauguguacacucauagcaauggaccuaggugaacuaugugaagacacaaugacauacaaauguccacaaauuacagaagcagaacccgacgauguagauugcuggugcaacgcaacggauacauggguaaccuacggaacaugcagucaaacaggggaacauagaagggauaagcgcucagucgcacuggcaccacauguaggucuagguuuagaaacgaggacugaaacguggaugaguagugaaggcgcauggaagcaaauacaacguguagaaacgugggcgcuucgccacccaggcuuuacgguaaccgcacuauuccuagcacaugccaucggaacaaguauaacacaaaagggaaucauauuuauacuauuaaugcuaguaacgccaagcauggcuaugaggugcguuggaauaggaaacagagacuuuguugaagggcuauccggagcuaccuggguggauguugugcuagaacaugguucuugcguaaccacgauggccaaaaauaaacccacauuggauauugagcuccuaaaaaccgaaguaacaaacccugcgauacuacgaaaacuaugcaucgaagcaaaaauaaguaacacuacuacugacagccgaugcccaacucaaggugaagcuacucuaguagaagaacaagacgcaaauuucguauguagaagaaccuucguagaucgagguugggguaaugguuguggacuuuuuggcaaagguagccuucugacuugugcaaaauuuaaauguguaacaaaacuagaaggaaaaauugugcaauacgaaaaucugaaauauucaguaauaguaacgguucacacgggagaucaacaccaaguagggaaugagacuacagagcauggaacaauagcaacuaucacaccacaggcuccaacaucugaaauccaauugacggacuauggugcacuuacacuagacuguucuccccguacuggguuagacuuuaacgaaaugguacuauuaacgaugaaagagaagucauggcuagugcauaaacagugguuccuugauuuaccccuaccauggacgucaggggcaucgacgucgcaagaaacauggaaccgacaagaucuauugguuacguucaaaacggcucacgccaagaaacaagaaguuguuguguuggggagccaagaaggagcgaugcacacugcacuuacaggggcuacugaaauacaaacaucugguacaacuaccaucuuugcaggucaccucaaaugccgauuaaaaauggauaaacuuacacucaaagguaccagcuaugucaugugcacagguucguuuaaacucgagaaagaaguugcagaaacucaacauggaaccguacucguacaaguuaaguaugaagggacagaugcuccuuguaaaauaccuuucagcacccaagacgagaaagggguaacucaaaacgguagguugaucacugcuaaccccauuguuacagacaaggagaaaccagugaauauugaaacggaaccuccguuuggugaaucuuacauaguugucggcgcaggagaaaaagcauugaaguuaucaugguucaagaaaggaucaucaaucgggaagauguuugaagccaccgcacgaggagcccgcagaauggcaauuuugggggacacagcaugggauuuuggaagcauagguggaguguuuacuagcguaggaaaacucgugcaucaaguauuuggcacagcauaugguguacuauucucagggguaaguuggacuaugaaaauuggaaucggaauuuuauuaaccugguuaggacuaaauucucgaucuacuuccuuauccaugacauguauugccguagguauggugacccucuaccugggaguaaugguccaagcagauucugguugcguagugaacuggaaagggagggaacucaaaugcgguuccgggauauuuguaacaaacgaaguacacacuuggacagaacaauauaaauuucaggcagauucaccaaaaagacucagugcggccauagguaaagcaugggaagaagguguuugcggcauucgaagcgcgacacgguuggaaaacaucauguggaaacaaauuagcaacgaacuuaaccauauacuauuggagaacgacaugaaauucacaguaguaguaggagacgcuaaugggauacucgcacaaggaaagaaaaugauaagaccacaaccuauggaacauaaauacucguggaaaaguugggguaaagcuaagauaaucggugcggauauacagaauacuacauucauaauagacgguccugauacuccugaauguccugacaaucagcgugcauggaauaucugggaagucgaagauuacggcuuuggcauauucacgacaaacauuugguuaaaacuaagagacagcuacacacagaugugugaucacaggcucaugagcgccgcuauuaaggacagcaaggcaguccacgcagauaugggauauuggauugaaagcgagaagaaugagacuuggaagcucgcucgagcuagcuucauagaggucaaaaccugcacuuggccuaagucucacacacuauggucgaacggaguucuggaaucugaaaugauuaucccgaagauuuauggggguccuauaucucaacauaauuaccgaccggguuauuucacucaaacugccggacccuggcaucuugggaaacuugaauuggauuuugaucucugcgaggguacgacuguuguagucgaugaacauugugguaacaggggacccucacuacgaacuacgacuguuacugggaaaauaauccacgaaugguguugcaggucuugcacauuaccuccacuaagauuucgaggagaagacggcugcugguacgguauggaaauucguccaguaaaagaaaaagaagaaaacuuaguaagaaguaugguuucggcagguucaggugaagucgauagcuucuccuuagguauuuugugugcuucuauuaugaucgaagaaguaaugaggucacguuggucucggaaaaugcuaaugaucggcacucuugcgguuuuccuucuccucauuaugggacaacuuacauggaaugacuuaauccguuuaugcauaaugguuggugcuaacgcuucugaccgcaugggcaugggaacgacguacuuagcacugauggccaccuuuaaaaugagaccuauguucgccguagguuuauuauuucgacguuugacaucucgagagguacuauuauuaacaauuggcuuaagucuaguagcaucggucgaacucccaaauucacucgaggagcuuggagauggauuagccauggguauuaugaugcuaaaacuucugaccgaguuccaaccacaccaacuuuggacaacccuucuuucuuugacguuuauuaagacuacccucucguuagacuacgcauggaagacaacagcuauggcacuaagcauaguaucucuuuuuccauuguguuuguccaccacaucccaaaagacaacaugguugccaguuuuguugggcagcuucggauguaagccacugacuauguuucuuauuacagaaaacaaaaucuggggucguaagagcuggccgcuaaaugaagguauuauggcuauagguaucgugagcauccuauuaucuucauuacugaaaaacgauguuccauuagccggaccacuaauugccggaggaauguugauugcaugcuauguuauaaguggauccucagccgauuuaagucuugaaaagacugcagaaguaucaugggaacaagaggcggagcacucagggacgucccacaauauucuaguugaaguacaagacgacggaacuaugaagauaaaagacgaagaaagagaugauacccuuacaauauuguugaaagccacacuccuugcgguguccggaguauauccaaugucuauccccgcuacguuauuuguuugguauuuuuggcagaagaagaaacaacggagugggguauuaugggacacaccauccccucccgaaguagagcgagcaguuuuagaugauggaaucuaucgaauacuccaaagaggacuacuuggucggucgcaagucgguguagguguuuuucaagauggaguuuuucacacaauguggcacguaaccagaggggcaguacuaauguaucagggcaaaagacucgagccauccugggcauccgucaagaaagaccugaucucauacggaggcggauggcguuuucaaggcucuuggaauaccggugaagaaguccaaguaauagcugucgaacccgguaaaaaucccaaaaauguacagacuacuccaggaacauuuaaaacaccugaaggagagguuggagcuauugccuuagauuucaaaccuggcacaagugggaguccuauaguaaaucgagaaggaaaaauuguagguuuauaugggaacggcguaguaaccacuucggguacauaugugagugcuauugcacaagcuaaagcgagucaagagggaccacuucccgagauugaagaugagguauuuaagaaaaggaauuuaacgauaauggacuuacauccaggaagugggaagacucggcgauaccuuccggcuauugucagagaagcaauaaaacgaaaauuacggacauuaauucuggcaccaacgcgcgucguugcuucggagauggcagaagcauugaaaggaaugccaaucagguaucaaacaacugcugugaagucagagcauacgggucgcgagaucguagaucuaaugugccaugcuacauucacuaugagacugcucagcccugucaggguucccaauuauaauaugaucauuauggacgaagcucacuuuacggacccugcaagcauugcagcacgaggauacauaaguacccgaguugguaugggggaagcugcagcaauauucaugacugccaccccuccaggaucaguugaagcauuuccccaaucuaaugcagugauacaagaugaagaacgggacauacccgagcgaucuuggaacucugguuaugacuggaucacagacuuuccgggaaaaacggugugguuugugccgagcauaaaaaguggaaaugacauugcuaacugccuacguaaaaaugguaaacgaguaauacaauuaucgcgcaaaaccuucgauacugaauaucagaaaaccaaaaauaaugauugggacuacgugguuacuaccgacaucucagaaaugggcgcaaacuuucgugcggaccgcguaauagacccuaggagaugucucaaacccguuauacucaaagacggaccggaacggguaauauuagcaggccccaugccggucacaguggcaucggcugcucagcgcaggggaaggaucgguagaaaucaaaauaaagaaggugaucaauauguauauaugggccaaccuuuaaacaacgacgaagaccacgcacauuggacugaagcaaaaauguuacuggacaauaucaauacuccagaaggcauaauucccgcuuuauuugaaccugagagagagaagucagcagccauugauggagaauauagacuuagaggagaggcgcguaagaccuucguggaacuaaugagaagaggcgauuuaccuguauggcugucuuauaaaguagcuagugagggcuuucaauacucagaucguagaugguguuuugauggugaacgaaacaaucaaguuuuggaggaaaacauggacguugaaauuuggaccaaagagggggaaaggaagaaacucagacccagauggcucgaugcuaggacauauucagauccacuagccuuaagggaauuuaaagaguuugcugcuggaaggcggaguguauccggagauuugauccuagagauuggcaaauuaccccaacaucuuacguuacgagcucaaaaugcucucgauaaucucgcgauguuacacaacagugaacaagggggaaaagcauaccgucaugcgauggaagaauuacccgauacgauugagacucuaaugcuacuagcacuaauagccguacuaacugguggagugacacuauucuucuugucaggcaagggacuaggaaaaacaucaauaggacugcuuugcguaacugcgagcucggcuuuacuuuggauggcuucgguggagccucauuggaucgcagcaagcauuauacuagaauuuuucuugaugguuuuacuaauaccagaaccagaucgccaacggacaccucaagauaaucaacuagccuauguaguaauaggauuacuauucaugauauuaacuguugccgcuaacgaaauggguuuguuagagacuacaaagaaggaucuaggaauaggucauguagcugcggaaaaucaccaacaugcuacgauguuagauguggaccuaagaccagcuagugcauggacacuauacgccguugcaacgacaguaauuacacccaugaugcgacauacgauagaaaauaccaccgcaaacauaucucuaacagcuaucgcaaaccaggcggccauucuuauggguuuagauaaaggguggccaauaaguaaaauggacauugguguuccacuacuagcguuaggaugcuauucucaagucaauccacuaacucuaacagccgcaguacucauguuaguagcacauuaugcaauaauuggaccaggacuucaagcaaaagcaacaagagaggcucagaaaaggacagcagcggguauaaugaaaaacccuacaguugauggcauaguugcuauugaccuagacccaguagucuacgaugcaaaauucgaaaaacaauugggacaaauaauguuacucauucucugcacaucucagauucuccuuaugagaacaacaugggcgcuaugcgaaucaauuacucuggcuacuggcccacucacaacucuuugggaaggaucucccggaaaauucuggaacacaaccauugcaguaucuauggcgaauauauucagggguaguuaccuggcuggagcaggauuggcuuuuucacuuaugaaaucuuuagguggcggacguaggggaacaggagcucaaggagaaacguuaggugaaaaauggaagcgacaauuaaaccaacuaaguaagucagaguucaauacauacaaaagaagcggaaucauggaaguggauagaucagaagcaaaagaaggacuuaagcggggagaaacaacaaagcacgcagucucccgugguacagcuaaacuucgcugguuuguggagcggaaucuaguaaaaccugagggaaaaguuauugaccucggguguggacgugguggcuggagcuacuacugcgcagguuuaaagaaagucaccgaaguuaaaggauacacuaaagguggcccuggacaugaagaaccuauuccuauggcaacuuauggcuggaaucuaguaaaacuucauaguggaaaagaugucuucuucaugccacccgaaaaaugcgauacauuauugugugacaucggugaaucaagcccaaacccgaccaucgaagagggaaggaccuuacguguuuuaaaaaugguagaaccauggcuaagagguaaucaauuuugcauaaaaauuuuaaauccuuacaugcccucagucguggaaacauuagaacagaugcaaaggaaacacggaggaauguuaguaagaaacccauugagcaggaauaguacccaugaaauguauuggguuucauguggaacugggaauauaguuucagcgguaaauaugacaucuagaaugcuacuuaaccgguucaccauggcucaucguaaaccaacuuucgaaagagacguagauuuaggugcagguacucgacacguugccguagaaccggaaguagcuaacuuggacauaauaggucagagaauagaaaauauuaaaaaugaacauaagagcacauggcauuacgacgaagauaacccauauaaaacgugggcauaucacgguagcuacgagguaaaaccuucaggaucugcuuccucaaugguuaaugguguuguaagacuucugacaaaaccgugggaugucauuccgaugguuacgcaaauugcaaugacagacacgacaccuuuuggacaacaacgcgucuucaaagaaaaaguagacacucgaacaccgcgagcgaaacgggguaccacacagauaauggaaguaaccgcaaaauggcuaugggguuuucuuucaagaaauaagaaaccacgcauauguacaagggaagaauuuacaagaaaaguuaggaguaaugccgcuaucggugcaguauucgucgacgaaaaucaguggaacagugcaaaagaagcuguggaagacgaaagauuuugggaucuaguacauagggaaagagaacuucacaaacaaggaaagugugcuacaugcguguauaacaugaugggaaaacgggagaagaaauuaggggaauuugggaaagcaaaaggaucgagagcgaucugguauaugugguuaggagcccgauuccuagaguuugaagcacuaggauuuaugaaugaagaucacugguuuucaagagaaaauucauuaucagguguagaaggcgaaggucuacauaaacuugguuauauacuaagagauauaucuaaaauaccgggcggaaauauguaugccgaugacacagccggaugggauacucgcauaacugaagaugaucuacaaaacgaagcgaaaauaacagacaucauggagccugaacacgccuugcuagcuacuucaauuuuuaaacucacuuaccagaauaaagucguccgaguucagcgcccagccaaaaauggaaccguaauggacguuaucucccguagagaucagagagguucaggacaaguuggcacuuacggacuaaacacguuuacuaacauggaagugcagcuaauacgucaaauggagucugaaggcaucuuuuugccuucagaauuggaaacaccuaacuuagcugaaagagugcucgauuggcuugagaaacauggcgcagaacgccuuaaacgcauggcgauauccggagaugauugcguagugaaaccuauugaugauagguuugccacagcucucacugcucuaaacgauauggggaaaguccgcaaagauauaccucaaugggaaccaaguaaaggcuggaacgauuggcaacaaguuccauuuugcagccaucauuuucaucaacuaaucaugaaagaugggcgagaaauaguaguaccauguagaaaucaagaugagcuaguuggacgagcacgaguaucacagggggcaggguggucccugcgagaaacagcgugucuagguaagucguacgcucaaauguggcaauugauguacuuucauagaagggaucugcgauuagcggccaaugcgauaugcagugcaguuccuguagacuggguaccaacuucucgcacaaccuggagcauacacgcacaccaucaauggaugacgaccgaggauaugcuaagcgucuggaauaggguuuggauagaagagaacccauggauggaagacaaaacucauguaucaucuugggaagaaguucccuaucugggaaaacgagaagaucaaugguguggcucacuaauaggucuuacggcgagagcgacuugggccaccaauauccaaguggcgauaaaucaaguuagaagauugauuggaaaugaaaacuaccuggacuauaugacaucaaugaaaagauuuaaaaaugaaagcgauccagaaggggcccuuugguaa

SEQ ID NO: 21290 - RNA, 9879 nt, Artificial Sequence
  derived and/or modified CDS sequence (opt6) from DENV-1__KJ189344__SS-prME
ucaguaacaauguuguuaaugcuauuaccgacugcgcuagcuuuucaucuaacaacacgaggaggagaaccccauaugauaguaucgaaacaagaacgaggcaaaagccugcuauuuaaaaccagugccgguguuaacauguguaccuuaauugcuauggaccuaggugaacuaugcgaagauacaaugacauacaaaugcccccaaauuacagaagcugaaccugaugacguggauuguugguguaaugcaacagauacauggguaacguacgggacgugcucccaaaccggcgaacauagacgggacaagagaagcgucgcuuuagcaccucacgugggucuaggacuagaaacacgaacagagacuuggaugucaucggagggagcauggaagcaaauacaaaggguagaaacaugggcucuacgccauccaggauuuacuguaacugcacucuucuuagcgcaugcaaucggaacaaguauuacucaaaaagguaucauauuuauuuugcucauguuaguaacgccuagcauggcgaugcggugcguagggaucggaaacagagacuucgucgaagguuugucgggugcaacuuggguugacguuguacuugaacauggaagcuguguuacuacaauggccaaaaauaaaccgacguuagauauugaauuauuaaaaacagaaguuacaaauccagcaauauugcgaaaauuaugcauagaagcaaaaauuaguaauaccacgacugacagucguugcccuacacagggcgaggcaacccuaguugaagaacaagaugcaaacuuuguuugcagaagaacauuuguugauagaggauggggaaaugggugcggauuauucgguaaaggcucucuccucacaugcgcuaaauucaaaugcgucacaaaauuagagggcaaaauaguucaauaugaaaaucuaaaguauagcguaaucguuacuguacacacaggagaccagcaccaaguagguaaugaaacuacugaacauggaacgauagcuacuaucacuccucaggcacccacuucggagauucaauuaacagacuacggagcacuuacucucgauuguagcccaagaacaggauuagacuuuaaugagaugguauuacucacaaugaaagagaaaaguugguuaguacacaagcaaugguuuuuagacuugccccuucccuggacaucgggcgcuucaacuagccaagaaacuuggaauaggcaggauuuacugguaacauucaaaacagcccaugccaaaaagcaagaagugguaguuuuagguagccaagaaggugcaaugcacacagcacugacaggagcaacagaaauccagacuagcggaacuacaacuauauuugcuggccaccuaaaaugccgauugaaaauggauaaguugacauugaaggguacuagcuauguaaugugcacaggaaguuucaaauuagaaaaagaagucgcagaaacacaacauggaacuguccuaguacagguaaaguaugaagggacugaugcucccuguaaaaucccguucucuacacaagaugagaaggguguuacacaaaacggccgcuuaaucacugcaaacccaaucguaacagacaaagaaaagccagucaacauugaaacggaaccacccuuuggugaauccuauauuguuguaggagcuggagaaaaagcucuaaaacugucgugguucaagaaaggcagcucuauugguaaaauguuugaagcgaccgcaaggggcgcccgccggauggcaauacuaggugauaccgcaugggauuucggcagcauaggggguguauuuacaagcguugggaaauuagugcaucaaguauucgggacagcguauggaguuuuauuuucaggaguuucuuggacaaugaaaauaggcauagggauucugcucacauggcuggguuuaaacucaagaaguaccagucuaucaaugacauguauagccguagggaugguaacguuauaccucggaguaaugguacaggcagauuccggguguguagugaacuggaaaggaagagaguuaaagugugggucgggcaucuuugugacaaacgaaguacacacauggaccgaacaauacaaauuccaagcagacagcccaaaacgccuaagugccgcaauaggcaaagcgugggaggaaggaguaugcgggauacgaagugcaacuagacuagaaaauauuauguggaaacaaauaagcaacgaacugaaccauauacuacucgagaaugauaugaaauucaccgucguaguaggggaugcaaauggcauuuuagcucaagguaaaaagaugaucagaccgcaacccauggaacauaaguauucguggaaaucauggggaaaagcaaaaaucauaggagcagacauccaaaauacaacuuuuauuaucgacggaccugacacaccugaaugcccagauaaucagcgugcuuggaacauaugggaagucgaggacuaugguuucgguauauucacaacuaauauauggcuaaagcuccgggauucauacacccaaaugugcgaucaccgcuuaauguccgcagcuauaaaggauuccaaagcuguacaugccgauaugggauauuggauagaauccgagaaaaaugagacauggaaauuagcuagggcaucauuuauagagguaaagacauguacauggccgaaaucucacacacuuuggucaaaugggguauuagaaagugaaaugaucauucccaaaauauacggcgguccuauuagucagcacaauuaccgucccggauauuuuacucaaacagcggguccauggcauuuagggaaauuagaacuugauuuugacuuaugugaaggaacaacuguagugguagaugaacacuguggaaauagagggcccucucuucgcacaacaacuguaaccggaaaaauaauacaugaauggugcugccggaguugcacuuugccacccuuaagauuuaggggagaggaugguuguugguauggcauggagauaagaccaguuaaagagaaagaagaaaaucuggugcgauccaugguaucagcgggaagcggggagguagauucauuuucacucgggauacuuuguguuuccauaaugaucgaagaagucaugagguccagauggucaaggaagauguuaaugacaggaacauuagcugucuuuuuauuauuagucaugggccaauugaccuggaaugaucuuauacgacuguguaucaugguaggggccaaugccagugauaggaugggaauggguacaacauaccuagccuuaauggcaacguuuaaaaugcguccaauguuugccgugggcuuauuguuccgaagacuaaccucaagagaaguguuauuacucacaauuggacuaagucuagucgcaaguguagaacuucccaauagcuuagaagaacuaggagacggacuagcaauggguauaaugaugcuaaaauuauugacagaauuucagccgcaccaauuauggacuacauuacuaucucucacuuucauuaaaacaacccucucucuugacuacgcuuggaaaacaacagcuauggcuuuaaguauaguauccuuauucccucuauguuuaucuacuaccucccaaaagacaacuuggcugcccguccuucuaggaucauucggguguaaaccgcuaacaauguuucucaucaccgaaaacaaaauauggggaagaaaaaguuggcccuuaaaugaagguaucauggcaauagggaucgucucaauccucuuaucaagccuccucaaaaaugauguucccuuagcgggaccgcuuauagcuggagguaugcucauugccuguuacguaauaucagggucaucugccgaccuaucacuagaaaaagcagcugaggugucgugggaacaagaagcagagcacagugguacaagucacaauauccuaguagagguacaagacgaugguaccaugaagauuaaagacgaagaaagagacgauacgcuaaccauauuauuaaaagcuacacuacuggcaguaucaggaguuuauccgaugucaauaccagcaacacucuucguaugguacuuuuggcagaaaaagaaacaaaggaguggcguacuaugggauacaccuaguccacccgaaguggagagggcgguauuagaugaugguauauauagaauauuacagcguggauuacuaggaagaagucagguggguguaggcguauuucaggacgggguauuucauacuauguggcacguaacgagaggugcaguauuaauguaucaggguaaaagauuagagccaucuugggcuucugucaagaaagaucuaauuuccuauggugguggauggcgcuuucaggguucauggaacacuggugaggaaguucaagucauugccguagaacccgguaaaaauccgaaaaaugugcaaacaacaccuggaacauucaagacuccugaaggcgagguaggggcaauagcgcuggacuuuaagccaggaacaucaggaucgccuauaguaaaccgugagggcaagauaguggggcucuacggaaauggaguagucacaaccuccggcacguaugugagugcaauagcacaggcaaaagcaucccaggagggcccauuaccggaaauugaagacgaaguuuuuaagaaacgcaaccuaacuauuauggauuuacaucccggcagcgguaagaccagaagguacuugcccgcaauugucagagaggcaauuaagcgaaaacucagaacucucauccucgccccaacaaggguuguagcgagugaaauggcagaagcacuuaaggguaugccaauaagauaccaaaccacggccguaaaaagugaacacacuggaagagagauaguagaccuuaugugccacgcgacguuuacgaugagacuauuaaguccgguacgagugccaaauuacaauaugauuauaauggaugaggcacauuuuaccgauccagcgaguaucgccgccaggggauauauaucaacacgcguuggaaugggagaagcagcggcaauauucaugacugcgacaccaccuggaagcgucgaagcauuuccacagaguaaugccguaauucaagacgaagagagggauauaccggaacguucuuggaacucggguuaugauuggauaacagauuucccuggaaaaaccgugugguucguucccaguauaaaaucaggcaacgauauagcaaacugucuucgcaaaaauggaaaaagagucauucaauuaucaagaaagacuuucgauacugaauaucagaaaacgaaaaauaacgauugggauuauguagucacuacugacauaucagaaaugggcgcaaauuuucgcgcagacagagugauagacccucguagaugucucaaaccaguuauucugaaagaugguccggagagagucauucucgcagggccuaugccaguuacaguugcgucggccgcacaacgaagaggacgaauuggacggaaucaaaauaaggaaggggaucaauauguuuacaugggacagccucuuaauaacgaugaagaucaugcucauuggacagaagcuaagaugcuacuagacaauauuaacaccccugaagggaucaucccagcucuuuuugaaccagagcgggagaagucagcagcuauagauggagaauauagacucaggggugaagcaagaaaaacauucguagaacuaaugagaagaggagaucugccuguuugguugucguauaaaguagcgagcgaagguuuucaguacucugacaggcgcugguguuuugacggagaacgaaacaaucaaguauuggaagaaaacauggauguagaaauauggaccaaagagggagaaaggaagaaacugaggccucgcuggcuugaugcaaggacauacuccgauccacuugcucuacgcgaguuuaaggaauuugcggccgguagaagaagcguaagcggagauuuaauauuagaaauagguaaacuuccacaacacuugacacuuagagcacaaaacgcccuagacaaucuuguaauguuacauaauucagagcaaggaggaaaagcauaucgacaugccauggaggaacuaccggauaccauugaaaccuuaauguugcuugcucuaauugcuguucugacagguggcguaaccuuauucuuuuugucugguaaggggcuugggaagaccucaauuggucuuuuaugugugacagcaaguagugcucuacuauggauggcgucgguggaaccccauuggauagcagcuagcauuauacuagaguuuuucuuaaugguacuacuaauaccagaaccagaucgccaaagaaccccacaagauaaucaacuagccuacguaguuauuggucugcuuuuuaugauccucacaguggcagcaaacgagaugggauuacuugagacaacaaagaaagauuuagguauaggucauguagccgcagaaaaucaucaacaugcgacgaugcucgauguagaucuucgaccagcuagugccuggacuuuguaugccguagccacuacgguaauuacuccaaugaugcggcacacuauagaaaauaccacagcaaauauaaguuuaacugcuauagcuaaccaagcggcuauuuuaaugggucuagauaaaggcuggccuauaucuaagauggacauuggaguuccacuccuagcauuaggcuguuacucgcaagugaauccccuaacuuuaacggccgccguauugaugcucguagcacacuaugcgaucaucggcccaggauugcaagcuaaagcaacgagagaagcgcaaaaacgcacggcugccggaauaaugaaaaauccuacaguagacggcauaguagccauugaccuagacccaguaguuuaugaugcaaaauucgaaaagcaauuaggacaaauuaugcuacuuauccuguguaccucucaaauauuguuaaugagaacaacaugggcacucugcgaaucaaucacgcuagccacaggcccauuaacaacguuaugggaaggaucaccugguaaguucuggaacacgacuaucgccguaucaauggcaaauauauuccggggaucuuacuuagcaggagcagguuuagcauucucccucaugaaaagucucgguggagguagaagagguacuggcgcacaaggugagacauuaggugaaaaauggaaacgacaacuaaaccaguuaaguaagucagaguucaauacauauaaaagaucagggauaauggaaguugauaggagugaagcaaaagaaggccugaaacgaggggagacaacuaagcaugccguuaguaggggaaccgcuaaacugagaugguuuguagagcggaaucugguaaaaccagaagguaaaguaaucgauuuagggugugguagaggcgguuggucauacuacugugcaggucucaagaaagucacagaggucaaaggguauacuaaaggggguccaggccaugaagaaccuauaccuauggcaacuuaugguuggaaccuagucaaacuccauagcggaaaggacguauucuucaugccaccugaaaaaugugauacauuacuuugugacauaggagaaaguucuccaaacccgaccauagaggaaggacgaacauuacgaguauugaaaauggucgagccauggcuaagaggaaaccaguuuuguauuaaaaucuuaaacccauauaugccaaguguaguagaagcauuagaacaaaugcaaagaaaacauggaggaaugcuaguacgaaauccuuuaucucguaauagcacccacgagauguauugggugagcuguggcacaggaaauauuguaagcgccguaaauaugaccucacguaugcuacuaaauagauucacuauggcucauagaaaaccgacguacgaacgggacguugaucucggugcagguacaagacaugucgcuguggaaccagaaguugcaaauuuagauauaauuggacaacgaauagaaaacauaaagaaugaacauaaaucuacauggcacuacgacgaagauaaucccuacaaaacaugggcuuaccauggaucauacgaggugaaaccuaguggcagcgccucaaguauggugaaugggguagugagacuguuaacuaaaccuugggauguaaucccaauggugacacagauagcaaugacugacacgacgccauuuggucaacaaagaguauucaaggagaaaguagauacacgaacacccagagcaaaaagagguacaacgcagauaauggaagucaccgcaaagugguuaugggguuuucucagcagaaauaagaagccuaggaucugcaccagagaagaauuuacuaggaagguaagaucgaacgccgccauuggagcuguauuuguagaugagaaucaauggaacucagcgaaagaagcagucgaggacgaacguuuuugggacuuagugcaucgagaacgagagcuucauaaacaagguaagugugcaacaugcgucuauaauaugauggggaaaagagagaagaaacuuggagaguucggcaaggcuaagggaagccgugcaauuugguauauguggcuuggcgcacgauuucucgaguucgaggcuuuaggcuucaugaaugaagaccauugguuuucacgagaaaauucacucaguggagucgaaggugaaggacugcacaaacuaggauauaucuuaagggacauaucuaaaauaccaggcggaaauauguacgcugacgauacggcugguugggauaccagaauaacggaggaugaucuccagaaugaagcuaaaauaacggagauaauggaacccgaacaugcacuucucgccacaaguauauuuaaguuaacauaucaaaauaaaguagugcgcguccaacgaccagccaaaaauggcacugugauggacgugauaucccgccgggaccagagggguaguggccagguggguaccuaugguuugaauaccuucaccaacauggaaguucaacuuaucagacaaauggaaagcgaggggauauuccuaccgucugaauuagaaacgccaaacuuggcagagagaguauuagacugguuagagaagcacggcgcggaacgacugaaacguauggcuauuucaggugacgacuguguaguuaaaccaauugaugaccgcuucgcgacagccuugacagcguuaaaugauaugggaaaaguaagaaaagauauuccacaaugggaaccaucuaagggguggaacgacuggcaacaaguuccuuuuuguucgcaccauuuucaucaauuaaucaugaaagauggaagagaaaucgucguaccguguagaaaucaagaugaacucgugggacgagcgcguguuucgcaaggagccgguuggucacuacgggagacagcaugucuuggcaaauccuaugcucaaauguggcaacucauguauuuucacagaagggauuuaagacuagcagcaaacgcaauauguuccgcaguuccaguugauuggguaccaacuucucgaacaaccuggaguauacaugcacaucaucaauggaugacaacggaggacauguuauccguguggaauagaguuuggauagaagagaauccguggauggaggauaaaacacacgugucaagcugggaggaggucccauauuuagggaaaagagaggaucaauggugcggaagccuaaucggccugacugcgcgugcuacaugggccacgaacauccaaguagcgauaaaucaagugcgcagacuuaucggaaacgaaaacuauuuagacuacaugacgagcaugaagcguuuuaagaacgaaagcgauccugagggagccuuaugguaa

SEQ ID NO: 21291 - RNA, 9879 nt, Artificial Sequence
  derived and/or modified CDS sequence (opt6) from DENV-1__KJ189346__SS-prME
aguguaacuaugcuuuuaaugcucuuacccacagcucucgcauuccaucugacuacucgaggaggagaaccccacaugaucguauccaaacaagaaagaggaaaaucccuauuauucaaaacuucggcuggaguuaauauguguacacuuaucgccauggaucuaggagaacuaugugaagauaccaugacauacaaaugcccgcaaauuacagaagccgaaccggacgacguagauugcuggugcaaugcaacagacacaugggugacauacgguacauguucucagacaggugaacacaggagggauaaacgaucaguagcucuggcaccccauguaggacugggccuagaaacaagaacugaaacauggaugaguucugaaggggccuggaaacaaauucaaagaguugaaacuugggcuuuacgacacccggguuucacaguaauagcgcuauucuuggcacaugcaauagguacaucgauaacucaaaaaggcaucauauucauacuacuuaugcuugugacacccucaauggcgaugagauguguggguaucgggaacagagauuuuguagaaggacuuucuggggcaacaugggucgacguugucuuagaacauggaagcugugucaccacaauggcuaaaaauaaaccaacauuggacauagaauuacucaaaaccgaaguuacuaaucccgcaauucuacgaaaauuaugcauagaagcgaaaauuagcaauacuacaacggacucucguuguccaacgcaaggugaggcgaccuuaguugaagaacaagacgccaauuucgucuguaggagaacauucguggacagaggauggggaaacgguuguggccuuuuuggcaaaggaaguuuguugacuugugccaaauuuaaauguguaacaaaacuagaaggaaaaaucguucaauaugaaaaucucaaauauucaguuaucguuacagugcauacaggagaccagcaucagguaggcaacgaaacuacagaacauggaaccauagcgacaaucacgccacaagcuccaacaucggaaauacaauuaaccgauuauggcgcucucacuuuggacuguucgccaagaacuggauuagacuucaacgagaugguucuuuuaacuaugaaagaaaaaucauggcuugugcauaaacaaugguuuuuggauuuaccuuugccuuggacaagcggggccucgacaagucaggagacuuggaaccgacaagaccuauuaguaacauuuaaaacugcgcacgccaagaaacaagaaguggugguauuaggcucacaggaaggcgcaaugcauacugcuuuaacgggagcuacugagauccaaaugagcggaacuaccacaauauucgcgggccauuuaaaaugccgccuuaaaauggauaaauuaacacucaaagguacaaguuaugucaugugcacagggaguuuuaaacuagaaaaagagguugcagaaacacaacauggaacgguacuuguccaaguaaaauaugagggcacagaugcaccuuguaaaauuccauuuucaacucaagacgaaaaggggguuacacagaacggaagauuaauaacggcgaaccccaucguaacagauaaggaaaaaccugugaauauagaaacagaacccccuuucggagaaagcuacauaguagugggcgccggagaaaaagcucuuaaacucucaugguuuaagaaaggcucaaguauaggaaaaauguuugaagcaacagcuaggggugcccgucguauggccauccuuggcgauaccgcaugggacuuuggcaguauaggaggaguuuuuacgagcguuggcaaacugguccaucaaguauuuggaacggcguaugguguuuuguuuucuggagugaguuggacaaugaaaauagggauagguauacuauuaacgugguuagguuuaaacucucgcaguacuagcuugagcaugacuuguauugcaguaggaauggucacacuauaccucggaguuauggugcaggcugauucaggauguguaauuaacuggaaaggucgcgaauuaaaaugcggaucaggcauauuuguaacuaacgaagugcacacauggacugagcaguauaaauuucaggccgauucacccaaaaggcuuagugcagcaauaggaaaggcuugggaagaaggcguaugugguauucguagcgcuaccagauuagagaacauaauguggaaacaaauuucgaacgaacucaaccauauucuacuggaaaacgauaugaaauucacuguagugguaggagaugccaauggcauauuggcacaagguaagaagaugauacguccgcaaccuauggaacauaaguacucguggaagucuugggggaaggcaaagauaauaggggcggauauacaaaacacuaccuucauaauagauggaccagacacuccagagugcccugacaaucaacgagccuggaacauuugggaaguugaggauuaugguuucggcauauucacuacuaacauuuggcuaaaacucagagauucauacacgcaaaugugugaccacagauuaaugucugccgcaauuaaagacucgaaagcuguucacgcggauaugggauauuggauagaaagcgagaaaaacgaaacguggaagcuggcgcgcgcuucauuuauugaagugaaaacguguacauggccuaagagccacacauuauggaguaacgguguaauggagagcgagaugauuauuccgaagauuuauggagggccaauaucacaacacaauuacaggccgggguacuuuacacagacugcagguccuuggcacuuaggcaaguuagagcuggacuuugauuuaugcgaaggcacuacaguaguaguggacgaacacuguggaaauagagguccuaguuuaagaacuaccaccguaacuggaaaaauaauacacgaauggugcugccguaguuguaccuuaccaccauugcgauucaggggagaagauggguguugguaugguauggaaauccgaccaguaaaagaaaaggaagaaaaucuaguaaggucuaugguaagugcggguuccggagaaguagacaguuucucuuuagguauuuuaugugcauccaucaugauugaggaaguuaugcgcucgagauggucgcgaaaaaugcuaaugaccggaacacuugcgguauuccuccuauuagucaugggacaacuaacguggaacgaccucauaagauuguguaucauggugggagcaaaugcaagugaucgaaugggaaugggaacaacuuaucuugcacuaauggcaacuuucaaaaugagaccgauguuugccguaggccuccucuuucgaagauuaacaagucgugaaguccuacuguugacuauaggcuuaagucugguggcaucuguagaacuaccaaacucgcuggaagaacuuggugauggucuggcuaugggcauaaugauguugaaacugcucacggaguuucagccacaccaauuguggacgacauuauuaucacucaccuuuauuaagacuacuuugagccuugacuaugcuuggaaaaccaccgcgauggcauugaguauaguaucacucuuuccacuuugccuaucuacaacgagucagaaaacaacauggcuaccgguucuacuagggucuuuuggcugcaagccauugacuauguuucuaauuacggaaaauaaaaucuggggacgcaaaucauggccucucaacgaagguauaauggcuaucggcauugucuccauccuauuaagcucucuacuuaaaaaugacguaccucuagcagguccacuaauagcuggagggauguuaauugcauguuaugugauuucuggaagcucugcggaucugucccuugaaaaggcugcugaagucucaugggaacaagaagcagaacacuccgguacaucacauaauauucuggucgagguacaagaugauggaacuaugaaaauaaaagacgaggaaagagaugacacauuaacaaucuuacuuaaagccacgcuauuagccgucagcggaguuuacccaaugaguaucccagcaacacuauuuuuaugguauuucuggcagaagaagaaacaaaggucuggcguacuuugggauacuccuucaccaccagaaguagaaagggcaguguuggacgaugguauuuacaggauucuucagcggggacuucugggucgaucacaaguagguguaggaguuuuucaggacggaguguuccacacuauguggcacgugacaaggggagcaguauuaauguaucaaggaaagcguuuagagcccucaugggcuucaguuaaaaaggacuuaauaucauaugguggcggauggcgauuucaaggcaguuggaauacgggagaagaaguccaaguaauagccgucgagccuggcaaaaauccgaaaaacgugcaaacaaccccagggacauucaaaacucccgaaggugaaguaggagcaaucgcacuugauuuuaagccuggaacaucaggaagcccgauuguaaacagggagggcaaaauugucggacuauacggaaauggagucguuacaacaucgggcacguauguuagcgcuauugcccaagcaaaggcaagucaagaagggccgcugccagaaaucgaggacgaaguauucaagaaacguaauuuaacaauaauggauuuacacccaggaucgggaaagacuaggagguaccuaccagcuauaguacgugaagccauuaaacguaaacuuaggacuuugauucuagccccaacuagaguaguagcuagugaaauggcagaggcguugaaagggaugccaauuagauaccagacgacagcuguuaaaagcgagcauaccgggagagaaauaguagaucugaugugucaugcaacuuuuacaaugaggcuacuaucgccuguuagaguaccgaacuacaacaugauaauuauggaugaagcgcauuuuacagacccggcaucgauugcagcuagaggauacauaucuacuagaguaggaaugggagaggcggcggcgauauuuaugacagcuacaccacccggaaguguagaagccuucccacaaucaaacgcaguuauucaggacgaagaaagggacauaccagaacguaguuggaacucuggauacgauuggaucacagauuuuccgggaaagacgguuugguucguccccagcaucaagagugggaaugauauagcgaacuguuuacguaaaaauggcaaaagaguaauucaauuaaguaggaaaacuuuugacacugaauaucagaaaacgaagaauaaugacugggacuacguagugacaacagauauuucagaaaugggagcaaauuucagagcagaucgaguaaucgacccccgaagaugucugaaacccgucauacuaaaagaugggccggaaagagucauccuggcagggccuaugccaguaacaguagcuucagcagcccaacgccguggaagaaucggucguaaucaaaauaaagaaggugaccaguauguauacaugggacaacccuuaaauaacgacgaagaucacgcacacuggacugaagcaaaaauguuauuggacaauauuaacacuccagaaggaauuauuccggcauuauuugaaccggaacgugaaaaaucugcugcaaucgacggagaauaucgcuuaaggggagaggcccguaaaacauuuguagaacuuaugagacgaggagaucuuccaguauggcugucauauaagguugcuucagaaggcuuucaguauucggaucgccgaugguguuucgauggugaaagaaacaaucaaguucuugaggaaaauauggauguagagaucuggaccaaggagggagaaaggaagaaacuacgaccuagaugguuggacgcgcgcacuuauagcgauccucuggcuuuaagggaguucaaggaauuugccgcaggaagacgcagcguguccggagauuugauacuugaaauagguaaacugccacaacauuugacaaguagagcucaaaaugcgcuagauaauuuaguaauguuacacaauucagaacaagggggaaaagccuauagacaugccauggaagaacugccugauacgauagagacacuuauguuauuggcuuuaauagcggugcucacagguggaguaacguuguuuuucuuauccggaaaaggccuugguaaaacaucaauaggacugcuaugcguuacagcuucaucagcacuucuauggauggccaguguggagccacacuggauagcggcauccauuauacuugaauuuuucuugaugguccuuuuaauaccggaaccggacaggcaacguacaccacaagacaaucaacuugccuacgucguaauaggauuacuguuuaugauacuuacgguagccgcuaaugaaaugggacuacuugaaacaacuaagaaagaucuuggcaucgggcacguagcagcagagaaccaccaacaugccacaaugcucgauguagauuugcguccagcaucggcuuggacccuauaugccguagcuacaacaguuauuacuccuaugaugcgacauacuauugaaaauacuacagcgaauauuucacuaacggcuauugcuaaucaagcggcuauauuaaugggacuagauaaaggauggccaauuucgaagauggacauaggcguaccacuucucgcguuagguugcuauucucaagugaacccacucacauuaacagcugcugucuuaauguuaguagcccacuacgcgauaauaggacccggacuacaagccaaagcaacaagggaagcacaaaaacgaacagcagcaggaauaaugaaaaauccgaccguggacggcauuguugcuauagauuuagauccaguaguguaugacgcaaaguuugaaaagcagcugggacaaauuaugcuucuaauauuaugcacaagucaaauucugcuuaugagaacuaccugggcucucugugaaucgaucacacuagcaacaggaccucuaacgacucugugggaagguucgccugguaaguuuuggaauaccacgauugcagugagcauggcgaacaucuuccgagguuccuauuuagcuggugcgggccuggcuuuuucccuuaugaagaguuuaggaggaggcagaagaggaaccggcgcucaaggagaaacuuuaggggaaaaauggaaaagacaguuaaaucaauuauccaaaagugaguuuaacacauauaaacguucuggaauaauggaaguagaccggagcgaagcaaaagaagguuuaaaaagaggggaaacaacaaaacacgcaguaucaagaggcaccgcuaagcucaggugguucguggagaggaaccuaguaaaaccugagggcaaagucaucgacuuaggaugugggcgaggaggguggucauauuauugugcgggacucaagaaaguuacggaaguaaaaggguauacuaaagguggcccggggcacgaggagccgauacccauggcaacguauggauggaaucucgcaaaauuacauucuggaaaagauguguucuucaugccaccagagaagugugauacucuccucugugacauuggagagucaaguccaaacccaacuauagaagaagguagaacuuuacgaguauuaaaaaugguagagccauggcuaagaggaaaucaauuuuguauaaaaauucuaaauccauauaugccaaguguaguggaaacguuagaacaaaugcaacgaaaacacggggguaugcuaguacgaaacccucugucuaggaacaguacacacgaaauguauuggguuucuuguggaacaggaaauauagugagugccguaaauaugacgaguaggaugcuccugaauagauuuacuacagcacaucguaaaccuacauacgaaagggacguggauuugggagcuggcacaaggcacguugcuguggagccagaaguggcaaaucuagacaucaucggacaacguauagagaacaucaaaaacgaacauaaaaguacuuggcauuaugaugaggacaaucccuauaaaacaugggcuuaucacgguaguuacgaaguaaagccaucuggaagugcaucgaguaugguuaacggaguuguuagauuacucaccaagccaugggacguuauuccuaugguuacccaaauugcuaugacugacacuacuccauucggacaacagaggguuuuuaaagagaaagucgauacgcgaacccccagagccaagcgaggaacuacacagauuauggagguaaccgcuaaauggcuauggggcuuccuaucgcgcaacaagaaaccaagaauuugcacacgcgaagaguucacacguaaggucagaaguaaugcagcaauaggcgcaguauuuguugaugaaaaccaauggaauagcgccaaagaagcggucgaggaugaaagauucugggaccuaguacauagagaacgggagcuacacaaacaggguaaaugcgcaacuugcguuuauaauaugaugggaaaaagagagaagaaauuaggagaauuuggaaaagcaaaaggaaguagagcaauaugguacauguggcucggagcgcgcuuuuuagaguucgaagcguuaggguuuaugaaugaagaucauugguuuagccgagaaaauagccuuagugguguagaaggagaaggauuacacaaauuaggauacauauuaagagauauaucaaaaauacccggagggaauauguaugcggaugacacagcuggaugggacacucguauuaccgaggaugaccugcaaaaugaagccaaaauuacagaaauaauggaaccugaacacgcccuccuggcuacuuccauauuuaaguugacauaccaaaacaaaguaguucgaguacaacgaccggcgaaaaauggcacuguaauggacgucauuucacguagagaccaaagggggucgggacaaguaggaacguacgguuuaaacacguucacgaauauggaaguacaauuaauaagacaaauggagucugaagggauuuucuuaccaucagaacuggaaacgccuaauuuagccgaaagaguauuggacugguuagagaaacauggugcggaacgucuuaaacguauggcaaucucaggagaugacuguguuguaaaaccuauugacgauagguuugcuacugcguugacugcacuaaacgauaugggaaaaguacgaaaggauauacuacaaugggagccgagcaaaggauggaacgauuggcaacagguacccuucuguucacaucauuuucaucaauuaauaaugaaagaugguagagaaaucguagugcccugcaggaaucaagaugaauuaguugggagggcuagaguaucucaaggugccgguuggucacuaagggaaaccgcuugccuggguaaaucuuaugcccaaauguggcaacuuauguauuuccaccgaagagaucuaaggcuagcagcaaacgcaauauguucugcgguuccagucgacuggguuccgacaucacgaacaacauggucaauacacgcacaucaucaauggaugacaaccgaagauauguugucggucuggaauagaguauggauagaagaaaaucccuggauggaagauaagacucaugucucuaguugggaagaaguuccuuaucugggaaaacgugaggaucaauggugugguagccuaaucggacuuacagcuagagcuacgugggcaaccaauauacagguggcaaucaaucagguaaggcgacuuauuggaaacgaaaacuauuuagauuauaugacgucgaugaagagauucaaaaaugaaagugacccugaaggggcgcuuugguaa

SEQ ID NO: 21292 - RNA, 9879 nt, Artificial Sequence
  derived and/or modified CDS sequence (opt6) from DENV-1__KJ189347__SS-prME
uccgugacuaugcuacuaaugcuauugcccacagcacuugcuuuucaucucacuacucgcgguggagaaccucacaugauaguuucaaagcaagaaagggguaagucacugcuauuuaagacgucugcugguguaaacaugugcacucuaauugcgauggaccuaggagaacuaugcgaagauacuaugacauauaaauguccacaaauuacagaagcagaaccagaugacgucgauugcugguguaaugcaacagacacauggguaaccuaugguacaugcucucaaacaggugaacaucguagagacaaaagaucuguggcacucgcaccgcacguagggcuggggcuugaaacucguacggaaacguggaugucuucugaaggugcguggaaacaaauacaaagggucgaaacuugggcguuaagacauccagguuuuaccguaaucgcguuguuuuuagcccaugccauaggaacaagcauuacgcaaaaaggaauaauuuuuauacuccuuaugcucgucacaccuucaauggccaugcgguguguaggaauaggaaauagagauuuuguagaaggauugucaggggcuacuuggguggacgucguacuggaacaugguucgugugugacuacaauggccaaaaauaaaccaacauuagacaucgaacugcugaagaccgaaguaacuaauccugcuauauuacgcaaacuuugcauugaagccaaaauuaguaacaccacaacagauaguaggugccccacccaaggcgaagccaccuuaguagaagaacaggaugcgaauuuugugugccgaaggacauucguugauagaggcugggggaauggauguggccuauucggcaaggggucccuuuuaacuugcgcaaaauucaaauguguaaccaaauuagaagguaagauuguucaauacgaaaaccugaaauauaguguuauagucacgguccacacaggugaucagcaccaaguagguaaugaaacgacagaacacgguacgauugcaaccauaaccccacaggcuccaacuucagaaauacagcugacugauuacggagcccuuacacuggacugcagucccagaaccgggcuagauuucaaugaaauggugcuacuaacuaugaaagagaaaagcugguuagugcacaaacaaugguuuuuagaucuuccucugcccuggacaaguggagccucaaccucgcaggaaacauggaaccggcaagaucuguuaguaacauucaaaacagcgcacgccaagaaacaagaaguaguaguauuagggagccaagaaggggcuaugcauacagcauuaacaggagcgaccgaaauacaaaccucagguacaaccacgauauuugcaggucaucuaaaaugcagauuaaaaauggauaagcucacuuugaaaggaacgucguacgugauguguacaggcccauucaaauuagaaaaagaaguagccgaaacgcaacauggaacaguguuagugcaaguaaaauacgaaggaacagacgcuccuugcaaaauuccuuuucucacacaagaugaaaaagguguuacacaaaaugggagacuaauaaccgcaaauccaaucguaacagacaaagaaaaaccuguuaacauagaaacagaaccaccuuucggggaauccuauaucguaguuggugcuggugaaaaggcauuaaaauuaagcugguuuaaaaagggaucaucuauaggcaaaauguucgaagcaacggcuagaggcgcacggcgaauggcaauucuaggcgauacggcaugggauuucggcucaauaggcggugucuuuacaaguguuggaaagcuaguacaucagguauuuggaaccgcauacggugugcuauuuuccggcguuucauggacuaugaaaauagguauagggauauugcuaacaugguuaggauuaaacucaagaucgacaagucucucuaugaccuguauugcaguugguaugguaacacuauaucucggagucaugguacaggcagauucaggauguguaauuaauuggaaagguagggaauuaaaauguggcucaggaaucuucguaaccaaugaagugcauacguggacagaacaauauaaauuucaagcagacucaccuaaacgacuaagugcagcgauagguaaagcaugggaagaagguguaugcgguauccgaagcgcaacgagacuagagaacauuauguggaaacagauaucaaacgaacuaaaccauauacuccuagagaacgauaugaaguuuacuguuguuguuggagacgcuaacggaauacuagcacaaggcaagaaaaugauacguccacaaccaauggaacauaaauauaguuggaaaucauggggaaaagcuaaaauaauaggggcagauauacaaaauaccacguuuaucauagauggaccagacacacccgaauguccggauaaccaaagagcauggaacaucugggaaguagaagauuauggauucgggauuuuuaccacaaauauuugguugaaguugagggacaguuauacgcaaaugugugaucauagacuaaugagugcggccauaaaagacucaaaagccguacacgcagauaugggcuauuggauugaaagcgagaaaaaugaaacauggaaguuagcacgggcgagcuuuauugaggucaaaacuugcacauggccuaagucccauacauuaugguccaauggagugcuagaaucggaaaugauaauuccuaaaauauacggaggccccauaucgcaacacaauuacagaccuggcuauuucacucaaacagcaggacccuggcaccucggaaaauuagagcuagauuucgaucuaugcgaggguacaacgguagucguagaugaacacuguggaaauagagguccuagccuaagaacgacuaccguuacaggaaaaauaauucaugaaugguguugcaggucauguacuuuaccuccccuucgguuuaggggcgaagauggcugcugguacggcauggaaauaagaccagugaaagaaaaagaagagaauuugguaagaucaauggugagcgcuggaaguggggaaguggauucauucucccuaggcauauugugcgugaguauaaugaucgaggaagugaugaggucgcgcuggaguagaaaaauguuaaugaccgguacgcuagccguguucuuacugcuugugaugggacaacucacuuggaaugacuuaauucgacuauguauuaugguuggagcgaaugcaagcgaccgaauggggauggggacaacuuauuuggcccuaauggcaacuuucaaaaugcgcccuauguuugcaguuggccuauuguuuagacgcuuaaccucgagagaaguucuguugcugacaauuggguuaagccuaauggcgucaguugagcugccgaacucucuagaagaacuuggagauggguuggcgauggggauuaugaugcuaaaacuuuugacagaguuccaaccacaucaauuauggacaacgcuacuaucacucaccuucauaaaaaccacgcuuucacuagacuaugcauggaaaaccaccgcaauggcucucuccauagugucacuauuuccacuuugucuguccacgacaagucagaaaacuacuuggcuaccagucuuacuggguucauuuggauguaagccauugacaauguuuuuaauuacugaaaacaaaaucuggggaaggaaaucauggccguugaaugaagggaucauggcaaucggaauuguaucaauauuguuaucgucguuacuaaagaacgacguaccauuggcaggaccauuaaucgcgggcggaauguugauagcaugcuacgugauaaguggaaguucagcugaucuaagucuugaaaaagcagcagaagugagcugggaacaagaggcugaacauagcggcacuucccauaauauacuuguugaaguucaggacgauggaaccaugaaaauaaaagacgaagaacgggacgauacauuaacuauucuccuuaaagcaacuuuauuagcgguaucaggugucuauccaaugaguauuccagcaacuuuauucguaugguauuucuggcagaagaagaaacagagauccgggguacuuugggauacaccaagcccucccgaaguugagcgggcaguauuagacgauggaauauacagaaucuuacagagagguuugcuaggccgaagucagguagguguagggguuuuucaggaugguguguuccacacaauguggcacguuacacgaggagcaguacuaauguaucagggaaaaagauuggaaccaucaugggcuucaguuaagaaggauuugauuucguaugggggaggauggcgguuucagggcucauggaacacuggugaagagguacaagugauugcaguagaaccaggcaaaaauccuaagaauguucagaccacaccaggaaccuuuaaaacucccgaaggggaaguuggugcuaucgcacuggacuucaagccagguaccagugguucuccuauaguuaacagagaagguaagauaguaggacuauauggaaacgguguagugacaacgucaggaacuuacguaucggcgauagcacaggcuaaagcgucgcaagaggguccucuaccagaaauagaagacgaaguguuuaaaaagagaaaccuuacaauuauggaucuccacccagggucuggaaagacccgucgauaccuaccggcuauuguccgugaagccauaaaaagaaaacucaggacacucauuuuagcuccuacucgaguugucgcuagcgaaauggcagaagcacucaaagguaugccuauacgauaucagacaacggcuguuaaaucugaacauacaggcagagagauaguagaccuaaugugccaugccacuuuuacaaugcgcuugcugagcccagugagaguaccaaauuauaacaugauaauuauggaugaagcacauuuuacugacccagccucuauugccgcucgaggguacaucaguaccagaguagguaugggggaggcugcagcaaucuuuaugacggcgacgccaccaggaagcguagaggccuuuccucaaagcaaugcaguaauucaagaugaagaacgagauauacccgagagauccuggaacucuggguacgacuggauaacugauuucccugguaagaccgucugguucguaccgucaaucaaaucaggaaacgacauagcgaauugucugcgcaaaaacggaaaacgugucauccaauuguccaggaagacguucgacacugaauaucagaaaaccaaaaauaaugauugggacuacgucgugaccacugauauuucagagaugggcgccaauuuccgagcagaucgaguuauugacccacguaggugcuuaaaaccuguaauauuaaaggacggaccugaaagggugauacucgccggaccgaugccuguuacaguagcaagcgccgcccaaagaaggggcagaaucgggcgaaaucaaaacaaagaaggggaucaauacguauauauggggcaaccguugaauaacgaugaggaccaugcacauuggacugaagcaaagauguuacucgauaauauaaauacaccugaggggaucauuccugcccucuuugaaccagaaagggagaaaagugccgccauagacggggaauaccgacuuagaggagaagcaagaaaaacauucguagaacuuaugcguaggggagaucuaccuguauggcucucuuacaaagucgcaucggaaggauuccaguauucggaucgucguugguguuucgauggagagagaaauaaucaaguuuuagaggaaaauauggauguugaaauuuggacuaaggaaggagaaagaaagaaacuuagaccaagaugguuggacgcccgaaccuacuccgacccacucgcauugcgagaguucaaagaguucgcagcgggaagacggagugucaguggggauuuaauccuggaaauagguaaauuaccucaacauuugacgcuacgagcccagaaugcuuuagauaaucuuguuauguuacacaacuccgagcaagggggaaaggcguaucgucaugcaauggaggaguugccugacaccaucgaaacauuaaugcuacuagcgcugauagcuguauuaacuggcgggguaacuuuauucuuuuuaucgggaaagggacuagggaaaacauccaucggguuauuaugcguaacugcuagcuccgcgcuacuauggauggcaucaguagaaccccauuggauagcugcuaguauuauccuugaguucuuucuaaugguacuauuaauaccagaaccagaccgucaaagaacaccgcaagauaaucagcuagcauaugugguuaucgguuuauuauuuaugauacuaaccguggcagcaaacgaaauggguuuacucgagacaacuaagaaagaucuaggaauuggacacguagcggccgagaaucaucaacaugcaaccauguuagauguugacuuaagaccagcuuccgccuggaccuuauacgcaguagcgacaaccguaaucacgccaaugaugcgucauaccauagaaaauacuacggcaaauaucucuuugacagccaucgcuaaccaagcagcuauccuaaugggacucgauaaaggauggcccauaucaaaaauggauaucggagugccacuucuugcacuaggaugcuauucucaaguaaaucccuugacacucacggcagccguacuuaugcuuguggcgcacuaugcaauaauagggccuggauuacaagcaaaagcgacgagagaggcacagaaaagaacagcagcaggcauaaugaaaaacccaacaguagacgggauaguagcuauagaccuugaucccguagucuaugaugccaaauucgaaaaacaacugggacagaucauguugcuaauacuauguacaucacaaauauuauuaaugagaacaacuugggcucugugugaaucaauuacccuagcuaccgggccgcuaacaacucucugggaaggaaguccagguaaguuuuggaacacuacaauagcagugucuauggcaaauauauuuagagguucauaucuggcgggagccggccuagccuuuucauuaaugaaaagccuggguggcggaagaagagguacaggugcacaaggagaaacauugggugagaaauggaaaaggcaacuaaaucaacuaucaaaauccgaguucaauaccuauaaacguagcggaaucauggagguugaucgauccgaggcaaaagaaggguuaaaaagaggugaaacaacaaaacaugcgguaucaagaggaaccgcuaaacuuagaugguucguggagagaaaucuaguaaaaccugaagguaaaguuaucgaucuugguugcggaagagguggcuggucuuacuacugcgcaggauuaaagaaaguaaccgaaguaaaaggauauacaaaaggcggccccggacaugaagaaccaauaccaauggcaaccuaugguuggaauuuaguaaaauuacauucaggcaaagauguuuucuuuaugccuccugagaaaugugauacacucuugugugacauaggcgaaagcagucccaauccaacuaucgaagaaggaaggaccuuaaggguauuaaaaaugguugaaccguggcuacgugguaaccaauucugcauuaaaauccugaauccauauaugccaucagugguagaaacgcuagagcagaugcaaagaaagcauggagggauguuaguuagaaacccucuuucucgaaauucaacacacgagauguacugggucucauguggcaccggaaauaucguaucggcuguaaauaugacgucacguaugcuauuaaauagauuuacaauggcacacagaaaaccaacauaugaaagagacgucgaccuuggugccgguacucgucaugucgcgguugaaccagaagucgcgaaucuagacaucauaggacaaaggauugaaaauauaaagaaugaacauaagaguacuuggcauuaugaugaagacaauccuuauaaaaccugggccuaucaugguucuuacgaaguucgaccaagugguagcgcgagcaguaugguuaacggcguaguucgucuucuaaccaaaccuugggacgugauaccgaugguaacgcaaauagcuaugacagacaccaccccauuuggacaacagagagucuucaaagaaaaagucgauacuagaacaccacgagcaaaacguggaacaacacaaaucauggagguaacugcaaaguggcuauggggauuucuuucaagaaauaagaaaccaagaauuugcacaagagaggaguucacacgcaaaguaagauccaaugcagccauaggagcgguguuuguagacgaaaaucaauggaacucugcuaaagaagcagucgaggaugagcgauuuugggacuuaguucacagagaacgggaacuacacaagcaagguagaugcgcuaccugcguauauaauaugaugggaaaaagagagaagaaauuaggcgaauuugggaaagcuaaggguucacgugcaauaugguacauguggcuuggggcaagauuccuagaguucgaagcucucggauucaugaacgaggaucacugguuuagccgugaaaacagcuugagcgguguggaaggugaaggauuacauaaacuuggguacauccugagagauaucucaaaaaucccuggaggcaauauguacgcagacgauacagcaggcugggacacuaggauuacggaagaugauuugcaaaacgaagcgaaaauuacggaaauuauggagccugaacaugcauuacuugcuacgagcauauucaaacugaccuaucaaaacaaaguaguuagaguacaaagaccagccaaaaauggaacaguaauggacguuaucaguagaagggaccagagagggucaggacagguagguacauauggacuuaauacguuuacgaauauggaaguacaauuaauaagacagauggaguccgaggggauauucuuaccaagugaacuggaaacccccaacuuagcagaaagaguguuagauugguuagaaaaacauggagcugaacgguuaaagagaauggcuauaucgggcgaugauugugugguaaaaccuaucgacgauagauucgcuaccgccuuaacggcgcuaaacgacaugggaaaaguacguaaagauauaccgcagugggagccgucaaaaggauggaaugauuggcaacaaguucccuuuugcucacaccauuuucaucaacuaaucaugaaggacggaagagaaauaguaguaccaugccgcaaccaagacgagcuaguaggccgugcaaggguuucgcagggcgcaggguggucuuuaagggaaacagcguguuuggggaagucauacgcacaaauguggcaauuaauguacuuccauagaagggacuugagguuagcagccaacgcaauaugcucugccguuccaguugauuggguuccuacuuccagaacgacuuggucaauucaugcacaucaucaauggaugacaacugaggauaugcuaagcguuuggaaccgugucuggauagaagaaaauccauggauggaagacaaaacacaugucucaagcugggaagaaguuccauaccuaggaaaaagagaagaccaauggugcggcucauuaauuggauugaccgcccgagccacaugggcgacuaauauacaagucgccauaaaucaaguaaggagauuaauagguaaugagaacuauuuggauuacaugacgaguaugaagagauucaaaaacgaaagcgauccugaaggggcguuaugguag

SEQ ID NO: 21293 - RNA, 9879 nt, Artificial Sequence
  derived and/or modified CDS sequence (opt6) from DENV-1__KJ189348__SS-prME
agcguuacaaugcuuuuaauguuauuacccacagcauuggcauuucaccucacaacacgaggaggagaaccucauaugaucguuucgaaacacgaaagagggaaauccuuguuauuuaaaacaucugcugguguuaauaugugcacacucauugcgauggauuuaggggaguuaugugaggacacaaugaccuauaaaugcccucgcauaacagaagcagaaccugaugacguagauuguugguguaaugcaacagacacaugggugacauacgguacuugcagucaaacgggggaacacagaagagacaaacgauccguggcgcuggcgccacauguaggacuagggcuugaaaccagaaccgagacguggaugaguucagaaggcgcauggaagcaaauacaaagaguggaaacuugggcacuucgacaccccggauucacuguaauagcauuauuccuagcucaugcaaucggaacaagcauaacacaaaaaggcauuauuuuuaucuuauugauguuagugacuccaucaauggcaaugagaugugugggaaucggaaauagagauuuuguagaaggguuaaguggcgcaaccuggguggacguaguauuagagcauggaucguguguaacaacaauggccaaaaauaaaccuacucuagauaucgaacuauuaaaaacagaagucaccaacccugcaguauuacguaaacucugcauagaagcaaaaauuagcaacacuacuacugauaguagauguccaacccaaggagaggcuacucucguagaagaacaagacgcuaacuuuguaugccgacggacauuugucgaccggggaugggguaauggaugcggcuuauucgguaaagguucacuacuaacaugugccaaauuuaaauguguaacuaaacuggaaggcaaaauuguccaauacgagaaccuaaaauauucaguuauuguaaccguacauacaggagaucaacaccaaguaggcaaugaaacuacagagcacgguacaauugcuacuauaacaccacaagcccccacaucagagauccaauuaaccgacuauggagcauuaacacuugacuguagcccaaggacuggacuagacuucaaugaaaugguccuacuaacaaugaaagagaaaucgugguuagugcacaagcaaugguuuuuagacuuaccuuugccauggacaucgggagcuucgacgucgcaagaaacauggaaccgacaggacuuauuaguaacguuuaagacagcacaugccaagaaacaggaaguaguugugcuaggaucacaagaaggcgcaaugcacaccgcccuaacaggagcgacugaaauccaaaccaguggaacaacuaccauauuugcaggucaccugaaaugcagacucaaaauggauaaacucaccuuaaaagguaccaguuauguaauguguacgggaucuuucaaauuagagaaagagguagcagaaacgcaacaugguaccguauugguacagguaaaauaugaagguacagacgcuccauguaaaauuccauuuucgacucaagacgaaaaaggagugacucaaaaugguagacuaauaacagcaaacccaaucguaacagauaaagaaaaaccuguaaauauagaaacggaaccacccuucggggagagcuacaucgucgucggagcaggggagaaggcccuaaaauugaguugguuuaaaaagggaaguucuauaggaaagauguuugaagcgacugcacgaggggcuaggagaauggcuauauuaggagacacagccugggauuucgguucaaucggaggaguauuuacaucaguaggcaaauuaguccaccagguuuuuggaacagcauauggcguuuuguucucagguguaaguuggacgaugaagauugguauuggaauuuuacucaccugguuaggacuaaacucaagaaguacuagcuuuucaaugaccugcauagcaguuggaaugguaacccuuuacuuaggcguuauggugcaagcggacagugguuguguaauaaacuggaaggguagggaacuaaagugcggauccgggaucuuuguaacaaaugaaguacauacguggacagaacaauacaaguuucaagccgacaguccaaaacgacugucagcagcaauugggaaggcuugggaggaaggcgugugugggauuaggagugcaacucgccucgaaaauauaauguggaaacagaucucuaacgaacuuaaucauauucuucuugaaaacgacaugaaauucacaguuguagucggagaugcuaaugguauccuggcucaaggcaagaaaaugauaagaccacagcccauggaacacaaauauuccuggaagucuugggggaaagcaaagauuauuggcgcagauauucaaaauacuacauuuauaaucgacggacccgauacaccagaauguccagaugaucaacgagcauggaauauuugggaaguugaagauuacggauucggaauauuuacuacaaauauuuggcuuaagcugcgagacucauacacgcagaugugugaucaucguuugaugucagcggccauuaaagauuccaaagcuguacacgcugauaugggauauuggauagaauccgagaaaaaugagacguggaaacuagccagggcgucguucauagagguuaaaacguguaccuggccuaaaagucauacacuauggagcaauggcguauuagaaucggaaaugaucauaccaaaaaucuacggugguccuaucucacagcauaauuaucguccaggauauuucacacaaacagcgggaccuuggcauuuagggaaauuggaauuagauuucgaucucugcgaaggaaccacagucguaguagaugaacauugcggaaauagagggccgucccuucgaaccacaacgguuacuggaaaaauaauccaugaauggugcugcaggaguugcacccugccaccauugcgauucagaggcgaagauggaugcugguaugguauggaaauucguccuguaaaagaaaaagaagaaaaccucguacgaaguauggucucagcaggaagcggugaaguagauucauuuucauuaggaauacuauguguuucaauaaugauugaggaaguuaugcguucccgcuggagucgcaaaauguuaaugaccgguacacuagcaguauuuuuguuguuaauaaugggacaacuaaccuggaaugauuugauacgauuauguaucaugguuggcgccaaugccucggaucguaugggaauggggacaacauaucuagcucuaauggccacauuuaaaaugaggccaauguuugcuguaggcaucuuguuucgccguuuaacgucuagagagguccuguuauugacaauaggauuaucgcugguugccucgguagaauuaccuaacucgcucgaggaacuaggagauggguuagcuaugggcauuaugaugcuaaaacuacuuacggaguuucaaccucaccaguuguggaccacauuacuaucauuaacauucauaaaaaccacacugucucuagauuacgccuggaaaacgacugcaauggcauugucuauagucucgcuguuuccuuuaugccuuucaaccacaucacagaaaacuacuuggcugccgguauuacuagguucauucgguugcaaaccuuugacuauguuuuuaaucacugaaaauaaaauauggggacgaaagagcuggcccauaaacgagggaauaauggcgauuggcauaguauccauauuacugagcagucugcuuaaaaaugauguuccacuagccggaccacuaauugccgguggaauguuaaucgcauguuauguaauaucuggaucuucagcagauuuaagucucgaaaaagcugcggaaguguccugggaacaagaggcagaacauagcgguacaucacacaauauccuuguugaaguacaagaugauggaacuaugcguauuaaagacgaagagaaagacgacacacugaccauccuucugaaagcuacacuccuggcaguaucagggguauaucccauguccauuccggcuacucucuuuguaugguauuuuuggcagaaaaagaaacaacgaucgggaguucugugggacacuccaagcccaccugagguagaaagggcaguacuugaugaugguauauauagaauauugcagcggggacuuuuggggcguagucagguuggcguagggguauuucaagauggagucuuucauacuauguggcacguaacucgaggagccguauuaauguaucaaggaaaacguuuagaaccgucaugggcgucggucaagaaagaccuaauaucguauggaggcggauggagauuccaaggaaguuggaacaccggugaagaaguacaagucauagcaguagagccaggaaagaaccccaaaaauguucagacaacaccgggcacauucaagacaccggaaggugaaguaggggccauugccuuagauuuuaaaccagggaccagcggaaguccaauugugaauagagaggggaagaucguuggauuguaugguaacggagucgucacaaccagcggcaccuauguaucagcaauugcacaggcgaaggcaucccaagaaggaccccuaccagaaaucgaagacgaggucuucaagaaacgcaaccuuacaaucauggaucuccauccgggaagugguaaaacuagacguuaccuaccagcaauuguucgagaagcgauaaagcgcaaacugcgcacucuuauuuuagcgccaacuaggguaguggcgagcgaaauggcagaagcccuaaaagguaugccuauaagauaucagaccacugcgguuaaaagugaacacacaggaagagaaauuguagaccuuaugugccaugcaacuuucacgaugcgguugcuuaguccagugagaguuccgaauuacaauaugaucauaauggaugaagcucacuuuacggacccggcaucaauagcagcacgaggguacaucucaacucguguugggaugggagaagcagcugcuauauucaugacugcaacaccaccuggaucgguugaagccuuuccccaaucaaaugcugucauacaggacgaagaaagggauauuccagaacgaucauggaacucugguuaugauuggauaaccgauuuuccggggaagacaguaugguucguaccauccauuaaaucuggcaacgacauugcaaauugucuacgcaaaaacgguaaaagagucauacagcuaaguagaaaaacguuugauacagaguaccagaaaaccaaaaauaacgauugggauuauguugucacgaccgacaucucagaaaugggagcgaacuuucgugcagauaggguuauagauccccgacgaugucuaaaaccaguuauauugaaagacggacccgaacgagucauucuagcugggccaaugcccguaacaguggcuucagcugcacaaaggagaggacgcaucggccgaaaucaaaauaaggagggagaucaguauguauauaugggacaacccuugaauaaugaugaggaucaugcacauuggacagaagcaaaaauguuauuagauaauaucaacacgccagaaggaauuauaccagcguuguuugagccggaacgagaaaaauccgcagcaauagauggagaauacagauuacggggcgaagcgcguaagacguucguagagcucaugcgucguggcgaucuacccguauggcuaucguauaaaguagcuucagaaggguuucaauacucggaucggagguggugcuuugacggggaacgaaauaaucaaguucuugaagaaaacauggacguagaaauuuggacuaaagagggugaaaggaagaaacuucguccacguuggcuagacgcacggacauacagugauccgcucgcauugagggaauuuaaggaguuugcagccgggcgacgcucagucucaggggaccuuauacuggaaauugguaaacucccucaacaucuaacccugagagcucagaaugcauuagauaaccuggugaugcuccauaacucagaacaaggcggaaaagccuacagacaugcgauggaagaguugcccgacacaauugaaacgcuuaugcuacuugcauuaauagcaguuuuaaccggaggugugacccuauucuucuugucaggcaaaggccuagggaaaaccucaauaggucuacuaugugucaccgcaagcucggcccuucuguggauggcaaguguagaaccacauuggauugcagcgucaauaauccuagaguucuucuugaugguacuacuaaucccggaacccgauagacagcguacuccacaagauaaccaacuagcauaugucgugauuggacuccuuuuuaugauuuuaacgguugcagcaaacgaaaugggauugcuagaaacaacaaaacgugaucuaggaauuggccacguugcggcggagaaucaucagcacgcgacaauguuagacguagaccuucggccagcuucggccuggaccuuauaugcugucgccaccacaguaaucacccccaugaugcgacauacuauagagaauacaacggcuaacauuagucuuacugcaaucgccaaucaggcggcaauccucauggguuuagauaagggguggccaauuaguaagauggauauaggugugccacuucuggcgcuaggcuguuauagucagguaaacccucuuacauuaacagcagcuguccucaugcuuguugcucacuacgcaauaauaggcccaggucuacaggccaaagcaacgagagaagcucaaaagcggacugcugcggguauaaugaaaaaucccacaguugacggcauaguagcuauagauuuagauccggugguguacgacgcaaaauuugaaaaacaacugggacaaauaaugcuacuaauacuauguacaagccagauucuuuuaaugagaaccacuugggcucuuugugaaucgauuacgcucgcaacuggaccucuaacaacucugugggaaggcucaccuggaaaguuuuggaacacaaccauugcaguauccauggcuaauauuuucaggggcaguuauuuggccggugcaggauuagcauuuucacugaugaaaucccuaggaggcggaagaagaggaacaggcgcucaaggugagacucuaggagaaaaguggaaaagacaauuaaaccaguuaagcaaacccgaguucaauacguacaaaagaaguggcaucauggaaguugacagaagcgaggcuaaagaaggucuaaaaagaggagagacuacgaaacaugcaguuuccaggggcacugccaaauuacgcugguuuguugaaagaaaccuuguuaagccagaagggaaaguaauagaucuuggauguggacgcggaggauggucauauuauugugcaggacugaagaaaguaacggagguuaaggguuacacgaaaggaggaccaggccacgaagaaccuauaccuauggcaacuuauggauggaauuuaguuaaacugcauucaggcaaagacguauuuuucaugccgcccgaaaaaugugauacucuuuugugugauaucggagaaaguagccccaacccaaccauagaagagggacgaacauugcguguacuaaagaugguugaaccaugguuaagagguaaucaguuuuguaucaaaauucucaauccuuacaugccaucaguaguagaaacauuagaacagaugcaaagaaagcacggagguaugcuaguaagaaauccucuaucaaggaacucaacucacgaaauguauugggucucaugugguacggggaacauagucucggcaguaaacaugacaucucgaauguuacuuaaucgcuuuacuauggcacaccgcaaaccaacauaugaacgagacguugauuuaggagcugguacucgacacguugcuguagagccagaaguagcaaauuuagauauuaucggacaaagaauugaaaauaucaaaaaugagcauaagaguaccuggcauuacgaugaagauaacccauauaaaacaugggcauaucacggauccuacgaaguaaaaccaagcgggucagcauccuccaugguuaauggagugguucggcuuuugacaaaaccgugggauguaaucccuauggugacucaaauagcaaugacggauacgacuccguucggacaacagagaguuuuuaaggagaaaguugacacaagaacgccaagggcgaaaagaggaacgacacaaauuauggaagucacagccaaguggcuaugggguuucuugucacguaacaagaaaccuagaauauguacgagagaagaauuuacaagaaaagugagauccaacgcagcuauuggagcuguauucguagacgaaaaucaauggaauagcgcgaaagaagcuguugaagacgagagguuuugggaccucguacaucgagaaagggaacuacauaaacaggguaaaugugcuacuuguguuuauaauaugaugggcaaacgagagaagaaacuaggugaauuuggaaaggcuaaaggaucaagggcaaucugguacaugugguugggagcccgauuccuggaauuugaagcacucgguuuuaugaacgaagaucacugguucuccagagaaaauucacuuucaggaguugagggcgaaggccugcauaaguuaggcuauauccuacgcgacauauccaaaauacccggaggaaauauguaugcugacgacaccgcaggaugggauacuaggauuaccgaagacgacuuacaaaaugaagcuaaaauaacugauauuauggaaccagaacaugcccuacuugcaacgucuauauuuaaacuuacguaucaaaacaaaguuguacguguacaacgaccagcuaaaaaugggaccgucauggacguaauaagucggagggaccagagagguucaggucaaguagggacauaugguuugaauacauuuacgaauauggaaguucaacuaauuaggcaaauggaaagcgaggguauuuuucuaccaagugaguuggaaaccccaaaccuagccgaacgaguauugaauuggcuagagaaacauggagcugaaagguuaaagcgaauggcuaucucaggagacgacugugugguaaagccaaucgacgacagauuugcgacugcgcuaacagcucuuaacgauaugggaaaagugcggaaggacauuccgcagugggaaccaagcaaagguuggaaugacuggcaacagguuccguucugcagucaucauuuccaccaacuaauaaugaaggauggccgagaaauagugguuccgugucgaaaccaggacgaacuugucggacgggcaagaguaagccaaggagcugguuggagcuuacgagaaacagcuuguuuagguaaauccuaugcccaaauguggcaauuaauguacuuucacagacgcgaucuaagguuagcggccaacgcgaucuguagugccguaccaguagauugggucccaacuucccgaacgacguggaguauacaugcucaccaucaauggaugacuacagaggauaugcugagcgucuggaacagagucuggauagaggaaaauccauggauggaagacaaaacucacguaucaucaugggaagaggugccuuaucugggaaaacgugaagaucaauggugcggcucauuaaucggauugacagcacgggcgaccugggcuaccaauauacagguugcuauaaaucaaguacgacgucuaauaggaaaugagaauuaucuggauuauaugacaucuaugaagcgauuuaaaaaugaaucagacccugagggcgcguuaugguaa

SEQ ID NO: 21294 - RNA, 9879 nt, Artificial Sequence
  derived and/or modified CDS sequence (opt6) from DENV-1__KJ189368__SS-prME
ucaguaacuaugcuacuaauguuauuaccaaccgcauuagcauuucacuuaacuaccagggguggugaaccacauaugaucguuaguaaacaagagaggggaaaaucucugcuuuuuaaaaccucugcaggcgugaauaugugcacucucauagccauggaccugggggaauuaugugaagauacuaugacuuauaaaugcccucaaauuacagaagcagagccggacgacguggacuguugguguaaugcaacggacacuuggguuacauacggaacguguucacaaaauggugaacaucguagggauaaaagaagcgucgcuuuggcgccucauguaggcuuaggucuggaaacacgaacagaaacauggaugucaucugaaggcgcauggaaacaaauucagagaguugaaacgugggcuuuaagacauccagguuuuacagucaucgcccuuuuucuagcacaugccauuggcacgucgauuacccaaaaaggaaucauauuuauauuguugaugcuggugaccccuucaauggcuaugcgaugcguaggaauuggaaaucgagauuuuguugaagguuuaucuggagcaaccuggguugaugucguacuagaacacggaucauguguaacuacgauggcuaaaaauaaaccaacuuuggauauugaacuguuaaaaacugaggugacaaauccagcaauacuccguaaauugugcauugaagccaaaaucuccaauacaaccacagauucucgaugcccaacacaaggagaagcuacauuaguugaagaacaagaugcgaauuucguauguaggaggacguucguggauagggggugggguaacgguugcggucuauucggcaaagggagcuuauuaaccugugccaaauuuaaauguguuacaaaauuagaggggaaaaucguacaauaugaaaaucuuaaauauucagugauagucacaguacauacuggcgaucaacaucaaguaggcaaugaaacaacggagcacgggacaauugcuaccauaacgccgcaagcgccaacaagugaaauacaacugaccgauuauggggcacuaaccuuagauugcaguccaagaacuggucuugacuucaaugaaaugguauuacuuaccaugaaagagaaaucaugguuaguacacaaacaaugguuuuuagaucuuccauuaccguggacaagcggagcgucaacuucgcaagaaaccuggaauagacaagacuuacuuguuacauuuaaaaccgcacacgcaaagaaacaagaaguuguuguacucggaucacaagaaggugcuaugcauacugcgcugacgggcgcgaccgagauacagacauccggaacuacaacgaucuucgcaggucaucuaaaaugucgacugaaaauggacaaacucacauugaaaggcacauccuacguuauguguacuggaccuuuuaaacuggaaaaagaagucgcggaaacgcagcauggaacagugcuaguacaaguuaaauacgagggcacugaugcaccaugcaaaaucccauucagcacacaagacgaaaaaggaguuacacagaauggacgacuaauaacggcuaacccaauaguaaccgacaaagaaaaaccggugaauauugaaacagaaccacccuucggcgagucuuauauaguugugggagcuggcgaaaaggcuuuaaaacuaucaugguuuaaaaagggcuccuccauaggaaagauguuugaggccacugcaaggggugcucggaggauggcgauacucggagacacagcuugggauuucgguucuauaggcgguguguuuacgagcguuggcaaguuaguacaucaaguguucggcacggcauaugguguucuguuuagugguguuaguuggacuaugaaaauuggaauaggcauacuucuuaccugguuaggacugaacaguagauccaccagucuaucaaugacuugcauagcuguuggaaugguaacauuauacuugggugucaugguucaagcagauucaggaugcguaaucaauuggaaaggaagagagcugaaaugcgggagcgguaucuuuguaacuaaugaaguacacacguggacagaacaauauaaauuccaagcagacucaccaaaacgacuaucugcagcaauaggaaaggcuugggaagagggcgucugcgggauuagaagugcaacuagauuagaaaauauaauguggaaacaaauaucaaacgaauugaaucacauauugcuagaaaaugacaugaaauuuacuguggucguuggggaugcaaaugggauuuuggcacaagggaagaaaaugauacgaccacagccaauggagcacaaguauucauggaaaucguggggcaaagcaaaaaucaucggggcugauauacaaaacaccacauuuauaaucgacggaccggauaccccugaaugcccugauaaccaacgagcuuggaacaucugggaagucgaggauuacgguuucggaaucuuuaccacuaauaucuggcuuaaauuacgcgauaguuacacacagaugugugaucaucgucuaaugucagcugcaauaaaagacagcaaagcggugcaugcagauauggguuacuggaucgaauccgaaaagaaugagacguggaaguuagcaagagccucauucauagaaguuaaaaccugcaccuggcccaaaagucauacguuguggagcaauggcgucuuagaaucugaaaugauuauaccaaaaauuuauggggguccaaucucacaacauaauuauaggccagguuacuucacccaaacugcgggacccuggcauuuaggaaaacucgaauuagacuuugaccucugugaaggaacuaccgugguuguagaugaacacugcgggaauaggggucccagcuuacguaccacuacgguaacuggaaaaauaauucacgaaugguguugucgaaguugcacauuaccaccacuaagauuucguggagaagacggauguugguauggaauggaaauuagaccaguaaaagaaaaggaagagaaucuaguuaggaguaugguuagcgcggguaguggagaaguagacagcuuuaguuuaggaauuuuauguguaucuaucaugauugaagaagugaugcggucgagauggagucguaaaaugcuaaugacuggcacauuagcaguauuuuuauuauuaguaaugggacagcuaacauggaaugacuugaucagacuuugcauaaugguuggagcgaacgccagcgauaggaugggaaugggaacaaccuaucuagcgcuaauggcgacuuucaaaaugaggcccauguucgcgguaggauuauuguuucgacguuuaacaucuagagaagugcuauuacugacaauuggguugagcuuaguagcaagugucgaauugccaaacaguuuggaagaacuaggagacgguuuggccauggguaucaugauguuaaaacuacucaccgaguuccaaccccaccagcuuuggacuacgcuuuuaucacuaacuuuuauaaaaacuacauuaucgcuugauuaugcauggaaaacgaccgcaauggcucuuucaaucgucagcuuauucccauuaugcuugucgacaacaagucagaaaacgaccugguugccuguacugcucgggagcuucggcuguaagccucuaacgauguuuuugaucacggagaacaaaaucuggggaagaaaaucauggccuuuaaacgaagguauaauggcaauaggaauagucuccauacuuuuauccagucuacuaaagaacgauguaccgcuagcggggcccuuaaucgcagggggaaugcuaauagcuugcuacguaaucagugguucaucagcugacuuaucacuugaaaaagcagcagaaguuucuugggagcaagaagcagaacauuccgguacaucacauaacauucuaguugagguccaggaugacggaacuaugaaaauaaaagacgaagagagggaugacacgcugacaauacuguugaaagcaacuuuacuggcuguuucgggcguauacccaaugucaauaccagccacacuguuugugugguauuuuuggcagaaaaagaaacaaagaucaggaguguugugggacacucccaguccgccugagguugaaagagccguguuggaugaugguauauacagaauacuucaaagaggccuauuaggucggagucaagucggaguaggaguguuucaagacggaguuuuccacacuauguggcauguaacaagaggggcagugcugauguaucagggaaagagauuagagccgucuugggcgaguguuaagaaagaucugauaucuuacggugguggcuggagauuucaagguuccuggaauacgggugaagaaguacaaguuauagccgucgaaccugggaaaaaccccaaaaacguccaaacgaccccuggcacguuuaaaacuccugaaggggaaguaggugcaauugcacuugauuucaaaccugguaccuccgggucaccgauuguaaaucgugagggcaaaauugucggucucuacggaaacggagucguuaccacgaguggcacauacguaucggcaauugcucaggcaaaggcaagccaggaaggcccccuuccugagauagaagaugaggucuuuaagaaaaggaaucugacaauaauggaccuucacccaggcucagggaaaaccagacguuauuuaccggcuauaguaagagaagcaauaaaacgaaaacuacgaacguuaauauuagccccuacccgcguuguugcauccgaaauggcagaggcuuuaaaaggcaugccaauccguuaucagacaacagcaguaaagagcgaacacacugggcgagagaucguugacuugaugugccaugcuacguucacaaugagacucuuaucaccgguacgaguaccgaauuauaacaugauaaucauggaugaggcacacuucacagacccugccaguaucgcugcucgagguuacauaucaacacgaguaggaaugggagaagcggccgccauauucaugacagccacucccccagggucaguagaagcauucccacagucaaaugcgguaauacaagacgaagaacgagauauuccugaaaggucauggaacucgggcuacgauuggauuaccgacuuucccgguaaaacugucugguucguaccgaguauaaagaguggcaacgacauugccaauugucuaagaaagaacgguaaaagagucauucaacuaaguagaaaaaccuuugauacagaauaucagaagaccaaaaauaacgauugggauuauguugucacaacggacauuucggagaugggggcaaauuuucgggcggaucgagucaucgaucccagaagaugcuuaaaaccgguuauucuaaaggacgggccugaaagagucauacuagcgggaccuaugccugucacggucgcuagcgcugcgcagaggcggggcaggauaggucgcaaccaaaacaaggagggagaucaguacguauauauggggcaaccccuuaauaaugacgaggaucacgcacauuggaccgaagcuaagauguuacuugauaacauaaacacuccagaaggcauaauaccggcauuauuugaaccagaaagggaaaaauccgcagcaauugauggugaauauagauuacgaggggaagcuagaaaaacuuuuguggaacuaaugcgacgaggagaucuaccgguaugguugucuuauaaaguugcgucggagggauuccaauacagcgauagacguugguguuucgacggagaacguaauaaccaaguauuagaggaaaacauggauguagagauauggacuaaagagggagaacgcaagaagcucagaccaagaugguuagaugcaagaacuuauagcgacccacuugcucuuagagaguuuaaagaauuugcagccggacggcgauccauuucaggagauuuaauccucgaaaucgguaaauuaccccaacaucucacgcuaagggcccaaaaugcauuagauaacuuaguaaugcuucauaauucagagcaggguggaaaagcauauaggcaugccauggaagaacugccggauaccaucgaaacauugaugcuuuuagcucugauagcgguucucacaggaggugucacucuauucuuuuuaucaggcaaagguuugggaaagacaucaauaggacuacuauguguaacggcgucuagugcgcuacuauggauggccagcguggaaccgcacuggauagcagcgucgauuauacuugaguucuuucucaugguguuauuaauaccugaaccagacagacaacgaacuccacaagauaaucaauuggcauaugucgugauuggucuauuauuuaugauacuuacaguagcagcgaaugaaaugggucuguuagaaacaacuaaaaaggaucucggaaucggacacguagcagcagaaaaucaucaacaugcaaccauguuagacguugaccuaaggcccgcaucagcuuggacguuauaugcaguugccacuacugugauaacgccgaugaugaggcauacaauagaaaacacuacggcuaacauaagucuaacugcaaucgcgaaucaggcagccauuuugaugggguuagacaaaggauggcccauuuccaagauggauaucggaguacccuuacuggcauuaggaugcuauucucaggugaauccucuaacacuuaccgcggccguuuuaaugcugguagcgcauuacgcgauaauaggaccaggcuuacaagcuaaggcaacaagggaggcacaaaaacgcacagcagcagggauuaugaagaauccgacuguagauggcauaguagcgauagaucucgauccuguuguuuacgaugcuaaguuugaaaaacaguuaggacaaauuaugcuauuaauauuaugcacaucacaaauuuuguuaaugagaacaacuugggcccuaugugagagcauuacguuggcgacuggaccgcuaacaacacuuugggaagguucgccggggaaauuuuggaacacaaccauagcggucaguauggcgaauaucuucagagggucuuaucuagcuggugcaggacuagcuuuuucuuuaaugaaaucauugggcggaggaaggagagggacaggagcacaaggagaaacccuaggagagaaguggaaacgacaauuaaaccaauuaagcaagagugaauuuaauacuuauaaacgaucagguauuauggaagucgacaggagugaagccaaagagggccuuaaacgaggagagacaacuaagcacgcaguuucucggggaacagcgaaacuaagaugguuuguugaacgaaauuuagucaaaccagaagguaaaguuauugauuuaggauguggaagaggggguuggaguuauuauugcgcgggucuaaagaaagugacugaagucaaaggauacacaaagggugguccaggucacgaagaaccgauaccgauggcuacauacggauggaaucuuguaaagcuacauaguggcaaagauguuuucuuuaugccuccagaaaagugcgauacuuuauugugugauauuggggaaucuucaccuaacccgacaauugaagaagggagaacuuugagaguauuaaaaaugguggagccuuggcugagggguaaccaauuuugcaucaaaauucuaaacccguacaugccuucgguugucgaaacacuagaacaaaugcaacggaaacauggcgguaugcuaguuaggaacccauugucaagaaauucuacucacgagauguauuggguuucaugcgguacuggaaauauugucagcgcagugaauaugacaaguagaauguuacugaauagauuuacaauggcccaucgaaaaccaacauaugaaagagauguggaccuaggagcaggaacacgacauguugcuguggaaccggaaguugcaaaucuagacauuaucggucagcgcauagaaaauauuaagaacgaacauaaaaguacguggcacuacgacgaagauaauccguacaagacuugggccuaucauggauccuacgaaguaaagccuagugggucagcauccaguaugguuaacgguguuguaagauugcuaacgaagccuugggacgucaucccuauggugacgcagauagcaaugacagauaccacgccauuuggccaacaaaggguuuuuaaagaaaaaguagauacccgaacaccuagggcaaaaagaggaacgacacaaauaauggaaguaacugcuaaaugguuauggggauuuuuaaguagaaauaagaaaccaagaauuuguacacgagaagaauuuacacggaaagucagaucaaacgccgcaauaggagcuguuuucguagaugaaaaccaguggaauagcgcaaaagaagcuguagaagacgaacgauuuugggaccuugugcaucgagagagagaacuacauaaacaagguaaaugugcaacauguguuuacaacaugauggggaaacgcgagaagaaacugggcgaauuugggaaagccaaagggagcagagcuauuugguauaugugguugggagcucgauuucuagaauuugaggcuuuaggguuuaugaacgaagaucacugguucagcagagaaaauagccuuucaggcgucgaaggagaaggcuuacacaaacucggauacauauugagggauauaucgaaaaucccagggggaaacauguacgcagacgauacugcggguugggauacucguauuaccgaagaugaccuucaaaacgaagcuaaaauuacagaguucauggagcccgagcacgcacuauuagccacuucuauauucaaauuaacauaccaaaacaaaguuguaagaguucagagaccugcgaaaaaugguacaguuauggauguuaucuccagaagagaccagagaggaaguggacaaguuggaacauacggauuaaauacuuuuacaaauauggaggugcaacuaaucagacaaauggagucugaggguauauucuuaccgucagaguuagaaacuccaaauuuggcagaacguguauucgauugguuggagaaacauggagccgaacgauugaaaagaauggccauaagcggcgaugauuguguaguaaaaccgauugaugaccgguucgcaacagcacuaacggcacuuaaugacauggguaagguuagaaaggacaucccacaaugggaaccgaguaaaggguggaaugacuggcaacaagugcccuuuuguucucaucacuuccaucagcuaauaaugaaggauggacgagaaaucguugugccauguagaaaucaagaugaauuagucgggagagcccgagucucacagggagcaggauggagccuucgagagacagccugcuuaggaaaaaguuacgcacaaauguggcaacugauguauuuucauagaagagaucucagauuagcggcgaacgcaaucugcagcgcuguuccaguugauugggucccaacgucgcgaaccacauggucaauccaugcccaccaccaauggaugacaacagaagacaugcucucuguauggaaucgagucuggauagaggaaaaccccuggauggaagacaagacccacgucaguucaugggaagaaguaccauaucuaggaaaacgagaagaccaaugguguggcagcuuaauugggcuaacggcaagagcuacaugggcuacaaacauacaaguagcuauaaaccaaguuagaagauuaauagggaaugaaaacuaucuugauuauaugacaucaaugaagagauuuaaaaacgaaagugacccggaaggagcccucugguag

SEQ ID NO: 21295 - RNA, 9879 nt, Artificial Sequence
  derived and/or modified CDS sequence (opt6) from DENV-1__KJ189369__SS-prME
ucaguaacuaugcuacuuaugcuacugccgacugcgcuagcauuucacuuaacaacucgcgguggcgagccccacaugauugucucuaaacaagaacgugggaaaagccuacuguuuaaaaccucagccgguguaaauauguguacccuuauagcaauggaucuaggcgagcuuugugaagauacaaugacauauaaaugcccucaaauuacggaagccgaacccgacgacguagacuguuggugcaaugcaacagacacuuggguaacuuacgguacuuguucucaaacuggggaacacagaagggauaaaagaagcguagcuuuagcaccgcacguuggccucggguuagaaacgagaaccgaaaccuggauguccuccgaaggagcauggaaacaaauacaacgaguugaaacgugggcacuuagacaccccggcuuuacagugauagcgcuuuucuuagcccacgcaauaggaacuagcauaacacaaaaagggaucauauuuaucuuacuuaugcugguaacgccuucaauggcuaugagauguguuggaauagguaaccgugauuucguggaaggcuuaagcggggccacauggguagaugugguucuagaacauggaagcuguguaacuacuauggccaaaaauaaaccuacgcucgauauagaacuguuaaaaaccgagguaacuaacccagcgauauuaagaaaauuguguauagaagcuaaaaucaguaauaccacgacggacagucgaugucccacacaaggagaggcuacauuaguagaggaacaagaugcaaauuuuguauguagaagaacguucguggauagaggcugggguaaugguugcggccuauuuggaaaagggucguuauuaacaugcgcaaaauucaaauguguaacaaaauuagaggguaaaauuguacaauaugaaaaccuuaaauacuccgucauaguaaccguacauacaggcgaucaacaucaaguuggaaacgaaacuacagagcauggcaccaucgcaacgauaacgccccaagccccaaccagcgagauccagcuaacagauuacggcgcucuaacacuagauugcucaccucguaccggccucgauuucaaugaaaugguucuauugaccaugaaagaaaaaucuuggcuaguccacaaacaaugguuuuuagaucuaccccuaccauggacaucgggagccucgacuucgcaagaaacauggaacagacaagacuugcuggugacauucaaaacggcccaugcuaagaaacaagaagucgucguauuagggucacaggaaggugcaaugcacacugcauuaaccggggccacagaaauacaaacaaguggcacaaccacuauuuuugcaggccauuugaaauguagauuaaaaauggacaaauuaacccuuaaaggaacaagcuaugucaugugcacaggcucuuuuaagcuagagaaggagguagccgaaacccaacacgguacagucuuaguacagguaaaauaugaaggcacugacgcacccugcaaaaucccauuuuccacacaagaugaaaaaggaguaacucaaaacggaagauuaaucaccgcuaaccccauuguaacugacaaagagaaaccaguaaacauagaaacagagccaccauuuggagaaucauauauaguaguuggcgccggugaaaaagccuugaaauuaaguugguuuaagaaaggcucuaguauagggaaaauguucgaagcaacagcaagaggcgcacggaggauggccauacuuggagauacagcuugggauuuuggaucgauuggcggagucuucaccagcguaggaaagcuaguacaccaaguauuuggaacugcauauggagugcuauuuagcggaguuagcuggacgaugaaaauugguauaggaauuuuguuaacuugguuaggguuaaauucgcguagcacaucacugagcaugacuuguauagcuguagggauggugacucuauaccuugggguuaugguucaagccgacucagguugcguaauaaacuggaaggguagagaguuaaaaugugguuccggaauauuuguaacaaaugaaguacacaccuggacugaacaauauaaguuccaagcugauagccccaagcgacuaucugcugcuauagggaaagcgugggaagaaggcguaugcggcauuagaucggcuacccggcuagaaaacauaauguggaagcaaauaucaaaugaauuaaaccauauccuacuggaaaaugacaugaaauucacaguaguuguaggagaugcuaacgggauucuagcgcaagguaaaaagaugauucguccucaacccauggaacauaaauacagcuggaaaaguuggggaaaagccaaaauaauaggggcagacauacaaaauacuacauuuauaauagacggcccugacacaccagagugcccagacaaucaaagggccuggaacauuugggagguggaggacuauggauucgggauauuuacaacgaacauauggcugaaacuacgcgacagcuauacucaaaugugugaccauagacuaaugucggcagcaaucaaagauucuaaagcgguacacgcggauaugggauacuggauagaaucggagaaaaacgaaaccuggaaacuugcucgagcaucuuuuauugaggucaaaaccuguacuuggccuaagagccacacuuuauggucuaaugguguacuagaaucggaaaugauuauaccuaaaaucuacggaggacccauaucucaacacaacuaccgaccaggauauuuuacacaaacagcagguccauggcaucuagggaaacuggaauuggauuucgaucugugcgaagguacaaccguugugguugaugagcauugugguaauagagggccuagucuacgaacaacaacaguaacaggaaaaauuauacaugaauggugcuguagaaguugcacucuaccuccucuuagauucaggggagaagauggcuguugguacggaauggagaucaggcccgugaaagagaaagaggaaaaucugguaaggaguaugguuucagccggauccggugaagucgauagcuuuucccuggguauucucugcgugaguauuaugauagaagaagugaugagaucaagguggucacguaaaauguuaaugaccgguaccuuagcaguauuucuauugcuagucauggggcaacuaacuuggaaugaccucauacgauuauguauuauggugggcgcuaaugcaucagaccguauggguaugggcacaacuuaucucgcacuaauggcgacauuuaaaaugagaccaauguucgccguagggcuauuauuuagaagacuaacaagucgggagguucucuuacuaacuauaggacugaguuugguugcaucuguagagcuaccuaauagucuagaagaauuaggcgauggccuggcaaugggcauuaugauguuaaagcucuuaacagaauuucagccacaucaauuauggacaacucugcucagcuuaacauucauaaaaacgacuuuaucuuuagauuaugcuuggaagacaacagccauggcucucucgauaguuagucuauucccccuaugcuuaucaaccacuagccagaagacgacuuggcuaccaguacuccuuggaaguuuugguuguaaacccuuaacaauguuuuuaauaaccgagaauaagauaugggguagaaaauccuggccacuuaaugaaggaaucauggcaauagguauaguuaguauacucuuaucuucccuucugaaaaaugacgugccacuagcggguccguuaauagcgggaggcauguuaauagccugcuauguuauuucaggaucuagugcugauuuauccuuagaaaaagcagcagagguuucaugggaacaagaagccgaacauucggguacaucccauaauauccuaguugagguucaagaugacggaacaaugaaaauuaaagacgaggaacgugaugacacacuuacuauauuacugaaagcuacgcuccuggcgguuagcgguguauauccaaugagcauaccagcaacucuauuugucugguauuucuggcagaaaaagaaacaaagaaguggaguuuuaugggauaccccuucuccacccgaagucgagagagcuguguuggaugacggaaucuaucguaucuuacaacggggucuucuagggagaucgcaaguaggggucggugucuuucaggacggaguuuuucauaccauguggcacguaacucggggagcaguucuuauguaucagggcaaacgucucgagccuucaugggcuagugucaagaaagaucuaauuagcuaugguggaggguggagguuucaaggaaguuggaauaccggagaagaaguacaagugauugcuguagaaccugguaaaaauccuaaaaacguucaaacuacaccaggaacuuuuaaaacccccgaaggagaagugggcgcgauugcccucgauuucaagccagggacaucgggcucuccaauagucaaucgugaggguaaaaucgugggcuuguacgguaauggagucgucacaacuucgggcacguacguuagugcgauugcucaagcgaaagccucccaagaagguccuuuacccgaaauugaagacgagguuuuuaagaaacgcaacuugacaaucauggaucuccacccugguucuggaaaaacucgacgauacuuaccagccauaguucgugaagcaauuaaacgaaaguugagaacauugauacuugcaccaacacgaguaguagcaagcgagauggcagaggcuuugaaaggaaugcccauucgauaucaaacaaccgcaguaaaauccgagcauacugguagagaaauagucgacuuaaugugccaugcaacauuuacuaugagacuacuuucaccaguucgagugccuaacuacaauaugauaauuauggacgaagcacauuuuacagaccccgcuucgauagcugcaaggggguacaucucgacacgaguugggaugggagaagccgcagcuauauuuaugacggcaacaccaccagguucagucgaggcguuuccucaaucuaaugcggucauacaagacgaggaacgugacauuccggaaagaagcuggaacucuggcuaugauuggaucacagacuuucccgguaaaacgguaugguuuguuccgucaauaaagucaggcaaugacaucgcaaauugucucagaaagaauggcaaacguguuauacaacuuucacggaaaaccuuugauaccgaauaucagaaaacuaagaauaacgacugggauuauguaguaacaacagacauaagugagaugggcgcaaacuuucgugcagaucggguuauugaucccagaagauguuuaaagccuguaaucuuaaaggaugguccggagagaguaauccuagccgggccaaugcccgucacuguagccagugcagcgcaaagacgcgggagaauuggcaggaaucaaaauaaagaaggagaccaauauguuuacaugggacagccauugaauaacgacgaagaccacgcucacuggacggaagcuaaaaugcuauuggauaauauaaauacuccagaagggauaaucccugcguuauuugagcccgaaagagaaaagaaugcagcaauagacggagaauacagacuuagaggggaagcaagaaagacauuuguagagcuaaugaggcguggcgaccuuccuguauggcuaucuuacaaaguagcaagugaaggauuccaauauagugacagaagauggugcuucgauggugaaagaaacaaccagguuuuggaagaaaauauggacguagaaauauggacuaaagaaggugaacguaagaaauuacgcccgagaugguuggacgcucgcacauauagugacccuuuggcacugagagaguuuaaggaguuugcggcaggucggcguagcguaagcggugaccucauacuggaaauaggaaaacuaccacagcacuuaacuuuacgggcucaaaaugcuuuagauaacuuggugauguuacauaauagcgagcaaggaggaaaagcauauagacacgcgauggaagaacuuccugacacaauugagacgcugaugcucuuagcauugauagcuguguuaacagguggugugacguuauucuuuuugagugggaaaggacuuggaaaaacguccauagggcuucugugcgugacugcuagcucagcgcuucuuuggauggcuucaguggaaccucauuggauugcugcuaguaucauuuuggaauuuuucuuaaugguacugcugauaccagaacccgaucgacaaaggacuccgcaggacaaucaauuagccuacguuguaauaggccuuuuauuuaugauacugacaguugcagcaaaugaaaugggguuguuggagacaaccaagaaagaccuugguauaggacauguagccgcagaaaaucaucaacacgcaacaaugcucgauguagaccuccguccagcgagugccuggacacuguaugcaguggcuacgacagugauaacucccaugaugcgccacaccauugaaaauacgacugcaaauauuucacucacugccauagcaaaucaagcagcaauacuaaugggacuugacaaaggcuggccuauuucaaaaauggacaucggaguaccccuacuugcuuuaggcugcuauagccaaguaaacccucuuacccuaacugcagcugugcugaugcucguagcacacuaugcaaucauaggaccaggacuccaagccaaagcaacacgugaagcccagaaaaggacagcagccgggauuaugaaaaauccgacugucgacggcaucguugcaauugaucuagacccagucguauaugacgccaaauuugaaaagcaacuaggacaaaucauguugcuaauacuauguacaagucaaauccuccuuaugagaacaacaugggcauugugugaaucaauuacacucgcuaccggucccuuaacgacgcuaugggaaggaaguccaggaaaauucuggaauacuacuauugcuguaaguauggcaaacaucuuuagaggauccuauuuagcaggagcgggacuugcuuuuucauuaaugaaaucucuggguggcggacgaagggguacaggggcacagggagaaacguuaggcgaaaaauggaagagacaguugaaccagcucucaaaauccgaauuuaacacguauaaacgcucaggcauaauggaaguugaccguucggaagcgaaagaggguuuaaagagaggggaaacaacuaagcacgcaguaucaagagguacagcuaaauuacguugguucgucgagagaaauuugguaaaaccagaagguaagguaauugaccuugguugugguagagguggcugguccuauuauugugcaggucugaaaaagguaacugaaguuaaggguuauacuaaaggagguccaggacacgaagaaccgaucccaauggccacauauggguggaacuuaguaaaacuacacagcggaaaagauguguucuuuaugccaccugaaaagugcgauacguuguuaugugacauaggugagaguucacccaaucccacaaucgaagaaggaaggacguugagaguucugaaaaugguagaaccuuggcuuagagguaaccaauuuuguaucaaaauccuuaaccccuacaugcccucgguggucgaaacacuagaacagaugcaaagaaaacauggagguauguuaguuagaaauccacuaucucguaacagcacacacgaaauguauugggugucaugcggcacaggaaacaucguaagugcuguaaauaugaccagcagaauguugcuaaacagguuuacuauggcacacagaaaaccaacguaugaacgcgauguugaccuaggcgcaggcacgcgacauguugcggucgaaccugaggucgcuaaucucgauauuaucggacaaagaauagagaauauuaagaaugaacauaaaucaacauggcauuaugaugaggauaaccccuacaaaacuugggcuuaucacggcucauacgaaguuaaaccaucuggaucugcuuccagcaugguaaauggagugguuagauuguugacaaaacccugggauguaauaccuauggucacacagauagcgaugacagauacuacuccauucggacaacaaaggguauuuaaagaaaaaguugacacccgaacuccuagagcaaaacgugguacaacacaaauaauggaagucacagcaaaauggcuuugggguuuccuaagucggaacaagaaaccgagaauuugcacaagagaagaauuuaccaggaaaguacgcucaaaugcagcuauaggagcggucuuuguagacgaaaaucaauggaacucggcaaaagaagcaguagaagacgaacgauucugggaccuaguacauagggaacgggaauuacauaagcaaggaaaaugugcaacaugcgucuacaauaugauggguaaaagagaaaagaaacucggagaguucggcaaggcuaaaggcagcagagcaauaugguauauguggcuuggcgcacgauuccuggaauuugaagccuuaggguuuaugaacgaagaucauugguucucacgggaaaauucccucucaggagucgaaggugaaggauuacacaaacucgguuauauauugcgugacauaagcaagauuccaggagggaauauguacgcagacgacaccgcaggaugggauaccaggauaacagaggacgaucuccagaaugaagcaaaaauaacggaaauaauggaaccugaacacgcauuauuagcaacaaguauuuuuaaguugaccuaucaaaacaaaguagugcguguucaacggccugcaaagaacgguaccgugauggaugugauaagucgccgagaucagcgcggaucuggacaaguuggaacauauggguuaaacacauucacaaauauggaaguacagcuuauaaggcaaauggaaagugaagggauauuccuuccuagcgaacuagaaaccccuaaucuugcagagcgggugcuagauuggcuugaaaaacauggagcggaaagauugaaacgaauggcuauuucuggagaugauugcguagugaagccuauagaugaucgguuugcuacugccuuaacugcccuaaacgauauggguaagguaagaaaagacauaccucaaugggaaccaucaaaaggauggaaugauuggcaacaaguuccauuuugcucacaccauuuccaucaacuaauaaugaaagaugggcgagaaauaguagucccaugccggaaccaagacgagcucgucgguagagccagagucagccaaggggcugguuggagcuuacgcgaaacugcauguuuaggaaaaucauaugcacaaauguggcagcuaauguauuuucauagaagagauuuaagauuagcggcaaaugcaaucuguucggccguuccuguagauugggucccuacuagccgaacaacuuggaguauacaugcacaccaucaguggaugacuacagaagauauguuaucuguauggaaucgaguuuggauagaagagaaucccuggauggaagacaagacacacguuagcaguugggaggaaguuccauaucucgggaaaagagaggaccaauggugugguagccuaauaggucuaacugcacgagcuacgugggcaaccaauauccaaguagcaauaaaucaaguuagacgucuaauagggaaugaaaauuaucuagauuauaugacaagcaugaaaagauuuaaaaacgaaagugauccagaaggugcacugugguaa

SEQ ID NO: 21296 - RNA, 9879 nt, Artificial Sequence
  derived and/or modified CDS sequence (opt6) from DENV-1__EU482615__SS-prME
agcguaacgauguuauuaauguuacuacccacugccuuggccuuccaucuaacuacccgagggggagaaccucacaugauagucucgaaacaagaaagagguaaaucgcuauuauucaaaaccucagccggaguaaauaugugcacguugauugcuauggaucuaggugaacugugcgaagacaccaugacuuauaaaugcccucaaauaacggaagcugaaccugacgauguugauugcugguguaacgcaacagacacaugggucacauaugguacauguucccaaacuggagaacaucggagggacaaacggaguguugcuuuagcaccacacguuggcuuagggcuagaaacgcggacagaaacuuggaugucaucugaaggggcauggaaacaaauacaaagaguagaaacaugggcacuaagacauccaggcuuuacuguaauugcucucuuccuagcgcaugcuauugguacguccauaacccaaaaagguauaauauucaucuuauuaauguugguaacuccaagcauggccaugaggugcguaggaauagggaauagagauuucguagaagggcugucuggcgccacauggguagauguuguccuugaacauggcucaugcgucacaacaauggccaaaaauaaaccaacccuggacauagaacuucugaaaacagaaguaaccaauccggcaauucuucguaaacuaugcauugaagccaaaauaaguaacacaacuacugacucuagauguccaacacaaggcgaagcgacacuugucgaggaacaagaugcuaauuuugugugucgaagaaccuucguagauaggggguggggcaauggguguggucuuuucggcaaaggaaguuuacuuaccugugcuaaauucaaaugcgucacuaaacuggaagguaaaauuguacaauaugaaaaucuaaaauacucugugauuguaacaguacauacuggugaccaacaucaaguagggaaugaaacaacggaacacggaacaauagcaacaauaacgccgcaggccccgacgagugagauucaacuuacggacuauggggcauuaacgcuagauuguucgccaagaacaggucuagacuuuaacgaaaugguauuacuuaccaugaaggaaaagucauggcuuguccauaaacagugguuucucgauuuaccacuaccguggacaucuggugccaguacaucgcaagaaacauggaauagacaggauuuauuaguaacauuuaaaacagcacaugcgaagaaacaggaaguuguagucuuaggcagccaagaaggugccaugcauacagcuuuaacaggggccacagagauucagaccagcgguacuacaaccaucuuugcaggucauuugaaaugucgacugaagauggacaaguuaacuuuaaagggaacaaguuauguaaugugcaccggaucuuucaaacuagagaaagaaguagcugaaacccaacacggaaccguucuaguacaagucaaauaugaaggaacagaugcaccuuguaaaauaccguucucaacacaagaugaaaagggagucacccagaauggcaggcuuauaaccgcgaauccuauuguaacagauaaagaaaaaccaguaaauauugaaacagaaccgcccuuuggugaaaguuauauugugguaggcgcuggagaaaaagcacuuaaauuaaguugguuuaaaaaggguuccucaauuggaaaaauguuugaagcuacugcacguggagcgcgccgcauggcaauacucggggauacugcuugggacuucggaucaauaggcggagucuuuacuucuguaggcaaguuaguacaucaagucuucggaacagcuuauggcguacuguuuucuggaguaaguuggaccaugaaaauagggauuggcauauuauuaacguggcuuggucuaaacucacgaaguaccucacuaucaaugacguguauagcagucggaaugguaacauuauaccuaggaguaaugguucaagcugacucagguuguguuauaaauuggaaggguagggaacuuaaguguggaucugguauuuucgugacuaacgaaguucacacguggacggaacaauauaaguuccaagcagacucgccuaagcgauuguccgcugcuauaggaaaggcuugggaagaggggguaugugguauaagaagugcaacaagauuagaaaacauuauguggaagcaaauuucaaaugaacuuaaccacauauugcucgaaaaugacaugaaauuuacagugguagucggugacgcgaacgguauacuagcucaaggcaagaaaaugauacggccucaaccgauggaacauaaauacagcuggaagucauggggcaaagccaaaauaauuggugcugauauacagaauacaacguucauaauagauggaccagacacuccugaaugcccagauaaccaaagggcguggaacauaugggaaguagaagauuauggguucgguauauuuacuacaaacauauggcucaaauuaagagauucauauacacaaaugugugaucaucgccuaaugucggccgccauaaaagauaguaaagcuguucaugccgauaugggauauuggauugagagugagaaaaaugaaacauggaaacuugcccgagcaaguuuuauagaagucaagacauguacauggcccaaaagucauacauuauggucuaauggagugcuagaaucagaaaugauuauaccgaaaauuuauggcgguccuauuucacagcauaacuacagaccuggauauuucacucaaacagcaggaccguggcacuuaggaaaauuggaauuagauuuugaucucugugaagguacaacagugguggucgacgagcauugcgggaauagggguccgagcuuaagaacaacaaccguaacuggcaaaauuauacaugaauggugcuguaggucaugcacauuaccaccacuuagguuuagaggggaagacgguuguugguacgguauggagauaagacccgucaaagagaaagaggaaaaccuuguaagguccaugguuagugcagguaguggcgaaguagauucauucagccuagguauacuaugugcaucgauaaugaucgaggagguuaugaggaguagauggagucguaagaugcuaaugaccgguacauuggccgucuucuuacuucuaauaauggggcaauugacuuggaacgaccugauccgauuguguauaaugguuggggcaaaugcaagcgacagaaugggcaugggaacaacguaucuugcucucauggccaccuucaaaaugagaccaauguuugcuguaggacuucuuuuuaggcguuugacaucaagagaaguguuauuauuaacaaucggguuaucucuaguagcaaguguugaacuaccaaacucgcuagaagaauuaggugacggauuggcuauggguaucaugaugcucaaacuccuaacugaauuucagccacaucagcuguggaccacauuacuaucacuaacuuucauaaaaacuacucucucuuuagacuacgcguggaaaacaacugccauggcuuuaaguaucguaagucuauuuccacucugccuguccacuaccagccagaaaaccacuugguuaccggucuuauuagggucuuuuggcugcaaaccacuaacaauguuucuaauaacagagaauaagauuugggggcguaaaaguuggccucuaaacgaagguauaauggcaauagggauuguaucgauucucuuaucuagccucuugaaaaacgauguaccguuggcugguccauuaaucgcaggcggcauguuaauagcuuguuacgugauaagcggaaguucugccgauuuaagucuagaaaaggcagcggaaguaucgugggaacaagaggcggagcauucagggacuucgcacaauauucucguugagguccaagaugauggcacuaugaaaaucaaagaugaggaacgcgacgacacacuuacaaucuuauuaaaagcaacauuacucgccgucucaggcguuuaccccaugucuaucccagccacguuauuuguaugguacuucuggcagaaaaagaaacagagaagcgggguucuaugggacacuccgucucccccagagguugaacgcgcaguuuuagacgacgggaucuauaggauacuacaacguggacuacucgguaggucacaagugggagugggaguguuccaagacgggguauuucauacuauguggcaugucacaagaggagcugugcucauguaccaaggaaaaagacuugaaccauccugggcgucugucaagaaagaucugauuaguuacgggggaggcuggcgauuccaaggcaguuggaacacuggugaagaggugcaggucauagcaguagaaccugggaaaaacccgaaaaacguccaaacaacgccuggaaccuucaagacuccugaaggggaaguaggggcaauagcacuugacuucaagccuggcacuucgggcaguccuauuguaaacagggagggaaaaauagugggccuauauggaaauggaguaguaacaacguccgguacuuauguaagugcaaucgcgcaagcuaaagcaucucaagaagggccguuacccgagauagaggaugaaguauucaagaagagaaauuuaacaauuauggauuugcauccagguucuggaaaaacaagacguuauuuaccggcaaucguaagagaggcuauaaaaagaaaacuaagaaccuuaaucuuggcacccacaagagugguagcauccgaaauggccgaagcucugaaaggaaugccaauaagauaucaaacaacagcagugaaaucagaacauacagguagggaaauuguugacuuaaugugucaugcaaccuucacaaugcgacuuuugucgccggugagaguaccuaacuacaauaugauaauaauggaugaagcucauuucaccgacccugccucgauugcagcaagggguuacauaaguacgcggguaggcaugggugaagcagcagccauuuuuaugacggcaacacccccggguucuguugaagcauuuccccaaaguaaugcaguaauacaagaugaggagagggauauuccugagagaaguuggaacuccggauaugauuggauuacagacuucccgggaaaaaccguuugguucgugccgaguauaaaaucaggcaacgacauagccaacugccugaggaaaaauggcaagcguguuauucaguuaagccguaagaccuuugauacagaauaucagaagacgaaaaauaaugauugggauuauguuguuacgacagacauaucugaaaugggagcaaauuucagagcagaucgagucauagacccgagacgcugucuaaaaccuguaauccucaaagauggacccgagaggguaauacucgcaggaccaaugccugucaccguagcgagugcugcacaaagacgugguagaaucggccgaaaucaaaacaaagagggagaccaauacguauacaugggccagccccucaauaaugacgaggaucacgcgcauuggacagaagcuaaaaugcuacuugacaauaucaauacgccggaaggcauuauaccugccuuguucgaaccugaaagagaaaagagugcagcaaucgacggggaguacaggcuacgaggagaggcuagaaaaacuuucguagaauuaaugagaagaggugauuugccagucuggcucaguuacaagguggcgagugaaggauuucaauauucugauagaagguggugcuucgauggagaaagaaauaaucagguacucgaggaaaauauggacguagaaauuuggacaaaagaaggcgaaagaaagaaacuccguccuagaugguuagacgccagaacauauucagacccucuugcccuucgagaguuuaaggaauuugcggcuggacgaagguccgucaguggagauuuaauacuugaaauuggaaaguuaccccaacaucuaacccuaagagcacaaaaugcauuagauaauuugguuaugcugcauaauagcgaacaagguggaaaagcauauagacaugcuauggaggaacucccggauacaauagaaacuuuaauguuacuagcacucaucgccguccugacuggaggaguaacacucuucuuuuuaagcggaaaaggacucgggaaaacgucuauuggcuuauuaugcgucacugcuaguuccgcauuauuauggauggccaguguagaaccccauuggaucgcagcaucaaucauacucgaauuuuucuuaaugguucuuuuaauaccggaaccagaucgccaacgcacaccccaagacaaccaacuagcauacgucgugaucggauuauuguucaugauuuuaacuguagcugcaaaugaaaugggacuauuagagaccaccaagaaagacuuggguauaggacauguagccgcugaaaaucaccaacaugcgacuauguuagauguagauuugagaccagccagugccuggaccuuauacgcuguagcaaccacagugauaacacccaugaugcgccauaccauugagaauacuacugcaaauauuucuuuaacggcaauugcaaaucaagcugcuauuuugauggguuuggacaaggguuggccuaucucaaaaauggacauuggugucccgcuauuagcuuuaggcuguuauucacaaguaaauccauuaacauugacagcagcgguccuuauguugguggcccauuaugcaauaauugggccaggacuacaagcuaaagcgacaagggaggcucaaaaacgaacggcagcaggaaucaugaagaacccaacgguagauggcauagucgcgauagaucuugauccuguaguauacgacgccaaguuugaaaaacaguuaggacagaucaugcucuugauccucuguaccucacaaauauuguuaaugcgaacuacaugggcucucugugaaucaauuacacuggcaacgggcccguugacaacuuuaugggaggguagccccggaaaguucuggaauaccaccauagcaguaucgauggcaaauauuuuucgaggaucguaucuagcaggagccgguuuagcauuuucauuaaugaaaaguuuaggaggaggcagaagaggcacuggagcacaaggugaaacauuaggcgaaaaauggaaaagacaauugaaccaauugaguaaaucggaguucaauaccuauaagagaucuggaauaauggaaguggaccgaagugaagcaaaagaagguuugaaacguggugagacaacuaaacacgcaguaaguagggguacagcaaaguugagaugguuuguagaaagaaacuuagucaaaccggaaggaaaagugauugacuugggcugcgguagagguggcuggagcuauuacugcgcagguuuaaagaaagucacggaaguaaaaggauauacaaagggaggaccuggacaugaagaaccaauaccuauggccaccuacggguggaauuuaguuaaauuacauaguggaaaggacguauucuuuaugccaccugaaaaaugugacacacuauuaugcgauauuggugaaucaucaccuaacccgacuaucgaagagggacgcacauuaaggguacugaaaaugguagaaccauggcucagaggaaaccaauucuguaucaagauacugaacccauacaugccaucggugguugaaacauuagagcagaugcagcguaaacacggugguaugcuaguacgaaauccauuaagcagaaacucaacacaugagauguauuggguaucuugugggacuggcaauaucguaucagccguuaauaugaccucacgaauguuauuaaauagauucacaauggcucaucguaaaccaaccuaugaacgagacguggacuuaggagcgggaacccgucaugucgcagucgaaccggagguugcaaaucuugacauaaucggccagcgcauugaaaacaucaaaaaugaacacaaaucaaccuggcauuaugaugaggauaauccauauaaaaccugggcuuaucacggaagcuacgagguuaaaccgagcggaucugcuucuaguauggugaacggagucguuagauugcuaacaaaaccgugggacguaauaccuaugguaacacaaauagcaaugaccgauacgacaccuuucggacagcagcgaguauuuaaagaaaaaguagacacgcgaacuccacgagccaagcgcgguacgacacaaauuauggaagugacagcaaaguggcucuggggauuccugucaaggaacaagaaaccacgaaucuguacuagggaagaguucacgagaaaaguuagaaguaaugcggcaauuggugcgguguucguagaugagaaucaguggaacagugcuaaagaagccguagaagacgaaagguuuugggacuuagugcauagagagagagagcuucacaaacagggaaaaugugcaacguguguuuauaauaugauggggaaacgggagaagaaacuaggugaguuuggaaaggcuaaaggaucacgagcuauaugguauaugugguuaggagcgagauuucuggaauuugaagcgcuaggcuucaugaaugaagaucacugguuuagucgagaaaauucauuaucagguguggaaggagaaggacuucacaaacucggauacauuuuaagagacauaucaaaaauaccuggcgggaacauguaugcagacgacacagcuggaugggacacaaggauaacagaagaugauuugcagaaugaagcaaaaauuacugacaucauggagccugagcaugcacuguuggccacgucaauauucaaauuaacuuaucaaaauaaaguuguuagagugcagaggcccgcuaagaauggcacagugauggacguaauuagccgccgagaucaaagaggaucuggccaaguaggaacuuauggcuugaauacuuucaccaacauggaaguucaauuaauuagacagauggagagcgaaggcaucuuucuacccucagaacucgaaacaccaaaucuugcugaacgcguauuggacugguuagagaaacacggcgcagagagauuaaaaaggauggcaauaaguggagaugauugcguuguuaaacccauagacgauagguuugccacagcucucacugcacuuaaugacaugggcaaaguaagaaaggauauaccgcagugggaaccaucaaaaggauggaacgauuggcaacaagugccguucuguucucaucacuuucaucaacuaauaaugaaagacggcagagaaauaguugucccgugucgcaaucaggaugaacugguaggacgugcaagaguuucgcaaggcgcagguuggucucucagagaaaccgcuugucugggaaaaucguaugcgcagauguggcaauugauguauuuccauaggagagaccugagacuugcagcgaaugcgaucugcagugcgguaccgguagacugggugccaacaucgaggacaacuuggaguauacaugcucaucaucaguggaugacgacagaagauaugcuuucuguauggaauaggguuuggauagaagaaaauccauggauggaagacaaaacgcauguaucuagcugggaagaaguaccauaccuuggaaaaagagaagaucaauggugugggucccuaauagguuuaacagcaagagcaacaugggcuacgaauauucagguagcuauaaaucaaguucgaagauuaauuggaaaugaaaauuaccuggacuauaugacgucuaugaaacguuucaaaagcgaaagugauccggaaggagcacuaugguag

SEQ ID NO: 21297 - RNA, 9879 nt, Artificial Sequence
  derived and/or modified CDS sequence (opt6) from DENV-1__EU482616__SS-prME
ucaguaacuauguuacugauguuacucccaacugcacuagcauuucacuuaacuacuagagguggcgaaccccacaugauaguaaacaaacaagaacgaggaaaaucacuucuauucaaaacaucagcaggaguaaauaugugcacauuaauagcuauggaccuuggcgaacuuugcgaagacaccaugacguauaaauguccacaaauaacugaagcagaaccagacgacguugacugcugguguaacgcaacagauaccugggugacauauggaacauguagucaaacaggcgaacauagaagggauaagagaucaguagcuuuggccccacaugucggguuggggcuagaaacucgaacagaaacauggaugaguuccgaaggagcauggaaacaaauucagcgaguugaaacuugggccuugagacauccaggcuuuaccguuauagcccuguuccuagcgcaugcgauagggacgaguauaacacagaaagguauaauauucauucuuuuaaugcuaguuacucccaguauggcuaugcguugcguggggauaggcaauagagauuuuguugaaggacuuaguggugcgacaugggucgaugucguacuggaacacgguucaugcguaaccacuauggcaaagaauaagccaacuuuggacauugaauuauugaaaacagaaguuacuaauccagcgauuuuacguaaguuaugcauagaagcuaagauuaguaacacuacaaccgauuccagauguccaacacaaggugaggccacguuagucgaggagcaggaugcgaacuucgucugccgacggacauuugucgaccgagggugggggaauggaugcggacuguuugggaaagguucacuuuuaacuugugcaaaauuuaaauguguuaccaaauuagaggguaaaauuguucaguaugaaaacuuaaaauacuccguuauugugacaguucauacuggcgaccaacaccaagucgggaaugaaacuacugaacacggaaccaucgcgaccauaacuccacaggcuccaacaagugaaauucaauuaacggauuauggagcccuaacauuggacuguagcccuaggaccggguuagauuucaacgaaaugguuuuguuaacuaugaaagagaaaucuugguuaguacauaagcaaugguuccuggauuugccacuaccauggacaucgggugcaucuaccagccaagagaccuggaacaggcaagaccuccuagugacuuucaagacugcccaugcuaagaaacaagaaguggugguguugggcagccaagaaggagcaaugcacacagcauuaacaggggccacugagauacagacauccggaaccacaacaauuuucgccgggcaccuuaagugcagauuaaaaauggauaagcuaaccuuaaaaggcacgagcuaugucaugugcacggggagcuucaaacuagagaaagagguagcagaaacccaacacgguacaguauuaguucaaguuaaauaugaagguacggaugcgccuugcaaaauaccauucaguacucaagacgagaaaggagugacucagaaugguagacugauaacugcuaaucccaucgucacugauaaggaaaagccuguuaauauugaaacggaaccaccguuuggagaauccuauauaguaguuggggcaggagagaaagcguuaaaauuaucuugguucaaaaaggggucaagcauaggaaaaauguuugaagcaacggcgagaggggcacgacgaauggcaauucuaggcgacacagcuugggauuuuggcuccauaggaggaguguuuacaaguguagggaagcuaguucaucagguauuugggacugcauacggcguuuuauucagcggcguuaguuggaccaugaaaauagguauaggaauacuccugacuuggcuaggucugaacucgcggucaacaucgcuaucaaugacaugcauagcuguaggaauggugacauuguauuuaggaguaaugguccaagcagauagcggauguguaaucaauuggaaaggucgagaguugaagugugggagcgguaucuuugugacaaaugaagugcauaccuggacagaacaauacaaauuucaagcagacucacccaaaagacugucagcggcuauaggaaaagcaugggaagaagggguaugcgggauccguucagcaacuaggcuugaaaauaucauguggaaacagaucucaaacgaacuaaaucacauccugcuggaaaaugacaugaaauucacaguagucguuggcgacgcuaacggcauauuggcgcaagguaagaaaaugauuagaccccagccaauggaacauaaauauagcuggaaaucauggggaaaagcaaaaauaauuggagcagauauacaaaacacaacauucauuaucgacggccccgauacuccagaaugucccgacgaucaacgugcuuggaacauuugggaaguagaagauuaugguuuuggcauuuuuacaacaaauauuuggcuuaaacugcgagacucuuauacacagaugugugaucaucgucuaaugucagcagcaaucaaagauaguaaagccguccacgcagacauggguuacuggauugaaucugagaaaaaugagacguggaaguuggcuagggcgagcuucauagaaguaaaaacaugcacauggccgaagucgcacacauuauggagcaauggcgucuuagaaagcgaaaugauuauuccaaagauauauggagggccuaucucccagcauaauuacaggccagguuauuucacccaaacagcgggcccauggcaccugggaaaauuagagcucgauuucgaccuaugugaggggacaacaguagucguugaugagcauugcgguaaucggggaccaucucuuaggacaacaacuguaacuggaaagauaauucacgagugguguuguagaagcugcaccuuacccccucuaagauuuagaggagaggaugggugcugguacggaauggaaauaaggccaguaaaggaaaaagaggaaaacuugguacgaucaaugguaagugcgggaucgggagagguagacagcuucucucuagggauccuuugcgcuaguauaaugaucgaggaagugaugaggucucgcuggagucgaaaaaugcuaaugacggggacucuugcaguauuucuauugcugaucaugggucagcugacauggaacgaucuaauacgauuguguauaaugguaggagcaaaugcaucagauagaaugggaaugggaacgaccuaccuugcuuuaauggcaacuuuuaaaaugaggcccauguuugcuguaggucucuuauuccgaagacugacaaguagagaaguauuacuauuaacgauaggauuaagccuaguagcaaguguggaauuacccaauagccucgaggaauuaggagauggucuagccauggggauaaugaugcugaaacuucuuacagaauuucagccacaccaacucuggacaacauuacuuaguuuaacguuuaucaaaacgacacuuucucuggauuaugcuuggaaaacaaccgcgauggcucuaucaauaguauccuuauucccauuaugcuuaagcacaaccucacaaaagaccacauggcuaccaguauugcuuggcucguuugguuguaaaccauuaacgauguuccugauaacggaaaacaaaauauggggccgcaaaucauggccucuaaaugaagguauuauggcuauugguauaguuaguauacuauuaucaucgcuacuaaagaaugacguuccauuagcagggccguuaauagcgggugguaugcugauagcauguuauguaauuaguggaucgucagcagaccuaucauuggagaaagcugcagaggugagcugggagcaggaagcugaacauagcggaacaucacauaauauccuaguagagguucaagacgacggaaccaugaaaauuaaagacgaggaaaaagaugauacccugacuauuuugcuuaaagcaacacuucuggcugucuccggagucuauccgaugucaauuccagcaacgcuuuucguuugguacuucuggcagaagaagaaacaaaggucugguguuuugugggacaccccuagcccacccgaaguugaacgagcaguacuugaugaugguauuuaccgcauucuacaaagaggcuuacuaggaagaagccagguggggguaggugucuuccaagauggaguuuuucauacaauguggcauguaaccaggggugcaguacuaauguaucaaggcaaaagacuugaacccucuugggcuucaguaaagaaagaccuaaucaguuacgguggcggauggcgguuccaagggucuuggaauacuggcgaagaaguucaagucauugcaguagagccagguaaaaaccccaaaaauguacaaacaaccccaggaacuuucaaaacgccagaaggugaaguaggcgcuauugcauuagacuuuaagcccggcacgagcgggaguccuaucgugaacagggaagggaaaaucguaggauuguauggaaaugguguagugacuacaucagggacauacgugagugcgaucgcgcaggccaaggcaagucaagaagguccuuuaccagagauugaggaugaaguauuuaagaaacgaaauuugacaauaauggacuuacauccuggaucuggaaaaacaagacgcuauuuaccggcgauuguucgugaagcaauaaaacgaaaguuacgcacacuaauacuugcuccuacgagaguuguagcuucagaaauggcugaagcacuaaaaggcaugccaauuagauaccaaacuaccgcuguuaaauccgaacacacgggaagagaaauaguagauuuaaugugucacgcaacauuuaccaugagauuacugagccccgugcggguaccaaauuacaauaugaucauuauggaugaagcucacuucaccgauccagcuucaauagccgcacggggauacauuagcacaagagugggaaugggagaggccgcugccauuuucaugacagcgacuccuccgggaucugucgaagcauucccacaaucuaaugccguaauccaagacgaagaacgugacauaccggagaggagcuggaacucuggauaugacuggauaacagauuuuccaggaaagaccguuugguuugugccaucaaucaaaucaggaaaugacauugcaaacugcuuacgcaagaacgggaagaggguuauacaacuaucuagaaagacguucgacacugaauaucagaaaacuaaaaacaaugacugggauuauguuguuacaacagauauaucggaaaugggagccaacuucagagcugaucgagucauugauccuagacgauguuuaaaaccgguuauuuuaaaagaugguccggaacgcgucauucuggcagguccuaugcccgucacaguagcaucugcagcgcaacgcagagggaggauaggccgcaaucaaaauaaagagggagaccaauacguauacaugggucaaccuuugaacaaugaugaagaucacgcccauuggacugaagcaaaaauguuacuagauaauauaaacacuccagaaggaauuaucccagccuuguuugaacccgaaagagaaaagagcgcagcuauugauggugaauauagacuaaggggagaagcccgaaagacauuugucgaauugaugcgacgaggcgaucuaccuguuugguuaucuuacaagguagcaucagaaggauuccaauacucagacaggagaugguguuuugacggagagcgaaauaaucaaguauuggaagaaaauauggauguugaaauuuggacgaaagaaggagaaagaaagaaacuucgcccacguugguuggaugccaggacuuauucagacccucuagcacuucgagaguucaaagaguuugcagcagggagacgaaguguaucgggagacuugauacuagaaauagguaaauugccacaacaucuaaccuugcgagcacaaaaugcguuagauaauuugguuaugcugcauaacagugaacaaggaggaaaagccuauagacacgcgauggaggaacuuccggacacgaucgagacuuuaauguuacuugcucuaauugcugucuugacgggagguguaacauuauuuuucuugagcgggaaagguuuggguaaaaccucuauugguuuacuauguguuacagcaaguucagccuuauuguggauggccaguguagaaccacacuggauagcugcgucgauuauauuagaauuuuuccucaugguuuuauugauaccugaaccagauagacagcgaacaccccaagacaaccagcuagcuuauguugucauuggauugcucuuuaugauuuuaacaguugcagcuaacgagauggggcuucuagaaacaacgaagaaagaccuagggaucggucauguagcagcugaaaaucaucaacaugcaacaauguuagauguagaucuuagaccggcuucugcuuggacauuguaugcaguugcgacaacgguuauaacacccaugaugaggcauacgauugaaaauacuacggcaaauauaucauuaacagcaauagcuaaucaagcugccauucucaugggacuagauaagggauggccgauaaguaaaauggauauagggguaccauuauuagcccuaggauguuacucucaaguaaacccccucacauuaacggcagcaguguuaauguugguugcacacuaugcgauuauaggaccaggcuuacaggcgaaagccacacgugaagcucaaaaacguacagcugcgggaauuaugaaaaauccaaccguagauggcauuguugcaaucgaccuugauccugucgucuaugacgcuaaauuugaaaaacaacuagggcaaauaauguuguugauauuaugcacuucccagauuuuguugaugaggacaacuugggcauugugugaaucaaucacgcuagccacuggaccucucacuacguugugggaagguagucccggcaaauuuuggaauacaacaaucgcgguuaguauggcgaauaucuucagggggucguacuuagcuggagcuggacuagcguucagcuugaugaaaaguuuagguggaggacggagaggaacgggagcucaaggagagacauugggagaaaaguggaagaggcaacuaaaucaacuguccaaaucagaauuuaauacauauaaacgguccgguauuauggagguagaccgauccgaggcaaaagagggacuaaagcgaggcgaaaccacaaaacaugcaguaagucgaggaacagccaaauugcggugguuuguagagagaaaucuaguaaagccugaagggaaggugauagacuuaggaugugggcgaggaggauggagcuauuacugugcgggauugaagaagguaacugaaguuaaaggauauacaaaaggagguccaggacaugaagaaccgauucccauggcuacuuauggcuggaaucuaguuaaacuucacucaggaaaagacguauucuuuaugccaccugaaaagugugacacgcuacugugugauauaggugaaucguccccaaauccaaccauugaagaaggacgaacauuaagaguuuugaaaaugguugaaccaugguugagaggaaaucaauuuugcauaaaaauauuaaacccauacaugccuucaguuguugaaaccuuagaacaaaugcaaagaaagcacggagguaugcugguaaggaacccucucucacgaaauaguacucaugagauguauuggguaucaugcggcacagggaauauaguaucugcgguuaacaugacgucuagaaugcuucuaaauagauucacgauggcccacagaaaaccgacuuaugaaagggauguagaucuuggagccggaacacggcacguugcaguggagccagaaguggcuaaucuugauauaauuggccaacgaaucgaaaauaucaaaaaugaacacaaauccacauggcauuacgaugaggauaaucccuauaaaacgugggcuuaucauggaucuuaugaaguaaagcccucggguuccgcgaguagcaugguaaauggugucgucagguuacucacaaaaccaugggaugucaucccuaugguaacccagauugcaaugacagacacaacaccauuuggacaacaaagaguauuuaaggaaaaggucgauaccaggacuccgcgcgcuaaacgcggcacaacacaaaucauggaagugacagcuaagugguuguggggauuucuuucccgaaauaagaaaccuagaauuugcacacgugaagaguuuacaaggaaaguccgaucaaacgcugcgauaggagcaguguuuguagaugaaaaucaguggaauagugccaaagaagcugucgaagaugaaagauuuugggauuuaguucaucgcgaacgcgaauuacauaaacaagguaagugugccacaugcguauacaacaugauggggaaaagagagaagaaacuaggagaguucgguaaagcuaaaggaaguagggcaauuugguauaugugguuaggugcaagauucuuagaauuugaggcacuuggauucaugaaugaagaucauugguucucgagagaaaacucgcuauccggagucgaaggcgaagguuuacauaaacuaggcuauauauuacgugacauaucuaaaauuccaggggguaauauguaugcagaugacacagcuggaugggauacacguauaacagaggaugaucuacaaaaugaagcgaaaauaaccgauauuauggaacccgaacaugcccuucucgcaacaaguauauuuaaacuuaccuaccaaaauaagguaguucgaguccaacgaccagccaaaaaugguacugugauggacgugauauccaggcgcgaccaaagagggagugggcaagucggaacauaugggcuaaauacguuuacaaacauggaaguacaacuuauuagacagauggagagcgaaggcauauuccuuccaagugagcucgaaacaccaaacuuggcaaagcgaguauuagauuggcuagaaaagcauggagcagaacgacugaaaagaauggccauauccggugaugauugcgugguaaaaccaauugacgaucguuucgcuacugcgcuuacggccuuaaaugacauggggaagguuagaaaagauauaccacaaugggaaccuagcaaaggauggaacgacuggcaacagguuccguucugcagucaccacuuucaucaauuaaucaugaaagacggcagagaaauaguaguaccuugccgaaaucaggaugagcugguagggcgagcuaggguaucacaaggugcuggcuggaguuuacgugaaacagcauguuuagguaaaagcuacgcccaaauguggcagcucauguauuuccacagacgggaccuacgucucgccgcuaaugcgauauguuccgcuguacccgucgacuggguaccuacaucgaggacuacauggaguauacacgcacaucaucaguggaugacuacagaggauaugcuaucuguauggaauagaguauggauagaagaaaaccccuggauggaggauaagacacacgucagcucaugggaagaaguucccuauuuagggaagagagaagaccaauggugugguuccuuaauaggauuaacagcgagagcgacaugggcaacaaauauacagguugccauaaaccagguaaggagacuaauagguaacgaaaacuauuuagauuacaugaccucaaugaaacgguuuaaaaaugaaagugaucccgaaggagcuuuaugguag

SEQ ID NO: 21298 - RNA, 9879 nt, Artificial Sequence
  derived and/or modified CDS sequence (opt6) from DENV-1__EU482618__SS-prME
aguguuacaauguuauuaauguuacuuccuacagcgcucgcauuccaccuaacaacuagagguggugaaccacacaugauagucaguaaacaagaaagaggaaagucccuguuauucaagaccagcgcaggaguuaacauguguacauugauagcaauggaccuaggagaacuuugugaagauacaaugacuuauaaguguccccaaauaacggaagcggaaccagaugauguggacugcuggugcaacgcuacugauacuugggucacuuacgguaccuguucucaaaccggugaacauaggagagacaaacgcucugucgcauuagcgccacauguuggucuaggacucgaaacacguacagaaacuuggauguccagugaaggugccuggaaacaaauacaaagagucgaaacuugggcgcuccgccauccggguuucacaguaauagcguuauuccuagcccaugccauagggacuucaauuacgcaaaaagguauaauauuuauucuacugauguuaguuacucccagcauggccaugagauguguaggaauagggaacagggacuuugucgaagguuuaagcggugcaacuugggucgaugugguauuagaacaugguuccugcguaacaacaauggccaagaauaaaccgacuuuagauauagaauuacucaaaacugaaguaacaaauccagcgauauuaagaaaguuaugcauagaagcuaagaucagcaacacuacuaccgacaguagguguccgacgcaaggugaggcaacauuaguagaggagcaggacgcaaauuucguuugcagacgaacguuuguggaccgcggauggggaaauggauguggacuuuuuggaaaaggaucacuacuaaccugcgccaaauuuaaauguguaacaaaauuagaaggcaaaauagugcaauacgagaacuuaaaguauucggucauaguaacuguccauacaggugaucaacaccaaguagguaacgaaaccacggaacauggaacaaucgcaaccauuaccccacaagcgccaacaagugaaauacaacuaacagauuauggagcacuaacacuggauuguucacccaggacaggauuagauuuuaacgaaauggugcuacuaacuaugaaagagaaaagcuggcuaguacauaaacaaugguuccuugauuuaccuuuaccuuggacuucaggugcaucuacaucacaagaaaccuggaaccgucaagauuugcuugucacguuuaaaacagcucaugccaagaaacaagaagucguuguauuagggagccaagagggcgccaugcauacugcucuaacaggcgcaacagaaauucaaacgucgggaacaacaacuauuuucgcugggcaccugaaauguagacuaaaaauggauaaauuaacucuaaaagggacgucguacgucaugugcacggguagcuuuaaacuggaaaaggaagucgccgaaacacaacacggaacuguccuuguacaagugaaauaugaaggaacugaugcuccauguaaaaucccauuuaguacccaagacgaaaaagggguaacccaaaauggaagacuuauaaccgcgaaccccaucgugacugauaaagaaaagccagucaacauagaaacggaacccccguuuggagaaucauacauaguagucggagcaggagaaaaagcacuuaaauugucaugguuuaagaaaggaucaucuauuggaaagauguuugaggcaacggccagaggagcacgaaggauggcgauccuaggugauacugcuugggacuuuggaaguaucggaggagucuucacgagcgugggaaaacucguacaucagguuuucgguacugcuuacggaguucuuuuuagcggaguaagcuggaccaugaaaauaggaauaggcauauuauuaacuuggcuuggcuuaaacucucgaucuacaucacucaguaugacguguauugcggucgguaugguuacguuauaucuagguguaaugguucaggcagauaguggcugcguaauaaauuggaaaggacgugaguuaaagugugggaguggaauauuuguuaccaacgaaguucauacauggacggaacaauacaaauuccaagcugacucuccaaaaagauuaagugcugcuauaggcaaagcaugggaggaagguguaugugguauaagaucggcaacgagacuugaaaacaucauguggaagcagauuaguaacgaacuaaaucacauuuuauuagagaaugacaugaaauuuacaguuguaguuggagacgccaauggcauauuagcccaggguaagaaaaugauucgaccccagccgauggaacacaaguauagcuggaaaagcuggggcaaagcgaaaauaauuggagccgauauccaaaacacaaccuucauaauugauggucccgacacaccugaaugcccagauaaccaaagggcauggaauauuugggaaguagaagauuauggauuugggauuuuuacuacgaacauauggcuaaagcuccgagauaguuacacgcaaaugugugaccaucgucuaaugagcgcugcgauaaaggacucaaaagccguacaugccgauaugggauauuggauagaaagugaaaagaaugagaccuggaagcuagcaagggccagcuuuauagaaguaaagacaugcaccuggccgaaaagucacacacuauggaguaauggcguccuagagucagaaaugaucauuccgaagaucuacggagguccuauaagccagcauaauuaucgaccggguuauuuuacccaaacugcuggcccuuggcaucuuggaaaacuugaauuagauuuugaucuaugugaaggaacgacugucguuguugaugaacacugcgggaaccgggguccuagucuacgcacaacaacaguaaccggaaaaauaauucaugaauggugcugccguagcugcacuuuaccaccuuuaagguuucgaggugaagauggguguugguauggaauggaaauaagaccggugaaagaaaaggaagagaaccugguccguucuaugguuucggcaggaaguggugaaguagauagcuucaguuugggcaucuugugugcuuccauaaugauugaagaggucaugaggucaagauggucacgaaaaaugcuaaugacaggaacucuagcaguguuccuccuacucauuaugggacagcugacuuggaacgaccuuaucaggcuuuguauuaugguuggagcgaaugcuucggacagaaugggaauggguacuacuuacuuagcgcucauggcuacauucaagaugagaccaauguuugcaguaggacuauuguuccgacgcuugacgucccgagaaguauuacuacugacaauagguuuaagccuaguagccucgguagaauugcccaacagccuggaggaacugggagaugggcuugcgauggggaucaugauguuaaaguuacugaccgaauuucaaccucaucaauuauggacuacuuuguuauccuugacauuuaucaaaacaacuuugagccuagauuacgcauggaaaacaacagcuauggcucuaaguauaguaucauuauucccacucugcuugagcacgacaucccagaaaaccaccuggcugccaguacuauuagggucauuuggcuguaaaccguugacuauguucuuaauuaccgaaaacaaaauauggggucggaaaucauggcccuuaaacgaaggaauuauggccaucggaauuguuucaauucuacuguccucuuuacuuaagaaugauguaccuuuagcugguccauuaauugcaggagggauguuaauagcaugcuacgugauaaguggaucuuccgcagauuuaucucuggagaaagcagccgaaguuagcugggagcaagaagcagaacauuccgggacaagucacaacauccuaguagaaguacaagaugauggaacaaugaaaauaaaagaugaagaacgcgacgauacauugacuaucuuauugaaagcaacauugcucgcgguauccgggguuuacccaauguccaucccggcaacucuauuuguaugguauuuuuggcagaaaaagaaacaacgauccggaguacuaugggauaccccauccccucccgaagucgaacgagccguucuagaugaugguauauauagaauacuucagagagggcuuuugggacgaucccagguaggcguugggguuuuccaggacggaguauuucauacaauguggcaugucacgagaggugcugugcugauguaucaaggaaaaagacucgaaccaagcugggcgagcgugaaaaaggauuuaauaucauacggcggggguuggagguuccaaggcaguuggaacacaggagaagaagugcaaguaauagccguagaaccggggaagaacccgaagaauguucaaacuacaccagguacguuuaaaacaccugaaggggaaguuggugcgauagcuuuggacuucaaaccuggaacaucugggagcccaauugucaacagagaggguaagauuguaggguuguauggaaacggcguaguaacaacgagugggacauacgugucugcuauagcacaggcaaaggccagccaagaagguccacuaccagaaauagaagacgaggucuuuaagaaacgcaauuuaacuaucauggaucugcacccggguagcggaaaaacaagaagguacuuacccgccaucguccgggaagcuaucaaacgaaaacuucguaccuugauauuagcgccaacaaggguagucgcaagcgaaauggcggaagccuuaaaagguaugccaauaagauaucaaacaacugccgucaaaagugaacauacuggacgagaaauaguugaucugaugugucacgcaacuuuuacgaugagauuacugucgcccguacgugucccuaauuacaacaugaucauaauggaugaggcucauuucacagauccggccucaaucgcagcgagaggcuauaucucuacaagagugggcaugggugaagccgcagcgauauuuaugacagccacaccacccggaucgguugaagccuuuccgcaauccaacgccguuauacaagaugaagagagagauauaccagaaagaucauggaauaguggauaugacuggauaaccgacuucccagguaaaacuguaugguucguaccaaguauuaaaagcggaaacgacauagcaaauugucuaaggaaaaacggaaaaagagucauucaacuuagcagaaagaccuuugauacugaauaccagaaaaccaaaaauaaugacugggauuacgugguaaccacggauauaucagagaugggugcuaauuuuagagcagaucgugucauugauccucguaggugccuuaaaccggugaucuuaaaggacggaccugagcgaguuauauuagcggggccgaugccuguuacuguugcgucggcggcucaacgcaggggaaggauaggaagaaaccagaauaaagaaggcgaccaauacguuuacauggggcaaccgcugaauaaugaugaagaucaugcucacuggacugaagcaaaaauguuacuagacaacauaaauacuccugaggggauuauuccggccuuguuugaaccagaacgggagaaaucagcugccauugacggagaauaucgucuacggggugaagcucgaaaaacauuuguggaacucaugcggcgaggugaucugcccgugugguuaucauauaaaguagcuucugaaggauuucaguacucugauagaagaugguguuuugacggagagcggaacaaucagguauuagaggaaaacauggauguugaaauuuggacuaaagaaggggaaagaaagaaauuacgcccuaggugguuagacgcgcgaacguauagcgacccguuggcauuaagggaguucaaagaguuugcagcugguagaagguccguauccggcgacuugauucuagaaauaggaaaacuuccccaacaccuaacuuuaagagcucagaaugcccuugacaaucuuguuauguuacauaacagugaacaaggaggaaaggcuuauaggcacgcgauggaagaacuaccagauacaaucgaaacucuuauguuauuggcccugauugcaguuuugacgggaggagugacucucuucuuucucaguggcaaaggacuagggaagacaagcauaggccuucuauguguuacagcuaguagcgcucugcucuggauggcaucaguagagccucauuggauugccgcaaguauuauccuagaguucuuccucaugguccuauuaaucccagaaccggacagacaaagaacaccucaagauaaccaacuggcauaugucgucauagguuuauuguuuaugauccuaacaguagcagcaaacgaaaugggacuauuagaaacuacuaagaaagauuugggaaucggucacgucgcugcagaaaaucaccaacaugcaacuaugcuggauguugauuugaggccugcgagcgcauggacauuauacgccguggcaacaacaguaauaacuccgaugaugaggcacacaauugagaauacaacagcaaacauaucauuaacagcaauagcgaaucaagcugcaauacuuaugggacuugacaaaggauggccaaucaguaaaauggauauaggugugccacuucuggcccuugguuguuauucgcagguaaauccccugacacuaacagcggcaguauuaaugcucguugcacacuaugcaauaauagggcccgguuugcaggcaaaagcuacaagagaagcucaaaaacgaacggcugcuggcauuaugaaaaauccaacaguagacgggauaguagcaauugauuuggauccaguggucuaugaugcaaaauuugaaaaacaauugggacaaauaaugcuuuugauccuauguacuagccaaauacucuugaugcggacgacaugggcacugugcgaaucaauaacucuagccacgggcccgcuuacuacauuaugggaagguuccccuggcaaauuuuggaauacuaccauagcgguuuccauggcuaauauauuuaggggcucguauuuggcaggggcuggauuagcauuuaguuuaaugaaaaguuuaggaggaggucgaagaggcacaggugcucaaggugaaacgcuaggugaaaaauggaaaaggcagcuuaaccaacuuaguaaaucggaauuuaacaccuacaaaagaucugguauuauggaaguugauagaagcgaagcgaaagagggacuuaaaagaggagaaacaacuaaacacgcagucagccgaggaaccgcgaaauuacguugguucguggaacgaaaucuugucaaacccgagggaaaggugauugaccucgguugcggccgaggaggauggucauauuauugcgcaggauugaagaaaguaacagaagucaagggauauacaaagggaggcccaggucaugaggaaccaauaccaauggcaacuuauggauggaaccuaguuaagcugcauucaggcaaggauguuuucuucaugccaccggagaaaugugacacauugcucugcgacauaggggaaagcucaccuaacccaacaauagaagaaggaagaacccuaagaguuuuaaaaaugguagagcccugguuacgcgggaaccaauuuugcauaaaaauacuaaauccauauaugccuucaguuguagaaacuuuagaacagaugcaacgaaaacauggcgggaugcuuguucggaacccuuugagcagaaacuccacacaugaaauguacugggucucaugcggcaccggaaauauaguaagcgcagucaacaugaccagcaggaugcugcuaaauagguucacuauggcgcauagaaaacccacuuacgaaagggauguugaucuaggagcagguacaagacaugucgcgguugaaccggaaguagcaaaccuggacauuauaggacaacggauagaaaauauuaagaaugaacacaagagcacauggcauuaugacgaagauaacccauauaaaacgugggcauaucacggguccuacgaagucaaaccaagcggcucugccucaaguaugguaaacgguguaguucgacucuuaacgaaaccaugggacguaauaccaaugguaacacaaauagccaugacagauacaacaccuuuuggccagcaacgaguguuuaaagagaagguagacacacguacaccuagagcuaagcgagggacaacacaaaucauggaagucacagcaaaguggcuguggggauuuuugucaaggaacaagaaaccacgaauauguacaagagaagaauuuacacgcaaagucagaaguaacgcugcaaucggagcuguguucgucgaugagaaucaauggaacagcgcaaaagaagcaguagaggaugaaagauuuugggaucuaguacaccgugaacgugaguuacacaaacagggaaagugugccacuugcguauauaacaugauggguaagcgugagaagaaacuaggagaguucgguaaggcaaaaggaucacgcgcgaucugguauauguggcuaggugcaagauuucuggaguucgaagcauuggguuuuaugaacgaggaucauugguucagcagggaaaauucacucucagguguagaaggugaagguuuacauaaacugggcuauauucuucgagacauaucaaaaauuccuggaggcaacauguacgcugacgauacagccggaugggauacaagaaucacagaagaugacuugcagaacgaagcuaagauaaccgacauaauggaaccugaacacgcucuccucgcaaccucaauauucaaguuaaccuaucagaauaaaguuguucgaguacaaaggccugcaaagaauggaacagugauggacguuauaucaagacgagaucaaagagguucaggacaaguuggaacauauggcuugaauacauucaccaacauggaaguacaguuaauaaggcaaauggaaucggaagggauauuuuugccaagcgaauuagaaacuccaaacuuagcagaacguguuuuggacuggcuugagaagcauggagcugagcgguuaaagaggauggccauaaguggagaugauuguguggucaaaccgauagacgaucguuuugcaaccgcucugacagcguugaacgacauggggaaaguacgcaaagauauaccucaaugggagcccaguaagggauggaaugauuggcaacagguaccauucugcucacaucacuuucaccagcucauaaugaaagacggacgcgagaucguaguuccaugccggaaucaagaugaacugguaggcagagcacgugugucucaaggagcgggauggucauuacgcgaaacugccugucuugggaaaucauacgcacaaauguggcaauuaauguacuuccaucggcgggaucuacgcuuggccgccaaugcaauauguucagcugucccgguagacugggucccuacaucaagaacaacuuggaguauacaugcacaucaucaauggaugacgacugaggauauguuguccguguggaauagaguauggauagaggaaaacccguggauggaagauaaaacacauguaucaaguugggaagaagugccauauuuaggaaaacgcgaagaucaaugguguggcagcuuaauaggacuaacagcaagggcuacaugggcaacuaauauucaaguggcaauaaaucaaguucgacgguuaauagggaaugagaacuauuuagauuauaugacuucaaugaaacgcuuuaagaacgaaucagacccagaaggcgcucuaugguaa

SEQ ID NO: 21299 - RNA, 9879 nt, Artificial Sequence
  derived and/or modified CDS sequence (opt6) from DENV-1__EU482619__SS-prME
uccguaacuaugcuacucaugcuucuuccaaccgcacucgcguuucauuuaacuaccagagggggugaaccacacaugaucguauccaaacaagaacgagggaaaaguuuauuauucaaaacuuccgcuggagugaauauguguacucugaucgcuauggaucucggagagcuaugcgaggacacaaugacauacaaauguccgcaaauaacugaagcagaaccagaugacgucgauuguuggugcaaugccaccgacacauggguuacauacggcacauguucacaaacaggcgaacaucgacgagauaaacgaagcguugcauuagcaccucacguaggacuagguuuagaaacgcgaacugaaacuuggauguccuccgaaggggcguggaaacaaauacaaaggguagaaaccugggcauuaaggcauccugguuucacaguaauagcacuguuccucgcacacgcgauugguacauccauaacucaaaaagguaucaucuuuauuuuauugaugcuuguuacaccuucaauggcuaugcguugcguagguaucggaaaucgcgacuucgucgagggacugucaggcgcuaccuggguagaugugguuuuggaacauggaucuuguguaacaacaauggccaaaaauaaaccaacacuagacauagaacugcuaaaaacugaagucacaaauccugcaauacuacgaaaauuauguauagaggccaagauaaguaauacaacaacugauucaaggugcccgacccaaggcgaagcgacucuaguagaagaacaagacgcuaacuucguauguagacguacuuuuguugaccgcggcugggguaacggguguggauuguuugguaaagguagucuguuaacgugcgcuaaauuuaagugcguuacaaaacuagaaggaaaaauaguucaauaugaaaaucuuaaauacagugucauagucacugugcauacuggugaucaacaccagguaggcaacgaaacgacugaacauggaacuauagccaccauuacaccacaagcuccaaccagugagauacagcuaacagacuacggagcauuaacucucgauugcaguccgaggacaggauuggacuuuaaugagaugguacuuuuaacuaugaaagagaaaaguuggcuaguacauaagcaaugguuccuagaucuaccauuaccuuggacaagcggugcgucaaccagccaagaaacuuggaaucggcaagaucuccuuguaaccuuuaaaacagcacaugcuaagaaacaagaagucguuguauuagggucucaagaaggcgcgaugcacacagcacuuacaggagccacggaaauccaaacuucgggaacuacaacaauuuucgcuggucauuugaaaugucgccuaaagauggauaagcuaacucuaaagggaacuagcuacguaaugugcacaggaucuuuuaaauuggagaaagaaguagcggaaacacaacacgguacaguucuaguacagguaaaauacgaaggaacagacgcaccaugcaaaaucccauucagcacacaagaugaaaaaggugugacacagaacggcagacucaucacggcaaacccaauuguaacagacaaagaaaaacccgucaacaucgaaacagaaccuccuuucggagagaguuacauuguggugggcgccggagagaaagccuuaaaacuauccugguuuaagaaaggaaguagcauagguaaaauguuugaagcgacagcacgaggugccagaagaauggccauuuuaggugauaccgccugggacuucggcucaauugguggcguauucacuucaguugguaaauuaguucaucaaguuuucggaacugcguauggaguccuauuuucaggagugucauggacaaugaagaucggaauagguauauuacuaacguggcugggcuuaaacagccguaguacaucuuugaguaugacauguaucgcuguuggaauggucacucuauauuuaggugucaugguacaagcagauuccgguuguguuauaaauuggaaagguagagaauugaaaugcggaaguggaauuuuugucaccaacgaggugcauacauggacagaacaguacaaguuucaagcggauaguccgaagagguuaagugccgcaaucggcaaagcaugggaggaaggaguuugcgguauccguagugcaacucgacuagaaaauauaauguggaagcaaaucaguaacgaacucaaucauauuuuauuagaaaacgauaugaaauuuacaguggucguuggugaugcaaauggaauacuagcacaggguaagaaaaugaucagaccccagccgauggaacauaaauauucuuggaagucauggggaaaagcuaagauuauaggagcugauauacaaaacacuacauucauaauugauggaccggacacaccagaaugcccggauaaucagcgcgcuuggaauauaugggagguggaagauuacgguuuugggauauuuacgacaaacauuuggcucaaauuaagagauagcuauacacaaaugugugaccauagauuaaugucugcugccauaaaggacucaaaagcagugcacgcagacaugggcuacuggauagagucagagaaaaaugaaaccuggaagcuagcucgcgccaguuucauagaagugaaaacuuguacguggccgaagucccacacccuaugguccaauggcgugcuagagucggaaaugauuauaccaaaaauauacggcgguccuaucagccaacauaauuaucguccagguuauuucacccaaaccgcagguccauggcacuuggggaaacuggaacuugauuuugacuuaugugaaggaacgacaguaguagucgacgaacauuguggaaaucgugguccaucuuugagaacaaccaccgucacuggaaaaauuauacaugaaugguguuguagaucuuguacguuaccaccacuacgauucagaggagaagauggauguugguauggaauggagaucaggccgguaaaagaaaaggaggaaaaucuaguaagaucgaugguaucugcaggguccggagaaguagauaguuuuagucuaggcaucuuaugugcuucuauuaugauugaagagguuaugcgaaguagauggagccguaaaauguuaaugacaggcacuuuagcuguauuuuugcuuuuaauaauggggcaacuaaccuggaaugauuuaauaagauuauguauuauggucggagcaaacgcaucagaccgcauggggaugggaacaaccuaccuugcccuuauggcaacauucaaaaugcgaccaauguuugcaguaggauuacuauuuagacgucucacuucccgagagguucuucuucuuaccauuggucuuuccuuaguggcaucaguagaacuccccaauucacuagaggagcuuggagauggucuugcaaugggaauaaugaugcucaaauuacucacagaguuccaaccucaccagcuuuggacuaccuuauuaucucuaacauuuauaaaaacaacauuaaguuuagacuaugccuggaaaacaacagcuauggcccuguccauagucaguuuauucccucucugccucucuacaacaagucagaaaacgacguggcugccaguauuguuaggaaguuucgggugcaaaccucuuacaauguuuuuaaucacagaaaauaaaauauggggacgaaagagcuggccucuuaacgaggguauaauggcaaucgggauugugucaauauuacuaucaucauugcuuaaaaaugacgugccucucgcaggaccacuuauugcuggugguauguuaauugcaugcuacguaauaagcggcagcagugcagacuugaguuuagaaaaagccgccgaaguauccugggaacaagaggcggaacacaguggcacaucacacaacauucuggucgaaguucaggaugaugggacuaugaagauaaaagacgaagaacgcgaugauacacuaacuauucuuuuaaaagcaacguuacuugcuguguccggaguuuaucccaugaguauuccagcuacuuuauuuguuugguauuuuuggcagaagaagaaacaaagaaguggcgugcuaugggacacaccaucaccuccggagguagaaagagcagugcucgacgaugguauauauagaauccuccagcgaggacuucuuggaaggagucaggucggcguugguguauuucaggauggaguguuucacaccauguggcacguaacacgcggagcuguuuuaauguaucaaggaaaaagauuggaaccuucuugggcaucugucaagaaagaccuaauaucauacgggggaggauggagguuucaagggucguggaauacaggcgaggaggugcaagugauugccguggaaccuggcaaaaaccccaaaaauguacaaaccacccccggaacauuuaaaacaccagaaggugaaguaggugcaauugcucuugacuucaaaccagguacaucaggaucucccauugugaaucgagaagggaaaauaguaggucuauacggaaauggcguuguaacaacauccgggaccuaugugucagccauugcacaagcaaaggcaucccaagaagggccgcucccagagauagaagaugaaguauuuaagaaacgcaaccugacaaucauggaccuacauccaggaucaggaaaaacgcggcgauaccuaccagcaauuguacgcgaagcuauaaaaagaaaacuacggacucuaauccucgcaccaaccagaguugucgcaagugaaauggcagaggcauuaaaagguaugcccauaagauaucagacgacagccgugaaaucggaacauacggggagagaaauaguugaccugaugugucaugcaacuuucacuaugcguuuacugucaccgguuagaguacccaauuacaauaugauaauuauggaugaggcacacuuuaccgacccagccucuauagcagcuagagguuauaucucuaccaggguggggaugggcgaagccgcagcuauauucaugacugcaacuccuccaggaucgguagaggcuuuuccucagucaaacgcuguuauacaagaugaagaaagggauauuccggaaagaagcuggaacucuggauaugauuggauuacagauuuuccagguaaaacgguuugguuugugcccucuauaaagucaggcaaugauauugccaacugcuuacggaaaaacggcaaacguguuauacagcuaucaagaaaaacuuuugacacagaguaucagaaaacuaaaaacaaugauugggacuauguugugacaacagauaucagugaaaugggggcaaacuuuagagcagacagaguuauagacccaagaaggugccucaaaccagucauuuugaaagacggaccagaaagggugauacuugcggggccgaugccgguaacuguagcuucagcagcgcaaaggagaggccgaauuggccgaaaucagaauaaggaaggcgaccaguauguauacaugggucaaccauuaaauaaugacgaagaccaugcacacuggacugaagccaagaugcuacuugauaauauaaauacaccagaaggcauuauacccgcuuuauucgagccagaacgcgagaaaagugcagccauagauggggaauauagauuacguggagaagcaagaaagacuuuuguagagcugaugcgaagaggugaucuaccagucugguuaaguuauaagguugcauccgaaggauuucaauacucugauagacgauggugcuucgauggagagagaaauaaucagguuuuagaagaaaauauggauguggagauuuggacuaaagaaggagaacgaaagaaguuacguccgaggugguuagaugcuagaaccuauagugauccucuagcacuacgcgaauuuaaggaauuugcugcugguagacgguccgucaguggagaucuaauauuagaaauagguaaacuuccccagcauuugacguuaagagcgcagaaugcccuugacaacuuagucauguugcauaacucugaacaaggaggaaaagccuaccgacacgcaauggaggaacuaccagacacuauagaaacacucauguugcuugcacugaucgccguacuuacaggcgguguuacccucuucuuuuuauccggcaaaggcuuagguaaaacuagcauuggguuacuaugcguaacagcaucuucagcccuguuguggauggccagcguagagccgcauuggauugccgcaucaauuauacuagaguucuuuuuaauggucuuacuaauaccggaacccgaccggcaaaggacgccacaggauaaccaguuagccuaugucguuauaggauuauuauuuaugaucuugaccguagccgcaaaugaaauggguuuacuagaaacuacuaagaaagaccuagguauagggcacguagcugccgaaaaucaccaacacgcgacgauguuagacgucgaucuuagaccugcaagcgccuggacauuguacgccguggcaacuacaguuauuacgccuaugaugcgacauacaaucgaaaauacaacggccaauauuucacuuacugcuauagcaaaucaggcggcuauucuuauggguuuagacaaagguuggccuauuaguaaaauggauauaggugucccacuccucgcccuuggauguuacagucaagucaauccccuuacucuaaccgccgcugucuugauguuagucgcucauuaugcuauaaucggaccuggauuacaagccaaagcuacacgagaagcacaaaagagaacugcagcgggaauaaugaagaacccaacaguggaugguauaguagccauugaucuagacccagucgucuacgacgccaaauucgaaaaacagcugggccagauaaugcucuugauacuaugcacgucucaaauucuauuaaugcgaacgacgugggcacucugugagaguauuacucuagcgacagguccgcugacaaccuuaugggaagguagcccgggaaaauucuggaacacgacuauagcuguuagcauggcaaauauauuccguggcaguuaccucgcuggagcuggguuagccuuuucccuuaugaaaaguuugggaggggguaggcguggaaccggugcccaaggugaaacauugggugaaaaauggaagagacaauuaaaucaacuauccaagucagaauuuaauacuuauaaacguuccgggauuauggaaguagauagaagcgaagcgaaggagggacuaaagagaggagagacaacaaaacacgcggucucuaggggaacagcaaaauuacguugguuugucgaacguaaucuaguaaaaccugagggaaaaguaauagaucucggauguggacgcggaggguggucguacuauugugcaggauuaaagaaaguaacagaaguaaaagguuauacaaaaggaggaccaggucaugaagaaccaauuccuauggccacauaugguuggaacuuagucaaacuccauucgggaaaagauguauucuuuaugccucccgaaaaaugugacaccuuauuaugugacauaggagaaucaucgccaaauccaacaauugaagaaggaagaacauuacggguacucaagaugguugaacccugguuacgagggaaccaguucuguauaaaaauacuaaauccauacaugccaagcgucguugaaacauuggagcaaaugcaacggaagcauggagggauguugguacgaaauccucuaucgcguaauagcacacacgaaauguauuggguaucgugcggcacgggaaauauuguauccgccguuaacaugaccucuaggauguugcucaaccgguuuacuauggcgcauagaaagccuacuuaugaacgcgacguagaccuuggcgcagggacaagacauguugcaguggaacccgaaguggcaaacuuagauauaaucggucagaggaucgaaaacauuaagaaugaacacaaaucaacauggcauuacgacgaagacaaucccuauaagacaugggcuuaccaugguuccuaugagguaaaaccauccgguucugcgaguucgaugguaaaugguguaguuagauugcuaacgaaaccgugggauguaaucccuaugguaacgcaaauugcuaugacagacacuacuccauuuggucaacaaagaguuuucaaggaaaaaguagauaccagaacacccagggcuaagaggggaaccacacaaauuauggaggucacggcuaaauggcuguggggguuucuaagcagaaauaagaaaccaagaauauguacuagagaggaguucacaagaaaagugagaucuaacgcagcaauaggggcgguauuuauugaugaaaaucaguggaacucugcaaaagaagcgguagaagacgaaagauuuugggacuugguacaccgugaaagagaauuacauaagcaagguaaaugugcaacauguguauacaacaugauggguaaaagagaaaagaaguuaggcgaguucgguaaagcaaagggaaguagagcaauaugguauauguggcuaggagcuagguuccuugaguuugaagcguuaggauucaugaaugaggaucauugguucucaagagaaaauagcuuaagcgggguggaaggagagggccuucacaaauuggguuauauccuacgagauauaucaaaaaucccagguggaaacauguacgcugacgauacugcuggaugggacacaagaguaacugaggacgauuuacaaaacgaggcuaaaauaacugauauaauggaaccugaacacgcacugcuagcuacaagcaucuuuaaacuaaccuaucaaaacaaaguaguaagaguccaaaggccugccaagaauggaacuguuauggauguaauaaguagaagagaucagcgugguuccggccagguugguacauauggcuuaaacacuuuuacuaauauggaaguccaacuaauccgacaaauggagagcgaaggaauauuuuuaccuucagagcuagaaacaccgaaccucgcugaaagaguauuagacugguuggaaaaacauggugcagaaagauuaagaagaauggcaauuucaggcgacgacuguguuguuaaaccgauagaugacagauuugcaacugcccuuacugcucuaaaugauauggguaaaguacgaaaagauaucccacagugggagccgaguaagggcuggaaugauuggcaacaagugccauucuguucacaucacuuucaucaauuaaucaugaaagacggacgugagauagucgugccaugcaggaaccaagacgaauuggugggucgagcacggguuucccaaggugcaggcuggucacucagagaaacagcgugccuggggaaaaguuacgcacaaauguggcagcugauguauuuucaccgucgggaccuucggcuagcugcuaaugcuauauguagcgcaguuccaguagacugggugccaacaaguagaacuacguggucuauacacgcgcaucaucaauggaugaccacggaagauauguuaucuguauggaaucgaguauggauugaagaaaacccauggauggaagacaagacccacgugucaucaugggaagagguaccuuacuuaggcaaaagagaagaccaguggugugggagucucaucggucuaacugcaagggcgacgugggcuacuaauauacaaguagcuaucaaucagguuagaagacuaauagguaaugagaacuaucuugacuauaugacaucaaugaagagguuuaagaaugaaucugauccugaaggcgcacucugguaa

SEQ ID NO: 21300 - RNA, 9879 nt, Artificial Sequence
  derived and/or modified CDS sequence (opt6) from DENV-1__FJ898433__SS-prME
agcguaacaauguuacuaauguuacuaccgacagcacucgcauuucaucuuacaacuagaggaggggaaccacauaugauaguaaguaaacaagaaagagguaaaucacuccucuuuaaaacaagugccgguguaaauaugugcacacuuauagccauggaccucggcgaacucugcgaggacacaaugacauacaaauguccccaaauaaccgaagccgagccggaugauguagacuguuggugcaacgcaacugauacaugggugacauaugggacuugcucucagacaggugaacaccgacgagagaaacgaagcguggcguuagcuccucaugucggacuuggccuugaaacacgaacggagaccuggaugagcucugaaggagccuggaagcaaauacaacguguagaaaccugggcauugcggcauccuggauucaccguuacggcacuauuccuugcucaugccauaggaaccuccauuacgcagaaaggcauaauauucauacuacuuauguuaguuacuccuaguauggcaaugagauguguuggaauaggaaacagagauuuuguagaagguuuguccggagcgacguggguugacguaguauuagagcacggaucgugcguuacaacaauggcuaaaaauaaaccgaccuuagauauugaacucuugaaaacugaggugacgaauccagccauauuacgaaaacuauguauugaggcgaaaauuucuaacaccacaacggacagcagauguccgacucaaggggaggcaacauuaguugaggaacaagaugcgaauuuuguuuguagacgaaccuuugucgauagagggugggguaacgguuguggucuuuuuggcaaagguucucuacuaacgugugcaaaauucaaaugcgugaccaaauuagaaggaaaaauaguucaauaugaaaaucuuaaauacucagucauaguaaccguucauacaggagaucagcaucaaguaggaaacgaaacuacagaacacgguacaauagcuacgauuaccccucaagcgccgacaucggaaauccaauugacagauuauggugcacuaacauuagauugcucaccgaggaccggucuugauuuuaaugaaaugguauuacuuacuaugaaagaaaaaucauggcuaguacauaaacaaugguuccucgaucucccccugccguggacgagcggggcgagcacgucacaggagacauggaaucgacaggaccuacuuguaaccuuuaaaacggcacaugcgaagaaacaggaagucguaguacugggaagucaggaaggugcgaugcauaccgcacucacaggcgcgacugaaauacagacaaguggaaccacaacaaucuuugccggccaucuuaaaugccgguuaaaaauggauaaacuaaccuuaaaaggcacgaguuacguaauguguacgggaaguuuuaaauuagagaaagagguggcugaaacgcaacauggaacgguucuagugcaaguuaaauaugaagguacugaugcgccaugcaaaaucccauucagcacacaagacgagaagggaguaacgcaaaauggacgauuaauuacugcaaacccuauagucacggacaaggagaagccaguaaacauugagacugagccucccuuuggugaaucauacauuguaguaggugcaggagaaaaggccuuaaaacucuccugguucaagaaaggaaguuccauaggaaaaauguuugaagcgacagccagaggagcuagacggauggcuauccuaggagacacugccugggauuuuggaucaauaggugggguguuuacaaguguaggaaaacuugugcaucaaguauucgguacggcauauggggugcuauuuucuggggucucauggacuaugaaaauagguaucggaaucuuguuaacaugguugggucucaauagucggucaacuucauuaaguaugacuuguauagcaguaggaauggugacacuuuauuugggugucauggugcaggcagauucagggugugugaucaauuggaagggaagagaauuaaaaugcgguucaggaauauucgucacaaaugagguacauacauggacggaacaauauaaauuccaagcagacagucccaaaaggcugagcgcggccauaggcaaggcuugggaagaaggcgucugugguauucgaagugcaacgcggcucgaaaacauuauguggaaacagauuucaaaugaauuaaaucauauauuacucgaaaaugauaugaaauuuacaguaguagucggagaugccaaugggauccuagcacaggguaagaaaaugauacgcccacaaccaauggagcauaaauacuccuggaaaagcugggguaaggcuaaaaucauuggggcagauauacagaauacaacguuuauuauagacgguccugauacuccagagugucccgauaaccagagggcuuggaauauuugggaagucgaagauuacggauuuggaaucuuuaccacaaacaucuggcucaaauuaagagauucauacacgcaaaugugugaucaucgacugaugagugcagcaauaaaggacuccaaagcaguacacgcugauauggguuacuggauagaaucagagaaaaaugagacauggaaacuagcuagagcuaguuucauagaaguuaaaacauguacauggccgaaaagucacacacuaugguccaacggaguuuuagaguccgaaaugauaauaccuaagauauauggaggucccauuagucaacauaacuaucgaccaggauauuucacacagacugcuggacccuggcaucuugguaaacuggaauuggauuuugauagcugugaaggcacuaccguaguuguagaugaacauugcgggaaucggggaccuucauuaaggacuacuacgguaacuggaaaaaucauccaugagugguguugcaggaguuguacgcuacccccacucagauuuagaggagaagacggcuguugguauggaauggagauacgaccgguaaaagaaaaggaggagaacuugguaagaaguauggugagugcagggagcggagaaguugacucuuuuucuuuagguauauuaugcguaucaauaaugauugaagaaguaaugagaucccgcuggagcagaaagauguuaaugacaggcacucuugcgguauuuuugcuccuuauaaugggacaacuaacguggaaagaucucauaagacuauguauaaugguaggugcaaaugcaagugauaggauggggaugggaacaacuuaccucgcguuaauggcaacuuuuaaaaugcguccuauguuugcaguaggacuauuauuuagaaggcuaaccagucgugaaguucuguuacugacuauuggacugagccuuguagcaucagucgaacuuccaaauuccuuagaggaguuaggugauggucuugcgaugggaaucaugaugcugaaauuacugacagaauuucacccacaucagcuuuggacgacuuuauuaucccugacauuuaucaaaacgacucuaucucuagauuaugccuggaaaacgacugcaauggcacucucaauaguuucacuguucccucuuuguuugagcacgacuagccagaaaacuacgugguugccaguacuacuaggauccuucggauguaaaccccucacuauguuccugauuacagaaaauaaaauauggggccgaaaaucuuggccauuaaaugaaggaauuauggcaauaggcauuguaucaauacuucuaaguaguuugcugaaaaaugaugugccacuugcaggaccauugauugccgguggaaugcuaaucgcuugcuauguaauuagcggauccucugccgaucuuucacuagaaaaagcggcagaaguaaguugggaacaagaagcugaacauucaggaacuucccauaauauauuagucgaaguacaagacgauggaacuaugaaaaucaaggacgaagaacgugaugauacacucacuauacuuuuaaaagcuaccuuauuggcgguuagugggguuuauccaaugaguauaccagcaacccuguucgucugguauuuuuggcaaaagaagaaacaacguuccggugugcuuugggacacacccucaccacccgaaguagaaagagcaguacuggaugaugggaucuauaggauauuacaacgaggucuauuaggucgaucacaaguaggaguaggcguuuuccaggacgguguguuccauacaauguggcaugugacaagaggagcagucuugauguaucaggggaaacgacuagagccaaguugggcuagugucaagaaagaccuaauuagcuauggggguggguggcgguuucaggggucuuggaacacaggagaggaaguacaaguuauugcaguagaaccaggaaagaauccuaaaaauguacaaaccacuccaggaacauucaagacuccggagggggaagucggggcuauugcauuagauuucaaaccaggaaccucugggucuccaauaguaaaucgugagggcaaaauaguaggccuuuacggcaauggagucgugacaaccucaggcacguacgucucugcaauagcgcaggcaaaagcaucgcaagaaggcccucuacccgaaaucgaagaugaaguauuuaagaaacgaaaccucacuauaauggauuuacauccaggcagcggcaagacaaggcgguacuugccggcaauuguaagagaagcaauaaaaagaaaauuaagaacgcuaauacuugcaccgacccgcgugguagccagcgagauggcagaggcguuaaaaggaaugccaauuagauaucaaacuacagcaguaaagagugaacauaccggucgagaaauaguagaucuuaugugucacgccacguuuacuaugaggcuucucagucccgugcguguacccaacuauaacaugauuauaauggaugaagcacauuuuacggauccugccuccauugcagcgcgcggcuauaucucaacacgcguuggaaugggugaagccgcagcgauauucaugaccgcuacaccaccgggaucuguagaagcauuuccacaaucaaaugcugugauacaagacgaagaaagagauauuccagaaagaaguuggaauaguggguacgauuggauaacugauuuuccggguaaaacgguuugguucgugccauccauaaaaucgggcaacgauauagcaaacugcuugagaaagaauggaaagcgaguaauacaacucagcagaaaaacguucgauacagaauaucagaagacuaaaaauaaugacugggacuacguagugacgaccgauaucucagaaaugggcgcgaauuuuagagcugacagaguaauagauccaaggagaugccuaaaacccguuauacugaaagauggacccgaaaggguaauacucgcggguccaaugccuguaacugucgcuucagcugcgcagagaagagggagaauaggacggaaucaaaauaaggaaggcgaccaauacgucuacaugggacaaccuuugaauaaugacgaggaccacgcucacuggacagaggcgaaaaugcuguuagauaauauuaauacacccgagggaauuauaccagcacuuuucgaaccugaacgugagaagucugcugcuauugauggugaauauagauugagaggugaggcacgaaagacuuucgucgaacugaugcggagaggugaucuaccagucuggcuaaguuauaaaguugcgagcgaaggauuucaauacucagauaggaggugguguuucgacggugaaagaaacaaccaaguacuagaagaaaauauggauguagaaauauggaccaaagaaggugaaagaaagaaacuacgaccaagaugguuggacgcuaggacguauagugacccccuggcauuacgagaauuuaaagaauuugcggccgguaggcgcucaguuagcggcgauuuaauucucgagauaggcaaacuaccacaacauuuaacauugcgugcucaaaaugcauuagauaauuuggucaugcugcacaacucagaacaaggcgguaaggcuuacaggcaugcaauggaagaguugccggauacgaucgagacucugauguuauuagcacucauugcgguccuaacaggcggagugacguuauucuuuuuaagcggcaaagguuuaggaaaaacaaguauaggauuacuaugcgugacugcaagcagugcucucuuauggauggcuucaguagagccucauuggauugcugcaucaauaauauuagaguuuuucuugaugguuuuacucaucccagagccggauaggcaaagaacaccucaagacaaucaacuagcuuauguagucauaggacuuuuguucaugauacuaacuguggcugcgaaugaaaugggguuauuggaaaccaccaagaaagaccuagguauaggucacgucgcugcugagaaucaucaacaugccacaaugcucgacgucgauuugaggccagcaucugcauggaccuuauacgccguugccacuacaguuaucacuccaaugaugagacauaccauagagaacacaaccgcaaauaucaguuuaacugcuauugccaaccaagcagcaaucuugaugggauuagacaaaggauggccaauuucaaagauggacauaggcguaccacuuuuggcuuuaggauguuacucccaaguaaacccucuuacccugacagcagcuguguuaaugcugguagcccauuacgcuauaaucgguccaggauuacaagcgaaggcaacuagagaagcacaaaaacgcacggcagcuggaauaaugaaaaauccaacuguagauggcauugucgcuauagauuuggacccggugguauaugacgcuaaauucgaaaagcaauugggacagauuaugcuauuaaucuugugcacaucacaaauuuuauuaaugagaacaacuugggcauugugcgagucaauaacacuagcaacuggacccuugaccacucuaugggaaggaucgcccgguaaguuuuggaauacaacaauugcuguuucaauggcuaauauuuuuagaggaucuuaccuggcaggcgcaggucuagcauucagucuaaugaagagucuaggcggcgggcggcggggaacuggcgcacaaggagagacccucggugaaaaauggaaacgccaacugaaccagcuaagcaagagcgaauuuaauacuuauaaacgaucaggcauuauggaaguagaccguucagaagcgaaagagggauuaaaacgcggagaaacuacaaaacaugcaguguccagaggaacugcgaaauuaaggugguucguagaacgaaacuuagucaaacccgaagguaaaguuaucgaucuagguuguggaagaggaggguggagcuacuacugugcagguuugaaaaaggugacagaaguaaaaggauacacuaaaggcgguccuggacaugaagaaccaauacccauggcaacguauggauggaaucuuguuaagcuccacucaggaaaagauguuuucuuuaugccucccgaaaagugugauacguuauuaugugauauaggggaaaguucacccaacccaacgauagaagaaggacgcacacuaagaguuuugaaaaugguggagccuuggcugagaggcaaccaguuuugcaucaaaauacuuaaccccuacaugcccagugucguagaaacgcucgaacaaaugcagagaaaacauggaggaaugcugguaagaaaucccuugucaagaaacucaacacaugaaauguacugggugucgugugggacggguaauauagugucugcaguuaauaugacaucgagaaugcuuuuaaauagguuuacaauggcccaccggaagccuaccuacgaaaaggacguggacuuaggagcuggaaccaggcacguagcaguugaaccggagguugccaaucucgauaucauagggcaaagaauagagaacaucaaaaacgaacauaaaagcacuuggcauuacgacgaagauaacccauauaagacaugggcuuaccacggaaguuaugaaguuaaaccgagcggcucugcuagcucaaugguaaacgguguaguuaggcugcugacaaaaccgugggauguuauuccaaugguaacacaaauagcaaugacggauacgacaccauucggacagcagagggucuucaaagagaaaguagauacucguacacccagagcaaagagggguacaacacaaauuauggagguuacagcaaaauggcuauggggauuccugagccgcaauaagaaacccagaauuuguaccagggaggaauuuaccaggaaaguuagaucuaaugcagcgauuggugcugucuucguagaugaaaaucaauggaacucagccaaagaggcuguagaagaugaaagauuuugggacuugguccacagagaacgcgaauuacauaaacaaggaaagugcgccacauguguauacaauaugauggguaaaagagaaaagaaacuuggggaauuuggaaaggcaaaggguucgcgagcuaucugguauaugugguuaggugccagauuucucgaguucgaagcacuggguuuuaugaaugaagaccacugguucucucgugaaaacaguuugaguggaguggaaggcgaagguuuacauaaacuuggguauauauuacgcgacauaagcaagauaccaggaggaaauauguacgcggaugacacugcaggaugggauacucgaauuacggaagaugaccuucagaaugaagccaaaauaacagacauuauggaaccagagcacgcucuauuagcaacuucaauauuuaaacuuacuuaccagaacaaagugguccgagugcaacgaccggccaaaaauggcaccguaauggaugucauaucaaggagagaucagagggggaguggacaaguugggacauacgguuuaaacacguuuacuaauauggaaguccaacuaauaagacagauggaaucagaggggauauuucuaccaucugaacuagaaacaccaaauuuggcggaaagaguucuagauuggcucggaaaacacggcgcggaacggcuaaaacggauggcaauaucuggagaugacuguguaguuaaaccaaucgaugaucguuucgcgacggcucuaacagcguuaaacgacauggguaagguacguaaagacauaccacagugggaaccguccaaaggcuggaacgacuggcaacaagucccauuuuguagccaccacuuccaccaauuaauuaugaaagauggaagagaaauaguagugccauguagaaaccaagaugaauuagucgguagagcuagaguuucucaaggagcaggguggagccucaaggaaacagcgugucuaggaaagucguacgcccaaauguggcaauugauguacuuucacagaagagaucuaagacuggcugcuaaugcaauauguagugcuguucccguagauuggguucccacaucaaggacaacauggucaauacaugcucaucaucaauggaugacuacagaagauauguuaucggucuggaacagaguguggauagaagaaaaucccuggauggaagacaaaacacauguaucaucaugggaggaggugcccuauuuagggaaacgagaggaccaauggugcgguagucucaucggccucacugccagagccacuugggcgacaaacauccagguugcaauuaaccaaguaagaaggcuaaucgggaaugagaauuaccuagacuacaugacuucgaugaaacgauuuaagaacgaaucugauccggaaggagcacuaugguaa

SEQ ID NO: 21301 - RNA, 9879 nt, Artificial Sequence
  derived and/or modified CDS sequence (opt6) from DENV-1__FJ547088__SS-prME
aguguaacuaugcugcuaauguugcuaccaacagcguuagcauuucauuuaacaacacgaggaggagaaccccauaugauagucucuaaacaagaaagagggaaaagucuauuauuuaaaacgucagcaggagugaacauguguacacuaauagcuauggaucugggagaacuaugugaagacacuaugacauauaaaugcccucaaauuacggaagcggaacccgacgacguagacuguuggugcaaugcaaccgacacuugggucacauacgggacguguucccagacaggugaacaccggcgugacaaaaggagugucgcuuuagccccucaugucggcuuaggacuagaaacgaggacagaaacauggaugucaagugaaggagcuuggaaacaaauacaaaggguagaaacuugggccuuaaggcauccuggcuuuacugugauugccuuguuuuuagcacaugccauaggaaccucuauuacucaaaaagggauaauuuuuaucuuacuaauguuggugacgccaucaauggcaaugcgaugcguagggauaggaaaccgugauuuuguugaaggccuauccggugccacauggguagauguaguauuagaacacgggucgugcguaacgacaauggcuaaaaacaaaccaacacuagacauagagcuauugaaaacggaaguaacuaaucccgcaauccugagaaaacuaugcauagaagccaaaauuagcaacacaaccacagauaguagaugucccacacaaggagaagcuaccuuagucgaagaacaagacgccaauuucguaugcagaaggacauuuguugaucguggauggggcaacggauguggcuuguuugggaaagguucguuacugacuugcgcaaaauuuaaaugcguuacgaaauuggaagguaaaaucgugcaguacgaaaauuuaaaauauagcguuauagugacaguccauacaggagaccagcaucaaguuggaaacgaaacaacugaacaugguaccauagcuacaauaacaccucaggcgccaacgucagaaauccagcuaacggauuauggugcucugacucuugauuguucucccaggacgggccuugauuuuaacgagauggugcuauuaacaaugaaagagaaauccugguuaguucauaaacaaugguuuuuagaccucccacugccuuggaccucaggagcaaguacuucucaagaaaccuggaauagacaagaucuguuaguaacauucaaaacggcgcaugccaagaaacaagagguagugguauuaggcucacaagaaggugcgaugcacaccgcauuaacuggagcaacugagauucagacgaguggaacaacuacaauauuugcaggacaccugaaaugcaggcuaaaaauggacaaauugacuuuaaaagguaccucauauguaaugugcacaggaaguuuuaagcuggagaaagaagucgcagaaacccagcaugguacuguacugguccaaguaaaauacgaaggaacagaugcaccaugcaagauuccauuuaguacacaagaugaaaagggcgugacccaaaauggaagauuaaucacagccaauccaauaguuacugauaaagaaaaaccaguaaacauugagacggaaccuccuuucggagaaagcuacaucguaguuggugccggggaaaaggcuuugaaacuaaguugguucaagaaaggaagcuccauaggaaagauguucgaagcaacagcaagaggggcaagacgaauggcaauuuugggugauacugcuugggacuuuggaagcauaggagggguuuuuaccuccguggguaaauuaguacaucaggucuucggaacagcauauggaguccuauucucaggaguauccuggacaaugaaaaucggaaucggaauauuacugaccuggcuuggcuugaacagcaggaguaccucccugucaaugacauguauagcaguaggaaugguaacccucuauuuagggguuauggugcaggcugauucaggaugcguuauaaacuggaagggaagagaauuaaaaugcggcucggguauauuuguuacaaaugaagugcacacguggacugaacaguacaaauuucaagcagacucgccuaaaagguuaucggccgcaauuggcaaggcuugggaggagggaguauguggaauaagaagugcgacgcgacuugagaacauaauguggaaacaaauuucuaaugagcuaaaucacauacuuuuagaaaacgauaugaaauuuaccguaguagucggagaugcaaacgguauauuagcucaaggcaagaaaaugauaagaccgcaaccgauggagcauaaauacaguuggaagucuugggguaaagcuaaaauuauaggagcugauauccagaacacuacauucauaauugaugguccggacacaccagaguguccagauaaucaacgagccuggaacauaugggaagucgaagauuaugguuuuggaauauucaccaccaauauuuggcuuaagcugagagauagcuauacacaaaugugugaccaccgacuuaugagcgccgccauaaaagauuccaaagcugugcaugcagacaugggauauuggaucgaauccgagaaaaacgagacuuggaaguuagcaagagcuucuuuuauagaaguaaagacuuguacauggcccaaaucacauacacucuggagcaacggaguucuagaaucggaaaugauuauaccuaaaauauauggggguccaauaucacagcauaauuauagaccaggcuauuuuacccagacggcggggccauggcaccuagggaaacuagaguuagauuucgaucuuugugaaggaacaacagucguaguagacgaacauuguggaaauagagggccuagcuuacgcacgacuacuguaacgggaaaaauuauacacgaauggugcugcagaucauguacgcuaccaccucugcgauucaggggugaagacgguugcugguaugguauggaaauaagaccagugaaggaaaaagaagaaaacuuaguaagaucuaugguuagugcgggcagcggagaaguugauucuuucagucuaggaauacuaugcgcuucuauaaugauugaggaagucaugaggucgcgguggucgagaaagauguuaaugacgggcacucuagcaguauuucuauuauuaaucaugggacaguugaccuggaaugaucucauacgguuauguauaaugguaggcgcuaaugcaucggaucgaauggggaugggcacaacauaucucgcucuaauggcgacuuucaaaaugcgcccuauguuugccguaggacuauuguucagaagauuaacuagccgagaaguuuuacugcuaacaauaggacuuagccugguggcaucugucgaacuaccaaauucacuugaggaacuuggagauggccuagcgauggguauuaugaugcuaaaacuucuaaccgaauuucaaccacaccaacuauggacgacacuccuaagccuaacguucaucaaaacuaccuuaucacuugauuacgccuggaaaaccacagcaauggcgcuaagcauuguaagucucuuuccguuguguuuaaguacaacaucccagaaaacuacuuggcuacccguucuccuaggaucauucggcuguaagccuuuaacaauguuccuaauaacugaaaacaaaauuuggggacgaaaauccuggccccucaacgaaggcauaauggcuauagguaucguuuccauauugcuuucuucuuuacuuaaaaacgauguaccauuggccgggccucuaauagcggguggcauguuaauagcaugcuacgucauuaguggguccucagcagacuugucuuuagagaaggcagcagaaguaaguugggagcaagaagcggaacacucgggaacaagucauaacauccuuguagagguacaagacgauggaacgaugaagauuaaagacgaagaaagagacgauacccucaccauucuacuuaaagcaacuuuacucgccgugucggggguauauccgaugaguauaccugccacguuauuuguuugguauuucuggcagaagaagaaacaacguaguggaguguugugggauacacccagucccccagaagucgaacgugccgucuuagacgacggaauuuaccguaucuuacagagagguuuauuagguaggucacaagugggagugggaguauuucaggauggagucuuccauacuauguggcauguuacaaggggugcagugcuaauguaucaagguaaaagauuagaaccaagcugggcaucggugaaaaaggauuuaauaaguuauggcggcgguuggagguuucaaggcucauggaauacuggcgaagaagugcagguaauagcgguagaaccaggcaaaaaccccaaaaauguccaaacaaccccagguacauuuaaaaccccagagggagaaguuggagcaauagcucuggauuuuaaaccuggaacaucaggcucaccuauuguaaauagggaaggcaagauaguagguuuguacggaaauggcguagucacaacaucagguaccuauguuucagcaauugcucaagcuaaagccucucaagaggguccuuuaccagaaauagaagaugaaguguucaaaaagcgcaaccuaacaauuauggauuuacauccaggaucagguaaaacuaggagauaucucccugcaaucguucgagaggccaucaaacgaaaauuacggacauugauccuggccccaacacgaguuguugcgucggaaauggcggaggcccucaaagguaugccaauuagguaucaaacgaccgcggugaaaucagaacauaccgguagagaaauaguagaccuaaugugucaugcuacauuuacuaugagauuacuaagcccaguuagagucccaaacuacaauaugauaauaauggaugaagcccauuucacggauccggcuaguauugcugcgagagguuauauaagcacaagaguagguaugggcgaagcagcugcuauauucaugacggcgacuccaccaggaaguguagaggcuuuuccacagagcaacgccgucauucaagaugaagaaagagauaucccagaaagauccuggaacucuggauacgauuggauuaccgacuuuccagggaagaccguuugguucguuccgucgauaaaaagugguaaugacauugcgaauugucucaggaaaaaugggaagagagugauucaauuaucaagaaaaacguucgauaccgaauaucaaaagaccaaaaacaaugauugggacuacgugguaacaacagauauaagcgaaaugggggcuaacuucagagcagaccgagucauugauccaagacgauguuuaaagccagucauucuuaaagauggccccgaaagagucauccucgcaggacccaugccuguaacuguagcgucggcagcacaaaggcgaggaagaauagggcguaaucaaaacaaggaaggcgaccaauauguuuauaugggacaaccccuuaauaacgacgaagaccaugcacacuggacugaagcaaaaaugcuucuagauaauauaaauacgccugaagggauuauaccggcacuuuuugaaccagaaagggaaaaaucagcugcgaucgauggugaguauagauugaggggagaagcaagaaaaacauuuguagaauuaaugcgucggggcgaucuacccguaugguugaguuauaagguagcaucugaagguuuccaauauucagauagaagauggugcuuugauggagaacgaaacaaccaaguauuagaagaaaacauggaugucgagauauggacgaaagaaggggagcgaaagaaauuacgaccuagguggcuagacgcaaggacauauagcgauccccuugcacuaagagaauuuaaagaguucgcugcugggcggaggagcguaucgggagaucuuauuuuagagauugguaaacuaccgcaacauuuaaccuuaagagcacagaaugcucuggacaacuuaguaaugcuacauaauagcgaacaaggagguaaagcauaccgacacgccauggaagaacuaccagacacuauugaaaccuuaaugcuauuagcauuaauagcggucuuaacagggggaguuacauuauucuucuuaagcggcaaaggucuagggaaaacaucuauaggucuccucuguguaacugcuucaagcgcauuguuauggauggcauccgucgaaccucacuggauagcagcgaguauuauuuuagaguucuuuuugaugguauuguuaauaccggaaccugauagacaaagaacaccacaagauaaucaacucgcauacguuguuauaggacuucuuuucaugauucuaacagucgcagcuaacgaaaugggccuguuagagacaaccaagaaagaccuggggaucggacaugucgcggccgagaaucaccaacaugcaacaaugcuugauguggauuuaagaccugcgagugcuuggacacucuacgcaguagcuacaacuguuauaacccccaugaugaggcacaccauagaaaacacaacagcuaacauuucacuuacugcgauugccaaucaagccgcaauucuaaugggucuagauaaagguuggccaauaaguaaaauggauauuggaguaccuuuacucgcauuggguuguuacagccaaguaaauccauuaacccugacugcagcgguauuaauguuaguggcacauuacgcuaucauaggaccaggucuucaagcaaaagcuacucgugaggcacagaagcgcacagccgcuggaauuaugaaaaacccaacaguagaugggauaguggccauagauuuagacccagucguguacgacacgaaauuugaaaagcaacuaggacaaaucaugcuauuaauacuguguacaucgcagauacuacuaaugcgaaccacgugggcguugugcgaaaguauuacgcuagcgacagggccacugacaacuuuaugggaaggaucgccgggaaaauuuuggaacacaacgauagcagucucuauggcgaauauuuuccgcgguucguaucucgcuggagcgggauuggcauucucgcuaaugaagucguuagguggagggagacgcggaacaggagcucaaggagagacacuaggcgaaaaauggaagagacaguuaaaucaacuuaguaagucagaguucaacauuuacaaacggucgggcaucauggagguugacaggucagaagcgaaagaaggucuuaagcguggagaaacuacaaaacacgcgguaucaagaggaacugccaaacucagaugguuuguagaaagaaaccuugucaaaccggaagguaaagugauagauuuaggcugugggcgcggcggauggucuuauuauugugcaggacucaagaaagucacagaaguaaaggguuauacaaagggcggcccgggacacgaagaaccaauaccgauggccacuuacggauggaauuuggugaaauuacacucaggaaaagacguauucuuuaugccaccagaaaagugcgauacauuauuaugcgauauaggugaguccucaccaaauccuacaaucgaagaagggaggacgcugaggguccuuaaaaugguagaaccauggcuccguggaaaccaauuuuguauuaaaauacuuaacccauacaugccgagugucgucgaaacauuagaacaaaugcaacgcaaauacggaggaauguuaguaagaaacccccuaucacguaauagcacgcacgaaauguauuggguguccuguggcaccgguaauauagugucugcugugaauaugacuagcagaaugcuccuaaauagguucacuauggcucacagaaaaccuacauacgagagagauguggaucuaggagcugggacacgccacguagcgguagaaccugaagucgcuaaucuagacauuaucggucaaagaauagaaaauaucaaaaaugaacacaagaguaccuggcauuaugacgaagauaauccauauaaaacuugggcguaucauggaaguuacgaagucaagccaucagggagcgcuucaagcaugguaaauggagucgugcgucucuugaccaaaccaugggauguaauuccaaugguuacacaaaucgcuaugacagauacuaccccuuucggacaacaacgaguguucaaggaaaaaguagacacccguacacccagggcaaagagagguaccacccaaauuauggaaguuacagcaaaguggcugugggguuuucuuagccguaauaagaaaccuagaaucugcacgcgagaagaauuuacacggaagguacgcucaaaugccgcaauuggagcggucuuugucgaugagaaucaguggaauagcgcaaaagaagcuguagaagaugaacgauuuugggacuuaguccauagagaaagagaacuacauaaacaagguaaaugugcuacauguguauacaauaugauggguaagcgagagaagaaacuuggugaauuugggaaagcaaagggaucacgagcuaucugguauauguggcuaggagcucgauuccuggaguucgaggcuuuaggauuuaugaacgaagaccacugguucagucgcgaaaauagcuuaucggguguagaaggagaagguuuacacaaacuaggguauauuuuacgagauaucucaaaaauaccaggaggaaauauguaugccgaugauaccgccgguugggauaccagaaucacggaagaugaucugcagaacgaagcaaaaauaacagauauuauggaacccgaacaugcccucuuggcuacaaguauauucaaacuaacauaucagaacaaaguagugcgcguucagagaccugccaaaaauggcacagucauggauguaaucucaagacgagaucaaaggggcucaggacaggucggaaccuaugguuuaaacacauuuacaaauauggaaguacaauugauaaggcaaauggaaagcgaggguaucuuccuaccaagcgaacuagaaacaccaaaccuagccggacguguacucgacuggcuagaaaaacacggagcugaacgacuaaagaggauggcaauuucaggugaugauuguguuguuaaacccauugaugaccgguuugccacagcgcugacugcccucaacgacaugggaaagguaagaaaagacauuccccaaugggaaccuucaaagggauggaaugacuggcagcaaguuccauuuugcagucaucacuuucaucaauuaauuaugaaagacggucgugagauagucguaccaugccgcaaucaagacgaguuagugggcagagcacguguaagucaaggagcaggauggagucugcgagagacagcuugcuuaggaaagucguacgcacaaauguggcaauuaauguacuuccauagacgagacuugcguuuagcugccaacgcuauaugcuccgcgguacccguagauugggugccuaccagucgaacgacauggaguauucaugcgcaucaccaguggaugacuaccgaggauaugcuaucugucuggaaucgaguauggauagaagagaacccuuggauggaagauaaaacacauguauccucaugggaagaagugccuuaccucgguaagcgagaagaucaaugguguggcaguuuaaucggacuuaccgcaagggcuacaugggcgacaaauauucaaguagcaauaaaucaaguccgaagauuaaucggaaacgaaaauuaucuggacuauaugacuagcaugaagagauucaaaaaugaaucagauccggaaggugcauuaugguaa

SEQ ID NO: 21302 - RNA, 9879 nt, Artificial Sequence
  derived and/or modified CDS sequence (opt6) from DENV-1__FJ810419__SS-prME
ucugugacuauguuguuaaugcuucuaccuacugcuuuagcauuccacuuaacgacuagaggaggcgaaccccauaugauagucucgaaacaagaaagagguaaaucacuacuauuuaaaaccucugcuggaguuaauaugugcacuuugauagcaauggaucuaggugaacuuugcgaagauacgaugacuuacaaaugcccacaaauaaccgaagcagaaccagaugauguggauugcuggugcaaugcaacugacacaugggucacguaugggacuugcucgcaaacaggagaacaucgccgagacaaacggagcguagcgcuagcuccacauguuggccuaggacuagaaacucguacagaaacauggaugucuucggaaggagcauggaaacaaauacagcgaguugaaacaugggcguugagacauccuggauucacuguaauagcauuauuuuuagcacaugcaauaggcacuucuauaacacaaaaaggaauuauuuuuauacuucuaauguuaguaacacccucaauggcaaugagauguguagguauaggaaauagagauuucguagaaggucuuucaggagcaacuuggguagaugugguauuggaacauggaagcugcgucacuacgauggccaaaaauaaaccuacucuggauauugaauugcuaaaaacggaaguaacuaauccugcaauucuacgaaaauuauguaucgaagcgaaaauauccaauacaaccaccgacuccagguguccuacacaaggggaagcgacucuaguggaagaacaagacgcuaauuuuguuugccguagaacauuuguugaccguggauggggaaaugguuguggucuuuuugguaaaggcuccuuauuaacuugcgcaaaauuuaaauguguuacaaaauuagaaggcaaaauaguacaguaugaaaaccuaaaauauucggugaucgucacgguacauacaggcgaccaacaccaaguagguaaugagacaacggaacaugguacuaucgcuacaauaacuccucaagccccaacaagugaaauucaauuaacagacuauggcgcacuaacauuagacuguagcccacgcacuggcuuagauuucaaugaaaugguucucuuaacaaugaaagagaaaucauggcuuguucauaaacaaugguuccucgauuuaccuuuaccguggacaucuggagccaguacgagucaggaaacauggaauaggcaagaccucuuaguuacguucaaaacugcacaugccaagaaacaagaagugguaguccucggaucacaggaaggagcaaugcauacugcacuaacgggggcaacagagauacagacaucggguacuacaaccauuuucgcuggccaucuaaaauguagauugaagauggacaaauuaacacuuaaggguacuucauauguaaugugcacgggaucauucaaacucgaaaaggaagucgcggagacgcagcauggcacagucuuaguccaaguaaaguaugaagggacagaugcccccugcaaaauuccguuuucgacacaagaugaaaaagggguaacacagaauggacgcuugauaacagccaauccgauaguaaccgauaaagagaaacccguaaauauagaaacggaaccuccuuuuggagaaaguuacaucguugugggcgcuggagaaaaggcauuaaaacuuucaugguuuaaaaaggguucaucuauaggaaagauguucgaggccacggcaagaggcgcgagaaggauggcgaucuuaggagacacugcgugggauuuugguucaauugggggaguauucacaucuguagguaaacucguucaucaaguauucggcacagcauauggggugcuuuucucaggcguuaguuggacuaugaaaauuggaaucgguauacuucucacauggcuuggcuuaaacagucgaucaacuagcuuaagcaugacaugcaucgcaguaggaauggugacacuauaucuagguguaaugguacaggcagauucagguuguguaaucaauuggaaggguagggaauuaaaauguggaucaggaauuuucguuacgaacgagguucauacuuggacagaacaauauaaauuucaagcagauagcccaaaaagguuaucagcagcaaucgggaaagccugggaagaaggaguuugcggaauacgaucagcaacacguuuggagaacauaauguggaaacaaaucucuaaugaacuaaaccauauacuccuugaaaaugauaugaaauuuacaguuguugugggcgacgcgaauggaauacuugcucaagguaagaaaaugaucaggccgcaaccuauggaacauaaguacucauggaaaaguugggggaaagcaaagauuaucggcgccgauauacaaaacacgacauucauaauagauggaccugauacaccagaauguccugacaaccaaagagcuuggaauauuugggaaguggaagauuacggcuuugggauauuuaccaccaacauauggcuaaaauuaagagauuccuauacccagaugugugaccauagauugauguccgcagcaaucaaggacucuaaagcgguucaugcggauaugggcuauuggauagaaagcgagaaaaacgaaacuuggaaacucgcaagagccaguuuuauugaagucaagacguguaccuggccaaagucacauacuuuauggaguaaugggguguuagaaucggaaaugauaauuccuaaaaucuacgggggucccauaucucaacacaacuaccguccggguuauuucacacaaacggcgggaccauggcauuuagguaaauuagaguuagacuucgaccuaugugaaggaacaacagucgucguagaugaacacugugguaauaggggaccgucuuuaagaacuacaacgguaacaggaaaaauaauccacgaaugguguuguagaucauguacucuaccaccauuaagguuucgaggagaagauggaugcugguauggaauggaaauacgaccgguuaaagagaaagaagaaaacuuaguucgaagcaugguuagugcagguucaggagaagucgacaguuuuucacuggggauacuaugcgcaagcauaaugauagaagaaguaaugaggaguagauggucaagaaagaugcuuaugacaggaacacuugcuguauuuuugcucuuaauuaugggucaauuaacauggaaugacuuaauuagacuuugcauaaugguaggagccaacgccucagaccguaugggaaugggaacuacauaucuagcgcucauggccacguuuaaaaugagaccaauguuugcaguuggacugcuauuccggaggcuaaccucgcgagagguucuacuccuaacgauaggauuauccuuaguugcaucuguagaacugcccaauagcuuagaagaguuaggggauggccucgcgauggggaucaugauguuaaagcuacuaacugaauuucaaccucaccaauuguggaccaccuuacuuucacuuacuuucaucaagacgaccuugagcuuagacuaugcuuggaaaacuacagcuauggcuuuauccauuguaucauuauuuccacuaugucucaguacuacgucacaaaagacaacaugguuaccaguacucuuagggucguuuggguguaaaccauuaacgauguuucucauuaccgaaaauaagaucuggggaagaaagagcuggccauugaacgaaggcauaauggcgauagggauugugagcauccuucuaagcucauugcucaaaaaugacgugcccuuagcaggaccacuuauugcaggggguauguuaauagccugcuacguaauuuccggcucaucggcagacuuaucacuagaaaaagcagcagaaguuaguugggaacaagaggcugaacauagcgguacaagccauaauauccucgucgaaguacaagacgauggaacuaugaaaaucaaagaugaagaaagggacgacacauugaccauacuguuaaaagccacacuguuagcaguuucaggcguauaucccaugaguauaccugcuacguuauuuguaugguauuuuuggcagaagaagaaacaaagaagcggaguauugugggauacucccagcccuccagaaguagagagagcugugcuugaugauggcauauaucgaaucuuacaaagaggucugcuuggcaggucacaaguagggguuggaguuuuucaagacggagucuuccacacaauguggcaugucacgcgaggagcaguucuuauguaucaagguaagcgacuagaaccaagcugggcguccgucaagaaagaucugauuuccuauggaggaggauggcgauuucaagggaguuggaauacaggugaagaaguccaaguuauugcaguagaacccggcaagaauccgaaaaacguccaaacaacaccugggacguuuaaaacaagugaaggcgaaguaggggcuaucgcauuagauuuuaagccaggaacauccgguaguccuauaguaaaucgagaagggaagaucguggggcuauacggcaauggaguuguaacgacuucagguacauaugugagugcaauagcccaggcuaaagcaagccaagaagguccgcuaccggagauagaagacgaagucuucaagaaaaggaauuuaacaauaauggauuugcacccuggaagugguaaaacaaggcgauaccuuccggcaauuguacgagaagccauaaaacggaaacugagaacccucauauuagcaccuacaagggucguagcaagugaaauggcagaggcgcuuaaaggaaugccaauacgauaccaaacgacagccguuaaauccgaacacacaggcagagagauaguagauuuaaugugccaugcuacuuuuacaaugcguuuacucucgccgguaaggguuccgaacuauaauaugauuauaauggacgaagcacauuuuacagacccagcuucaauugccgcgcgugguuauauuagcacgagagucggcaugggugaagcagcagccauauuuaugacggccacuccaccuggcucaguugaagcauuuccacaaaguaaugcggugauucaagaugaggagcgcgacauaccugaacguucauggaacucaggguacgauuggauuacugacuucccaggaaaaacagugugguucguucccucaauuaagucggguaacgacauugcgaacugccuucguaaaaauggaaaacgaguaauucagcuuaguagaaaaaccuuugauaccgaauaucagaaaacuaaaaauaaugacugggacuacguuguuacaaccgacauaucggagaugggagcaaacuucagagcagauagaguaauugauccaagacggugcuuaaagccuguuauucugaaagacggcccagaacgagugaucuuagcagggccaaugccuguaacaguagcaagcgcggcacagcgucgaggaaggauuggaagaaaucaaaacaaagaaggagaucaguauguguauaugggucagccuuuaaacaacgaugaggaccacgcgcauuggacugaagccaaaauguuauuagauaauauaaacacgccggaggguauuauucccgcucuuuucgaaccagaaagagagaaaagcgcagcaauugauggagaguaucgacuaaggggagaggcaaggaaaaccuucguugaauuaaugaggagaggugaccucccugugugguuaucauauaaagucgcuucugaaggcuuucaauauucggauagacgaugguguuuugacggugaacgaaauaaccagguguuagaggagaauauggaugucgagauauggacgaaagaaggugaaagaaagaaacuaagacccagauggcuagacgcgcgcacauauucggauccccuagcacuuagggaauuuaaagaauuugccgcagggagacgguccgugucgggugacuuaauacuugaaauaggaaaauuaccccaacacuugaccuuacgugcgcagaacgcauuagacaaucuagucauguugcauaacucagaacaaggugggaaggcuuaucgccacgcaauggaagaauuacccgauacgaucgagacccuaauguuacuagcguuaauugcuguacuaaccggaggagucacacucuucuuccuaagcgggaagggguuaggaaaaacaucaauugguuuauuaugcguuaccgcuaguucggcacuucuuuggauggcuucuguggaaccacauuggauugcggcuucaauaauucuagaguucuuccugauggucuuauuaauuccugaaccugauaggcaaaggacaccacaggauaaucaauuggcauacguaguaauuggucuucuguuuaugauacugacuguagcagcuaacgagaugggccuacucgagaccaccaagaaagauuuagggauugggcauguggccgcagaaaaucaucaacaugcaacuauguuagauguugauuuacgccccgccucugcauggacguuauacgcgguagcgaccacgguaauaacuccaaugaugaggcauacuauugaaaauacgacagcaaacaucucccuuaccgccauugcuaaucaagcugcaauauugaugggucuagauaagggauggccuauaucuaagauggacauagguguuccacuucuggcuuugggcuguuacucccaaguaaauccucuaacauugacggcggcaguucucauguuagucgcccauuacgcgaucaucggaccuggucuucaagcuaaagcuacacgugaagcacaaaagagaacagcugcaggaauaaugaaaaauccuacuguagauggcaucguagcuauagauuuagauccagugguuuaugaugcuaaguuugaaaaacaguuaggacagauuaugcuauugauucucugcacuucccagaucuugcuaaugcgaacaaccugggcccucugugaaagcauaacuuuggcuacugguccguuaacaacacucugggaggguucaccgggaaaauuuuggaauacaacaauagcugucucaauggcuaauauauucaggggauccuaccuagcgggagcaggauuagcguuuaguuuaaugaaaucgcuagggggcggccguagggguaccggagcccaaggggaaacccugggagaaaaauggaagaggcaauugaaucaacugucaaaaagugaguucaauacuuauaaacgaagcggcauuauggagguagauagguccgaagcuaaagagggauuaaaaagaggagagacgacaaagcacgccguuucuagggguacagccaaauugagaugguuuguggaacggaaccuaguuaaaccggaagguaaaguuauagauuuaggaugcggacguggcggcuggaguuauuauugugcaggacuaaagaaagucacugagguuaaaggauacacaaaaggaggccccggacacgaagaaccuauucccauggccacauacgguuggaaucucgugaaguuauauuccggaaaagacguauuuuucaugccgcccgagaaaugugauacauuacucugcgauauaggagagagcucacccaauccuacuauugaagaagguagaacuuuacgagucuuaaaaaugguagaaccguggcuuagagguaaccaauuuuguauuaaaauucuuaaccccuauaugccaucaguugucgaaacauuagagcaaaugcagagaaagcauggaggaaugcuaguucgaaacccgcuaagcagaaauucuacacaugaaauguacuggguuucaugcgguacagguaauaucguaagugccguaaauaugacaucaagaauguugcugaaucgauuuaccauggcccauaggaaacccacguaugaacgagacguugaucuaggugcaggaacaagacacgucgccguagaaccagaggucgcuaacuuggauauaauaggacaacgaauugaaaacauuaaaaacgaacacaaaucaacuuggcauuaugaugaagauaaccccuauaaaaccugggcuuaucauggaucuuacgaaguaaaaccuucuggaagugccucaucaaugguaaaugguguaguaagacuauugacgaaaccaugggaugucauaccaaugguaacccaaaucgcgaugacugauacaacacccuuuggacaacaacguguauuuaaggaaaaaguugacaccaggacaccaagggcuaagcguggaacgacccaaauaauggaaguaacagcgaaauggcuuuggggguuuuuaucgcgaaacaagaaacccagaauauguacaagagaggaguucacaagaaaaguaaggucuaaugcagccauuggagcgguauuugucgaugaaaaccaguggaacucugcuaaagaagcuguugaagacgaacguuucugggauuugguucacagggaacgagaacuacacaaacaaggcaaaugcgcaaccugcguauauaauaugaugggcaaacgagagaagaaacuaggagaguucggaaaagcaaaagguagccgcgcgauaugguacauguggcuuggcgcaagguuucuagaauuugaagcauugggguuuaugaaugaagaucacugguucucuagagaaaauaguuuaucaggagucgagggagaaggccuucauaaauuaggauauauucuccgggacaucucuaaaauucccggcgguaauauguaugcagacgauaccgccgguugggauacuagaauuacggaggacgaucugcaaaaugaagcaaaaaucacugauauaauggaacccgaacaugcccuauuagcgaccucaauuuucaaguugacauaccaaaauaagguaguaaggguucaaagaccagccaaaaaugggacagugauggacguaauaucuaggcgcgaccagagagguucgggucaaguggguacauauggacuaaacacuuuuacaaacauggagguucaauuaauuagacaaauggaaucagaggggauauuucuaccaucagaacucgaaacucccaauuuagcagaacguguuuuagauuggcuagagaaacacggagcagaacggcuuaaaagaauggccauuagcggagaugauuguguugucaaaccuaucgacgaucgauucgcuacggcuuuaacggcuuuaaacgauaugggaaaagugcgaaaagauauaccccagugggaaccuaguaagggguggaacgacuggcaacaagucccauuuugcagucaucacuuccaucaacuaauuaugaaagauggaagagaaauaguaguuccguguaggaaucaagacgaacugguggggcgcgcccggguuucgcaaggugcgggcuggucauuacgcgaaacugcaugcuuaggaaaaucguaugcacaaauguggcaacuaauguacuuccaucgaagagaucuacgauuagcagcgaaugccauauguuccgcaguccccguagauuggguucccacuucuagaacuacuuggaguauacacgcacaucaccaguggaugacuacagaggacauguugucuguguggaacagaguauggauugaagagaaccccuggauggaggauaaaacacacguaucuucaugggaagagguaccuuauuuaggaaaaagggaagaucaauggugcgguagcuuaauuggacuaacugcaagagcaacaugggcuacuaauauacaagucgcaauaaaccaaguuagaagacugauagguaaugaaaauuacuuggauuauaugacaagcaugaagagauuuaagaacgagucggaccccgagggugcacugugguaa

SEQ ID NO: 21303 - RNA, 9879 nt, Artificial Sequence
  derived and/or modified CDS sequence (opt6) from DENV-1__FJ547068__SS-prME
agcguaaccauguuauuaaugcuccugccuacugcauuggcauuucauuuaacuaccagaggaggugaaccucauaugauuguuucaaaacaagaaagaggaaaaagucuucuauuuaaaacguccgcgggaguaaauauguguacguugauagcuauggaucuaggggaauugugugaggauacaaugacauacaaaugcccccaaauuacugaggcagaaccggaugacguagacuguugguguaacgcuacugauacauggguaacauaugggaccugcagucagacaggagagcaucguagagacaaacguucuguugcguuagcaccccaugucggucucggacuugaaacgcgaacugagacauggaugaguucagaaggagcauggaaacaaauacaaagaguagaaacaugggcacucaggcauccugguuucacaguaauagcacuguuucuugcgcacgcaauagggacaucaauuacccagaaaggaauaauuuuuauauugcuaauguuagugacacccuccauggcuaugagaugugucgggauaggaaacagagacuucguugaaggacuuagcggagcaacauggguugacguuguauuggaacauggaaguuguguaacaacaauggccaaaaauaaaccaacauuagauauagaacuccuaaaaaccgaaguuacgaauccggcaauacuacgaaaauugugcauagaagcaaaaauuucuaacacaacaacagauucuagauguccaacacagggugaagccacucucgucgaagaacaagacgcgaauuucguuugcaggagaacauucguagacagaggauggggcaacgguuguggguuauuuggcaaaggaucucuacuaacaugugcuaaauucaaaugcgucacuaaauuagaaggcaaaauaguccaauaugagaaucucaaauauaguguaauaguuacaguucauacuggcgaucaacaccagguugguaacgaaacuacggagcacgguacaauagcaacaauaacaccccaagcuccaaccucagagauacaacuuacagacuacggagcacuuacuuuggacugcucccccagaacuggacuagacuucaaugagaugguacuacuaaccaugaaagaaaaauccuggcugguucacaaacaaugguuccuugaucuuccgcucccuuggaccucaggggcuaguacaagccaggagacauggaauaggcaagacuuauuggucacauucaaaacagcccaugcuaagaaacaggaagucguggugcugggcucgcaagaaggcgcaaugcacacugcucugacaggagcaacagaaauccagacaucaggaaccaccacaaucuuugcuggacaccuaaaauguagauuaaaaauggauaaauuaaccuugaaagggacgucauacgugauguguacagguucuuucaaacuggaaaaagaaguggcggagacucagcacgguacaguucuaguucaaguuaaauacgaagguacagaugcuccauguaaaauacccuuuucaacucaagacgaaaagggaguaacgcaaaacgggagauuaauaacagccaauccaauuguaacagacaaggaaaagccugucaauaucgagacugaaccaccauucggugagucauauauaguuguuggggccggagagaaagcguugaaacugucaugguucaagaaaggcaguuccaucggaaagauguuugaagcuacagcacgcggugcacggcgaauggcaauuuugggagauacagcuugggauuucggaaguauagguggcguguuuacaaguguuggcaaauuaguccaucagguguuuggaacagccuauggcgugcucuuuaguggugugucauggacuaugaaaauuggaauaggcauccuacuuacauggcuaggauuaaacucaagaaguacaagucuaaguaugacauguauugcggucggaaugguaacucuauaucucggcguaaugguacaagcugauagcggauguguaauuaauuggaaaggucgagaacucaaauguggaagcggcauuuuugugacaaaugaagugcauaccuggaccgagcaauauaaauuucaagcggauaguccuaaaagacuaagugccgcaaucgguaaggcgugggaggaggggguaugcgggauaagaucagcuacuagacuggaaaauauuauguggaaacagauuucuaacgaacuaaaucacauacuauuggaaaacgauaugaaauucacuguaguagugggugaugcgaacggaauauuagcacaagggaaaaagaugauuagaccgcaaccgauggaacacaaguacucauggaaaucuugggguaaagcaaaaauuaucggagcagacauacaaaacacuacuuucauuaucgacgguccugauacucccgagugucccgacaaucaaagagcguggaacauaugggaaguggaagauuacgguuucgggauauucacaacuaauauauggcuaaaauuacgggacagcuacacacaaaugugcgaucaucggcuaaugucagcagccauaaaagauaguaaggcaguucaugcggauauggguuauuggauugagagcgagaaaaaugaaaccuggaaacuugcucgcgccaguuuuauugaagucaagaccuguacuuggccgaaaagucauacgcuauggaguaacggcguuuuagaaagcgaaaugauaauacccaaaaucuauggugguccaauaucucaacauaacuacagaccuggauacuuuacacagacugccggccccuggcauuuaggcaaauuggaacuagauuucgaucugugugaaggcacuacuguaguaguugaugaacacugcggaaauagaggucccucacugcguacuacaacuguuacagguaaaaucauacaugaaugguguugccguagcuguacacugccaccgcuacguuuuagaggcgaagaugguugcugguauggaauggaaauuagaccgguuaaagaaaaggaagaaaaucuuguuagauccauggucuccgccggauccggugaaguagacucauucuccuuaggaauauuaugugcuuccaucaugauagaagaagucaugaggaguagguggagccgaaaaaugcuuaugacagggacuuuagcaguuuuccucuuacuaauaaugggacaacuaacauggaacgaucuuauacgguuauguauaauggucggugcaaacgcuuccgaucgaaugggcaugggaacaacuuaccuugcuuuaauggcuacauuuaagaugcgaccaauguuugcaguuggacuacuuuucagacgccugaccagcagagagguucugcugcuaaccauagggcuaucuuuagcugcuucuguugagcuaccaaauucacuagaagaauugggagauggucuugcaaugggaauaaugauguuaaaauuacuaacugaauuucaaccucaucaguuauggaccacucuacuuucacuaaccuucauaaaaacaacacuaucccuagauuaugcauggaaaacaacagcaauggccuuaaguauaguaucacuauucccgcugugccugaguacuacgucacagaaaacaacauggcuaccuguacuauuggggucauucggcuguaagccgcucacaauguuucuaauuacugaaaacaaaauauggggcaggaagucguggccgcuaaaugaagguaucauggcuauaggaauaguaucaaucuuauuaagcucauugcugaaaaaugauguaccacuggccggaccauuaauagcggguggaaugcugauugcgugcuaugucauaucugggucuucggcugauuuaaguuuagaaaaggcugcagaaguaucaugggaacaggaggcagaacacucagguacaucgcauaauauacuuguagaaguccaagaugauggaacaaugaaaauaaaagaugaagaacgcgacgauacucugacaauccuacucaaagccacauugcucgcuguaagcggaguauauccgaugaguauaccagcaacccuguuuguuugguauuuuuggcagaagaagaaacaacggucaggaguauuaugggacacccccagcccuccugaaguagagagagcaguacuagacgaugguauuuaucguaucuuacaacgcggcuuauugggaaggagccaggugggaguugguguauuucaggacggaguauuccauacgauguggcacguaacgagaggugcaguacuuauguaccaagguaagcgccucgaaccuucaugggcaucagucaagaaagauuuaauuaguuauggaggcggauggagauuccagggaucguggaauacgggggaggaaguacagguuauagcaguugagcccggcaaaaauccgaagaacguacaaacgaccccagggacauuuaaaacaccagaaggcgaaguaggugcaauagcguuagauuucaaacccgggaccaguggauccccuauaguaaauagagaagggaaaauagugggacuuuacgguaauggaguaguuacuacuucugguaccuacgucagcgcuauugcgcaggccaaagcaucacaagaaggaccgcuuccagaaauugaagaugagguguuuaagaaacguaaccuuacuauuauggaccuccaucccggaucugguaaaacgaggcgauaucuuccggcgauaguuagagaggcgauaaagagaaaacuuaggacacuaauacuagcaccuacucgaguaguggcauccgagauggcagaggcacuaaagggaaugccaauuagguaucaaacuaccgcaguaaaguccgaacauacuggucgggaaauuguugaucuaaugugccaugcuacauucacgaugagauuguugucaccggugagaguaccaaauuacaauaugauuauaauggaugaagcacacuuuacggacccugcuaguauagcugcucgagguuacauaucuacgaggguagguaugggcgaagcagcugcgauuuucaugaccgcgacgccaccaggaucuguugaagcauucccccaaagcaacgcugucauucaagaugaagaaagagacaucccagaacguaguuggaacuccggcuaugacuggauaacugauuuccccgggaaaacaguuugguuuguaccaaguauaaagagcgggaaugauauagcgaauugccugaggaaaaacggaaagagagucauccaacuaaguagaaagacauuugauaccgaguaucagaaaaccaaaaauaaugauugggacuauguuguaaccacggacauuucagaaaugggcgccaauuuuagagcagauagagucaucgacccuaggagaugccucaaacccguaauucuuaaagauggacccgaaagagucaucuuagcggggccgaugcccguaacuguagcaucggcagcucaacgucgagggagaauaggaaggaaucagaauaaagaaggugaccaguauguauauaugggccaaccccugaauaaugaugaggaucacgcacacuggaccgaagcaaagaugcuucucgacaauauaaauacccccgaaggaauuauaccggcacuauuugaaccugagcgagaaaagagcgcagcgauugacggagaguauagguuaagaggugaagcacgcaaaacauucguagaacuaaugcggcgcggagacuugccaguuuggcugucauacaaaguugcaucagaaggauuucaauauagugacagacgcugguguuuugauggagaaagaaacaaccagguacucgaagaaaacauggauguagaaauauggacgaaagagggagagagaaagaaauuacggccuagguggcuugacgcuaggaccuacagcgauccacuagcccucagagaguucaaggaauuugcagcaggacggaggaguguuagcggcgauuuaauauuagaaauugggaaguugccgcaacaucuaacccuacgggcgcagaacgcauuggauaauuugguuaugcugcauaauucagaacaagggggcaaggcuuacaggcaugcuauggaggaacuacccgacacaauagaaacauuaaugcuacuagcauuaaucgcgguuuugacagguggaguuacauuauucuuucugucagggaaaggguuaggaaaaacaucaauaggauuguugugcguuacagcgagcucagcccucuuauggauggcuucuguagaaccccacuggauagcagcaucgauaauucucgaauuuuucuuaaugguccuauuaauuccggaaccggacagacaaagaacuccacaagauaaccagcuugcauacguggucauaggauuacuauucaugauccuuacugucgcagcaaacgagauggggcuucuagaaacaacaaagaaagauuuagguaucggacauguggcagcugagaaucaucagcaugccacaaugcucgauguagaucuucggccagcuucugcuuggacccuuuaugccguggcaacaacagucaucacgccaaugaugcggcacacaaucgagaauacaacggcuaacaucucacuuacagcaauugcuaaucaagcugccaucuuaaugggcuuagacaaaggauggcccauaucaaaaauggauauaggagugccauuacuugcucuuggcuguuauagucaaguaaauccucuuacauuaaccgccgcagucuuaaugcuggucgcacauuaugcaauaauaggacccggccuacaagcaaaagcaacacgagaggcucaaaaacggacagccgcuggaauaaugaagaaucccacuguugacgguauuguagcgauagaucuagaucccguugucuacgacgcaaaguucgaaaaacaauuagggcagauaauguuauugauccuaugcacgucacaaauccuacugaugcgaacaacaugggcacuaugugagucaauaacacuagccaccgguccucugacgacucuaugggaaggguccccugguaaauucuggaacacaacaaucgcaguaucaauggccaauaucuuuagaggcagcuacuuagccggugcgggccuagccuuuagucuuaugaaaucguuaggaggugggcgcagggggacaggagcacaaggagaaacucuaggagagaaguggaagagacaauuaaaucaauuaagcaagucagaauuuaacacauauaaacgaucagguauuauggaaguagauaggucagaagcuaaagaaggauugaaaaggggugaaacgacuaaacaugcaguuagucggggaaccgcgaagcucagaugguucguagaaagaaaucuuguuaagccugaaggaaaaguuauugaucuagguugcggacguggagguuggaguuauuauugugcaggauuaaagaaaguuacugaaguuaaaggauacacuaaaggagguccaggucaugaggaacccauaccgauggcgaccuauggcuggaaucuugucaagcuacacucugguaaagacguuuucuucaugccgcccgagaagugcgauacuuuauuaugugauauaggcgagucuuccccaaauccaacuaucgaggaaggcagaacacucagaguacugaagaugguagagccguggcucagagguaaucaauucuguauuaaaauccuaaaucccuauaugccaucgguuguggagacacuagaacagaugcaaagaaagcacggcggaaugcuaguaagaaacccucuaagcagaaauucaacccacgaaauguauuggguuaguuguggaacggggaauauaguuucagcagucaauaugacgucacguaugcuacucaauagauuuacaauggcacauagaaagccgaccuacgagcgcgauguggauuuaggagcgggaaccaggcacgucgcugucgaaccagaaguagccaaucuugauaucauugggcaacgaauagagaacaucaaaaacgaacacaaaaguacauggcacuacgacgaagauaauccuuauaagacuugggcauaucacgguaguuaugaaguuaaaccaaguggcucagcaaguagcaugguaaacgggguaguaaggcuuuuaacaaagccaugggacguuauaccgauggugacacaaauagcuaugacggauaccaccccguucggacaacaaagaguauucaaagaaaagguugauacuaggacuccuagagcgaaacgaggcaccacgcaaauaauggaaguuacugcaaaauggcuuuggggcuuccuaucaagaaauaagaaaccccguauauguacucgggaagaguucacuagaaagguaaggucuaacgcugcuauuggggcagucuucguagacgaaaaucaguggaauagcgcaaaagaagccguagaagaugagagauuuugggaccugguucaucgggaaagggaauugcauaagcaagguaaaugugccaccuguguauacaacaugauggguaaaagagaaaagaaauuaggugaguuuggaaaagcuaaaggaagcagagccauaugguacaugugguugggagcaagguucuuagaguucgaggcguuaggauucaugaaugaagaucacugguuuagcagggaaaauucgcuuucugguguagaaggugaaggauuacauaaacuagguuauauacuaagggauaucucuaagaucccggguggcaauauguacgcagacgacacugcugguugggacacacgaauuaccgaggaugaucuccaaaacgaagcaaaaauaaccgacauaauggagccagagcacgccuuauuggcuacaucgaucuuuaaacuuaccuaucaaaauaaaguaguacgaguacaaaggccagccaaaaacggaacagucauggacguaauauccagaagagaccaacgaggcucuggccaagucggcacguaugguuuaaacaccuuuacaaacauggagguccaacugauaaggcaaauggaaagcgaaggaauauucuuaccaagugaacuugagacuccuaaccucgcagaaagaguucuugauugguuagaaaagcauggugccgaacgauuaaaaagaauggccauaucaggagaugauugugucgucaagccaauugaugaccgguuugcuacagcacuuacagcacuaaaugauauggggaaaguccgaaaagacauaccccagugggaaccuaguaaggguuggaaugauuggcaacagguuccauucugcucucaucauuuucaccaauuaauaaugaaagacggacgggaaauaguaguuccauguaggaaucaagacgagcuaguaggucgggccagaguuucccagggggcuggauggucucugagagaaacugccugccucggaaaaucauacgcacaaauguggcagcucauguauuuccauagacgugacuugagguuagcugccaacgccauauguucagcggugccaguagacugggugccgacuucgcggacgacauggucuauucacgcccaccaucaauggaugacaacugaagacauguuaagcguuuggaaccgagucuggauagaagaaaauccauggauggaggacaaaacacauguuuccaguugggaagagguaccguaucuaggaaagcgagaagaccaguggugugggucauuaauaggauuaacugcgagagcuaccugggcaacaaauauacagguagcaauaaaucaaguaagacgacuaauuggaaacgagaauuaucuugacuacaugacaucuaugaagcguuuuaaaaaugaaucugaccccgaaggcgcucuaugguga

SEQ ID NO: 21304 - RNA, 9879 nt, Artificial Sequence
  derived and/or modified CDS sequence (opt6) from DENV-1__FJ562104__SS-prME
ucgguaacuaugcugcuaaugcuguuaccuaccgcucuagcauuccauuugacaacgagagguggcgaaccccauaugaucguuagcaaacaggaacgcgggaaaagucuauuauuuaaaacaucagccgguguuaauaugugcacacucauagcaauggauuuaggcgaacuuugugaagauacgaugaccuacaaaugcccacaaauuacugaagcagaaccagaugacguagauuguugguguaaugcaacugauacauggguaacauaugggacgugcucucaaacaggugaacaccgucgggauaaacgaagcguugcucucgcaccucauguggguuuggggcuugaaacuagaacggaaacguggaugaguucggaaggcgcauggaaacaaauucaaagaguagaaaccugggcauugagacacccggguuucaccguaauagcacuguuccuagcgcaugcgauaggaacaucuauuacucaaaaagggauaauauuuauucuccucaugcuagugaccccaaguauggcuaugagauguguaggaauaggcaaucgagacuuuguugaaggauuaucaggagcgacauggguugauguuguauuggagcaugggagcugcguuacaacuauggcuaaaaauaaaccaacucuggacauugaauuacucaaaacagaagugaccaauccggcaauauugcguaaauuaugcauagaggcaaaaauuuccaacaccacaacugacucaagaugcccaacucaaggugaagcaacacucguugaagaacaagaugcaaauuucguauguaggcgaacuuuuguugaccguggaugggguaaugggugcggauuguucgggaaaggcaguuuacucacuugcgcuaaauucaaauguguuacaaaacuugaagguaaaauaguacaauaugaaaaccuaaaauauagcguuauuguaacgguucauaccggagaucagcaccaagucgggaacgaaacaacugaacauggcaccauagcaacuaucacaccucaagcaccuaccucugaaauucaacuaaccgauuauggagcacuaacacuagacugcucacccagaacagguuuggacuuuaaugagaugguucugcuaacaaugaaagaaaagagcuggcuaguacauaaacaaugguuccuagauuuacccuuaccuuggacauccggugcaucuaccagccaggaaacguggaaccgacaagaccuacuggugacguucaagacagcccacgcgaagaaacaggaaguagucgugcucggcucccaagaaggagccaugcacacagcccuaacaggggccaccgaaauccagacaucagggacaacgacaauuuucgcaggucacuugaaauguagguuaaagauggacaaauuaacauuaaaaggaacgagcuacguaaugugcacagggagcuucaaacuugaaaaagaaguagcugaaacgcaacacgggacaguguugguucaaguuaaauaugaagggacggaugcaccuuguaaaauacccuucuccacccaagacgagaaaggggugacccagaauggccgacuaaucacggcaaauccaauuguaacugauaaagaaaagccuguaaauauugaaacagaaccaccauuuggagagucauacauuguuguaggcgcuggagaaaaagcauugaaacuuaguugguuuaagaaaggcuccucgauaggaaaaauguucgaagcuacagcaagaggagcaagaagaauggcgauccucggugacacggcuugggauuucgggucaauagguggcguguuuacaucuguaggaaaguuaguucaccagguguuugguacagcauaugggguuuuauuuucuggcguuaguuggacaaugaagauuggaauagguauuuuauugacaugguuaggacuuaacagucguuccacaucacucagcaugacuuguauugccguaggaaugguaacucucuauuuaggaguaaugguacaggcggacucaggauguguuauaaauuggaaagggagagaacugaaaugcggcagcggaauuuuuguaacgaaugaaguccauacguggacugaacaauauaaauuccaagcagauucgcccaagcgacuaagugcagcuauugguaaggcuugggaagagggcgugugcggcauacggucugcuacgagacuggaaaauaucauguggaaacaaauaucgaaugaacuaaaccacauacucuuggagaaugauaugaaguucacagugguuguaggugaugcaaauggaauauuagcacaaggcaagaaaaugauccgaccccaaccuauggaacacaaauauuccuggaagaguuggggcaaagcaaaaauuauaggggcagauauccaaaacacaacuuucaucauugacgggccagauacgccugaguguccagauaaucaacgcgcauggaacauaugggaaguagaggauuauggauuuggaauauucacaacaaauauauggcuuaaacuuagggauaguuauacacaaaugugcgaccauaggcuaaugagugcagcaauuaaagacuccaaagcagugcaugccgauaugggauauuggauugagagcgaaaagaaugaaacuuggaagcuagcacgcgccagcuuuauugaggucaagacuugcacauggccaaaaagucacacccucuggucaaacggaguguuagaaucagagaugauaauuccaaagauuuacggaggacccauuagucaacacaacuaccgcccaggauacuuuacucaaacagcaggaccauggcacuuagggaaauuagaguuagacuuugaucuaugcgaagggaccaccgucguaguggaugaacacugcgguaauagagguccaagccucaggacgacuacugucacgggaaaaaucauucacgaaugguguugccgaagcuguacuuuaccgccguugcgauuccgcggagaggaugguuguugguaugggauggaaauacgcccugugaaagaaaaggaggaaaauuuaguucgaucaaugguaucagcgggcucaggugaagucgauagcuuuucauuagggaucuuaugcgcuucaaucaugauagaagaaguaaugaggucacgcuggucaagaaagaugcuaaugacaggcacauuagcaguauucuuacuacugauuaugggacaacuaacguggaaugauuuaauaagacuuuguaucaugguuggagcaaacgcuucagaucgaaugggcauggguacgacauaucuggcucuaauggcuacuuuuaaaaugaggcccauguuugcuguuggacuuuuauuuagaagacuuacauccagggaaguucugcucuuaacaauuggacuaaguuuaguggcgucaguugaacuaccuaauaguuuagaagaacucggagauggucuagcaauggggauuaugaugcugaaacuacuaacagaauuucaaccacaucaauuauggacuacccuucuaucuuuaacuuucauaaagacaacacuaucacuagacuaugcauggaaaaccacugcaauggcccuuagcauaguaagucuauuuccucuauguuugucaaccaccagccagaaaacuaccuggcuuccuguauuauuaggcucguuuggauguaagccacuaacaauguuuuuaauaacagaaaacaaaauauggggucgaaagaguuggccacugaaugaaggaauuauggcuauugguauaguuaguauacuccuaucaucccugcuaaagaacgauguuccacuggcaggaccuuuaaucgcgggcggaaugcuaauagcaugcuacguuaucaguggcucaagcgcagaccuaagccucgagaaagcggcagaaguaagcugggaacaagaggccgaacacucaggaacaucacauaauauacuuguagaaguccaagacgauggaacaaugaaaauuaaagaugaggaaagagacgauacccuuacgauauuauuaaaagcaacacuucuugcugugagcggcguauacccaauguccaucccagcaacgcuauucguuugguauuucuggcagaagaagaaacagcguucaggaguacuuugggauacuccaucaccacccgagguagaaagagcaguauuagaugauggaauuuacaggauuuuacaacgaggacuucuaggaagaucccaaguagggguggguguauuucaagauggaguauuucauacaauguggcacguuacacguggagcuguacuuauguaccaagggaaacgucucgagccuucgugggcaagcgucaagaaagaucuaauaagcuacggaggaggauggagauuccaggggucauggaauaccggggaggagguucaaguaauugcaguugaacccgguaaaaaccccaaaaaugugcaaacuacaccaggaacguucaaaacucccgaaggcgagguaggugcaauugcgcuugauuucaaaccaggaacuuccgggaguccaaucguaaacagagaagggaaaauugucggauuguacggaaaugggguuguuacuacaagugguacauaugucagugcgaucgcgcaggcgaaagcaagccaagaagggccauugccugaaauagaggaugaaguauucaagaaaagaaacuuaacgauuauggaucuucauccagguucugguaaaacgcgaagauaccuccccgccauaguaagggaggcgauaaagaggaaacugagaacccugaucuuagcuccaacacgugucguagcgucagaaauggcagaagcucucaaggggaugccaauucgauaucaaacuacggcugugaaauccgaacacacaggucgugaaaucguagaucuuaugugucacgcaacauuuacuaugagacucuuaaguccuguuaggguucccaacuacaacaugaucaucauggaugaagcacacuuuacagacccagcuucaauugcagcacgugguuacauaucaacucgggugggaaugggugaagcggccgcgaucuuuaugacagcaacgccacccgggucgguggaagccuucccccaaucaaacgcgguuauccaggaugaagaacgcgacauaccagaacgaucauggaacucaggauacgacuggauuaccgacuuucccgggaaaaccgucugguuuguuccuucuauaaaaaguggcaaugacauagccaauugucuuaggaaaaauggcaaaagggugauacaacuaucucgcaaaaccuuugauacagaauaucagaaaacuaaaaauaacgacugggauuauguaguaacuacggauauuagugaaaugggggcuaacuuuagagcagaucgcgucauugacccacgaagauguuugaaaccgguaauacuaaaggacggccccgaaagaguaauauuagcaggacccaugccagucacaguggcaagcgccgcacaaagaaggggcagaauuggaagaaaucaaaacaaagaaggagaccaauacguuuacaugggacaaccuuuaaauaaugacgaggaucaugcucauuggacagaagcgaaaaugcuacucgacaauauaaauacaccagaagggaucauaccagcguuauuugaaccugaaagggaaaaaucagcagcgauagauggagaguaucguuuaaggggagaagcucgcaaaacauuuguagaacucaugcgaagaggagauuuaccagucugguuaucauauaaaguugcuucugaaggcuuccaguauagugaccgcagaugguguuuugauggagaacguaauaaccagguucuugaggaaaauauggauguagaaauauggacaaaagaaggugagaggaagaaacugcgaccacgaugguuagacgcuagaacuuacagcgauccacuagcauugcgagaguucaaagaguucgcugcuggacgacgaagcgugagcggggaccugauacuggaaauagggaaguuaccucaacacuuaacucuccgugcucaaaacgcucucgauaauuuaguaaugcuacacaacagugaacaaggcgguaaagcguaucgucaugcuauggaagaauuaccagacacuauugaaacguuaaugcuauuggcgcuaauugcagucuugacagguggaguuacccucuucuuccuaucaggaaagggucucgguaaaacgaguaucggccuauuaugcgugaccgcaucuagugcacuccuguggauggcaucaguggagccacauuggaucgcagcguccauuauauuagaguucuuuuuaaugguguugcuaauaccugagccugaucgccaaagaacuccacaagauaaccaacuagccuauguaguaaucggauuacuguuuaugauacugacaguagcagcaaacgaaaugggguugcuugagacaacaaagaaagauuuagggaucggccauguagcagcugaaaaucaucagcaugcaacuaugcucgacguugacuuaagaccagccucagcguggaccuuauacgcaguagcaacuacaguuauaacuccgaugaugagacauacgauugaaaauacuacugccaauauaaguuuaacugcaaucgccaaucaagcggcaauccuaaugggccucgauaaagguuggccaauaagcaaaauggauauaggaguaccauuauuagcguuaggguguuauucucaaguaaauccucuaaccuuaacugcagcuguacucauguuagucgcccauuacgcaauaaucgguccaggacuccaagcaaaagcaacgcgagaagcccagaaaagaacugcagcgggaauaaugaaaaauccuacaguugacgggauaguagccaucgaucuugacccuguaguuuaugauacaaaauuugaaaaacagcuugggcaaauuaugcuauugauucuguguacgagucaaauccuucucaugcguacaacuugggcacuaugugaaaguauuacguuagccacaggacccuuaacaacgcuaugggaagguucaccaggaaaauuuuggaacacuacaauugcgguaaguauggcgaacauauuccgggggucauauuuggcaggggcagguuuggcuuuuucacuaaugaaaucuuuaggagggggacgacgaggcacuggagcgcagggagaaacauuaggcgagaaauggaaaaggcaacuuaaccaauuaucgaaaagugaauuuaacauauacaaaagaaguggaauuauggaaguugaucgaagcgaggcuaaggaaggacugaaacgaggagaaacuacaaagcacgcugucagucgaggaacagccaaauugagaugguuuguggagcgaaauuuagucaagccggaagguaaagucaucgacuuagggugugggagagguggauggaguuauuauugugccgggcuuaaaaagguaaccgagguaaaaggguauaccaaaggagggccgggacacgaagaaccgauuccuauggccacguacgguuggaacuuagucaaacuucacucugguaaagauguguucuuuaugccgccugaaaaaugugacacgcuccugugugacauuggugaaucgucaccaaacccaacuaucgaagaaggcagaacgcuacgaguauugaaaaugguagaaccuuggcucagaggaaaucaguuuuguauuaaaauauuaaauccuuauaugccaucugugguagagacuuuagaacaaaugcagagaaaauauggagguauguuagucagaaauccacuaaguagaaauucuacacaugaaauguauuggguuaguugcgggacaggaaauauaguuucagcgguuaacaugaccucucgaauguuacugaaucguuuuaccauggcacauagaaaaccuaccuaugaaagagacguugaccucggggcaggaacaagacauguagcagucgaaccagagguagccaauuuagacauuauuggccagagaauagagaauauaaagaaugaacauaaaucgacuuggcacuaugacgaagacaacccauauaagacaugggccuaucaugguucauaugaagucaagccaucaggcagugcgaguucgauggugaacggcgucguucgauuacuuacgaaaccgugggacguaauaccaaugguaacucaaauagcaaugacagauacgacgcccuucggucagcagcgaguauuuaaagaaaaaguagacacacgaacgcccagggcuaaaagaggaacuacacagaucauggaagucacagcuaagugguuauggggauuucuaucucgaaacaagaaaccacguauaugcacacgagaagaauuuacacguaaggucagaagcaaugccgcuaucggugcaguauuuguagacgaaaaucaauggaacuccgcuaaagaggccguggaagaugagcgcuuuugggacuuaguacacagagaacgagaauuacacaaacaaggaaaaugugccacguguguauacaauaugauggggaaaagggagaagaaacuuggugaguucgguaaggcaaagggcuccagagcgauaugguacauguggcuaggagcaagauuuuuggaguuugaagcccuaggauucaugaacgaagaucacugguucucucgugaaaauucacucucugguguugagggagagggacuccauaaacuaggcuacauuuugcgugauauaaguaaaauaccaggaggaaauauguacgcggacgacacagcagggugggacacaaggauuacagaagacgaccuacaaaaugaagcuaaaauaacagauauaauggagcccgaacaugccuuauuagcaacuuccauuuuuaaauuaacauaccagaauaaaguggugagaguacaaagaccggccaaaaaugguacggugauggacguaauaucuagaagagaccaacguggaucuggccaaguaggcacauacggacuaaacacguucacgaauauggaagugcagcuuauucgacaaauggaaagugaaggaauauuuuuaccaagugaacuugaaacuccgaaucuugcggaaagaguguuagauugguuagaaaaacacggugcugagcgauuaaaaagaauggcgaucaguggggacgauugcguuguaaaaccuauagacgauagguucgcaacugcacugacugcacuaaaugacaugggcaaaguucgaaaggauauaccccaaugggaaccguccaagggcuggaaugacuggcaacagguccccuuuuguagccaucacuuucaucagcugaucaugaaagauggucgggaaauaguugucccaugucguaaucaagacgaauuagugggucgcgcaagaguaucucagggggcaggauggucucuaagggaaacggcaugcuugggaaagucguacgcacagauguggcaauuaauguauuuucacagacgugauuugagauuagcagcaaacgcaauuuguucggcaguaccaguugacugggugccuacuagcaggacgacuuggucuauacaugcccaucaucaguggaugacuacagaggauaugcucucagucuggaaccguguauggauagaggaaaacccauggauggaagauaagacacacguauccucuugggaagaggugccauaccuagguaagagggaggaucaaugguguggcucucuuauaggucuuaccgcaagggcgaccugggcuacgaauauucaaguagcaauaaaucaaguucggaggcuaauaggcaacgagaacuacuuagacuacaugacaaguaugaaacgguuuaagaaugaaagcgacccugaaggggcacugugguag

SEQ ID NO: 21305 - RNA, 9879 nt, Artificial Sequence
  derived and/or modified CDS sequence (opt6) from DENV-1__GQ199857__SS-prME
agcgucacuaugcuucugaugcuuuuaccuacugcguuagcauuucaccuuacuaccagaggaggcgaaccgcauaugauaguuuccaaacaagagcgagguaaaucauuauuauuuaaaacuucagcagggguaaacaugugcacguuaauagcaauggaucuaggagaacuuugcgaagauacuaugaccuauaaauguccccaaauaacugaagcagaaccagaugauguggauugcugguguaacgcaacugacacguggguaacuuacgggacauguucgcaaacuggcgaacaucgaagagauaaacgaagcguugcauuggcuccacacguuggcuuaggauuagagacacgcacggaaacuuggaugagcucugagggagcuuggaaacaaauacagcguguagaaacuugggcuuugagacauccaggauucacuguuauugcauuguuuuuagcacacgcaauaggaacgucaauaacacagaaaggaauaauauuuauacuguuaauguuggucacucccaguauggcaaugagguguguggggauuggaaauagagauuuuguugaaggacuuagcggugcgacuuggguagacgugguauuagagcaugguucuugcguaacaacaauggccaaaaacaaaccaacccuugacauagaacuuuugaaaacugaaguaacgaaucccgcaauucuccgaaaauuauguauugaagcaaaaaucucuaacacaacgaccgacucaagauguccgacacaaggggaagcaacacuuguugaagaacaggaugcuaacuuuguaugucgaagaacguucguugaucgaggguggggaaacggaugcggacucuuuggaaaagguagucuucuaacaugugcgaaauucaaauguguaacuaaacuugaggguaaaauuguacaguacgaaaaccucaaauauaguguuauugucacgguacauaccggagaucaacaucaagugggcaacgaaaccaccgaacauggaacaauugcuaccauaacaccacaggcaccaacaagcgaaauucagcucacagauuacggggcucugacacucgauugcaguccacgaacuggucuugacuuuaaugaaaugguguugcuaacgaugaaagaaaaaucuugguuaguacauaaacagugguucuuagacuuaccacuccccuggacaaguggagcuucaacaucgcaagaaacuuggaacaggcaagaucuccugguaaccuuuaaaaccgcucaugccaagaaacaggaaguaguuguuuuaggaucgcaagaaggugcaaugcacacagcacuaacuggagccaccgaaauccaaaccucaggaacgacaacaauauuugcaggccauuuaaaaugccgauuaaaaauggacaagcuaacccucaaggguaccucguaugugaugugcaccggcaguuuuaaguuggaaaaagaagucgcagaaacccaacacgggacuguccuugugcaaguuaaauacgaagguacggacgcaccauguaagaucccguucucuacacaagaugagaagggagugacacagaacggaagacuuauaacugcaaauccaauugugaccgacaaagaaaagccaguuaauauugaaacagagccaccuuuuggggaaucuuauauugucguaggagcgggagaaaaggcauuaaaacuaaguugguuuaagaaaggaaguaguauaggaaagauguucgaagccacagcacgaggugcgaggagaauggcaauauuaggagauacggcgugggauuucgggucaauuggcgguguauuuacaaguguuggaaaacuugugcaucaagucuuuggaaccgcuuacggagucuuguucucggggguaaguuggaccaugaaaauuggaauaggaauuuuauuaacuugguugggcuuaaauagucgaaguacaagucuaagcaugacauguauagcaguagggaugguaacucuguaccuaggagugaugguucaggcugauucaggguguguaauaaacuggaaaggcagggagcuuaaaugugguuccggaaucuuuguaacuaaugaagugcacacauggacggaacaguauaaauuccaagccgauaguccgaaaagacuaucagcagccauagguaaggcuugggaagaaggaguauguggaauacgaagugccacgagauuggaaaauauaauguggaaacaaauaaguaaugaguuaaaucauauuuuacuagaaaacgauaugaaauucacgguaguaguaggagacgcgaaugguauacuugcacaagggaagaaaaugauacgaccccaaccuauggaacauaaauauuccuggaaaucaugggguaaggcuaagauaauaggagcugacauccagaauacgacauuuauuaucgacgguccggacacccccgaauguccagauaaccaaagagcauggaacauaugggaaguggaagacuacggguuugguauuuucacaacuaauaucuggcuaaaguugcgagacucuuauacccaaaugugugaucauaggcugaugagcgcugcaaucaaagacuccaaggcagugcaugccgacaugggguauuggauagaaagcgaaaagaaugagacauggaaguuggcuagagcguccuucauagaaguaaaaacaugcacuuggccaaaaucgcauacgcuaugguccaaugguguuuuagaaagugaaaugaucaucccaaaaauauacggaggaccuauuucucagcauaacuauaggccgggauacuuuacucaaacagcagguccguggcacuuaggaaaacuugaacucgauuuugacuuaugugaagggacuacuguugugguagacgaacauugcgguaaucgugguccaucuuuaaggacaacuaccgugaccggcaaaauuauacaugaauggugcugcaggucuuguacauuaccacccuugagauucagaggggaagaugguuguugguacggcauggaaauucgucccgucaaagaaaaagaagagaaucuagugagaaguaugguaagugcggguucaggagaggucgauucauuuucacuagguauauugugcgcuucuaucaugauugaagaaguaaugagaucaagauggaguagaaagaugcuuaugacagguacauuagcaguuuuucuacuacuaaucaugggucaauuaaccuggaacgaccuaauacgguuauguaucaugguaggggcaaaugccagugacagaaugggcaugggaacaacuuacuuagcauugauggcuacauucaaaaugaggccgauguuugcagucggguuacuguucagaagacuaacaucccgugaaguccuucuacugacuauagguuuaucuuuaguugcgagugucgaauuacccaacagucuagaagaauuaggagauggauuagcgauggguaucaugauguuaaaacuacugacggaauuucagccucaucaguuauggacgacgcuuuugaguuuaacauuuauaaaaacuacauugaguuuagauuaugcguggaagaccacagcuauggcauugucaauaauuagccuauuuccccuauguuugaguacuacaagucagaaaacaacuuggcuaccaguauuacucggguccuucggcuguaagccauuaaccauguuccugauuacugaaaauaaaauauggggacgaaaaaguuggccgcugaacgaaggaauuauggcgaucggcaucgucucuauacuauuaucuaguuuacugaaaaaugacguuccccuugcgggacccuugauugccggugguauguuaaucgcguguuaugucauuucuggcucaagcgcugaucuuaguuuggagaaggcugccgaagucucgugggaacaggaagcagagcauagcggcacaagucauaacauccuagucgaagugcaagacgauggaacaaugaaaauuaaggaugaagaaagggacgauaccuuaacgauuuuacuaaaagcaacacuccuagccguuaguggaguguauccaaugucgaucccagcuacacuauucguaugguauuucuggcagaagaagaaacagagaucugggguccuaugggacacacccagcccaccagaagucgaaagagcaguuuuagacgaugguauuuacagaauacuacagagaggucuacucgguaggucgcaagucggaguuggugucuuucaggauggagucuuucacacgauguggcauguaacuagaggcgcaguauuaauguaucaggguaaaagguuggagccaucaugggcgucagucaagaaagaucucauaagcuacgggggagguuggagauuucagggaucuuggaacacaggggaagaagugcaaguaauagcaguagagccaggcaaaaaucccaaaaauguucagaccacacccgguaccuucaagaccccagaaggagaagucggugcaauagcauuagauuuuaaacccggaacaaguggaucuccgauugugaaucgggaagguaaaauaguaggacucuauggaaacggaguaguaacgaccaguggaacuuacguaucagcuaucgcccaagcuaaagcgagucaagaggggcccuuaccugaaauugaggacgaaguuuuuaagaaaagaaaccuaaccauaauggaccuucauccaggcuccggaaaaacucggagauaucugcccgcuaucguaagagaggcaauaaaacgaaaauuacgaacacuuauacuagcaccgacacgaguaguagcaucugaaauggccgaagcacucaaaggaaugccuauaagauaucagacaacagccguuaaguccgagcacacugggcgagaaauagucgacuuaaugugccaugcaaccuucaccaugcgccuccuaucaccagugagaguaccuaauuacaauaugauaaucauggaugaagcacacuuuacagacccugcaagcauagcggcucgagguuacauauccacccguguggggaugggagaggccgcagcaauauucaugaccgcuacaccuccagguuccguagaggccuuuccucaaagcaaugcggucauccaagaugaagagagggauauuccggagagauccuggaacucgggauacgauuggauaacggauuucccgggaaaaacaguaugguuuguacccagcauaaagucugguaaugacauagcgaauuguuuaagaaagaauggcaaaaggguaauacaauugaguagaaaaacauuugauacugaauaucagaaaacgaaaaauaacgauugggauuauguagugaccacagauauaagcgaaaugggcgcuaauuuuagagccgaucggguuauugauccuagaagguguuugaaaccugucauauuaaaagacgguccagagcggguaauccucgcggggccgaugccaguuaccguagccucugcugcacaaagaagaggacgaauaggucguaaccaaaacaaagaaggugaucaauauguauauaugggacagccauugaacaacgacgaggaccaugcacacuggacagaagcaaagauguuauuagauaauauuaacacacccgaaggcauaauaccugcucucuuugagcccgaaagagaaaagucagcggcgaucgacggagaguaucguuugaggggagaagcacguaagacauuuguggagcuuaugagacgcggggaucuuccagucuggcuaucauauaaagucgccucagaaggauuccaauauucagauaggagaugguguuuugauggagaaagaaauaaucaaguuuuagaggagaacauggacguagagauauggacgaaggaaggcgaaagaaagaaauuacgaccuagguggcuugacgcaaggacuuacagugacccauuagcacuccgugaguuuaaagaauuugcagcuggaagaaggagcguaucuggagaucucauacucgaaauuggaaagcuaccacaacaccuuacacuuagagcacaaaaugcguuagauaaccugguaaugcuucacaacagcgagcaaggcgguaaagccuaccgacacgcaauggaagaacuacccgauaccauugagacgcuaaugcuccucgcacuaaucgccguucuaacugguggaguaacucuauucuuuuuaucaggaaaagguuuagguaagacgucuauaggacuuuuguguguuacugcuucaucugcacuucuuuggauggcuucaguugagccacauuggaucgcagcgagcaucauccucgaguuuuuccucaugguucuguuaauuccggaacccgauaggcagagaacaccacaggauaaucaacuagcguacguaguaauaggacuccuauuuaugauacuuacuguagcugcgaaugaaauggguuuguuggaaacaaccaagaaagaccugggaauaggacauguugcugcggaaaaccaccagcaugcuacuauguuagauguagauuugagaccagcaucagcguggacuuuauacgcgguagcuacaaccgucauaacuccaaugaugagacacacaauagaaaacacaacagccaauauauccuuaacugccauagcgaaucaagcagcuauacuaaugggccuagacaagggauggccgaucucgaagauggauauaggagucccacucuuagcuuugggcugcuauucucaggugaacccucuaacauuaacugccgccguauuaauguuaguggcgcauuaugcuauaauaggcccgggucuacaagcaaaggcuacucgagaagcccaaaagaggacugcagcagggaucaugaagaacccaacgguugacgggauuguggcaauagauuuagauccuguuguauacgauaccaaauuugaaaaacaauuaggacaaauuaugcuacugauccucuguacuucucaaauauuacucaugcgaaccacaugggcacucugugaaucuauuacuuuagcuaccggaccucugacaacuuuaugggaagguucuccaggaaaauuuuggaauacaacuaucgcaguaaguauggcgaauauauucagagguagcuauuuagccggagcaggccuggcguuuucauuaaugaaaagucuaggagguggaaggcgugguaccggagcccaaggcgaaacacuaggagagaaauggaagcggcaauuaaaucaacuuucaaaaucagaguucaauauuuauaaaaggaguggcaucauggaaguugauagaucagaagcgaaagaaggacuaaaaagaggggaaaccacaaaacaugcuguuagccgaggaaccgcaaaauugagaugguuuguugaacguaauuuagugaaaccagaaggcaaaguaauagacuuaggaugcgggcgaggaggguggucauacuacugcgcaggccuuaagaaaguuaccgagguaaaaggauauacaaaaggugggccgggccacgaggaaccaauuccaauggcaacuuaugguuggaaucuaguaaaguuacauagugguaaagacguguucuucaugccaccugagaaaugugauacccuauugugugauauuggagaaaguucgccgaacccgacaauugaagaaggacgaacucuacguguauuaaaaaugguugagccuugguuacgugguaaucaauucuguauuaaaauucuaaaucccuauaugccaucugucguugaaacgcuugaacaaaugcagcgaaaguacggggguauguugguuagaaacccucugucaaggaacagcacacaugagauguacuggguuaguugcgguaccggaaauauaguaagcgcaguaaauaugacaagccggaugcuucugaaccgcuuuacaauggcccaccgaaagccaaccuaugagcgggaugucgaucucggagcaggaacaagacacguagcgguagaaccagaggucgcuaacuuagauauaauagggcaaagaauagaaaacauaaagaaugaacauaaaucaaccuggcauuacgaugaggauaauccuuauaagacuugggcauaucaugguaguuaugaggugaagccuagcggaucagccucaucuaugguaaauggaguggucagacuauuaacaaaacccugggauguuauaccuaugguuacacaaauugcgaugacugacacaacuccuuuuggucagcaaaggguauucaaagaaaaagucgauacaagaacaccuagggcgaaacgaggcacuacucagauaauggaaguaacggcaaaguggcucuggggauucuugagcagaaauaagaaaccaagaaucugcacgagagaagaguucacucgcaaaguacgguccaacgcugcaauaggugcgguauucauugaugaaaaucaauggaacucagcuaaagaagcaguagaagacgaaagguucugggauuuaguucacagagaaagggaacugcauaagcaaggaaaaugugcaacauguguauacaauaugauggguaaacgugaaaagaaauugggggaauuuggcaaagcuaaggguucuagagcuauuugguauauguggcucggagcucguuuucucgaauuugaagcacuaggauucaugaaugaagaccacugguucucuagagaaaauaguuugucaggugucgaaggagaaggguuacauaagcuaggguauauauuaagagauauaaguaagauaccugguggcaacauguaugccgacgacaccgcuggcugggauacuaggauaacugaagaugaccuacaaaacgaagcuaaaauaaccgauauaauggaaccagaacaugcguugcuagcaacgucuaucuucaaacuaacauaccaaaauaaagugguacguguacagagaccugcgaaaaaugguacgguuauggauguuauaagcagacgcgaucagcguggaucgggucaagugggaacuuacggucucaauacauuuacuaauauggaaguacaacucauuagacaaauggaaagugaggggauauuucucccuagcgaacucgaaacccccaaucuggcagaacgaguucucgauugguuggaaaaacauggagccgaacgccuuaaaagaauggcuauaaguggagacgauugugucgugaagcccauugaugauagguucgcgacggcauuaacugcucugaacgacauggguaaaguucggaaagauauuccucagugggaaccuagcaaaggauggaacgacuggcaacaaguaccuuucuguagucaucauuuucaucaacuuauaaugaaagauggcagagagaucguaguucccuguagaaaucaagacgaguuggucggucgugcacgugugucacagggagccggauggucgcuacgugaaacugcaugucuagggaaaucauaugcacaaauguggcaauugauguauuuccaccgaagagacuuaaggcuagcagcaaaugccauuuguagcgcuguucccguugacugggucccgacaucccgaacgacuuggaguauucacgcccaucaucaauggaugacaacugaagacauguuaucaguguggaaccgaguauggaucgaggagaauccauggauggaagauaaaacucauguuucaucaugggaagaaguccccuacuuaggaaagagagaagaucaauggugugguagucuaaucggguuaaccgcaagagcaaccugggccacaaauauacaaguagcgauuaaccaaguccgccgacugaucggaaaugaaaauuacuuagauuauaugaccuccaugaagcgauuuaaaaacgaaagugaucccgagggugccuuaugguag

SEQ ID NO: 21306 - RNA, 9879 nt, Artificial Sequence
  derived and/or modified CDS sequence (opt6) from DENV-1__GQ199858__SS-prME
agcguaacgaugcuccuaauguuauuaccaacugcuuuagcguuucauuugaccacgcgcgggggagaaccacauaugaucguuucaaaacaagagcguggaaaaagucuauuauuuaaaacuucagccggaguuaauaugugcacccuaauagcuauggaucucggagaauugugcgaagauacuaugacauauaaauguccacaaaucacugaggcugaaccagacgauguggacugcugguguaaugcaaccgacacaugggugacuuacgguaccuguucccaaaccggggaacacaggagggauaaaagaaguguagcauuggcuccgcacguaggguugggucuugaaacuagaaccgaaacuuggaugaguuccgaaggagcguggaaacaaauccaaagagucgaaacaugggcacuacgacauccuggauuuacagucauagcucuguuuuuagcgcacgcaauaggaacaucuauaacgcaaaaaggaauaauuuucauacuucugaugcuaguaacgccgagcauggcuaugagauguguugguauuggaaacagagauuucguggaaggacuaucaggugccaccuggguugaugucguuuuagagcaugggucguguguaacaacaauggccaaaaauaaaccaacauuggacauugaauuauuaaaaacugaagugaccaauccagcuauauuaagaaaauugugcauagaagcaaaaauaaguaauacaacaacggacucacgauguccgacccaaggagaagcuacuuugguagaagaacaagacgcuaauuuuguaugucggcggacguuuguggaccggggaugggguaauggguguggacuguucggcaaaggcagcuuauuaacaugcgcuaaauucaaaugcgucacaaaacuagaaggaaaaauaguucaauaugaaaacuuaaaauauagugucaucguaacaguccacacuggcgaucaacaccaagucgguaaugaaacuacggaacaugggacaauagcaacuauaacgccccaagccccaacaucggaaauucaauuaacagauuacggugcuuuaacacucgauuguagccccaggacaggacuugauuuuaacgaaauggucuuauuaacuaugaaagagaaaucuugguugguacauaaacagugguuucuagaucuaccauugccauggaccucaggggcuaguacgagucaagagacuuggaaucgucaagauuuacuggugacuuuuaagacugcccacgcgaagaaacaagagguaguuguccucggcagucaagaaggagcgaugcauaccgcacucaccggcgccaccgaaauucaaaccucagguacuacuacuauauuugcuggucaccuaaaaugucgauuaaaaauggauaagcuaacacuaaaagggacuucauauguaauguguacugggagcuuuaagcuagaaaaagaagucgcugaaacucaacacggaacaguccuaguucaaguaaaauaugaagggaccgacgcaccaugcaaaaucccuuuuaguacacaggacgagaaaggugucacacaaaauggaagacugauuacugcgaacccaauaguuaccgauaaagaaaagccaguaaacauugagacugaaccuccauucggagagucuuauauaguaguuggugcgggugaaaaagcgcucaaacuuaguugguuuaagaaagggaguucgauaggaaagauguucgaggccacagcccgaggagcaaggcggauggcgauauuaggagacacagcaugggacuucgguagcauagguggaguauucacaucgguaggaaagcuaguccaucaaguguucgguaccgcauacggaguccuguuuuccggaguaucuuggacuaugaagauuggcauaggcauacugcuaacauggcuuggacugaauaguaggaguacuucguugucaaugacuugcauugcaguaggaaugguuacgcuguaucuaggugugaugguacaagcugacuccgguuguguaaucaauuggaaagguagagaacuaaaaugcggaagcgguaucuuugugacuaacgaaguucacacauggaccgagcaauacaaauuucaagcugauagucccaaacgauuaucagcagcaauaggcaaagcaugggaagaaggugucuguggcauaagauccgccacuagacuugagaacauaauguggaagcaaauaucaaacgagcucaaccacauuuuauuagaaaacgauaugaaauucacaguagucgugggagacgccaauggcauacuugcucaaggcaagaaaaugauacgaccccaaccaauggaacauaaauacaguuggaaaucuugggguaaagccaaaauaauuggggcagauauacaaaacacuaccuuuauuauagaugguccagacacucccgaaugcccagacaaccaaagagcguggaauauaugggagguugaagauuauggcuuugguauauucacaacaaacauuuggcuaaaacuuagagauucauacacgcagaugugugaccaccguuuaaugucggcagcaauuaaagacaguaaagccguccaugcagauaugggguacuggauagagagugagaagaaugagacuuggaaauuggcccgugcuucauucauagaagucaaaacauguaccuggccaaaaagccacacucucuggaguaauggagucuuggaaucugagaugauuauuccuaaaauauauggcgggccaauaucacagcauaacuacagaccuggauauuuuacucaaacugcgggacccuggcaucucggaaaacuugaacuggacuuugaucuaugugagggcacaacuguaguaguagacgaacauugcggaaacagagguccgagcuuacgaacaacuaccguaacagguaaaauaauccacgaaugguguugccgauccugcaccuugccuccccuuagauucaggggagaagacggaugcugguacgggauggaaauacgaccaguuaaagaaaaagaagaaaaccucguaaggucaaugguaucugcagguucuggagagguagauucuuuuagcuuaggcauauuaugugcaucaaucaugauugaagaaguaaugcggucucguuggucgagaaagauguugaugaccggaacacuugccguauuucuguuacuuauaaugggccaacugacauggaaugaccuaaucagguuaugcauaauggugggagcuaaugcaucggauagaaugggcaugggaacuacauaccuugcccucauggcaacauucaaaaugcgaccuauguucgcuguaggacuucucuucagaaggcuuacaucccgggaagucuuacuacuaacaauaggacugagucuggucgcgucuguagaguuaccaaauaguuuagaggaacuuggagaugguuuagcuauggguauaaugaugcuaaaacuuuugacugaauuucagccucaucaacucuggacuacauugcugagucuuaccuucauuaaaacaacccuuucgcuugauuaugcguggaaaacaacggcuauggcgcuaucuauaaucucacuauuuccacuaugccuuucuacgacaagccagaaaacuacuuggcuuccuguucuucuaggaucauuugguuguaaaccucuaaccauguuucuaauaacagaaaauaaaaucuggggaagaaagagcuggccucugaacgaagguauaauggcaauaggcaucguuucuauccuuuuaagcucucuuuugaaaaacgaugucccgcuggcugggccacuaaucgcaggagguauguugauagcaugcuacguuauaagcggcucuagugcagauuugagucuugaaaaagcugccgaaguuuccugggaacaggaagcagaacacuccggaacaagucauaacauuuugguugaaguccaagaugauggaaccaugaaaauaaaagaugaggaacgagacgauaccuuaacaauacuauugaaagcaacacuuuuggcagugagcgguguuuauccaaugucaauacccgcgacguuguuuguaugguauuuuuggcaaaagaagaaacagagaucagguguguugugggauaccccaagucccccagagguugaaagagcagugcucgaugauggcaucuaccgaauccuccagcgaggacucuuaggcagaagccaaguggguguggguguuuuucaagacggaguauuucauacaauguggcaugucacacgcggggcaguacuaauguaccaaggaaaaagacuugagccgucaugggccucugugaaaaaggaucuuauaucguaugggggcggguggagguuucaagguucguggaauacaggggaggaaguacaaguuauugccguagagcccggaaagaaucccaaaaaugugcagacaacgcccgguacuuuuaagacaccagaaggagagguaggagcaauagcgcuagauuuuaaaccuggaacgagcggcucaccgauuguaaauagagaaggcaaaauagugggacucuaugguaauggaguaguaacgacgucgggaacauacgugagugcaaucgcacaagcuaaagcaucucaagagggcccuuuaccagaaauugaagaugaaguguucaagaaacguaaucucacaauuauggauuuacaucccgggucaggcaagacaagacgauauuuaccagcuauaguacgagaagcuauuaagagaaaacuacggacguuaauauuagcaccuacaagaguaguagcgagcgaaauggcggaagcacugaaaggaaugcccauacguuaccagacaacagcaguuaagagcgaacauaccggcagagaaaucguggacuuaaugugucacgccacuuucacuaugagacuuuugagucccguucgugugccuaauuauaauaugauaauuauggacgaagcccauuuuaccgacccagcaagcauagcugcuaggggguauauuucuacucguguugguaugggagaagcugcugcuaucuucaugacugccaccccuccaggaucuguagaagccuuuccccaaucuaacgcaguaauacaagacgaagaaagagauauacccgagcguucauggaacuccggauaugauuggaucacugauuucccuggaaaaacugucugguuuguucccaguauaaaauccgggaaugauaucgcgaauugucuucguaaaaaugguaaacgagucauucaguuaagccgaaagacuuucgacaccgaauaucagaagacuaaaaauaaugauugggauuauguaguaaccacagauauaucggagaugggagcuaauuuucgcgcagacagaguaaucgauccaagacgcugucuaaaaccuguuauuuugaaggacgguccagagcgaguaauucuagcugguccuaugccagugacuguggcauccgcagcgcagcggcgaggucguauagggaggaaucaaaacaaggagggugaucaguacgucuauaugggacaaccauugaauaacgaugaagaccaugcgcacuggaccgaggcaaagauguuauuggacaauaucaauaccccugaagguauaaucccugcacuuuucgaaccggaacgagaaaaauccgcagccauagauggugaauaccgcuuacgaggugaagcucguaagacuuucguagaacuaaugcggcgaggagacuuaccaguuugguugucauacaaaguagcaucggaagguuuucaauacagcgacagaagaugguguuuugacggugaaagaaacaaucaaguacuagaagaaaacauggacguagaaauuuggacgaaggaaggcgagcgaaagaagcucaggccacgaugguuagacgcuagaacguauucagauccuuuagcauugagagaauuuaaagaguucgcagcaggaaggcguucaguaucgggcgaucuaauucuagaaauaggaaaauuaccgcaacaucucacacuccgcgcacagaaugcauuagauaacuuagucauguuacauaacagugaacaaggggguaaagcauacagacaugccauggaggaacuucccgacacaauagagacacuaaugcuucuagcauuaauugcuguucuaacaggcgggguaacgcuauucuuucuaucugggaaaggcuuaggaaaaacaaguauaggccuccuuuguguaacggcaucaagugcauuacucuggauggcauccguagaaccacauuggauagcugcuucuauaauucuagaguucuuucuaauggugcuuuuaauaccagaaccggauagacaaagaacgccccaagauaaucaacuugcguacguuguuaucggucuuuuauucaugauacuaaccguugcugcaaacgaaaugggcuuauuagaaacgacaaagaaagacuuaggaaucggacacguagcagcagagaaucaccaacacgcuacaaugcuagacgucgacuuaagaccagcuagugccuggacuuuguaugcaguagcuacaacaguuaucacacccaugaugcgucacacuauagaaaacaccacagcuaacauuagucuaaccgccauugccaaucaagcggcgauccuaaugggccuggacaaaggauggccaauaucaaaaauggauauuggagucccucuucuugccuugggaugcuauucacagguaaauccacuaacuuuaacagcugcuguauuaauguugguggcacauuacgcgauaaucgggccaggacuucaggcaaaagcaacuagagaagcacagaaaagaacagcggcaggcauaaugaagaacccuacuguagacgguauaguugcgauagauuuagauccaguuguauacgacacgaaauucgaaaaacaacuaggccaaauaauguuacuuauacuguguacgucucagauccuauuaaugagaacaacuugggcacuaugugaaaguauuacacuugcaacaggcccuuuaacaacacuaugggaagguaguccggguaaauuuuggaacacgacaauagcaguuucaauggcgaauaucuucaggggguccuaucuagcgggcgcgggacuagcauucucgcuaaugaaaagucuagguggaggaaggagaggaaccggugcccaaggcgaaacguugggugagaaauggaaacgucaauuaaaucaacuaucaaaaucugaauuuaauaucuacaaaagaagugggauaauggagguggacagaucggaggcuaaagaaggacugaagcgaggggagacuacaaaacaugcaguaagccggggaacugccaaauugagaugguuuguagagcguaaccuaguaaaaccagaaggaaaagugauagaucugggaugugguagagguggauggucauacuauugugcuggacuuaagaaagugacggaaguaaagggcuacacaaaaggaggucugggucaugaagaacccauaccaauggcgacauacgguuggaacuuaguaaaacuacacagugguaaagauguauucuuuaugccuccagaaaaaugugauacacuguugugugauauaggugaaucaagcccaaauccuacgauagaagaaggacgaacucuaagaguuuugaagaugguugaaccauggcuacgaggaaaucaauucuguauuaagauauuaaauccuuacaugccaaguguggucgagacauuagaacaaaugcagagaaaauacggagggaugcugguucgaaauccccugucccguaauagcacucaugaaauguauugggugucuugugguacagggaauauagucucagccguaaauaugacauccaggaugcuuuuaaaucgguuuaccauggcacaucgaaaaccaacguaugagcgagauguagaccuaggagcaggaacuaggcacguggcagucgaaccggaaguagcaaaucuagacaucaucggccaacgaauagaaaauauaaagaacgaacacaaaucuacauggcacuacgacgaagacaacccguauaagacuugggcuuaucacgguagcuaugaaguaaaaccgucagggagugcaucgucaauggugaacggaguuguacgucuacuaacgaaaccgugggaugucauaccuaugguaacucagaucgcaaugacagauacgacccccuuuggucaacagagaguuuucaaagaaaaaguugauacacggacuccaagggcuaagagaggcacaacucagauuauggaaguaaccgcaaaaugguuaugggguuuucuaaguaggaauaagaaaccacggauauguacgagagaagaguucacucgaaaagucagaucgaaugcagcaauuggagcgguauuuguagaugagaaucaguggaacuccgccaaggaagcaguagaagaugaaagauuuugggacuuagugcauagagaaagagaauuacauaaacaggguaaaugugcaaccugugucuacaacaugaugggcaaacgugagaagaaacuaggagaguuuggcaaagcaaagggaucaagggcuauuugguauauguggcuaggcgcacgauucuuagaguucgaagcucuugguuucaugaacgaagaucauugguucucacgugaaaacaguuuaagcgguguugaaggcgaagggcuacauaaauuaggauauauucuaagagacauuagcaaaauuccuggagguaauauguacgcagaugauacagcgggaugggauacaaggauuacggaagaugaucuccagaaugaggcuaaaauaaccgacauuauggagccggaacaugcacuacuagccacaagcaucuuuaaauuaaccuaccagaauaaaguugucaggguucaaagaccggcgaagaacgggaccguaauggaugugaucagucgaagagaucagagaggaucaggucaaguggggacuuaugguuuaaauacuuucacuaacauggaaguccaacucauaagacagauggaguccgaaggcauauuucuucccucugaauuggagacuccuaacuuagcugaaaggguacuugauuggcuagaaaagcacggagcagaacguuugaagagaauggcaaucaguggggaugauugcgucgucaaacccauagacgaucgguuugcaacagcgcuaacugcauuaaaugauaugggcaaaguuagaaaagauauaccgcagugggaaccauccaaaggcuggaaugacuggcaacaagugccauucugcagccaucacuuucaucaacuaauaaugaaggauggcagagaaaucgucguuccuugcaggaaucaggaugaacuuguaggcagagccagggucagucaaggggcagguuggaguuuacgugagacagcaugcuugggaaaaucauaugcucaaauguggcaacucauguauuuucauagacgugauuuaagacuagcggcaaaugcaaucuguucugccguaccuguagacuggguacccacaucacgaaccacauggagcauucaugcucaucaucaguggaugaccacagaagauauguugucaguauggaacagagucuggauagaagaaaacccauggauggaagauaagacacauguaucuagcugggaggaaguaccauauuuaggaaaaagagaggaucaaugguguggaucguugaucgguuugacagcaagagcaacaugggccacaaauauucaaguagcaaucaaccaagugcggcggcugaucgguaaugagaacuaccuugauuacaugacaucgaugaaacgauuuaaaaacgaaucugauccagaaggcgcacuuugguga

SEQ ID NO: 21307 - RNA, 9879 nt, Artificial Sequence
  derived and/or modified CDS sequence (opt6) from DENV-1__GQ199859__SS-prME
agcguuacuauguuguuaauguuauuaccaacugcauuggcauuccacuuaacgacuagagggggagaaccgcacaugauaguuucuaaacaugaaagaggcaaaagucuccuguuuaaaaccagcacuggaguuaacauguguacuuuaauagccauggauuuaggcgaacuaugugaagauacuaugacuuauaaaugcccuagaauaacagaagcagaaccagacgauguagacugcuggugcaaugcaacggauacguggguuacauacggaacaugcucacaaacaggugaacauagacgagauaaaagaaguguggcccuugcgccacacguaggucucgguuuagaaacaagaacagagacauggaugagcagcgaaggagcuuggaaacaaauacaaagaguugaaacuugggcauuacgacaucccggauucacaguuauugcucuauuuuuagcacaugcuaucggaacauccauaacgcaaaaaggcaucauauuuauauuauuaauguuagugacaccgucaauggcgaugagguguguaggaaucgguaaucgcgauuucguugagggucuuagcggagcuacuugggucgauguaguauuagaacacgguagcugugugacuacuauggcuaaaaauaaacccaccuuagacauagaacuacucaaaaccgaaguuacuaauccggcaguauuaagaaaauuauguauugaagcgaagauaagcaauacgacgacagauucucguugcccaacacaaggagaagcgacuuuaguagaagaacaagacgcaaacuuugugugucgccguacauugguagacagggguuggggcaaugguugcggucuauuuggcaaagguagucuguuaacaugugcgaaauucaaguguguuacaaaauuagaggguaaaaucgugcaauaugaaaauuuaaaauacucaguaauuguaacagugcauacaggcgaccaacaccaagucggaaacgaaacaacugaacacgguacaauagcaacuauaacaccgcaagcgccgacaucagaaauacaauuaacggacuauggagcacugacgcuggauuguucuccccguacaggcuuagauuuuaaugaaaugguauuauuaacaaugaaagaaaaaucguggcuuguucacaaacaaugguuccuugaucuaccacuaccguggacguccggugcaaguacuagccaggagaccuggaacaggcaagaccuacuuguuaccuuuaaaacugcacaugcuaagaaacaagaaguaguagugcuaggaagccaggaaggggcuaugcauaccgcccuaaccggugcgaccgaaauacaaacaucaggaacuacaacuauauuugccggucaucuuaaaugucgacuaaaaauggauaaguuaacccugaagggcacgaguuauguaaugugcacaggaaguuuuaaacuagagaaggaaguagcugaaacgcaacaugggacagugcuuguccaaguaaaauacgaagguacagaugcgccuuguaaaauaccauucucaacucaagaugagaaaggggucacacaaaauggaagacucauaacggcgaacccgauagugacugauaaggaaaaacccguaaacauagaaacugaaccucccuucggagaaaguuauaucgugguaggagcaggagagaaagccuuaaaauuaucaugguuuaaaaagggcuccucuauagggaaaauguuugaagcuacggcacgaggagcaaggaggauggcuauacugggagauacugcgugggauuuuggaucgauaggcggaguauuuacuuccguggguaaauuaguacaucaagucuuuggcacagcauaugguguuuuauucuccggcgugaguuggacuaugaagauaggaauaggaauacugcuaacuugguuaggucuaaauucaaggucuacaagccuuaguaugacguguauagccgucgguaugguaacacuauaccucggugugauggugcaggcugacucagggugugugauaaauuggaaaggaagagaauugaaaugcgguucggguauauucguaacaaacgaaguacauacauggacugaacaauauaaauuucaggcugauaguccaaaacgauuaagugcggcaauaggaaaagcgugggaagagggugucuguggaauuaggagcgcuaccagauuagaaaacaucauguggaaacaaaucucgaaugaacucaaucacauucuucuagaaaacgauaugaaguucacagugguaguuggugaugccaaugggauucuagcacaaggaaagaaaaugauaaggccgcaacccauggagcacaaauauucuuggaaaagcugggggaaagccaaaaucauuggugccgacauacaaaauaccacauuuauaauagacgggccugauacaccggaauguccggacgaucaacgagcguggaauauaugggaaguugaggauuauggguucgguauuuuuaccacuaacauauggcugaaguuacgagacucauauacgcaaaugugugaccaccgauuaauguccgcagcgaucaaggacucaaaagcugugcacgccgacaugggauacuggauagaaagcgagaaaaacgaaaccuggaaauuagcgagagcuucuuuuauagagguaaaaacuugcacuuggccuaagucucacacucuuuggucaaacggagucuuggaaucggaaaugauuauacccaaaauauacgguggccccauuagccaacauaauuauagaccaggauacuuuacucaaacagcgggaccauggcaucuuggaaaacuggaacuugauuuugaucugugcgaagguacaacuguuguaguugaugaacauugcgguaacagagggccgaguuuacguacaacaacaguaacaggaaagauuauacacgaauggugcuguaggucguguacguuaccaccccuaagguuccgaggugaagauggauguugguauggaauggaaauccgcccuguaaaagagaaagaagagaauuuagucagguccaugguaucugcagggucgggugagguagauucuuuuaguuuagguauccugugcguaucaauaaugaucgaagaagugaugcgaucuagguggucgaggaagaugcucaugacuggaacucuagccguguuucuucucuugauuauggggcaacucaccuggaacgaccuaauacgauuauguaucaugguaggagcuaacgccucagaucgaaugggaaugggaacgaccuacuuagcauuaauggccacauuuaaaaugagaccuauguucgcuguagguauuuuguuuagaagacuaacuagccgagaggugcuacuguuaaccauuggauugucauuaguugcuucaguugaauugccgaauagccuagaagaacuuggcgauggauuggcaaugggaauaaugaugcuuaaauuauuaaccgaauuucaaccacaccaauuauggacaacauugcuaucacuuacauuuauaaaaacuacacuaucgcuugacuaugcguggaagacaacugcaauggcucuaagcauuguaucccuauuuccgcuaugucucucaacaacuucucagaaaacuacguggcucccuguacugcuuggcucauucggaugcaaaccauuaacgauguauuuaaucacagaaaauaaaauauggggucgcaaaagcuggccgauuaacgaaggcauaauggcuauuggaauugucagcauuuuguuaucuucccuacucaaaaacgacguaccauuggcaggcccuuuaauagcaggaggaauguuaaucgccuguuaugucauuucugguaguucggccgaccuaagccucgaaaaagcagccgaaguaucuugggaacaagaagcggaacacucgggcacaagucacaacauucuuguugaaguucaagacgacgggacaaugcggauaaaggacgaagagaaagaugacaccuugacgauuuuauugaaagcaacgcuacuagcugucucaggagucuacccuaugucgauaccagcgacauuauuugugugguauuuuuggcagaagaagaaacaacggucgggaguuuuaugggacacaccuucacccccagaaguagaaagagcugugcuggaugaugguauauaucgaauacuucagagaggguugcucgggagaucccaaguugguguaggaguauuccaagacggcgucuuucacacaauguggcacguuaccagaggagcgguccuuauguaucagggaaaacgucuugagccaucaugggcuuccguuaagaaggaucuaaucagcuaugggggugguuggagguuucaaggaagcuggaauaccggugaagaagugcaagucauagccguagaaccaggaaagaaccccaaaaauguucaaacgacaccuggaacauucaaaacaccagagggagaaguaggcgcaauagcccuggacuuuaagcccggaacaucagguucaccgauaguaaacagagaaggaaaaaucguugguuuauaugguaauggaguugucacaacaucagguacuuacguaucugcgauugcccaagcaaaagcaucacaggaagggccgcuaccggagauugaggacgagguuuucaaaaagagaaaccucacuauaauggaccuacauccuggaaguggaaaaacaagacgauaucuaccggcuaucguuagagaggcgaucaaacgcaagcugagaacgcugauccuugcaccaacacgaguaguagcgagugaaauggcagaggcuuugaaggguaugcccauacgauaucaaacaacggcaguuaaauccgaacauacaggacgcgaaauaguagaccuaaugugucaugcaacauucaccaugaggcuacucucuccagugcgggugcccaacuacaacaugauaauaauggaugaggcucauuuuacagauccagcuagcauagcggcuaggggcuacaucaguacuagagucgguaugggcgaggcagcagcgauuuucaugacugcaaccccuccagguucuguagaggcauucccucaaucuaacgcgguuauacaggaugaagaaagggauauuccagaacgcaguuggaacagcggcuaugacuggauaacggacuucccugggaaaacgguaugguucgucccgucgauaaaaagcggaaaugacauugcaaauugccuaaggaaaaacgggaaaaggguuauacaacuuagcagaaaaacuuuugacacagaguaccagaaaacuaaaaauaaugacugggacuacguaguuacuaccgauauaucagaaaugggagcaaacuucagagccgacagaguaauagauccacgaaggugucuuaaaccugucauacugaaagaugguccugagagagugauacuagcugguccaaugccaguuacggucgcaucugcugcacaacgucgagguaggaucgguaggaaccaaaacaaggagggugaucaauacguauauaugggacagccacuaaauaaugaugaagaccacgcacauuggacugaagcaaaaauguuacuugauaacauaaauaccccggaagggauuaucccagcuuuauuugaaccagaaagagaaaaaucagccgcaaucgacggagaauaccggcuccgaggggaagcacggaaaacauuugucgaauuaaugaggagaggugaucuuccaguauggcuaaguuauaaaguugcaagugagggauuccaauauagcgaucguagauggugcuuugauggcgagcguaauaaucaagucuuagaagaaaauauggaugucgaaaucuggacaaaagaaggcgaaagaaagaaacugcgaccgcgauggcuagaugcacgcacauacagugauccgcuagcacugcgcgaauuuaaggaauuugcugcaggacgaagaucggucucuggggacuuaaucuuagagauuggaaaauugccucagcaccugacccuaagggcccaaaaugcauuagauaauuuggugaugcuucacaauuccgaacaaggaggaaaggcguacagacaugcuauggaggaauugccggauacaauagagacauugauguuacuagcuuuaauagcaguauuaacuggaggaguaacacuuuucuuuuugaguggcaaaggcuuagggaaaacgagcauaggauugcuuugcguaacagcaucaucugcauuacucuggauggccucaguggaaccucauuggauagcagcuagcaucauacuugaguucuucuuaauggucuugcuaauaccagagccugauaggcagcggacaccacaggacaaucaacuugcauaugucguuauaggucuacucuucaugauauugacgguugcggcaaacgaaaugggauuauuagaaacaacaaaaagagaccuuggaauuggacauguugcggcugaaaaucaccaacacgcaaccaugcucgauguagaucugaggccagcauccgcuuggacauuguaugcagucgcuaccacagugauaacaccgaugaugcgccauacaauagaaaauacuacugcgaauauuucacuaacugcaaucgcgaaccaagcagccauucuaaugggucuugacaaaggauggcccauaucgaaaauggauauagggguuccacuauuggcacuuggaugcuauagccaaguuaauccgcuaacuuuaaccgccgcgguauuaauguugguggcacacuacgcaauaaucgguccaggccuucaggcuaaagcuacgagggaagcacagaaaaggacugccgcugguauuaugaaaaauccaacgguagauggaaucguagccauagaucucgacccuguaguuuacgacgcaaaauucgaaaagcaguugggucaaauaaugcucuuaaucuuaugcaccucccaaauauuacucaugaggacaacaugggcacuaugugaaaguaucacacuagcaaccggaccuuugacgacgcuuugggaaggaucaccagguaaguucuggaacacuacaauagcaguaucaauggcaaacauauuuagggguuccuacuuagcgggagcugggcuggcauucagcuuaaugaaaucuuugggcggaggccgaagaggaacaggagcacagggugagacauuaggggaaaaguggaaacgccaauuaaaucaacugagcaaaccagaauuuaauaccuauaaaaggucaggcauaauggagguagaccgcucagaagcgaaggagggcuuaaaaagaggggagacaacaaagcacgcaguaagucgaggaacugcaaaauugagaugguucguugagagaaaccuaguuaaacccgaaggcaaagucauugaucuugguugugguagaggagguugguccuauuauugugcaggucuuaaaaaggugacagaagugaaaggcuauaccaaaggaggaccgggccaugaagaaccgauaccuauggcuacuuauggauggaauuuaguaaaacuacacucagggaaagaugucuuuuucaugccaccugaaaagugugauacucuacuaugugauaucggcgaaucuagcccgaacccaacaauugaggaaggcaggacacuuagaguuuuaaagaugguagaacccuggcugcgaggaaaucaguuuugcauuaagauuuugaacccauauaugcccaguguagucgaaacucuagaacaaaugcaaaggaagcaugggggaaugcuuguccgcaacccauuaagccguaauagcacccacgagauguauuggguaagcugugguacgggaaacaucgugucagccgucaacaugacaagucggauguuacugaauagauucacaauggcccaucgaaaaccaaccuacgaaagggauguagaucucggugcagggacaagacacguagcaguagaaccagaaguugcaaaccuugacauaaucggacaaagaauugagaauaucaaaaacgaacauaaauccacauggcauuacgacgaagacaacccuuauaaaacuugggcguaucaugguucauaugaaguaaaaccuaguggcagcgcaaguuccaugguaaauggaguuguacgucuacuaacuaaaccuugggauguuauccccauggugacacaaaucgcaaugacagacacaacaccauuuggccaacaaaggguauucaaagagaaaguggacacgagaacuccuagagcuaaaagaggcacaacccaaauuauggaaguaacggcuaaauggcuguggggauucuuaaguagaaacaagaaaccacgaaucuguacaagagaggaguucacaaggaaaguuagaucaaacgccgcgauuggagcggucuuuguugaugaaaaucaauggaacucugcuaaagaagccguggaagacgaaagauucugggaccuaguccaucgagaaagagaacuacauaaacaaggaaaaugugcaacguguguauacaauaugaugggaaagagagaaaagaaacuaggagaauuuggcaaggcaaagggaucucgagcuaucugguauauguggcuuggagcgagauuccuggaguucgaagcacuaggcuuuaugaacgaagaucacugguucucgagagaaaauucuuuaaguggaguagaaggagaaggacuccacaaacuuggauauauucugagagacauuagcaagauuccaggagggaacauguaugcggaugauacagcaggaugggauacgagaauaacugaagacgaucuacaaaaugaagccaaaauaaccgacauaauggaacccgaacacgcacuuuuggcaacguccauauuuaaauuaacauaccaaaauaagguaguaaggguacaaagaccagccaagaaugguacuguaauggaugugauuaguaggcgcgaccagcgagguagcggucaggugggcacguacggacucaacaccuucacaaacauggaagugcaacuaaucagacaaauggaaagugaagguauauuccuucccucagaauuggaaacaccaaaucuagcagaacgaguccuagauuggcucgaaaagcauggcgcagaacgucucaaaagaauggccaucucgggcgaugacugcguggugaaacccauagaugauagauuugcaacagcgcuuaccgcguugaaugacaugggaaaaguccguaaagauauuccacaaugggaaccaucgaaaggcuggaaugacuggcaacaagucccauuuugcagccaucauuuucaucaauugauuaugaaggacggccgugaaauagucgucccauguagaaaccaggaugaacuugucgggagagcccgaguaagucagggggcagguuggucauuaagggaaacagcauguuuagggaaaucauacgcacaaauguggcaauuaauguacuuucaucgucgagaccuaagacuagcagcgaaugcaauauguuccgcaguuccaguggauuggguccccacuucuagaacgaccuggagcauacacgcucaccaucaauggaugacaaccgaggauaugcucaguguguggaauaggguauggauagaagaaaaucccuggauggaggauaaaacccaugugaguuccugggaagaagucccuuaccuugggaaaagagaagaucaguggugugguucacuuauaggcuuaacugccagagcuaccugggcaacuaacauacaaguggccaucaaucagguuagaagguuaauuggcaaugaaaauuaccuagauuauaugaccaguaugaaaagauuuaagaacgaauccgauccugagggagcacucugguaa

SEQ ID NO: 21308 - RNA, 9879 nt, Artificial Sequence
  derived and/or modified CDS sequence (opt6) from DENV-1__JF937645__SS-prME
agcguuacuaugcuauugaugcuguuacccaccgcacuggcuuuccauuuaacaacccgagggggugagccccacaugauaguuaguaaacaagagaggggaaaaucauuauuguucaaaacaagugcaggagucaauauguguacacuuauagcaauggaccugggagaauuaugcgaggauacgaugacauauaaauguccacaaauaacagaagcagaaccggaugauguugauugcuggugcaaugcaacagacaccuggguaacuuauggcacauguagucaaaccggggaacauaggagagacaaacgaaguguagcgcuagcaccccacgugggccuuggacuugaaacucguacugagacguggaugucuagcgaaggagcuuggaaacagauacaaagaguagaaacuugggcucuuagacacccuggcuuuacaguaauugcauuguuccuagcacacgcaauagguacaucgaucacucaaaaaggaauaauauucauacuauuaauguuaguaacuccaagcauggcaaugaggugcguaggaauuggaaaucgugacuuugucgaaggcuuaucgggugcaaccuggguagauguuguacuggaacacggcaguuguguuacuacgauggccaaaaacaaaccgacucuagacauagaguugcuaaaaacugaaguaacgaaucccgcgauacucagaaaauuauguauagaagcaaaaauaagcaauaccacuacagauucaagauguccaacucaaggagaagcuacguuaguagaagaacaagaugcaaauuuuguuuguagaaggaccuuaguugaccgagguuggggcaacggguguggacuguuuggaaaagguagcuuacucacaugcgcuaaauuuaaaugugugaccaaauuggaggggaaaauugugcaauacgaaaaccuuaaauauuccguuaucgucacuguacauacuggagaucaacaccaagugggaaacgaaacgaccgaacacgggacuauagcgacuauuacuccucaagcuccuaccucugagauacaacuuacggacuauggggcuuuaacuuuggauuguucgccaagaacaggguuagauuuuaaugaaaugguacuguugacgaugaaagagaaaagcuggcuaguacacaaacaaugguucuuggauuuaccauugccuuggacaucaggagcuagcacaagccaagaaacuuggaaucgucaagaucuacuggucacguucaaaacagcacacgcuaagaaacaagaaguagucguuuuaggaagucaagaaggagcuaugcauacggcacucaccggggcaaccgagauucagacgucggguacaacaacaauuuuugcgggacacuuaaaauguagacugaaaauggauaaauuaacucuaaaagguacaagcuauguaauguguacaggcucauucaaauuagaaaaagaggucgcagaaacacaacauggaacuguauuggugcaagugaaauacgagggcaccgacgcaccaugcaaaauccccuucaguacgcaggaugaaaagggaguuacacaaaaugguagacuaaucacagcaaauccuaucgucaccgauaaggaaaaaccaguaaacauagagacagagccuccuuuuggagaaagcuauaucguuguaggagcuggcgagaaggcauuaaaacuaucuugguuuaaaaagggaucaucaaucggaaaaauguuugaagcgacggcgcguggugcacgccgaauggcaauucuaggugauacagccugggauuucgggucaauaggaggcguuuuuacgucaguagguaagcuaguacaucaaguauuuggaacagcguaugguguucuguuuuccgggguuucauggacuaugaaaauagggaucgguauacuauugacgugguuagggcuaaacagcaggaguacaucacuuagcaugacuugcauagcugucggcauggugacucuuuaucuaggagucaugguccaagcagacuccggauguguaauaaacuggaaagggcgugagcuaaagugcggauccggcauuuuuguaaccaacgagguacauacuuggacagaacaauacaaauuccaagcugauucaccaaaacgucucucggccgccauaggcaaggcaugggaagaaggggucugugggauacgaucagcaaccagacuagaaaacauaauguggaagcaaauuaguaaugagcuuaaucauauacuacuagaaaacgauaugaaauuuacuguagucguaggugaugccaacgggauucucgcacaaggcaagaaaaugauccgaccgcaaccaauggaacauaaauauucauggaagucaugggguaaagccaaaaucauaggugcagacauacagaauacuacauucauaaucgauggcccugauaccccugaaugcccagauaaucaacgagccuggaacauaugggaaguggaagauuauggcuuugguauauucacuacgaacauaugguuaaagcuccgagauucauacacacaaaugugugaccacagauuaaugucagcagcaauaaaagacucaaaagcaguucaugcagauauggguuacuggauugaaagugagaaaaaugaaacauggaaauuagcuagagcauccuuuauugaggugaaaaccuguaccuggccaaaaucccauacauuauggucaaacggaguauuagaaucagaaaugauaauaccuaaaauuuauggcgguccaauaagucaacacaauuaucgucccggcuauuuuacccagacagcaggacccuggcaucugggaaaauuggaacuugacuucgaccuaugcgaggguaccacggugguaguggacgagcauugugggaauagaggcccgucguuacggacuacgacagugacgggaaaaaucauacaugaaugguguugcaggucaugcacgcuuccgccacugcgauuucgaggagaagacggauguugguauggaauggaaauaagacccguuaaagagaaagaagaaaaucuaguaagaucuaugguaagugccggaucaggugaaguagauaguuuuucauuggggauacuaugugcuucuauuaugaucgaagaagucaugagaagucgguggucucgaaagaugcuaaugacgggaacccucgcaguguuucuacucuuaauaaugggccaauuaacauggaaugauuuaauuagauugugcauuauggucggagcaaaugcaucugauagaaugggcaugggaaccacuuacuuagcuuuaauggccacauucaagaugagaccgauguuugcagugggccuacuauuucgucguuuaacgagucgugaaguguuauuacugacuaucggacuuaguuuggucgccuccguagaacuaccgaacucgcucgaagaguuaggagauggacucgcuauggggaucaugauguuaaaauuauugacagaauuucaaccucaucaacuauggaccacauuauugucguuaacauucauaaaaacaacguuaaguuuagauuaugcuuggaaaacuaccgcaauggcacuuagcauaguaaguuuauucccuuuauguuugucuacaaccagucagaaaaccacuuggcuucccguacuccuaggaucauuuggcugcaagccucucaccauguuuuuaauuacggaaaauaagauuugggguagaaaaucauggccacuuaacgaaggaauuauggccauagguauaguuaguauacuuuuaaguagucuucucaaaaaugauguaccguuagccgguccucuuauugcaggaggaaugcuuauagccuguuacguaaucagcggaucgagugccgaucuuucacuugaaaaagcagcugagguuucgugggagcaagaggcagaacauagcggaaccagccauaauauauugguagaaguccaggaugacggaacaaugaaaauaaaagaugaagaacgagaugauaccuuaacaauucuccuaaaagccacucuauuggcugugagcggcguauacccgaugucgauaccugcgacacucuuuguuugguauuucuggcagaagaagaaacaacguaguggagugcuuugggauacgccaaguccacccgaaguagaaagagcgguucucgaugacgguauauaccggauacuucaaagagggcuacucgguagaagccaagucggaguggguguauuccaagacgguguuuuucauacaauguggcacguaaccagaggggcaguuuuaauguaccaagggaaaagguuggaaccgucaugggcgagcgucaagaaagaucucauaucauacggaggaggauggagauuucagggguccuggaauacgggggaagaaguucaaguaauugcagucgaaccugggaaaaaccccaaaaacguccagacgacuccggguacguuuaaaacgcccgaaggcgaaguaggggccauugcauuagacuucaaaccagguaccucaggaaguccaauaguaaaucgugaaggcaaaauugucggcuuguauggaaacggagucguaaccacuucgggaaccuauguuucagcgauugcucaagcaaaggcuucacaggaggggccauuaccggaaauugaagaugaaguauucaagaaacgaaacuugacaauaauggaucuacacccaggcagcggaaaaacaagacguuaccuacccgcuauugugcgggaagcuaucaagagaaagcuacgaacacucauauuagcuccaacaagggucguggcaagugaaauggcggaagcucuaaaaggaaugccgauaagauaccagacuaccgcuguuaaauccgagcacacggggagagagauaguugaucugaugugucaugcaacuuucacaaugagauuacuaucacccguacguguuccuaauuauaauaugauaaucauggacgaagcacacuucaccgauccggcaucaauugcugccaggggcuauauaucaacgagaguugggaugggugaagcugcagcuauuuucaugacagcaacaccuccagggagcguagaagcauuuccgcaaucuaaugcaguaauucaggaugaagaaagagauauaccggagcguaguuggaacaguggguacgauuggauaacggacuucccugguaaaaccguaugguuuguccccagcauaaagucaggcaacgauauugcuaauugcuuacgaaagaacggcaagcgcguaauacaacuaucaagaaaaacauucgauacagaauaucagaaaacuaaaaacaacgacugggauuacguggucacuacagauauaucagagaugggggcaaacuuuagagcagaccgaguuauugacccacggagauguuuaaagccaguuauuuugaaagauggaccagagagagugauauuggcuggcccaaugcccgucacaguagcaucugcugcucaacgcagagguagaauagggcgaaaucaaaacaaggagggagaccaguauguuuacaugggacaaccgcuaaacaaugaugaagaucaugcucacuggaccgaagcuaaaaugcuauuagauaacaucaacacaccggaagggauuaucccggcccuuuucgaaccugaaagggaaaagagcgcggcaauagauggcgaguaucgacuuagaggagaagcaagaaaaacauuuguugaacuuaugaggaggggagaucucccuguuuggcugagcuauaaaguugcgucagaagguuuccaauauucggacaggagguggugcuucgacggggaacguaauaaucaagugcucgaggaaaacauggacguugaaauuuggacuaaagaaggugaaagaaagaaacuaagaccgcgaugguuagaugcgcgcacauacagugacccacucgcucucagagaguucaaagaauuugcggcuggccggaggaguguuucuggugauuuaaucuuagaaaucggaaaacugccacaacacuuaacguugagggcgcaaaacgcccuagauaaucuaguaauguuacauaauucagaacaggguggaaaagcguauagacaugcuauggaagaauuacccgauacgaucgaaacacuaauguuauuagccuuaauugcuguacuaacuggagggguaacacuuuucuuucugucagguaagggguugggaaagaccaguaucggccuuuuaugugucacagcaucuagugcgcuacuuuggauggcaucgguggaaccgcacuggauugcagccaguauuauucuagaguucuuucuuaugguacuacuuauaccagaacccgauaggcaacguacaccucaagacaaccaacucgcauacguagucauaggacuuuuauucaugauucuaacuguugcugcuaaugaaauggguuuacuagaaacaacuaagaaagaccucgguauaggccacguagcugcugaaaaucaucaacaugcaacuauguuggauguagaccuuagaccagcaagugcauggacacuuuacgcaguagcaaccacaguaauuacgccaaugaugcgacacacuauagaaaacacaacagccaauaucagcuugacugcgauugccaaucaagcggcuauucuaaugggucuagauaaaggauggccuauauccaaaauggauauagguguaccucuauuagcucuaggguguuauucacaagugaauccauuaacuuuaacugccgcagugcuaauguuaguagcucacuacgcaauuauagggccaggacugcaagcaaaagcgacaagagaagcucaaaaacgaacagcagccggaauaaugaaaaauccuacgguugauggaauaguagcaauagacuuggaucccgugguauaugaugcuaaauuugagaaacagcuaggccaaauaauguuauuaauuuuaugcaccucacaaaucuuacuaaugcgaacuacgugggcucucugugaaaguauaacuuuagccacaggaccacuuaccacuuugugggaagguaguccuggaaaauuuuggaacaccacaauagcgguaucgauggccaacauauuucgaggaucuuaucuagcgggugcuggucucgcauuuucauuaaugaagucucuuggagguggaagaaggggaacuggagcacaaggcgaaacacucggugagaaauggaaaagacaacucaaucaauuaagcaaaucggaguuuaacacauauaaacguagcggaauaauggaaguagaucgaucagaagcaaaagaaggacuuaaacgaggugagacgacaaaacaugcaguuagucggggaacggccaaauuaagaugguuuguggaacgaaacuugguuaaaccggaagggaaaguuauugacuuaggcugcggcagagguggauggucauacuauugugcugggcuuaagaaagugacggaaguaaaaggauauacaaaggguggacccggacaugaagaaccuauaccgauggccaccuauggcuggaacuuaguaaagcuacauuccggaaaagaugucuucuuuaugccuccggagaaaugugauacacuccuaugugauaucggagagucuucaccaaaccccacuauugaagaggguagaacucuacgcguacuaaaaaugguggaacccuggcuuaggggaaaccaguucugcauuaaaauacucaacccuuauaugcccagugucguugaaacgcucgagcaaaugcaaaggaagcacgguggcauguuaguuagaaauccccucucacgaaacaguacucaugaaauguauuggguuagcuguggaacagggaacaucgucucagcaguuaauaugacgucccguauguugcucaauagauuuacgauggcacaccgaaaaccuacuuaugaaagggauguagaucuaggagcggggacuagacacguugcuguagagcccgaaguggcgaaucucgauauaauaggccagcgaauagagaacauuaaaaacgaacacaaaucaaccuggcacuacgaugaagacaaucccuauaaaacuugggcauaucaugguucauaugaagucaaacccagcgggucugcuucuucaauggucaauggcguugugagguuauugacgaaaccuugggauguuauaccaauggugacacaaauugccaugacagacaccacgccauuuggacagcagcgcguauuuaaagaaaaaguugauacucgaacaccccgggcuaaacgaggaaccacucaaauuauggagguaaccgcaaaauggcuuuggggauuucuauccagaaauaagaaaccaagaauaugcacgagagaggaauuuacaagaaaaguacgaucgaaugcagccaucggcgcuguguuuguggacgaaaaccaauggaacagugccaaggaagcaguugaagacgagcguuuuugggauuuaguccacagagaacgugagcuccauaagcagggaaagugugcaaccugcguauacaacaugauggggaaaagagagaaaaaguuaggugaauuuggaaaagcaaagggguccagagcuaucugguauaugugguugggagcgagauuucuagaguucgaggcuuuaggauuuaugaacgaagaccacugguucucaagggagaacucguuguccggaguggaaggagaaggacuacauaaacucggauauauacuccgagauauaucuaaaauaccaggagguaauauguaugcugaugacacagcagggugggauacgcggauuacugaagaugacuuacaaaaugaagcuaaaaucacagauauuauggagccugaacaugcuuuacuagcaaccucuauauucaaauuaacauaucaaaauaaagucguaaggguacaaagaccagccaaaaauggaacugucauggacguuauuucccgacgagaucaaagagguucgggacaaguuggaacuuauggucuaaauaccuuuacuaauauggagguacaauugauacgccagauggagucugagggaauauuucuuccaagugagcuagaaacaccaaaccucgcugaaagggugcuggacugguuagaaaagcacggagcagagagguuaaaaagaauggcaauuaguggagaugauuguguaguuaagccuaucgaugaccgauuugcgacagcacuuacagcucuaaacgauaugggaaaggugagaaaagauauaccacaaugggaaccaucuaaaggauggaaugauuggcaacaagucccauuuuguucacaucauuuucaucaauuaauaaugaaagaugguagagaaauugucguuccguguaggaaccaggaugaauuagucgggagggcaaggguuucgcagggugcaggauggucgcugcgagaaacagcaugccuaggaaaauccuaugcacaaauguggcaguuaauguauuuccacagacgagauuuaagauuagcagcgaacgcaaucuguagcgcaguacccguagauuggguuccaaccaguagaacaacauggagcauacaugcucaccaccaauggaugaccacugaggacauguuaucaguauggaaucgaguauggauugaagaaaauccauggauggaggauaaaacacacgucaguagcugggaggaaguaccauaucuagguaaaagagaagaccaaugguguggaucauuaauaggcuuaacagcaagagcaaccugggcgaccaauauccaagucgcuaucaaucaaguacgacggcuaauaggaaaugaaaauuauuuagauuacaugacgucgaugaaaagauuuaaaaacgaguccgacccggagggcgccuuaugguag

SEQ ID NO: 21309 - RNA, 9879 nt, Artificial Sequence
  derived and/or modified CDS sequence (opt6) from DENV-1__FJ850114__SS-prME
uccguuacaauguuauugauguuauuaccaacggcucuagcauuucacuuaacaacaagggguggugaaccacacaugauaguaagcaaacaagaaagggguaagagcuuacuuuucaaaacaucagcugguguaaauauguguacacuaauagcaauggaccuuggagaacuuugcgaagauacuaugacauacaaaugcccucaaauaacggaagcggaaccugaugacguugauuguugguguaacgcuacagacacauggguaaccuauggaacuuguagccaaacaggggaacacagaagagauaaacgaaguguugcauuagcgccacacguaggacugggguuagaaacccgaacugaaaccuggaugaguagugaaggagcauggaaacaaauucaaagaguugaaacaugggcgcuacggcacccaggauuuacggucauugcgcuauuuuuagcccaugcaauuggcacgaguauuacucaaaaaggcauaauuuucauucuuuugaugcuuguaacgccgucuauggcuaugagauguguuggaauuggaaaccgugauuucguugaaggccugaguggagcuacuuggguagaugugguucuugaacacggaaguugcgucacuacuauggcuaaaaauaaaccgacucuagauauugaacuuuuaaaaacagaaguuacuucgcccgcgauccuacggaaacucugcaucgaagcgaaaauuucgaacacaacaacagacucgcgcuguccaacacaaggggaagccacucuagucgaagaacaggaugcaaauuuuguaugcaggcguaccuucguagaccgugguugggguaacggaugcggacuauucggcaaagggagcuuauugacuugugccaaauuuaaaugcgugacuaaacuugaaggaaaaauuguucaauacgagaaucuaaaauauaguguaaucgugaccguccacacuggagaucaacaccaaguagggaacgaaacgacugagcauggaacaauagccacuauuacaccucaagccccaacuucagagauacaauuaacagauuauggagcacucacauuagacuguucucccagaacuggguuagauuuuaaugaaaugguauuauuaaccaugaaagaaaaaucuuggcuaguacacaaacaaugguuucuagauuuaccgcuucccuggacgucuggugccucuacgagccaggaaaccuggaauaggcaagaucuucuagugacauucaaaacagcacaugcaaagaaacaagagguugugguucuagguucucaagagggagcaaugcauacggccuugacuggugcuacagaaauccaaaccagcgggacuacuacaauauuugcaggucaucuuaaauguagauugaaaauggauaaauuaacucuuaaagggacgaguuauguaauguguacgggaucauuuaaauuagaaaaagaaguagcagaaacacaacacggcacaguucugguucaagugaaauacgaaggaacugaugcaccauguaaaauaccauucagcacgcaagaugaaaaaggcguaacucaaaacggaagacuaauaacagcaaacccgauaguaacugauaaagaaaaacccgugaauaucgaaacggaaccuccuuuuggagagagcuacauuguaguaggagccggagaaaaagcgcucaaacugucgugguucaagaaaggaucaaguauaggcaaaauguucgaagcaacugcuagaggagcuaggagaauggcgauacugggagauacagcaugggauuuugggaguauagguggaguauuuacaagcguaggaaaguuaguacaucagguguucggcacagcuuaugggguccuuuucucuggaguuucauggacaaugaaaauagggauaggaauacuccuuaccuggcugggacugaauagcagaagcacgucuuuaaguaugacgugcaucgcaguaggcaugguuaccuuauacuuggggguuauggugcaagccgacagcgguugcguaauaaacuggaaaggucgugaacucaaaugcggaucgggaauauuugucacaaacgaaguacauacuuggaccgaacaguauaaauuucaagccgacagcccaaaacgauuaucggcagcgauagguaaagccugggaggagggaguuugugguaucagaagugcaacgcgucucgaaaauauaauguggaaacagauuucgaaugaauuaaaucauauuuuauuggaaaacgacaugaaguuuaccguugucgugggagacgcaaaugggauacuagcacaaggcaagaaaaugauaaggccacaaccaauggaacauaaauauucauggaaaucuuggggcaaagcaaaaauaaucggcgcagauauacagaauaccacauuuauuauugacgggccugacacaccagaauguccagauaaccaaagagcguggaauauaugggaaguugaggauuauggcuuugguauuuucacuacuaacauauggcugaagcuacgugacaguuauacucagaugugcgaucaucgucugaugucagcagccauaaaagauucaaaagcaguacacgcugauaugggauacuggauagaaucugagaaaaaugaaaccuggaagcuagcacgagcuucuuuuauagaaguuaaaacuuguacuuggccaaaaagucauaccuuauggucgaauggcguacuagaaucagagaugauaauaccaaaaacauauggaggaccaauuucgcaacauaauuacagaccaggauacuuuacucaaacugcaggaccguggcaucugggaaagcuagaauuagacuucgauuugugugaaggaacaacugugguaguggacgaacauugcggcaacagaggcccaagucuacguacaacuacaguaacaggaaaaauaauacacgaaugguguugucgcaguuguacguugcccccuuugagauuccguggcgaagaugguugcugguacggcauggaaauuaggccaguaaaggaaaaagaagaaaaucucguucgaucgaugguuucagcagggaguggggaagucgacaguuuuucacuaggcauucuaugcgcaucaauaaugauugaggaagugaugagaucacgauggagucguaaaaugcuaaugacaggaacauuagcgguguuuuuguuacugauaaugggucaacuuacguggaacgaucuaauacggcuuugcauaaugguaggugcuaaugcuagugauagaaugggcauggggaccacguauuuagcacuaauggcaaccuucaaaaugagaccaauguucgcgguaggauuacuuuuucgcagauuaacaagcagggaaguuuugcuguuaacaauuggccugucauuaguagcaucgguagagcuaccuaauucauuagaggaauuaggggacggccuggccauggggauuaugaugcuaaaacuauuaacugaauuucaaccacaucaauuauggaccacucuauugucuuuaacauucaucaaaaccacacugagccuggacuaugcuuggaaaaccacugcaauggcauuaaguauagugucacucuuuccauuaugucuuucuacaacaucgcagaaaacuacaugguuaccagucuugcuuggaaguuucgguugcaaaccacuaacaauguuucuuauuacagaaaauaagauuuggggucgaaaauccuggccccuuaaugaggggauaauggcaaucgguauuguaaguauucuucucagcucguuacucaaaaacgauguaccgcuagcagguccccuaauugcaggcgguaugcuuauugccugcuacguaauaagugggaguucggccgaccucucgcuggaaaaagccgcagaaguaucaugggaacaagaagccgaacacucaggaacuucucauaauauccuagucgaagugcaagaugaugggacuaugaagauaaaagacgaagaacgggaugauacccuaaccauauuacucaaagcuacguuacuggcaguaucaggugucuauccaaugucuauacccgcuacccuauuuguaugguauuuuuggcagaagaagaaacaaagaagcggcgucuuaugggacacuccaagucccccugaggucgaaagagcuguucuugacgacgguauauacaggauauuacagaggggacuacuagggcggagucaaguaggaguugguguauuucaagauggaguguuccacacaauguggcacguuaccaggggagccgucuuaauguaccaagguaaacgcuuggaaccaucgugggccuccgucaagaaagaucuuauaucauacggcggaggguggagauuucaggggagcuggaacacaggggaggagguacaaguaauagccguagaaccagggaaaaaccccaaaaacguccagacuacacccgguacguucaagacuccagaaggcgaggugggcgcgauugcacucgauuuuaaaccuggcacaagcggaucuccuaucgugaaucgcgaagguaagauagugggauuguauggcaacggaguaguaacuaccaguggaacauauguaucugcgauugcacaagccaaagcaucucaagaaggcccccuaccagaaauagaagaugaaguauucaagaaaagaaacuuaacgauuauggaucuucaccccggcucaggaaagacaagaagauacuuaccugcaauagucagagaggccauaaaacgaaagcucagaacccuaauauuggcuccuacacgaguaguugcgucugaaauggcugaagccuuaaaagguaugcccauacgauaucaaacuacagcuguaaaaagugagcauacggguagagaaauagucgaccugaugugucacgcaacguucacgaugcgacuacuguccccaguacguguacccaacuacaauaugauaauuauggacgaagcacauuuuacugauccagcuucgaucgccgcacgaggguacaucucaacaagaguagggaugggugaagcagccgcgauauuuaugacugcuacaccaccggggucaguagaggcuuuuccgcaaaguaaugcaguaauucaagacgaagaacgugauauaccggagcgcaguuggaacagcggguaugauuggauaaccgauuucccagguaagacagucugguuuguuccuuccauuaaauccggaaacgauauugccaauuguuuacguaaaaacgguaaaaggguuauacaauugagccgaaaaacauuugauaccgaguaccaaaagaccaaaaauaacgauugggauuauguuguuacaacagacauuagugaaaugggugcaaacuuccgagcugaucgcguuauugauccgagacggugcuuaaaaccugugauacuaaaagaugggccagagcguguuauacuggcagguccuaugccuguuacaguugcaagugcagcccaaagaagaggucgaaucggaagaaaucaaaacaaagaaggagaucaauauguauauauggggcaacccuuaaauaaugacgaagaucacgcacauuggacagaggcaaagaugcuacucgacaauauaaacacuccggagggaauaauacccgcuuuauucgaacccgaaagagaaaaauccgcagccauagacggugaauauagacucaggggcgaggcgcgcaaaacauucguagaacuuaugcgacggggcgauuugccaguauggcuauccuacaaaguagccagugaaggauuccaauacagcgauagaagaugguguuuugauggggaaaggaauaaccaaguucucgaagaaaacauggauguagaaauauggacaaaagaaggagagaggaagaaauuaaggcccagguggcuagaugcaagaacuuacagugauccgcucgcucucagggaguucaaagaguuugcagcaggucguagaucaguuagcggagaucuaauacuagaaaucggaaaacucccgcaacaccucacccuucgugcacagaaugcacuagacaauuugguaauguugcacaacuccgaacagggugggaaggccuaucgccaugccauggaagaacuaccugauacuaucgagacguuaaugcugcucgcccuuauagcgguucuaacaggggguguaacucuguuuuucuuauccgguaaggggcuaggaaagacuucuauuggacuacucuguguaaccgccagcagugcucuauuauggauggcgucuguagaaccccauuggauugcugccaguauaauauuagaguucuuucuuaugguauuacucauaccugaaccugauagacaaaggaccccgcaagauaaucaacuagcguacguagucauaggucuacuauucaugauacuuaccgucgccgcaaacgaaauggggcuauuagaaacgaccaaaaaggacuuagguauaggacacgucgcagcagaaaaucaucaacaugcaacuauguuagacguagauuuacgccccgccucagcauggacuuuauaugcuguggcuacaacuguuaucacgcccaugaugagacacaccauugaaaacaccaccgcaaauauuagccuuacagcgaucgccaaucaagcagcgauacucaugggucuagauaagggauggccgauaucaaaaauggauauaggagugccauuacuugcacuaggcuguuacagucaagucaacccauuaacucucaccgccgccgucuuaaugcucgucgcccauuacgcaauaauagguccuggucuucaagcaaaagccacccgagaagcucagaaacgaacggcugcuggaaucaugaagaauccgacaguagaugggauuguagcuauugaucuagaucccguagucuaugacgcaaaauucgaaaaacaauugggacaaaucauguuauuaauucuauguacaagucaaauacuacuaaugagaacuacaugggcacuuugugagucgauaacauuggcaacaggaccauugacuacccuuugggaaggcucuccugggaaauucuggaacaccacaaucgcaguaaguauggccaauaucuuccguggguccuauuuagcuggagcaggauuagcuuucucacugaugaaaucauugggugguggacgacguggcacaggagcucaaggggagacucuuggggaaaaguggaaaaggcaacuaaaucaauuaucaaaaucagaguucaauacauauaaaagauccggaauaauggaaguugauagaagugaagccaaagagggacuaaaaagaggggaaacuacaaagcaugcgguaucacgaggaaccgcgaaguugcgaugguucguagaaaggaaccuggucaaacccgaagguaaaguuauugaucucggaugugggagaggagguuggaguuacuauugugcaggguuaaagaaaguuacagaaguuaaaggauauacaaaaggugguccaggacacgaagaaccuauacccauggcaacguauggauggaaucuuguuaaguugcauucuggaaaagauguuuucuucaugcccccugaaaagugugauacacuacugugcgacauaggugagucaaguccgaacccaacaaucgaagaaggaagaacgcucaggguuuuaaaaaugguagaacccugguugaggggaaaccaauuuuguaucaaaauucuaaaccccuauaugccaaguguagucgaaauuuuagaacaaaugcaacguaaacaugggggaaugcuagugagaaauccauugucgagaaacucgacucaugaaauguauuggguuagcuguggcacuggaaauauagucucugcuguuaauaugacgagucgcaugcuucuaaaucguuuuacgauggcucaucgcaaacccaccuaugagcgcgacgucgacuuaggagcagguacacgacauguggcagucgaacccgagguugccaauuuggacauuauuggacaacgcauugaaaauaucaaaaaugaacacaaaucaacauggcauuacgacgaagauaauccauauaaaacgugggcauaccauggaagcuacgaggugaaacccagugguucggcaagcagcaugguaaacggggucgucagauuacuuacaaaaccaugggauguaauaccuaugguaacacaaauagcaaugacugacacgacaccauuuggacaacaacgcguauuuaaagaaaaaguagacacaaggacaccuagagcaaaacgugggacaacgcaaauuauggaaguaacagcgaaaugguuauggggauuuuugucgagaaauaagaaaccacguauuugcacgagagaagaguucacgcgcaaaguaaggaguaacgccgcuauaggcgcuguuuuuguagaugagaaucaauggaacucagcgaaagaagcaguagaagacgaacguuuuugggaucuuguacaccgagaaagagaacuacauaaacaagguaaaugugccacuugcguauacaacaugauggggaaacgagagaagaaauuaggcgaguucgggaaagcuaaaggaucccgcgcuauaugguauauguggcugggcgcgcgauuuuuagaauuugaggcauuaggcuuuaugaaugaagaccacugguuuucacgugaaaauucgcuaagcggaguggagggcgaagggcuacacaaauuggguuauauacuaagagauauuaguaaaauaccgggagguaacauguaugcugacgacacagccggcugggauacccguauuacugaagaugauuuacaaaaugaagcuaaaauuacugacauaauggaaccagaacaugcauuacuagccacauccauuuucaagcugacauaccaaaacaaaguuguucgaguccaaagaccggccaaaaacgguacugugauggacguuauaucaagacgugaucaaagggguaguggacaaguuggaacuuauggauuaaauacuuucacuaacauggagguucaauuaauccgacagauggaaagugaagguauauuuuuaccgucugaacucgaaacucccaaucucgcagaacgaguguuggacuggcuagaaaaacauggagcagaaagacuaaaacguauggcuauaucgggagacgauugcgugguaaaacccauugaugacagauucgcaacggcauugacugcacucaaugacauggggaaaguacgaaaagacauaccgcagugggaaccuucuaaaggauggaacgauuggcaacaaguaccauucuguagccaucauuuucaucaguuaaucaugaaagauggucgagaaaucgugguaccuuguaggaaucaagacgagcucgugggucgugcacguguuucacaaggggcagguuggucacuacgugaaacagcuugccuagguaaaucuuaugcccaaauguggcagcuuauguauuuucacaggagagauuuacgguuagcagccaaugcgauaugcucggcagugccaguagauuggguaccuacuucaagaacaacuuggaguauccaugcacaucaccaauggaugacgacagaggacaugcugagcgucuggaaccgaguuuggauugaagagaauccguggauggaagauaaaacucacgugagcaguugggaagaaguuccauaucuuggaaaaagagaagaucaaugguguggaucgcuuaucggguugacagcuagagccacgugggcgacgaacauucaagucgcaauaaaccaaguacguagguuaauuggaaacgagaauuaccuggauuauaugauuucaaugaaaagauuuaaaaaugaauccgaucccgaaggugccuugugguaa

SEQ ID NO: 21310 - RNA, 9879 nt, Artificial Sequence
  derived and/or modified CDS sequence (opt6) from DENV-1__JN819402__SS-prME
ucuguaacuaugcuacucauguugcuacccacagcucuugcauuucaucugacaaccagaggaggugaaccacacaugauaguauccaaacaagaacguggaaaaagucuguuauuuaaaacaucggccggaguaaauauguguacauuaauugcgauggaccuuggagaauuaugugaagauaccaugacauacaaauguccacaaauaacugaagcugaaccugacgacguugauuguuggugcaaugcgacggacacuugggucacauacggaacauguucacaaacuggcgaacaucgacgagacaaaagauccguugcccuagccccacaugucggccucggauuggaaacgcgaacagaaaccuggaugaguucugaaggagccuggaaacaaauccaacggguagaaacaugggcucuacggcauccuggguucacaguuauugcauuauuccuagcgcaugcaauagguacaucuaucacucaaaaaggcauaauauucauauugcucaugcugguuacuccaucaauggcaaugagaugugucgguauaggaaauagagauuucguagaaggcuuaucuggagcaacauggguagacgugguacuagaacaugguuccugcgucacaacgauggcuaaaaacaaaccuacucuggauauagaauuauuaaaaacagaaguaacuaauccugcuauucugcgaaaacuauguauagaggcuaaaauaucaaacacgacaaccgauaguagauguccgacccaaggagaagcaacgcuuguggaagaacaagacgccaauuuugucugcagaagaacuuuuguugacagaggauggggcaauggguguggccuauucggcaaaggaucuuuauuaacaugugcaaaauucaaaugcguuacgaaauuagagggaaaaauuguccaauacgaaaauuugaaauacagcguuaucguaacaguacacacuggugaccaacaccaagucggcaaugagaccacagagcauggaacuauagcuacaauuacaccacaagcaccaaccagugagauacaauuaacagauuacggagcguuaacauuagacugcagcccacgaacugguuuagauuuuaaugaaaugguccuguugacaaugaaagagaaaagcuggcuaguccacaaacaaugguuccuggauuugccauuaccguggacuagcggagcuuccacuagccaagagacauggaaucgucaagaccuauuaguuacauuuaaaacugcgcacgcuaagaaacaagagguagucguuuuaggaucccaagaaggugcaaugcauacggccuuaaccggugcaaccgagauccaaaccucaggaacgacgacuauuuucgcagggcauuuaaaauguagacugaaaauggacaaacuuacacuaaagggcacaagcuacguaauguguacgggaucuuucaagcuggagaaagaaguggcagaaacacaacaugguaccguacucgugcaaguuaaauacgaaggaaccgaugccccauguaaaauucccuuuucaacgcaggaugaaaagggaguuacccagaacggaagacugauaacagcaaauccaauagucaccgacaaagaaaaaccaguuaauaucgagacagagccuccauucggugagucguauauagugguaggagcgggggagaaagcucuuaaacuaucuugguuuaagaaagggagcagcauaggcaagauguuugaggccacagcgcguggcgcucguagaauggcuauuuuaggagacacugcaugggauuucgguaguauaggcggagucuuuacaucaguaggaaaguuaguucaccaaguauucggaaccgccuacggcguucuauucucugggguuucauggacaaugaagauaggcauagggaucuuauuaacguggcuggguuuaaacagucgcucaacaucucuuucaaugaccugcauagcaguugguaugguaacucuauacuuagguguaaugguacaggcagauucuggcugugucauaaacuggaaaggaagagaauuaaagugugguucagguauauuuguuaccaaugaaguacauacauggacagaacaauacaaguuucaggcugacucuccgaagagauuaagugcggccauugguaaagccugggaggaaggcguauguggaauccgaucggcgacucgccucgaaaacauuauguggaaacagauaucuaaugaauugaaucacauucuucuugaaaacgauaugaaauuuacaguuguagugggcgacgcuaaugggaucuuagcucaggguaagaaaaugauacgaccccagccaauggaacauaaauauuccuggaaguccuggggcaaagcaaagauaauuggugccgacauacagaacacaacauuuauaauugauggaccugacacuccugaguguccugacaaucaaagagcuuggaacauuugggaaguagaagauuaugguuuuggaaucuuuacuacaaauauauggcucaaauuaagagauucuuauacacaaaugugcgaucaucgacugaugucagcugcaauuaaggauucuaaagcgguucaugcugacaugggcuacuggauagaaagugagaaaaaugagaccuggaaacucgcgagggcuaguuucauagagguuaagacauguaccuggccgaaaagccauacucuauggucaaacgguguacuugaaagugagaugauuaucccuaagauauauggugggccgauuucgcaacauaauuaccguccugguuacuucacacagacagccggucccuggcacuuaggcaaacuagagcuugauuuugaucuaugcgaaggaacaacagugguugucgaugaacacuguggaaaucgcggaccaucacuacgcacuacuacagucacagguaagauuauacaugaauggugcugccgcuccugcacguuacccccacuuagauuccggggagaagauggaugcugguacggaauggaaauuagaccaguaaaagaaaaagaggagaaccucguacgaagcaugguuucugcagggucgggcgagguggacucuuucucucuagguauccuuugugcuucaauaaugauugaagagguuaugcguucacgauggucuagaaaaaugcuuaugaccgguacacuagcggucuuuuuacucuuaauaaugggacaacuaacguggaaugauuuaauacgacuauguauuaugguaggagccaaugcaagugauagaauggguaugggaacaacuuaucuggcgcuuauggccacuuuuaaaaugaggccaauguuugcgguaggccuacuauuucguaggcugaccucccgugaaguucuacucuuaaccauaggauuaucguuaguagcgucuguagaacugccuaauagucuugaagaacugggagaugggcuagcuaugggaauaaugaugcugaaauuacuaacagaauuucagccacaccaacucuggacaacucuucuuucacuaacuuuuauaaaaacaacacuuagucuagacuacgcauggaaaacaacagcuauggcacuuucaauagucucauuauuuccucuuugucuuaguacuacgucucagaaaacaaccuggcuuccaguccuacuaggcucuuuugguugcaaacccuuaacgauguuucuaauuaccgaaaauaaaauauggggacggaaaucguggccccuuaaugaaggcauaauggcgaucgguauagucucuauacuacugucuucauugcuuaaaaaugacguaccucuagccggaccauuaauugcaggcggaauguuaaucgcaugcuauguaauaagugguuccucugcagaucuuucauuggaaaaagcagcagaagugucgugggaacaagaggccgaacacaguggcacgagucacaacauucuuguugaagugcaggaugaugggacaaugaaaaucaaagacgaagaaagggaugacacucuaacaauacuauuaaaagcaacacuguuagcaguaucaggagucuacccaaugucaauacccgcuacauuauucgucugguauuucuggcagaagaagaaacagcguaguggagugcucugggauacgccaaguccuccagaaguggaaagagcaguacuagaugacggcauauauagaauacuucagagaggcuuauuaggccguucgcaaguugggguuggaguuuuucaggacggaguauuucauacuauguggcaugucacgcgaggagcaguauuaauguaucagggaaaacgguuagagcccucgugggcaucaguuaagaaagauuuaauaagcuauggaggggguuggagguuucagggcucguggaauacaggagaagagguucaaguaauagcaguagaaccagguaaaaaucccaaaaauguccaaacaacgccuggaacguucaaaacuccagagggggaagugggagcgauugcucucgacuucaagccagggacuuccggaucuccgauuguuaacagggaagguaaaauaguaggauuguauggcaauggcguaguuacaacuucagggacuuacguuuccgcuauagcccaggcaaaagcuagucaagaaggaccucucccugaaauagaagacgagguuuuuaagaaacgaaacuuaacgauaauggacuuacacccuggaagcggcaaaacacggcgauaucugccagccaucguacgagaagccaucaaacgcaaacuccggacucugauauuagccccaacgagagucguggcuagcgaaauggcugaggcuuuaaagggaaugccaauacgauaucaaacaacagcgguaaagucggaacacacuggacgagaaauaguugaucuaaugugccaugcgaccuucacaaugcgacuucuaucaccaguuagaguuccuaauuacaauaugauuauuauggaugaagcacauuucacagauccagcaagcauugcagcucggggguauauuucaacaagagucgguaugggagaggcggcggcaauauucaugacggcuacuccaccuggaagugucgaagccuucccgcaaucuaacgccguaauccaagacgaagaacgagauauacccgagcgaucguggaacucagguuaugauuggauaacagacuuccccgguaaaacugugugguucguacccagcauuaaaucgggaaaugauaucgcaaauuguuuaaggaaaaaugguaaacgaguaauacaacugagccgcaaaacuuuugauacggaauaccagaaaaccaaaaauaacgauugggacuauguagugacaacggacauaucugagaugggggcgaacuuuagagcggaccgcguuauagauccaaggcguugcuuaaaaccuguaauacuuaaagauggcccagaacgaguaauauuagcgggacccaugccaguaaccguagcgagugcugcacaacgucguggacgaauuggccgaaaccaaaacaaagaaggugaccaauacguguacaugggccagccauugaacaaugacgaggaccaugcucacuggacagaagcaaagaugcuucuagacaauauuaauaccccggaaggcauuauacccgcgcuauuugagccggaacgagaaaaauccgcagcuauugauggugaauaccgauuaagaggagaagcaagaaaaaccuuuguggaauuaaugcggagaggggacuuaccagucuggcuaucauacaaaguugccuccgaaggcuuucaguacuccgaccgacguugguguuucgacggcgaaagaaacaaucaaguucuagaagaaaauauggauguagaaauauggaccaaagaaggagaaaggaagaaauuaaggccaagguggcuggaugcccgcacuuauucugacccguuagcacuaagggaguuuaaggaauuugccgcaggucggagaucaguaucaggggaccuaauauuagaaaucggaaaauuaccccaacaucucacuuuaagagcacaaaacgcauuagauaauuuagucaugcuacauaauuccgaacaaggagguaaggcauaucgucacgcaauggaggaacuacccgauacaauugaaaccuuaaugcuacucgcucuaauugccguuuuaacgggugguguuacccuauucuuuuugagugguaagggauuaggaaaaaccucuauagggcuccucuguguaacagcaucaucugcuuuauuauggauggcaucaguggagccgcauuggaucgcugcaucgauaauccucgaguucuuucugaugguucuuuuaauaccagaaccagaucgucaacgaacuccccaggacaaucaacuugcauacgugguuauugggcuccuauucaugauacuaacuguugcugcgaacgaaaugggguuacuagaaacuaccaagaaggauuuggguauaggacauguggcggcugaaaaucaucaacaugcuaccaugcuugauguagacuuacgucccgcaucggcguggacuuuauacgcuguagcaacaacgguuauaacaccuaugaugcgacacaccauagaaaauaccacagcaaauauuucacuaacagccauugcaaaucaagcagcuauauuaaugggucucgauaagggauggccaauuagcaaaauggauauaggaguaccccuccuggccuuaggauguuauucacaaguaaauccacuaacuuuaacagcagcaguacuaauguuagucgcacacuaugcaauaauaggaccaggucuccaggcaaaagcaacgagagaggcucaaaagcgaacagcggccggaaucaugaaaaacccaaccguagauggaaucguugcuauagacuuagauccaguggucuaugaugcgaaguucgaaaaacaauuaggacaaauaauguugcuaauuuuauguacuagccaaauacuccucaugaggacaacuugggcguuaugugaaucaauaacauuagcaacaggaccacuuacaaccuuaugggagggauccccuggaaaauucuggaauacuacaaucgcaguaagcaugacuaauauauuucgagguucuuauuuagcaggagcaggacuugcauuuucucugaugaaaagccuaggaggcggccggcgaggcacuggagcucaaggagaaacuuuaggagaaaaauggaaaagacaauuaaaucaguuaagcaaaucagaauuuaauacuuauaaaagaucgggaauuauggaaguggaucgcagcgaagcaaaggaagguuuaaagcgaggcgaaacaaccaaacacgcaguaagccggggcacagccaaacugagaugguucguugaacgaaacuuaguuaaaccugaaggaaaaguaauugacuuagguugugggcgaggcggauggagcuacuacugcgcgggucuaaagaaaguaacugaagugaaggguuauacuaaaggagguccuggucaugaagaaccgauuccuauggcuacauacggguggaacuuaguaaaacuacacagcgggaaagacguguucuuuaugccuccagaaaaaugugauacucuauuaugugacauuggcgagagcucgccgaauccuacgauagaagaaggacgcacacuaagaguuuuaaaaaugguagagccuuggcuuagagggaaucaguuuuguauuaaaauauuaaacccauauaugccauccguaguugaaacguuagaacaaaugcaacguaagcacggagggauguuaguuagaaauccgcucagucgaaacaguacucacgagauguauugggucaguuguggaacagggaauauuguuagugcaguaaacaugacuagcaggaugcuacuaaauagauuuacaauggcucacagaaaaccaacguaugaaagggacguggaucucggcgcaggcacuaggcauguagcaguggagcccgaggucgcgaauuuggauauaauagggcaaagaaucgagaauaucaagaaugagcacaaaucuacauggcacuaugaugaagauaacccuuauaaaacgugggcauaccacgguaguuaugaagucaaaccuucuggaagugcuaguuccauggugaacggcgugguacguuuauuaacaaaaccaugggaugugauucccauggugacucaaauugcaaugacggauacuacaccauuuggacagcagaggguuuuuaaagaaaaaguagauacgcguacuccucgugcuaaaagaggaaccacacagauuauggaagugacagcgaaauggcuauggggcuuccuaucgcggaauaagaaaccucgaauuuguacacgagaagaauuuacaagaaagguaagaaguaacgcagcaauuggugcuguauuuguagaugaaaaccaguggaacucagcuaaggaagcuguggaagacgaaagauuuugggaccuaguacauagggaaagggagcuacacaaacaaggaaaaugcgcgacauguguuuauaauaugauggggaaacgggagaagaaacuaggugaauuugggaaggccaaaggaucgcgcgcaauuugguauauguggcuaggcgcaagauuccuagaguuugaggcuuuagguuucaugaaugaagaucacugguuuagucgagaaaauuccuuaaguggagucgaaggagaaggacuucauaaauugggauauauacugcgugauaucagcaaaauucccggcgggaacauguaugcggaugauaccgcaggaugggauacaagaauuacagaagacgauuuacagaacgaagcaaagauaacggauauuauggaacccgaacaugcacuucuugcuaccaguauauucaaacuuacauaucaaaacaagguagugagaguacaaaggcccgcuaaaaauggaaccguuauggacguaauauccagacgagaccaacgagguucaggacaagugggcacguauggguuaaacacguucacgaauauggaagugcaauugauaagauuaauggagucugaggguauuuucuuacccagcgaacucgaaacuccuaauuuggccgaacgaguccuggauugguuggaaaagcauggcgccgaacgauuaaaacgaauggcaaucaguggagaugacugcguuguuaagcccauagaugaccgauucgcuacugcauuaaccgcacugaaugacauggguaaaguaagaaaggauauaccacaaugggagcccucaaagggauggaaugauuggcagcaagugccauucuguagccaccauuuucaucaacuuauaaugaaggacggaagagaaauagugguuccgugucgaaaucaagacgaauuaguagguagagcuaggguaucccaaggggcugguuggagcuuaagagaaacggcguguuugggaaagucguacgcucagauguggcaacugauguacuuccauagacgcgaccuccggcucgcggcaaaugcgauaugcucugcaguaccgguagacuggguaccgacgucuagaacaacauggucuauacaugcucaccaccaauggaugacuaccgaagauauguuaagcguauggaaucguguguggaucgaagaaaacccauggauggaagauaaaacccauguuuccucgugggaggaagugccauauuuggggaaacgagaagaucaguggugcggaucccuaauugggcuaacagcucgagcaacaugggcuacuaacauucaaguggcuaucaaucagguccggcguuuaauaggaaaugagaacuauuuagacuacaugacuuccaugaaaagauuuaaaucagagucugacccugaaggugccuuaugguaa

SEQ ID NO: 21311 - RNA, 9879 nt, Artificial Sequence
  derived and/or modified CDS sequence (opt6) from DENV-1__FJ850113__SS-prME
ucaguuacuaugcuucuaauguuauuaccuacugcauuagcuuuccauuugacuacccgaggaggagaaccacauaugauaguauccaaacaagaacgagguaaauccuuacuguucaaaacuucagcgggcgucaauaugugcacuuuaauagcaauggaucuaggugaacuuugugaagauacuaugacuuacaaaugcccacagauaacagaagcagaaccugaugauguugacugcuggugcaacgcuaccgauacgugggugaccuaugggacuuguucacaaacuggggaacauaggagggauaaacguucuguugcauuggcaccucauguaggacugggguuggaaacuaggacugaaacuuggaugagcuccgaaggugcuuggaaacaaauucaacgaguagagacaugggcauuacgccacccaggguuuacaguaauugcacuauuuuuggcucacgcaaucgggacgagcauuacacaaaaaggaaucauauuuauauugcuuaugcuagucacuccuagcauggcaaugaggugcgucgggauugguaaucgugacuucgucgaaggacuaucuggggcaacauggguagacgugguauuagagcaugguaguugcguaacuacuauggccaaaaauaaaccaacacuagacauagaauuacuaaaaacagaaguaacaaauccagcuauauuaagaaaacuauguauagaagcaaagauaucaaacacgacaacagacucgagguguccgacgcagggugaagcgacuuuaguggaggaacaagaugccaauuuuguuugcagacguacauucguagacagagguugggggaauggaugcggccucuucggaaaaggaucauuacucacaugugccaaauuuaaauguguuacaaaacuagagggaaagauaguccaauaugaaaauuuaaaauauucuguaauaguaacaguucacacuggugaucaacaucaagucggaaacgaaacaacggagcauggaacaauugcgacuaucacaccccaagcacccaccagcgagauacaguuaacugacuauggugccuuaacauuagauugcuccccuagaacugguuuagacuuuaaugaaaugguauuauuaacuaugaaagaaaaaucauggcuuguacacaaacagugguucuuggaccuuccccuuccauggacuucaggagccaguacaucccaggaaaccuggaaccgacaagaccuauuaguaacuuuuaagacggcccacgcaaagaaacaggagguaguaguauuaggaucacaggagggugcuaugcauacagcacucacaggcgccacggaaauacagacaucgggcacuacaacuauauucgcaggucaucuuaaaugcagacuuaaaauggauaaacuuacucuuaaaggaacaagcuaugugaugugcacuggcuccuucaaacuugagaaggaggucgccgagacucagcacggaacugucuuagugcaagugaaauacgaagguacagaugcuccuuguaaaauuccauuuuccacacaagacgaaaaagguguuacucaaaauggaaggcuuauaacagcaaacccaaucgugacugacaaggaaaaaccugucaacauagagacggagcccccauuuggcgagucauauauaguaguaggagcuggugaaaaagcccuaaaacuaucuugguuuaagaaagguucuucaaucgguaaaauguuugaggccacugcacgcggagcgcguagaauggcuauuuuaggugacacugcuugggacuuugguucaaucggaggaguauucacauccguugggaaacugguucaucaaguauuugggacagcauacgguguuuuguucucaggaguuaguuggacgaugaaaauaggcauagguaucuuguuaacuuggcuuggccuuaacuccaggucgacaucacuaucaaugacaugcauugcugugggaaugguuacauuguaucuagguguuaugguacaagcagacagcggaugcguuauaaauuggaaagggcgugaauugaaauguggaagcggaauauuuguaaccaacgaaguucauacauggacggaacaauacaaguuucaggcugauucaccgaaaagacuuagugccgccauaggcaaagccugggaagagggaguaugugggauaaggucagcgacacgguuagaaaauauaauguggaaacagaucucgaaugaauuaaaccauauauuauuagaaaaugauaugaaauucacgguuguaguaggagaugcgaauggcauucuagcacaagggaagaaaaugauccgaccacaacccauggaacauaaauacaguuggaagucuugggggaaagcgaaaaucaucggugcagauauacaaaauacgaccuuuauuauagaugguccggacacgcccgaauguccagacaaccagagggcguggaauauaugggaaguagaggacuauggcuuugggauauuuacuacaaauauuuggcuaaaauuaagagacucguacacccaaaugugugaucaucgacugaugagugcagcgauuaaggacagcaaagcaguacacgcugacauggguuacuggauagaaagugaaaagaaugaaacuuggaaacuagcucgcgcgucguucaucgaagucaaaaccuguacauggccaaagucacacaccuuguggucaaacggaguucuugaaucggagaugauaauaccgaaaauauauggcggacccaucucucaacacaauuauagaccugguuacuuuacccaaacagcagggccauggcauuuggguaaauuagaauuggacuucgaucuaugugaagguacaacaguaguaguugaugaacauuguggaaacagagguccaucacugcguacaacaacgguuacugguaaaauaauucaugaauggugcuguagaucuugcacauuaccaccacuucguuuucguggagaagaugguugcugguaugggauggaaaucaggccagucaaagagaaagaggagaaucuaguaagaucaaugguauccgcagguagcggagaaguagacucuuuuagucuaggaauuuuaugcgcaagcauaaugauagaagaagucaugagaaguagguggucacgcaagaugcuaaugacagggacucuggcagucuuucuauuacugauaaugggucaauuaacuuggaaugacuugauucgacuguguauuauggucggcgcaaaugcuucggauagaaugggaaugggcacuacauauuuagcauugauggcaaccuucaaaaugaggccuauguuugcuguagguuuauuauuucggcgguuaacaagucgcgaaguauuguuauugacaauuggacugucucuaguugcgucagucgaauuaccaaacagcuuagaggaauugggagauggacuagcgaugggaauaaugaugcugaaacugcuuacugaguuccaaccacaucaacuauggaccacucuccuaagucugacauuuauaaaaacuacuuuaucacucgauuacgcuuggaagacaacugccaugguucuuucuauagucucauuauuuccacuaugcuuaucaacuacaucucagaaaacuacuuggcuuccaguacugcucggauccuuugguuguaagccccuaaccauguuuuuaauaacugaaaauaaaauuuggggaagaaaaucguggcccuuaaacgaaggaauaauggccauagggauugucuccaucuuauugucgucauuacucaaaaaugaugugccguuggcaggaccccucauagcuggaggaauguugaucgcaugcuaugugauaagcggaucaagcgcagaucuaucacuugagaaagcggcagaaguaaguugggaacaagaggccgaacacucgggaacaagucauaacauucuagucgaaguacaagaugauggaacgaugaaaauaaaagacgaagaacgugaugacacccuaacaaucuuacuaaaagcaacguuacuugcaguuuccgggguauauccaaugaguaucccugcgacucucuuuguaugguacuucuggcaaaagaagaaacaaagaucuggaguauugugggauacccccaguccuccugaaguagaacgagcagugcuugaugaugggauuuacaggauucuccaaagaggacugcuugggcgaagucaagugggagugggaguuuuucaagacggaguauuucauacuauguggcauguuacaaggggagccgucuugauguaccaaggcaaaagacuugaaccaucuugggcuaguguuaagaaagaucuaauuucuuaugguggaggguggcguuuccaagguuccuggaacacaggagaggaaguucagguuauagcaguagagccaggcaaaaaccccaaaaacguacaaacaacuccaggaacauuuaaaacaccugaaggugagguaggcgcgauagcacuggacuucaaaccgggcacaagcggaucaccaauaguaaauagagaggggaaaaucgugggcuuguauggaaacggcgucguaacaacaucugguacauauguaagugcaauagcucaggcuaaagcaucccaggaaggucccuugcccgagauugaagaugaaguuuucaagaaacgaaauuuaacuauuauggaucuacacccuggaucagggaagacucgucguuauuuaccagcaaucguaagggaagcaaucaaacgcaaacuacgcacacuuauauuagcgccuacaagagucguagcaagugagauggcugaggcacuaaaggggaugccaauacgguaccaaaccaccgcuguaaaaucagaacacacuggcagagaaaucguagaucuuaugugucacgcgaccuuuacuaugagacugcucucaccagugagaguaccuaacuauaauaugauuauaauggaugaagcucauuucacagauccugcaucuauagcagcucgaggguauauuaguaccagaguuggaaugggagaggcugccgcuauuuuuaugacagcgacgccgcccggaagcguagaggcauuuccucaaucuaaugcugucauacaagacgaggagagagauauaccagaacggagcuggaacucaggcuaugauuggauuacugacuuuccaggaaagacugucugguucgucccaucaaucaaauccgggaacgauaucgcuaauugccuacggaaaaacgggaaaagaguuauacaauugagcagaaaaaccuuugauaccgaauaccagaagacuaaaaauaaugauugggauuauguaguaaccacggauauaucugaaaugggggcuaauuuuagagcagaccgaguuauugauccaagaagaugucuaaaaccaguuauacuaaaggauggaccugaaagagucaucuuagcuggaccaaugccaguuacaguagcaucugcggcucaacggagagguagaauaggucgaaaucaaaauaaagagggugaucaauacguguacaugggacaaccauuaaauaacgaugaggaucaugcacauuggacugaagcaaaaauguuguuagauaauauaaacacaccggaggguauaauuccagcacuguucgaaccggaacgagaaaaaucagcugcuauagauggagaauauagguuaagaggagaagccagaaaaacuuucguugagcuaaugagacguggagacuugccaguaugguuaagcuauaagguggcaagcgaaggauuucaauauucagacagacguuggugcuuugauggugaacgcaauaaccaggugcuagaagagaacauggauguagaaauuuggacuaaggaaggugagaggaagaaacuacgacccaggugguuagaugcgagaacuuauucagacccacuagcauugcgugaauuuaaagaauuugcggcgggccgccgcaguguaucaggugacuuaauccuggaaauuggcaaacucccacagcaccugacacuacgcgcgcaaaacgcgcuagacaaucuggucauguuacauaacucagagcaaggggguaaagccuaucgccacgccauggaagaacuaccagacaccauugaaacuuuaaugcuacuagccuuaauugcgguucuaacuggaggcguaacuuuauucuuucuaucuggaaagggacuaggaaagacuucaaucgguuuacuguguguuaccgcaagcucagcgcuuuuguggauggcaaguguagagccucauuggauugcagccucuauaauauuagaauuuuucuugauggucuuauugauucccgagcccgaucgucagagaacuccgcaagacaaccaguuagcguacguagugauuggucuauuguucaugauauugacgguagccgcaaaugaaaugggguugcuugagacaaccaagaaagauuuggggauagggcacguugcagcagaaaaccaccaacaugcuacuaugcuugacguugaucugcgcccggcaagugcuuggacacuauaugcagucgccacaacaguuauaacgccaaugaugagacacacuauagaaaauacaacagccaauauaagccugacagccauagcaaaucaagcagccauauugaugggcuuagauaaaggauggccuauaaguaaaauggauauuggggugccacuucucgcacuugguugcuacucucaagugaacccccuaacguuaacggccgccguucuuauguuaguagcacauuacgcaauuauagguccugguuuacaagcaaaagcuacccgagaagcucaaaaacgaaccgcugcgggcauaaugaaaaacccaacgguugauggaaucguugcgaucgaccuggacccugucguauaugacgccaaauuugaaaaacaacuaggacaaauaaugcuuuuaaucuuaugcaccucacaaauuuuauuaaugcggacuaccugggcacuuugcgaaaguauuacauuagccacggguccucugacaacacuaugggaagguucaccagguaaauucuggaacacaacaauugcggucucuauggcuaacauauucagggggaguuacuuagcaggggcaggccuagcauuuagucuaaugaagucuuuagguggagggcgaagaggaaccggggcucaaggagaaacgcuuggagaaaaauggaaaaggcaauuaaaucaacuuucgaaaagcgaauuuaauacuuauaaaagaaguggaauaauggaaguagaccgcagugaggcaaaggaaggauuaaaaagaggagaaacgacuaagcacgcggugucgaggggaacugcuaaauuaagaugguuuguggaaagaaacuuaguuaaaccggaaggaaaggugauagauuuagguugugguagaggaggauggucauacuauugcgcuggacuaaagaaaguaacugaaguuaaaggauacacaaaagguggaccaggacaugaagaaccaaucccuauggccacauacggauggaacuuggucaaauugcauagugguaaagacgucuucuuuaugccaccugaaaaaugcgauacacugcuuugugauaucggugaaaguuccccuaaucccaccauagaagaaggccguacacuacguguauuaaaaaugguagaaccaugguugagagguaaccaauuuugcauuaaaauucucaauccuuacaugccguccguuguagaaacccuggaacaaaugcagagaaaacacgggggaauguuagugcguaacccuuuaagccggaacagcacacaugagauguauuggguauccugcgggacagggaauauaguuagugcaguaaacaugacaagcagaaugcuacuuaaucgauucaccauggcgcaucgaaaacccacuuaugaaagagauguagauuugggugcgggcacaagacacguugcuguagaacccgaggucgcgaauuuggacaucauagggcaacguauagaaaauaucaaaaaugaacauaagaguaccuggcacuacgaugaagauaauccuuauaaaacaugggcauaccacggguccuaugaaguuaaaccaucugggucagcgaguucgauggucaacggaguugugagacuauuaaccaagccaugggaugugauucccaugguaacacaaauagccaugacagacacuacuccauucggucaacagagaguguuuaaagagaaaguagauacuagaaccccaagagcgaaacgaggaacaacucaaauaauggaggugacggcaaaauggcuauggggcuuucuaagucggaauaagaaacccagaauaugcacgagagaagaguucacaagaaaaguaagaucaaaugccgccauaggagcuguuuuugucgacgaaaaucaguggaauagugcgaaagaagcaguugaagaugagcguuuuugggaucuaguacauagagagcgugaacugcauaaacaaggaaaaugugcaacuugcguauauaacaugaugggaaaacgagagaagaaauuaggugaguucggaaaagcuaaaggaagccgagcaauuugguauaugugguuaggggcacguuuucuugaguucgaggcucucggauuuaugaacgaagaccauugguuuucccgagaaaauagucuaagugggguagaaggagaaggacuacauaaacuagguuacauacugagagauauuuccaagauccccggagggaacauguacgcagacgauacagccggaugggacacacguauaacagaggaugaucuucagaaugaggcgaaaauuacagacaucauggaaccagagcaugcacuguuagcuacgucgauauuuaaacuaacauaucaaaacaaaguaguuaggguacaaaggccagcgaaaaauggaacagucauggaugucauuagcaggcgagaucaaagaggaucaggacagguuggcacguauggucuaaacacuuuuaccaauauggaaguacaauugauucgacuuauggaaucugaaggcauauucuuacccucggagcuagaaacgccaaaccuagccgagagaguuuuggauugguuagaaaagcacggcgcugaacgcuugaaaagaauggccaucucgggggaugauuguguugucaagccaauagaugaccgguucgcuacagcucuuacagcucuaaaugacaugggaaaaguaagaaaggauaucccucaaugggaacccucaaaaggauggaacgacuggcaacaagugccauucugcagccaccauuuucaccaacucauaaugaaagaugguagggagauugucguaccaugucgcaaucaagacgaacuuguaggaagggcaagagugagccagggugcgggcuggucuuuacgagaaacugcaugucuuggaaagucauaugcacaaauguggcaauuaauguauuuucauaggcgagaucuaagacuagcggcaaaugcuaucugcagcgcgguaccaguagacuggguaccaacuucgcgaacuacuuggucgauucacgcccaucaucaguggaugacaacugaggacauguugucaguuuggaaucgcgucuggauagaagaaaacccguggauggaagacaaaacgcauguaucuagcugggaggagguaccauaucuaggcaaaagagaggaucaauggugugggagcuuaauaggccuuacggcgagagcgaccugggcuacaaacauacaagucgcuauaaaucaggucaggcgccuaauaggaaacgaaaacuacuuggacuacaugaccuccaugaaaagauuuaaaagugaaagcgauccagaaggagcgcucugguaa

SEQ ID NO: 21312 - RNA, 9879 nt, Artificial Sequence
  derived and/or modified CDS sequence (opt6) from DENV-1__JF937635__SS-prME
ucgguaacuauguuauuaauguuaaugcccacugcucuugcuuuccauuuaacuacccguggaggagaaccacauaugauagucaguaaacacgaaagaggaaaagcgcuuuuauuuaaaaccaguacuggagucaacauguguacauuaauugcaauggauuugggagaauuaugcgaagacacuaugacguauaaaugcccgaggauuacagaagcugagccugacgacgucgacuguuggugcaaugccacugauacuuggguaacguacgguacauguucucaaacaggggaacauaggagagauaaaaggaguguugcgcuugcuccacauguaggacuaggacuugaaacgagaacugaaacauggaugucuagugaaggggcuuggaaacaaauacaacgaguagagacaugggcucugcgccaucccggauucacggugauagcccuuuuucuugcacaugccauaggaacaucaauuacccaaaaaggcauaauuuuuauucuauugauguuggugacuccauccauggcaaugagauguguggggauuggaaauagagauuuuguugaaggauugucaggagcgaccugggucgaugucguguuagaacaugguucaugcgucacaacuauggccaaaaacaaacccacacuagacauagaauugcuuaaaacagaggucacaaauccugcaguacuccgaaaacuaugcauagaggcuaaaauaucaaauacaacaacagacagcagauguccaacacaaggcgaagcuacuuugguugaggaacaagaugccaacuucguuugcagacguacuuuuguagauagaggguggggcaacgguuguggccuauucggaaagggaucccuuuuaacaugugcaaaguuuaaauguguuacaaaauuagaagggaaaaucguacaauacgaaaauuuaaaauacucgguuauuguaaccguacauacaggugaucaacaucaaguagggaaugaaacaacagaacacggaacaauugcuacgaucacaccccaagcacccaccagugaaauacaacuaacagacuacggugcacuuacacuagacugcucaccucggacaggauuagauuuuaaugagaugguauugcuaacaaugaaggaaaaauccuggcuaguacauaaacaaugguuuuuagauuuaccauuaccauggacgucuggugccucuacgagucaggaaacauggaauagacaagauuugcucguuaccuucaaaacugcacaugcuaagaaacaagaaguaguaguauuaggcagucaagaaggagcgaugcacacagccuuaacaggugcaacugaaauacagacuagcggaacuacaacaaucuucgcuggacaucuaaaauguagauuaaaaauggauaaauuaacauugaaaggaacaucauacguuauguguacagggucauucaaacucgagaaggaaguagcggaaacacaacacggaacggugcugguacagguaaaauacgaggggacagacgcucccugcaaaauuccguucaguacacaagaugaaaagggagucacacaaaaugggcgauuaauuacugcuaacccgauuguaacagacaaagaaaagccuguaaauauagagaccgaaccaccguucggcgaaucauauaucguuguaggcgcgggagaaaaagcauugaaacuuucuugguuuaagaaaggaagcaguauagggaaaauguuugaagcuacagcuaggggagcuagaagaauggcaauucucggagauacggcgugggauuucggcuccauuggagguguuuuuaccucaguugguaaacuuguacaccagguauuugguacagcauauggaguuuuauuuucugggguaaguuggacgaugaaaauagguaucgguauacucuugacauggcucggacuaaauagucgaaguacaucacuuaguaugacaugcaucgccgucgggauggugacccuuuaccuggguguuaugguacaggcagauagcggaugcgugauaaauuggaaaggaagagaauugaaaugcgggucaggaauauuugucacaaacgagguacacacuuggaccgaacaguacaaauuccaagcugacucccccaaaagacuuucugcagcuauagggaaagcgugggaagaaggcguauguggaauacgaagugccacgcgauuagagaauauuauguggaaacagauaagcaaugaacucaaucauauauuauuggaaaacgauaugaaauuuacuguagugguaggcgacgcaaacgggauucucgcacaaggcaagaaaaugauuagaccacaaccuauggaacacaaauauagcuggaaaagcuggggaaaggcaaaaaucauaggagccgacauucaaaauacaacguucauuauugauggaccggauacuccagaaugccccgaugaccagcgggcauggaauaucugggagguagaagacuacggauuuggcaucuuuacaacaaacaucugguuaaaacucagggacagcuauacucaaaugugugaucacagacuaaugucagccgcaauaaaagauaguaaagcggugcaugcggacaugggguacuggaucgaaucagaaaagaaugagaccuggaaacucgcucgcgcaucauucauagaagucaaaacauguacauggccaaaaucccacacacuauggucaaauggaguuuuagaaagugaaaugauuauaccaaaaauauacggcggucccauuucacaacacaauuacagaccuggauauuuuacgcaaaccgccggcccauggcacuuggguaaauuggaguuagauuuugaccucugugaagguacaacuguuguaguggaugagcauugcgguaauagaggaccaucguuacgaaccacaaccguaaccggaaaaauuauacaugaguggugcuguagauccuguacuuugccuccguuacgauuucgaggggaggacggauguugguacggaauggaaauccgaccaguuaaagagaaagaagaaaacuuagucagaaguaugguaagcgcaggcucgggagaaguugauucguucagccuaggcaucuuauguguaucaaucaugauagaagaaguaaugagaucacgguggucaagaaaaauguuaaugacuggaacucuugcgguauuccuauuguuaauaauggggcagcucacuuggaaugauuuaauacgauuauguauaaugguaggugcaaaugcuagugauagaauggguauggggacaacguaucuggcuuuaauggcuacuuuuaagaugcggcccauguucgcgguuggaaucuuguucagacgacuaaccaguagagaaguacuuuuguuaacgauugguuuaagucuugucgccucaguagaauugccuaauagccucgaagaacugggugacggcuuggccauggguauaaugaugcuuaaauuauuaacagaauuucaaccacaucaacuauggaccacguuauugagccugacauuuaucaaaacuacacuuucucuagauuaugcauggaaaaccacggccauggcgcucaguaucguuagcuuauuuccucucugcuuaucaacuacaagccagaaaacaaccuggcugccaguauuacugggaucuuucggcuguaagccgcuuacaauguuccugauuacagaaaauaaaauaugggguagaaaaaguuggccgaucaaugaaggaaucauggcuauagguaucgucaguauauuacucuccaguuugcucaaaaaugaugucccucucgcagggccacuuauagcagggggaaugcuaauagccuguuacguaauuucaggcucaagugcagacuuaucacuugaaaaagcggcagaggucaguugggaacaggaagcagagcacucaggcacaucacauaauauucuugucgagguacaagacgaugguacgaugcgcauuaaggaugaggagaaagacgacacauugacaauauuacugaaagcuacgcuacuugcaguaagcggaguuuauccgaugucuauaccagcaacucuuuuuguuugguacuucuggcaaaagaagaaacaaagaucaggaguucuuugggauacaccuuccccaccagaaguagaaagggcaguacuagacgaugguauuuaucguauucuacaacgaggucuucuagguagaucacaaguaggaguaggaguauuucaagaugggguauuucacacuauguggcaugugacacgaggagcaguuuuaauguaucaaggaaagcggcuagaacccucgugggccuccgugaagaaggaucugauaucauaugguggcgguuggagauuccaagguucuuggaauacaggagaagaagugcagguaauugcaguggaaccgggaaagaauccgaaaaauguccaaacaacacccgggacuuuuaaaaccucggaaggagaggucggagccauugccuuggacuuuaaaccgggcacaucaggaucaccaaucgucaaucgagaaggcaaaaucgucggccuuuacggaaacgguguuguaaccacaagugguacuuacguaucagcgauagcucaagccaaaacaucucaagagggaccuccuccagaaaucgaggaugaaguuuucaagaagagaaacuuaacuauaauggaucuucauccggguagugggaagacacgccguuaucucccagccauaguccgggaagcuauuaagagaaaacugaggacacuuaucuuggcaccaacaaggguagucgcgucggaaauggcggaggcauugaaaggcaugcccauacgauaccagaccacugcaguaaaaagugaacauacuggaagggaaauuguagaucucaugugucacgcaacauuuacuaugagguugcuaaguccugugagagugccaaauuauaacaugaucauaauggacgaagcacauuucacagauccagcuucaauugcugcaaggggguauauuaguacacgcgugggcaugggagaagcugcagcaaucuucaugacggcaacaccuccaggaucaguagaggccuucccgcaguccaaugcaguaauacaagaugaggaaagagauauaccagaacgaucauggaauagugguuaugauuggauaacagacuuuccagguaagacggugugguuugucccuucaauaaaaagugguaaugauaucgcgaauugucuuaggaaaaaugggaaacggguaauacagcuuaguagaaaaaccuuugauacggaauaccaaaagaccaaaaacaacgauugggacuauguagugacuaccgauauuagugaaaugggugcuaacuuucgcgcagaucgaguuauagacccaaggagauguuuaaagccuguaauacugaaggacggaccggagcggguaauauuggccggacccaugccgguuacugucgcuagcgcagcccagaggcgugguagaauugggaggaaccagaacaaagaaggagaccaauauguuuauaugggacaaccacuuaauaacgacgaagaucacgcacauuggacagaggcaaaaauguuauuggacaauauaaacacaccugaaggcauaauaccggcuuuauuugaaccggaacgagaaaaauccgcggcaaucgauggagaguaccgcuugcguggugaagcaaggaaaacauucguugaauugaugagaagaggcgaucuaccaguaugguuaucguauaaaguugcaucagaaggauuccaauauagugauagacgaugguguuuugauggagaaagaaauaaccagguuuuagaagaaaauauggauguagaaauauggacaaaagaaggggaaagaaagaaguuacgaccucgcuggcuugacgccagaacauauagugauccucuugcauuaagggaauuuaaagaauuugcugccggaaggaggucgguuucgggagaucuaaucuuggaaauuggcaaacuuccucaacacuuaacuuuaagagcgcaaaaugcuuuggacaauuuaguaauguuacacaauucagagcaaggagguaaagcguaccggcaugcaauggaggagcucccagacacaauugaaacccucauguuacucgccuugauagcagucuuaacaggcgguguuacuuuauuuuucuuguccggaaaaggauuaggaaagacaucuaucggacuacucuguguaacagccucgucagcucucuuauggauggccagcguugaaccccauuggauagcagcuaguaucauccuagaauuuuucuuaaugguauuguuaauaccagaaccagauagacaaagaacgccucaagauaaccaacuagcuuauguaguuauaggguuauuauuuaugauuuugacuguagcggcaaacgagaugggacuauuggaaaccacaaaaagagauuuaggaaucggucacguugccgcagaaaaccaccagcaugccacaaugcuggauguagaucuaagaccugccagcgcauggacccuauacgcaguagcaacuacggucauaacaccuaugaugagacauacuaucgaaaauacaacagcgaauauauccuuaaccgcuauagcuaaucaagcagcaaucuuaauggggcuugauaagggauggccgauaaguaaaauggauauaggagucccauuacuugcauuagguuguuacucucagguaaaccccuugacacuaacggcagcuguucugaugcuaguugcucacuaugcaauuauaggucccggccuucaagcuaaagcaacacgugaagcucagaaaagaacugccgcaggaauaaugaaaaauccgacuguagaugguauuguagccauugaucuagaucccguaguguaugaugccaaguucgaaaaacaauuaggacaaauaaugcuacuuauauugugcacaucccaaauuuuauuaaugcgaacaacaugggcauuaugugaaagcaucacgcuugcaacaggaccacuuacaacucuaugggaaggaagcccaggaaaauuuuggaacacuacuaucgcagugucaauggcaaauauauuucgagguucauauuuggccggagcaggguuggcauucucacucaugaaaucgcuaggaggugggagacgugggacaggggcucaaggggaaacauugggugaaaaauggaaaagacaauuaaaucagcuuagcaaaccagaguucaauacauacaaaaggucaggaauuauggaaguagacagaagugaagcaaaagagggcuuaaaacgcggcgagacaaccaaacaugcuguuucacgaggcacugcaaaacugagaugguuuguugaacguaaucuaguuaaaccagaaggaaaaguuauugauuuaggauguggccgcgguggguggucauauuacugcgcgggacuaaagaaaguaacugaaguaaaaggcuacacaaaagggggcccuggacacgaggaaccaauaccuauggcgacuuacggauggaaccuagugaaauuacauucaggaaaagacgucuucuuuaugccucccgaaaagugcgauacacugcuuugcgauauaggggagagcucaccgaauccaaccauugaagaaggaagaacucuaagaguacuaaaaauggucgaaccuugguuacgugguaaccaguucuguaucaaaauauuaaaucccuauaugccgucuguaguugaaacucuagaacaaaugcagagaaaacauggugguaugcuaguacgaaauccucuuucuaggaauagcacucaugaaauguauuggguuaguugugguacagggaauauaguuagugcuguuaauaugaccagccguaugcuauugaauagguuuacaauggcccauagaaagccaacuuaugaacgcgacguugacuugggagcaggaacaagacauguugcggucgaaccagaaguagcaaaucuagauaucauuggacaaagaaucgaaaauaucaaaaacgaacauaagagcaccuggcauuaugaugaggacaaccccuauaaaacaugggccuaccauggaucauaugagguaaagccuucgggcucagcuaguaguaugguaaacgguguaguccgacuguugacaaagcccugggauguaaucccgaugguuacucaaauugcaaugacagauacuacaccauucggacaacaaagaguuuucaaagagaaagucgacacuaggacgccacgugcgaagagaggcacgacucaaauaauggaggugaccgcuaaguggcuguggggcuuucuaucacguaacaagaaaccgcgaaucugcacuagggaagaauuuacucgaaaaguccgcucaaaugccgcgauaggggcgguuuuuguagacgaaaaucaauggaacucugcaaaagaagcuguagaggacgaaagauuuugggacuuaguacaucgagagcgagaacuucacaagcaaggaaaaugcgcgacauguguuuauaacaugaugggaaaacgggagaagaaauuaggcgaguucggaaaggcaaagggaagucgugcaaucugguauaugugguuaggagcaagauuuuuagaguuugaggcccuaggcuuuaugaaugaagaccacugguuuucaagggagaauagccuaagcggaguugaaggugaagguuuacauaaguugggauauauuuugagagacaucucaaaaauacccggugggaauauguacgcagaugauacagcagguugggauacuagaauaacagaagacgaccuccaaaacgaagccaaaaucacugacauaauggaaccugaacaugcuuuguuagcaacauccauauuuaaacuuacauaucaaaauaaaguagucagaguucaaaggccggccaaaaauggcacagucauggaugucauaagucguagagaccaaaggggaaguggacaagucgguacauacggacuaaauacauuuacaaauauggaaguacaacuuauacgacaaauggagucugaaggaaucuuccuaccuucagaauuagaaacaccgaaucuggcugagaggguacucgacugguuagagaaacacggugcugagagauuaaaacggauggccauuucuggagaugacuguguuguuaaaccuauagaugauagauuugcuacagcacugacugcguuaaaugacauggggaaaguacgcaaagacauuccucaaugggaaccgucaaaaggauggaaugacuggcaacaggugccauucugcucccaccauuuccaucaacucauaaugaaggauggacgagagauuguaguaccgugcagaaaccaagaugagcucguuggacgagcgcgagugucucaaggagcgggauggucuuugcgagaaacugccugccuuggaaaaaguuaugcucaaauguggcaacucauguacuuccaccgacgagauuuaagacuagcagcgaaugcuauuuguucagccgucccaguagauuggguacccacaaguaggacaaccuggaguauucaugcucaucaucaauggaugacaacagaagacauguuaaguguauggaauagggucuggaucgaggagaauccauggauggaagacaaaacucacguuagcaguugggaggaaguaccauaccuagggaagcgagaagaucaguggugcggaucauugauaggacuaacugcucgggcaacaugggccacaaauauacaagucgcaauuaaucaagucaggaggcugauagguaaugaaaacuaucuugacuacaugacaucaaugaaaagguuuaaaaaugaaucagacccggagggagcuuugugguaa
